(12) United States Patent
Porteus et al.

(10) Patent No.: US 12,043,843 B2
(45) Date of Patent: Jul. 23, 2024

(54) MATERIALS AND METHODS FOR TREATMENT OF HEMOGLOBINOPATHIES

(71) Applicant: CRISPR Therapeutics AG, Basel (CH)

(72) Inventors: Matthew Hebden Porteus, Cambridge, MA (US); Melanie Ruth Allen, Cambridge, MA (US); Chad Albert Cowan, Cambridge, MA (US); Ante Sven Lundberg, Cambridge, MA (US); Michelle I-Ching Lin, Cambridge, MA (US); Jeffrey Li, Cambridge, MA (US); Thao Thi Nguyen, Cambridge, MA (US)

(73) Assignee: Vertex Pharmaceuticals Incorporated, Boston, MA (US)

( * ) Notice: Subject to any disclaimer, the term of this patent is extended or adjusted under 35 U.S.C. 154(b) by 400 days.

(21) Appl. No.: 15/762,700

(22) PCT Filed: Nov. 4, 2016

(86) PCT No.: PCT/IB2016/001750
§ 371 (c)(1),
(2) Date: Mar. 23, 2018

(87) PCT Pub. No.: WO2017/077394
PCT Pub. Date: May 11, 2017

(65) Prior Publication Data
US 2018/0273609 A1    Sep. 27, 2018

Related U.S. Application Data

(60) Provisional application No. 62/328,203, filed on Apr. 27, 2016, provisional application No. 62/250,823, filed on Nov. 4, 2015.

(51) Int. Cl.
| | | |
|---|---|---|
| *C12N 15/85* | (2006.01) | |
| *A61P 7/00* | (2006.01) | |
| *C07K 14/805* | (2006.01) | |
| *C12N 9/22* | (2006.01) | |
| *C12N 15/11* | (2006.01) | |
| *C12N 15/90* | (2006.01) | |
| *A61K 48/00* | (2006.01) | |
| *C12N 15/10* | (2006.01) | |
| *C12N 15/113* | (2010.01) | |
| *C12N 15/63* | (2006.01) | |

(52) U.S. Cl.
CPC ............... *C12N 15/85* (2013.01); *A61P 7/00* (2018.01); *C07K 14/805* (2013.01); *C12N 9/22* (2013.01); *C12N 15/11* (2013.01); *C12N 15/907* (2013.01); *A61K 48/00* (2013.01); *C12N 15/102* (2013.01); *C12N 15/113* (2013.01); *C12N 15/63* (2013.01); *C12N 2310/20* (2017.05); *C12N 2800/80* (2013.01)

(58) Field of Classification Search
CPC .......... C12N 15/85; C12N 15/86; C12N 9/22; C12N 2310/20; C07K 14/805
See application file for complete search history.

(56) References Cited

U.S. PATENT DOCUMENTS

| | | |
|---|---|---|
| 8,383,604 B2 | 2/2013 | Orkin et al. |
| 9,738,693 B2 | 8/2017 | Telford et al. |
| 9,840,538 B2 | 12/2017 | Telford et al. |
| 10,738,305 B2 | 8/2020 | Porteus |
| 11,268,077 B2 | 3/2022 | Chakraborty et al. |
| 2014/0085593 A1 | 3/2014 | Feng et al. |
| 2014/0093913 A1 | 4/2014 | Cost et al. |
| 2015/0044772 A1 | 2/2015 | Zhao |
| 2015/0152436 A1* | 6/2015 | Musunuru ................ A61P 7/06 435/462 |
| 2015/0166969 A1 | 6/2015 | Takeuchi et al. |
| 2016/0289675 A1 | 10/2016 | Ryan et al. |
| 2018/0021413 A1 | 1/2018 | Porteus |
| 2018/0030438 A1 | 2/2018 | Porteus et al. |
| 2018/0094033 A1 | 4/2018 | Telford et al. |
| 2018/0112213 A1 | 4/2018 | Welstead et al. |
| 2018/0119140 A1 | 5/2018 | Porteus et al. |
| 2018/0179521 A1 | 6/2018 | Rahdar et al. |
| 2018/0200387 A1 | 7/2018 | Porteus |
| 2019/0256829 A1 | 8/2019 | Chakraborty et al. |
| 2021/0009998 A1 | 1/2021 | Porteus |

(Continued)

FOREIGN PATENT DOCUMENTS

| | | |
|---|---|---|
| CN | 104284669 A | 1/2015 |
| EP | 3262172 A2 | 9/2016 |

(Continued)

OTHER PUBLICATIONS

*Ortho-McNeil Pharms. Inc.* v. *Mylan Labs., Inc.*, 520 F.3d 1358 (Fed. Cir. 2008), (Year: 2008).*
*Eisai Co. Ltd.* v *Dr. Reddy's Labs.*, Ltd 553 F.3d 1352 (Fed. Circ. 2008) (Year: 2008).*
Sankaran et al. N Engl J Med (2011) 365(9):807-814. (Year: 2011).*
Chakalov et al. Blood (2005) 105(5):2154-2160. (Year: 2005).*
International Search Report and Written Opinion mailed Sep. 7, 2016 for International Application No. PCT/IB2016/000276.
International Preliminary Report on Patentability mailed Sep. 8, 2017 for International Application No. PCT/IB2016/000276.
International Search Report and Written Opinion mailed Sep. 7, 2016 for International Application No. PCT/IB2016/000282.

(Continued)

*Primary Examiner* — Marcia S Noble

(57) ABSTRACT

The present application provides materials and methods for treating hemoglobinopathies. More specifically, the application provides methods for producing progenitor cells that are genetically modified via genome editing to increase the production of fetal hemoglobin (HbF), as well as modified progenitor cells (including, for example, CD34$^+$ human hematopoietic stem cells) producing increased levels of HbF, and methods of using such cells for treating hemoglobinopathies such as sickle cell anemia and β-thalassemia.

12 Claims, 15 Drawing Sheets
Specification includes a Sequence Listing.

(56) References Cited

U.S. PATENT DOCUMENTS

| | | | |
|---|---|---|---|
| 2021/0180091 | A1 | 6/2021 | Chakraborty et al. |
| 2021/0317450 | A9 | 10/2021 | Chakraborty et al. |
| 2022/0259578 | A1 | 8/2022 | Chakraborty et al. |

FOREIGN PATENT DOCUMENTS

| | | |
|---|---|---|
| WO | WO 2013/126794 A1 | 8/2013 |
| WO | WO 2013/169398 A2 | 11/2013 |
| WO | WO 2013/176772 A1 | 11/2013 |
| WO | WO 2014/036219 A2 | 3/2014 |
| WO | WO 2014/085593 A1 | 6/2014 |
| WO | WO 2014/093712 A1 | 6/2014 |
| WO | WO 2014/186585 A2 | 11/2014 |
| WO | WO 2014/197748 A2 | 12/2014 |
| WO | WO 2015/006498 A2 | 1/2015 |
| WO | WO 2015/006747 A2 | 1/2015 |
| WO | WO 2015/026885 A1 | 2/2015 |
| WO | WO 2015/113063 A1 | 7/2015 |
| WO | WO 2015/148863 A2 | 10/2015 |
| WO | WO 2015/183026 A1 | 12/2015 |
| WO | WO 2016/135557 A2 | 9/2016 |
| WO | WO 2016/135558 A2 | 9/2016 |
| WO | WO 2016/135559 A2 | 9/2016 |
| WO | WO 2017/077394 A2 | 5/2017 |
| WO | WO 2017/115268 A1 | 7/2017 |
| WO | WO 2017/160890 A1 | 9/2017 |
| WO | WO 2017/182881 A2 | 10/2017 |
| WO | WO 2017/191503 A1 | 11/2017 |
| WO | WO 2018/081470 A1 | 5/2018 |
| WO | WO 2019/081982 A1 | 5/2019 |

OTHER PUBLICATIONS

International Preliminary Report on Patentability mailed Sep. 8, 2017 for International Application No. PCT/IB2016/000282.
International Search Report and Written Opinion mailed Sep. 7, 2016 for International Application No. PCT/IB2016/000286.
International Preliminary Report on Patentability mailed Sep. 8, 2017 for International Application No. PCT/IB2016/000286.
International Search Report and Written Opinion mailed Oct. 20, 2017 for International Application No. PCT/IB2017/000532.
International Preliminary Report on Patentability mailed Nov. 15, 2018 for International Application No. PCT/IB2017/000532.
International Search Report and Written Opinion mailed Apr. 15, 2019 for International Application No. PCT/IB2018/001338.
International Search Report and Written Opinion mailed Jul. 2, 2019 for International Application No. PCT/IB2019/000183.
International Search Report and Written Opinion mailed May 11, 2017 for International Application No. PCT/IB2016/001750.
International Preliminary Report on Patentability mailed May 17, 2018 for International Application No. PCT/IB2016/001750.
[No Author Listed] Endonuclease. Wikipedia. Accessed Aug. 9, 2019. 6 pages.
[No Author Listed] Geneseq Submission; GSN, Database Accession No. GS_NUC_ALERT:WO2016161380.324727. Oct. 6, 2016. 1 page.
Camaschella et al., A New Hereditary Persistence of Fetal Hemoglobin Deletion Has the Breakpoint Within the 3' ?-Globin Gene Enhancer. Blood. 1990;75(4):1000-1005.
Canver et al., BCL11A enhancer dissection by Cas9-mediated in situ saturating mutagenesis. Nature. Nov. 12, 2015;527(7577):192-7.
Canver et al., Customizing the genome as therapy for the beta-hemoglobinopathies. Blood. Apr. 6, 2016;127(21):2536-45.
Chandrakasan et al., Gene Therapy for Hemoglobinopathies: The State of the Field and the Future. Hematol Oncol Clin North Am. Apr. 2014;28(2):1-23.
Cottle et al., Controlled delivery of beta-globin-targeting TALENs and CRISPR/Cas9 into mammalian cells for genome editing using microinjection. Sci Rep. Nov. 12, 2015;5:16031,13pages.

Cradick et al., CRISPR/Cas9 systems targeting ?-globin and CCR5 genes have substantial off-target activity. Nucleic Acids Research. 2013;41(20):9584-9592.
De Montalembert, Management of Sickle Cell Disease. BMJ. Sep. 8, 2008;337:a1397. doi: 10.1136/bmj.a1397.
Dever et al., CRISPR/Cas9 beta-globin gene targeting in human haematopoietic stem cells. Nature. Nov. 17, 2016;539(7629):384-389.
Dipersio et al., Plerixafor and G-CSF versus placebo and G-CSF to mobilize hematopoietic stem cells for autologous stem cell transplantation in patients with multiple myeloma. Blood. Jun. 4, 2009;113(23):5720-6.
Hendel et al., Chemically modified guide RNAs enhance CRISPR-Cas genome editing in human primary cells. Nat Biotechnol. Sep. 2015;33(9):985-89. Author manuscript provided. Available in PMC Sep. 1, 2016, 14 pages. doi: 10.1038/nbt.3290.
Henthorn et al., (A gamma delta beta)0-Thalassaemia in Blacks is due to a deletion of 34 kbp of DNA. British Journal of Haematology. 1985;59(2):343-356.
Howden et al., CRISPR gene editing causes hundreds of unintended, off-target mutations. Cosmos. 2017. 3 pages.
Huang et al., Abstract: Production of Gene-Corrected Adult Beta Globin Protein in Human Erythrocytes Differentiated from Patient iPSCs After Genome Editing of the Sickle Point Mutation. Stem Cells.2015;33(5):3.
Huang et al., Production of Gene-Corrected Adult Beta Globin Protein in Human Erythrocytes Differentiated from Patient iPSCs After Genome Editing of the Sickle Point Mutation. Stem Cells. May 2015;33(5):1470-9. doi: 10.1002/stem.1969.
Joly et al., Identification and molecular characterization of four new large deletions in the ?-globin gene cluster. Blood Cells, Molecules, and Diseases.2009;43:53-57.
Maeder et al., Genome-editing Technologies for Gene and Cell Therapy. Mol Ther. Mar. 2016;24(3):430-446.
Mansilla-Soto et al., Cell and Gene Therapy for the Beta-Thalassemias: Advances and Prospects. Hum Gene Ther. Apr. 2016;27(4):295-304.
Roosjen et al., Transcriptional regulators Myb and BCL11A interplay with DNA methyltransferase 1 in developmental silencing of embryonic and fetal ?-like globin genes. FASEB J. Apr. 2014;28(4):1610-20. Epub Dec. 26, 2013.
Saglio et al., Italian Type of Deletional Hereditary Persistence of Fetal Hemoglobin.Blood. 1986;686(3):646-651.
Sebastiano et al., In Situ Genetic Correction of the Sickle Cell Anemia Mutation in Human Induced Pluripotent Stem Cells Using Engineered Zinc Finger Nucleases. Stem Cells.2011;29:1717-1726.
Sheth et al., Sickle cell disease: time for a closer look at treatment options? BJH. Aug. 2013;162(4):455-64.
Song et al., Improved hematopoietic differentiation efficiency of gene-corrected beta-thalassemia induced pluripotent stem cells by CRISPR/Cas9 system. Stem Cells Dev. May 1, 2015;24(9):1053-65. doi: 10.1089/scd.2014.0347. Epub Feb. 5, 2015.
Suzuki et al., Fetal globin gene repressors as drug targets for molecular therapies to treat the β-globinopathies. Mol Cell Biol. Oct. 1, 2014;34(19):3560-9. Epub Jul. 14, 2014.
Townes et al., Modified IPS Cells for Hemoglobinopathies. Blood. Dec. 2015;126(23):SCI-17.
Traxler et al., Genome Editing Recreates Hereditary Persistence of Fetal Hemoglobin in Primary Human Erythroblasts. Blood. Dec. 3, 2015;126(23):4 pages.
Urnov et al., Genome editing with engineered zinc finger nucleases. Nat Rev Genet. Sep. 2010;11:636-46. doi: 10.1038/nrg2842.
Wartiovaara et al., CRISPR-Cas9 gene editing of CD34+cells to increase fetal hemoglobin (HbF) production. Collaborative Congress of the European-Society-of-Gene-and-Cell-Therapy. Oct. 2015;26.
Xie et al., Seamless gene correction of [beta]-thalassemia mutation in patient-specific iPSCs using CRISPR/Cas9 and piggyBac. Genome Res. Aug. 5, 2014;24(9):1526-1533.
Xu et al., Both TALENs and CRISPR/Cas9 directly target the HBB IVS2-654 (C>T) mutation in [beta]-thalassemia-derived iPSCs. Scientific Reports. Jul. 9, 2015;5(12065):1-12.
Ye et al., Genome editing using CRISPR-Cas9 to create the HPFH genotype in HSPCs: An approach for treating sickle cell disease and

(56) References Cited

OTHER PUBLICATIONS

?-thalassemia. Proc Natl Acad Sci U S A. Sep. 20, 2016;113(38):10661-5. doi: 10.1073/pnas.1612075113. Epub Sep. 6, 2016.
Zhu, Overview of guide RNA design tools for CRISPR-Cas9 genome editing technology. Frontiers in Biology. Aug. 2015;10(4):289-296.
Sun et al., Seamless correction of the sickle cell disease mutation of the HBB gene in human induced pluripotent stem cells using TALENs. Biotechnol Bioeng. May 2014;111(5):1048-53. doi: 10.1002/bit.25018. Epub Aug. 26, 2013.
Thein et al., Control of fetal hemoglobin: new insights emerging from genomics and clinical implications. Hum Mol Genet. Oct. 15, 2009;18(R2):R216-23. doi: 10.1093/hmg/ddp401.
Tuan et al., Different 3' end points of deletions causing delta beta-thalassemia and hereditary persistence of fetal hemoglobin: implications for the control of gamma-globin gene expression in man. Proc Natl Acad Sci U S A. Nov. 1983;80(22):6937-41. doi: 10.1073/pnas.80.22.6937.
Zhang et al., Optimization of genome editing through CRISPR-Cas9 engineering. Bioengineered. Apr. 2016;7(3):166-74. doi: 10.1080/21655979.2016.1189039.
U.S. Appl. No. 16/758,990, filed Apr. 24, 2020, Chakraborty et al.
U.S. Appl. No. 17/585,365, filed Jan. 26, 2022, Chakraborty et al.

\* cited by examiner

Figure 1A
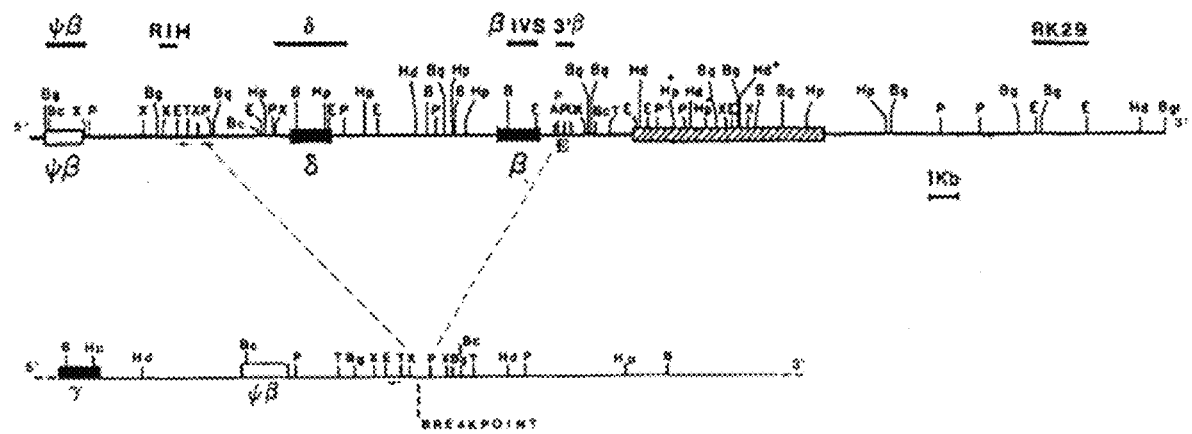
Figure 1B
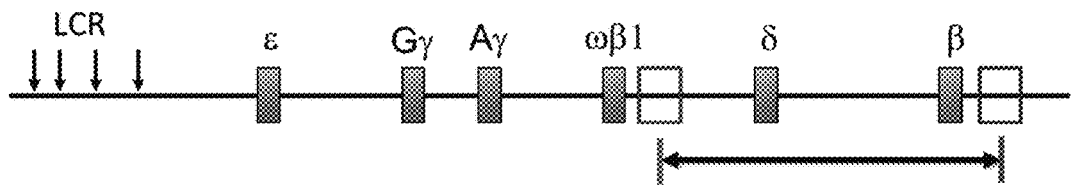
Figure 2
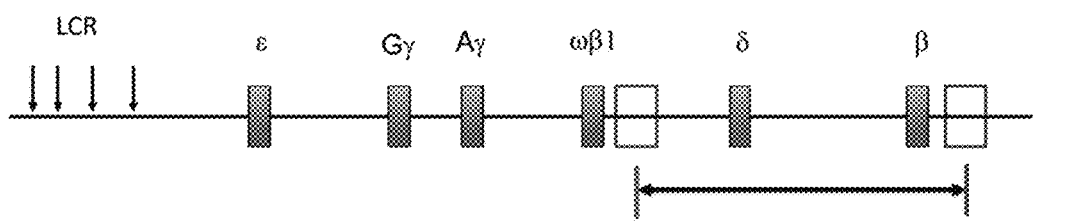

Figure 3
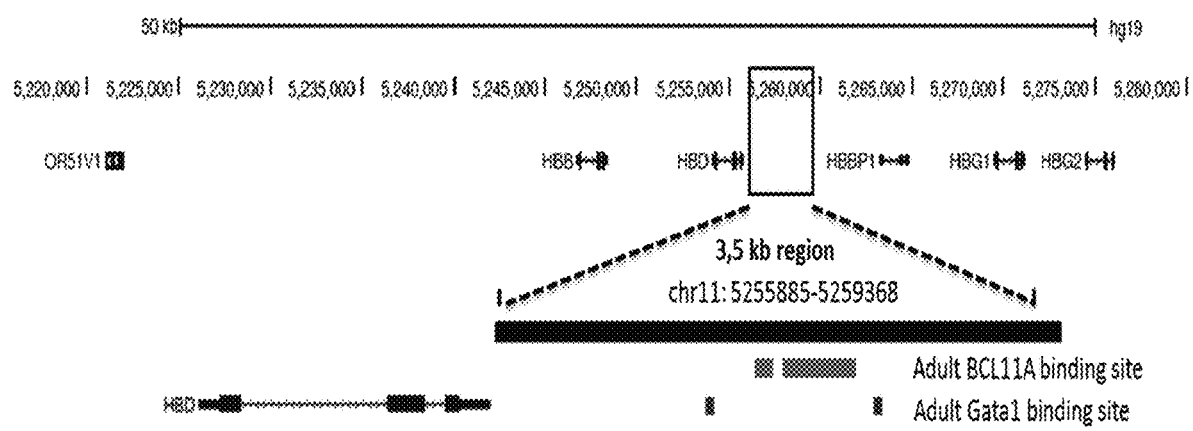
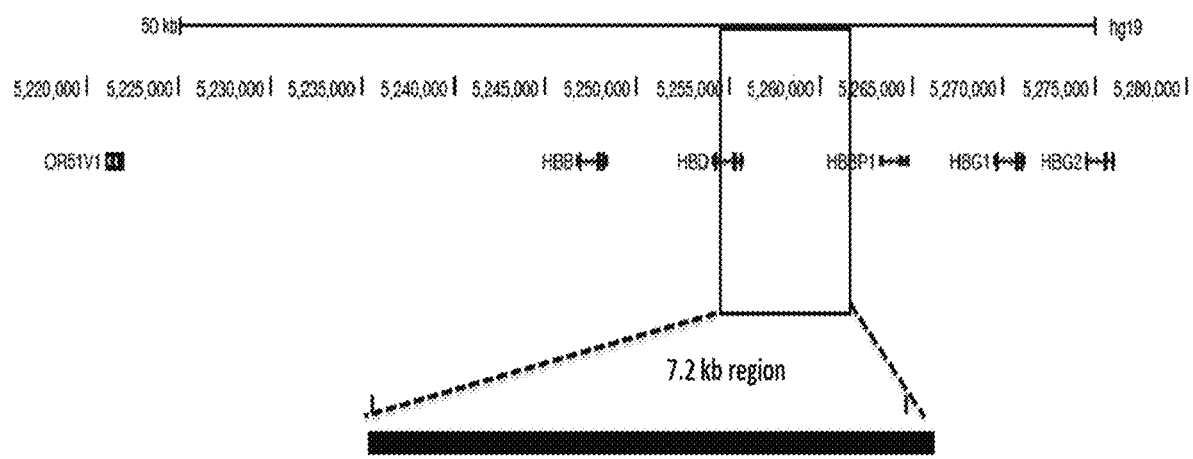

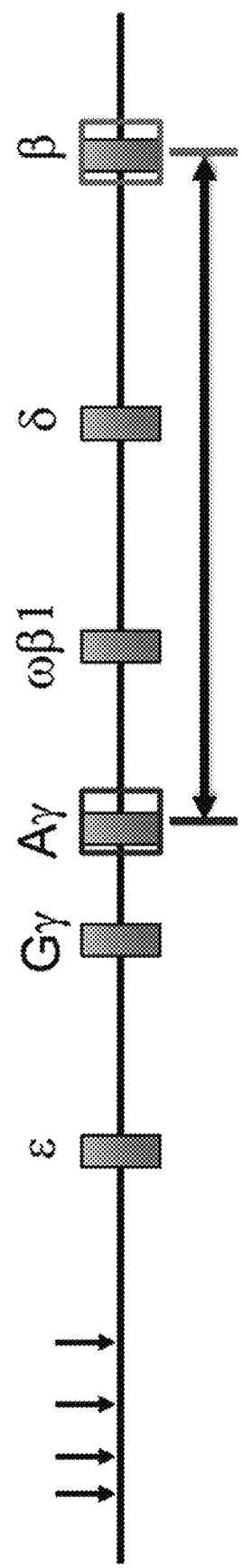

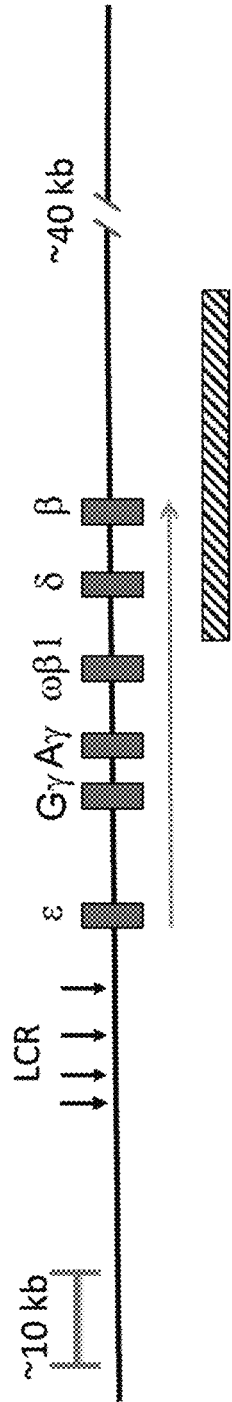
Figure 6A
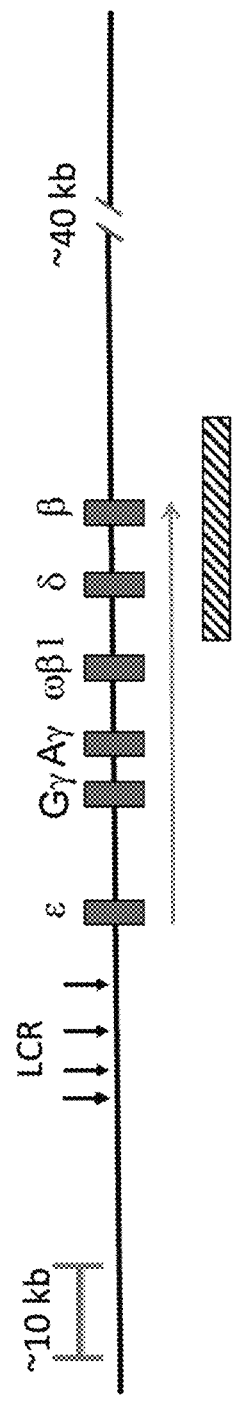
Figure 6B
Figure 6C
ggggcccct(cccc)cactatctcaatgcaaaTa(c)g(ct)aa(gg)cc(c)ggctaaactc(cc)cc(cc)tgggttgg
SEQ ID NO:161,315

Figure 8
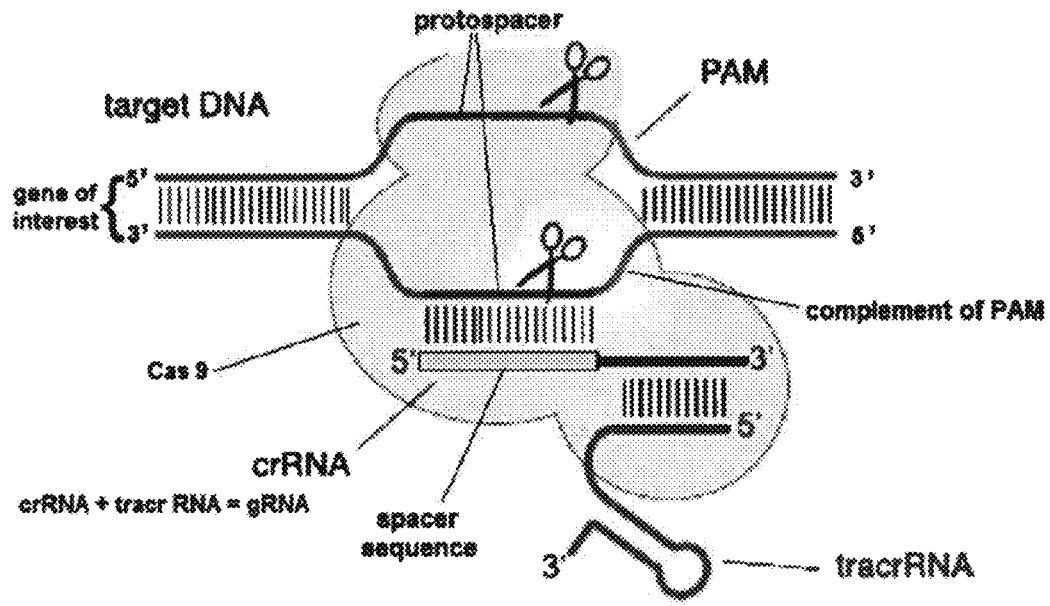
8A
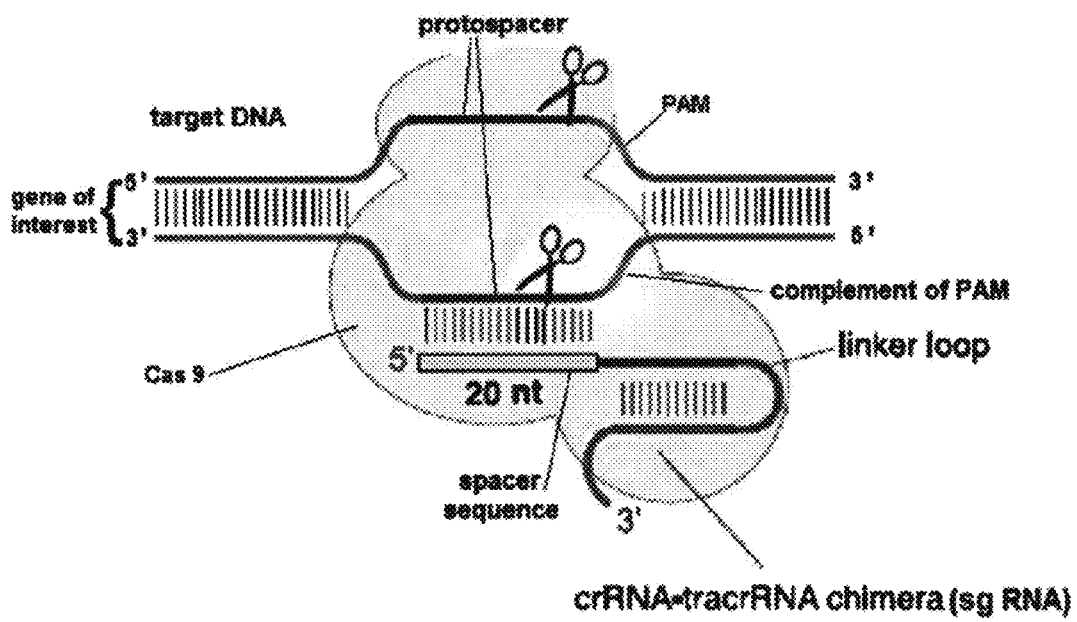
8B

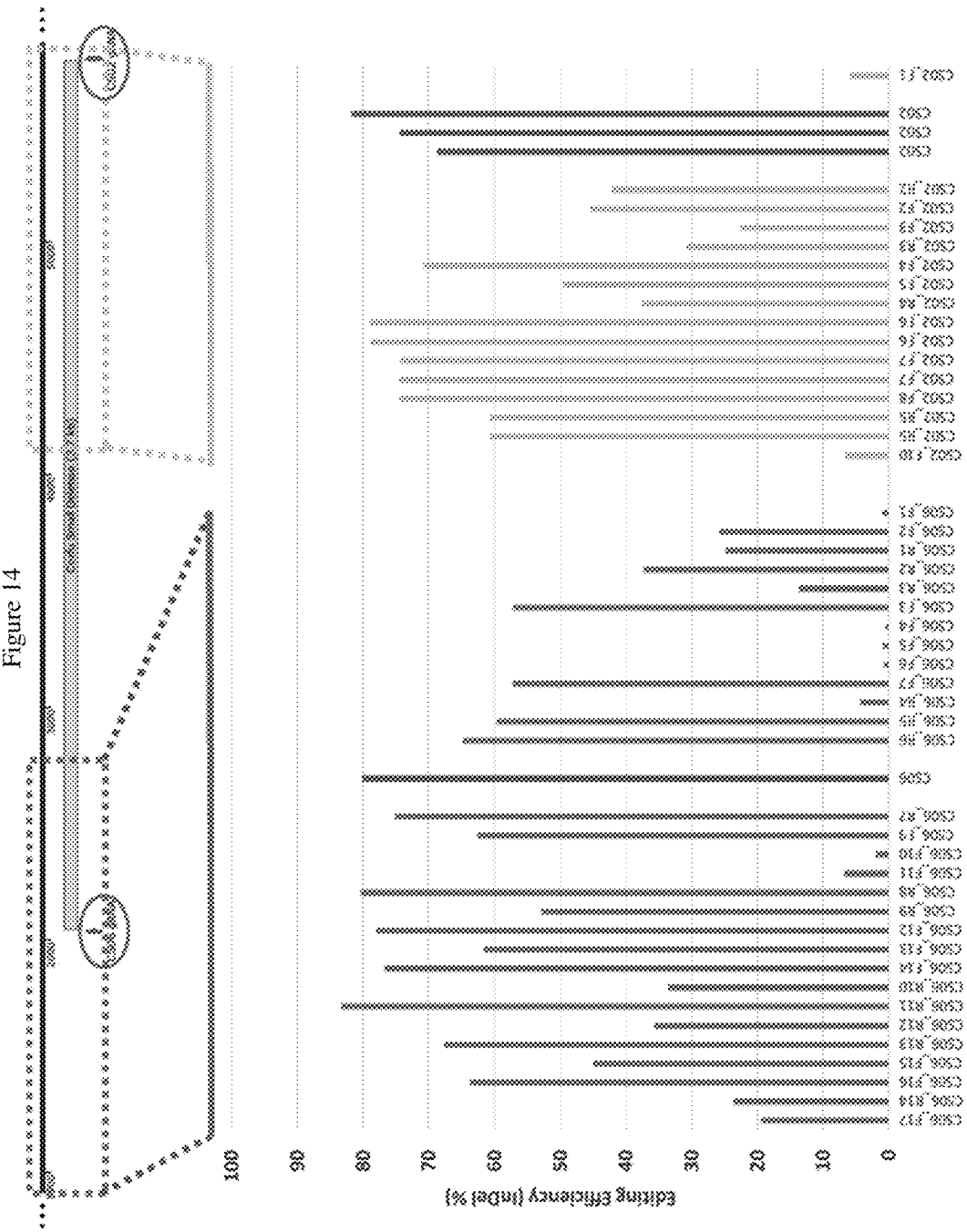

MATERIALS AND METHODS FOR TREATMENT OF HEMOGLOBINOPATHIES

CROSS REFERENCE TO RELATED APPLICATIONS

This application claims the benefit of U.S. Application No. 62/250,823 filed on Nov. 4, 2015 and U.S. Application No. 62/328,203 filed on Apr. 27, 2016. The disclosures of these related applications, including their sequence listings, are herein incorporated by reference in their entirety. To the extent that there are any discrepancies between the disclosures of these related applications and the instant application, the disclosure of the instant application should control.

REFERENCE TO SEQUENCE LISTING

The instant application contains a Sequence Listing which has been submitted electronically in ASCII format and is hereby incorporated by reference in its entirety. Said ASCII copy, created on Nov. 4, 2016, is named 116339_8_Sequence_Listing.txt and is 31.0 MB in size.

FIELD

The present application provides materials and methods for treating hemoglobinopathies. More specifically, the application provides methods for producing progenitor cells that are genetically modified via genome editing to increase the production of fetal hemoglobin (HbF), as well as modified progenitor cells, including for example CD34+ human hematopoietic stem cells (hHSCs) producing increased levels of HbF, and methods of using such cells for treating hemoglobinopathies such as sickle cell anemia and β-thalassemia.

BACKGROUND

Hemoglobinopathies encompass a number of anemias that are associated with changes in the genetically determined structure or expression of hemoglobin. These include changes to the molecular structure of the hemoglobin chain, such as occurs with sickle cell anemia, as well as changes in which synthesis of one or more chains is reduced or absent, such as occurs in various thalassemias.

Disorders specifically associated with the β-globin protein are referred to generally as β-hemoglobinopathies. For example, β-thalassemias result from a partial or complete defect in the expression of the β-globin gene, leading to deficient or absent hemoglobin A (HbA). HbA is the most common human hemoglobin tetramer and consists of two α-chains and two β-chains ($\alpha_2\beta_2$). β-thalassemias are due to mutations in the adult β-globin gene (HBB) on chromosome 11, and are inherited in an autosomal, recessive fashion. β-thalassemia or β-thaI is classified into two clinically-significant types (which are a focus of symptom management, medical treatments and the present application) that are distinguished by the severity of symptoms: β-thalassemia major (or $\beta^0$, in which mutations block production of β-globin chains, resulting in a severe condition that is also known as "Cooley's anemia") and β-thalassemia intermedia (or $\beta^+$, an intermediate condition in which mutations reduce but do not block production of β-globin chains). In contrast, β-thalassemia minor or β-thalassemia trait refers to the heterozygous situation in which only one of the β-globin alleles contains a mutation, so that β-globin chains can be produced via expression from the other (i.e. unmutated) chromosome 11 allele. While such individuals are carriers of a β-thalassemia mutant allele that they may pass on to their children, individuals with β-thalassemia minor are generally either asymptomatic or nearly asymptomatic themselves as a result of β-globin production from the unaffected allele.

The signs and symptoms of thalassemia major generally appear within the first 2 years of life, when children with the disease can develop life-threatening anemia. Children with thalassemia major often fail to gain sufficient weight or grow at the expected rate (failure to thrive) and may develop jaundice. Affected individuals may also have an enlarged spleen, liver, and heart, and their bones may be misshapen. Many people with thalassemia major have such severe symptoms that they need frequent blood transfusions to replenish their red blood cell supply, which is referred to as transfusion-dependent thalassemia. While transfusions have been a critical life-saver for many patients, they are expensive and are frequently associated with significant side effects. Among others, over time the administration of iron-containing hemoglobin from chronic blood transfusions tends to lead to a buildup of iron in the body, which can result in liver, heart, and endocrine problems.

Thalassemia intermedia is milder than thalassemia major. The signs and symptoms of thalassemia intermedia appear in early childhood or later in life. Although symptoms are less severe, affected individuals still have mild to moderate anemia and may also suffer from slow growth and bone abnormalities.

Sickle cell disease (SCD) is a group of disorders that affects millions of people worldwide. It is most common among people who live in or whose ancestors come from Africa; Mediterranean countries such as Greece, Turkey, and Italy; the Arabian Peninsula; India; Spanish-speaking regions in Central and South America, and parts of the Caribbean. However, SCD is also the most common inherited blood disorder in the United States. SCD includes sickle cell anemia, as well as sickle hemoglobin C disease (HbSC), sickle beta-plus-thalassemia (HbS/$\beta^+$) and sickle beta-zero-thalassemia (HbS/$\beta^0$).

Sickle cell anemia (SCA), which is the most prevalent form of SCD, is among the most common severe monogenic disorders worldwide, with approximately 250,000 children born with SCD every year. The incidence of SCA is greatest in West and Central Africa, where 1-2% of babies are born with the disease, and as many as 25% of people are heterozygous carriers. The SCA point mutation is believed to have been spread through selective advantage because heterozygosity provides modest protection against death from childhood malaria. In India, where malaria is also prevalent, it is estimated that there are more than 2.5 million heterozygous carriers of SCA and approximately 150,000 homozygotes with the disease.

Despite the relative absence of malaria in North America and Europe, the fact that each has large populations with genetic origins in affected areas has meant that both regions have substantial populations of heterozygous SCA carriers, and therefore affected homozygous individuals. For example, the US Centers for Disease Control (CDC) estimates that there are approximately 90,000 to 100,000 Americans with SCA; and incidence is also high in countries of Western Europe, particularly those with large immigrant populations, with an estimated 10,000 in France and 12,000 to 15,000 in the United Kingdom for example. Associated costs to healthcare systems are likewise substantial. In a five-year US study conducted from 1989 through 1993, the CDC estimated that SCD resulted in more than 75,000 hospitalizations annually, and cost approximately $0.5 billion. System wide costs would be expected to be substantially greater now given the steady rise in healthcare costs over the intervening two decades.

All forms of SCD are caused by mutations in the β-globin structural gene (HBB). Sickle cell anemia (SCA) is an autosomal recessive disease caused by a single missense mutation in the sixth codon of the β-globin gene (HBB; A→T) resulting in the substitution of glutamic acid by valine (Glu→Val). The mutant protein, when incorporated into hemoglobin (Hb), results in unstable hemoglobin HbS (which is $\alpha_2\beta_2^S$) in contrast to normal adult hemoglobin or HbA (which is $\alpha_2\beta_2^A$). Upon de-oxygenation, HbS polymerizes to form HbSS through hydrophobic interactions between $\beta^S$-6 valine of one tetramer and β-85 phenylalanine and β-88 leucine of an adjacent tetramer in the erythron, which leads to rigidity and vaso-occlusion [Atweh, *Semin. Hematol.* 38(4):367-73 (2001)].

When HbS is the predominant form of hemoglobin, as in individuals with SCA, their red blood cells (RBCs) tend to be distorted into a sickle or crescent shape. The sickle-shaped RBCs die prematurely, which can lead to anemia. In addition, the sickle-shaped cells are less flexible than normal RBCs and tend to get stuck in small blood vessels causing vaso-occlusive events. Such vaso-occlusive events are associated with tissue ischemia leading to acute and chronic pain as well as organ damage that can affect any organ in the body, including the bones, lungs, liver, kidneys, brain, eyes, and joints. The spleen is particularly subject to infarction and the majority of individuals with SCD are functionally asplenic in early childhood, increasing their risk for certain types of bacterial infections. Occlusions of small vessels can also cause acute episodic febrile illness called "crises," which are associated with severe pain and multiple organ dysfunction. Over the course of decades there is progressive organ disease and premature death.

Children with SCD may be diagnosed by newborn screening but otherwise do not present until later, when levels of fetal hemoglobin (HbF) decline and levels of HbS increase as a result of the hemoglobin allelic "switch" from fetal hemoglobin (encoded by HBG1 (A-gamma, also written $^A\gamma$) and HBG2 (G-gamma, also written $^G\gamma$)) to the adult β form encoded by HBB). The switch from HbF to the adult form of β-globin (i.e. HbA in unaffected children or HbS in those with SCA) typically begins a few months prior to birth and is complete by about the age of 6 months. The clinical effects of SCD are not manifested until HbF levels become significantly low relative to HbS, which typically occurs two to three months after birth. SCD often first presents as dactylitis or "hand-foot syndrome," a condition associated with pain in the hands and/or feet that may be accompanied by swelling. In addition, the spleen can become engorged with blood cells resulting in a condition known as "splenic sequestration." Hemolysis associated with SCD can result in anemia, jaundice, cholelithiasis, as well as delayed growth. Individuals with the highest rates of SCD hemolysis also tend to experience pulmonary artery hypertension, priapism, and leg ulcers.

Sickle cell anemia (homozygous HbSS) accounts for 60%-70% of sickle cell disease in the US. The other forms of sickle cell disease result from coinheritance of HbS with other abnormal globin β chain variants, the most common forms being sickle-hemoglobin C disease (HbSC) and two types of sickle β-thalassemia (HbSβ+-thalassemia and HbSβ°-thalassemia). The β-thalassemias are divided into β+-thalassemia, in which reduced levels of normal β-globin chains are produced, and β°-thalassemia, in which there is no β-globin chain synthesis. Other globin β chain variants such as D-Punjab, O-Arab, and E also result in sickle cell disease when coinherited with HbS.

Although improvements in the management of SCD have reduced mortality in affected children followed up since neonatal screening, the mainstay of treatment for the majority of individuals with SCD remains supportive. Current treatments aim at relieving symptoms and treating complications such as: pain from vaso-occlusive crisis, infection, anemia, stroke, priapism, pulmonary hypertension or chronic organ damage. Preventative therapies include infection prophylaxis with regular penicillin, vaccination against *Streptococcus pneumoniae* and *Haemophilus influenzae*, as well as regular transfusions in children with abnormal transcranial Doppler ultrasonography to prevent strokes and iron chelation for transfusional iron overload. Stroke is also considered an indication for bone marrow transplantation in children and adolescents, who have siblings with identical human leukocyte antigen (HLA). Effective treatment of acute pain is one of the most common problems raised by the management of SCA. Thus, at the present time, definitive therapies that substantially alter the natural history of the disease (such as regular transfusion or exchange transfusion, long-term hydroxycarbamide and HSC transplants) are limited.

WO2014/085593 relates to methods and compositions for treating hemoglobinopathies by targeting BCL11A distal regulatory elements that are purported to act as a stage specific regulator of fetal hemoglobin expression by repressing γ-globin induction. Thus, for example, claim 1 of WO2014/085593 is directed to a method for producing a progenitor cell having decreased BCL11A mRNA or protein expression, the method comprising contacting an isolated progenitor cell with an agent that binds the genomic DNA of the cell on chromosome 2 location 60,716,189-60,728,612 (according to UCSC Genome Browser hg 19 human genome assembly), thereby reducing the mRNA or protein expression of BCL11A.

For these and other targets, gene therapy has long been proposed as a potentially curative option for hemoglobinopathies (see, e.g., de Montalembert, *BMJ*, 337: a1397 (2008); Sheth et al., *British Journal of Haematology*, 162: 455-464 (2013), and references cited therein.

However, as recently summarized by Chandrakasan and Malik in a review entitled "Gene Therapy for Hemoglobinopathies: The State of the Field and the Future" [*Hematol Oncol Clin North Am.* 28(2): 199-216 (2014)] gene therapy for hemoglobinopathies has faced a number of challenges. For example, retroviral (RV) vectors were the first vectors to be used in clinical trials, and although vectors with long terminal repeats (LTRs) intact mediated high levels of transgene expression leading to clinical improvement, the success in the trials were soon marred by safety concerns from insertional oncogenesis from transactivation of cellular oncogenes by the RV LTR. The lympho-proliferation and leukemia in X-SCID was ascribed to insertion activation of the LMO2 oncogene. In the gene therapy trial for chronic granulomatous disease (CGD), after some initial success, there was silencing of transgene expression caused by methylation of the viral promoter, and myelodysplasia developed with monosomy 7 as a result of insertional activation of ecotropic viral integration site 1. Cf. Chandrakasan and Malik, supra, and references cited therein.

Bioengineering of HIV-1 devoid of any pathogenic elements resulted in the development of lentivirus (LV) vectors. Initial studies had established LV vectors as dependable vehicles for high-efficiency gene transfer. Bluebird Bio, Inc. is developing LentiGlobin® BB305, as a potential treatment in which autologous CD34+ hematopoietic stem cells (HSC) are transduced ex vivo with a lentiviral $\beta^{A\ T87Q}$-globin vector with the goal of inserting a fully functional human β-globin gene in patients with β-thalassemia major. The Bluebird study is intended to build on early clinical data from the LG001 study, in which the drug product had been administered to a patient with β-thalassemia major [Cavazzana-Calvo et al., Nature, 467: 318-322 (2010)].

Gene therapy using γ-globin has also been considered. However, γ-globin transcripts are known to be highly silenced in adults and so approaches to circumvent this have included driving γ-globin expression with β-globin promoters and enhancers, as described by Chandrakasan and Malik, supra.

However, the introduction of strong promoters and enhancers in the context of gene therapy, particularly with vectors that integrate at unpredictable locations within the genome (which include RV and LV vectors), raises safety concerns since the activation of a proto-oncogene or other harmful event can be triggered by the introduction of such elements. In the severe combined immunodeficiency disease (SCID) trials, for example, 5 of the 20 patients treated developed leukemia in connection with their treatment [Wu et al. Front Med. 5(4): 356-371 (2011)].

In sum, despite decades of efforts from researchers and medical professionals worldwide who have been trying to address hemoglobinopathies such as β-thalassemia and sickle cell disease, and despite the promise of gene therapy approaches, there still remains a critical need for developing safe and effective treatments for these and related diseases which are among the most prevalent and debilitating genetic disorders.

SUMMARY

Provided herein are methods of increasing the level of fetal hemoglobin (HbF; two polypeptide chains of which are expressed from the γ-globin genes as described below) in human cells by genome editing, which can be used to treat hemoglobinopathies such as β-thalassemia and sickle cell disease, as well as components, kits and compositions for performing such methods, and cells produced by them, including without limitation autologous CD34+ human hematopoietic stem cells (hHSCs) that can be administered to a patient suffering from a hemoglobinopathy.

In one aspect, provided herein are methods of increasing the level of HbF in a human cell by genome editing using DNA endonuclease to effect a pair of double-strand breaks (DSBs), the first positioned at a 5' DSB locus and the second positioned at a 3' DSB locus within the δβ-globin region of human chromosome 11, causing a DNA deletion of the region between the 5' DSB locus and the 3' DSB locus that results in increased expression of either or both γ-globin genes, thereby bringing about an increase in the level of HbF in the cell.

In another aspect, provided herein are methods of increasing the level of HbF in a human cell by genome editing using DNA endonuclease to effect a pair of DSBs, the first positioned at a 5' DSB locus and the second positioned at a 3' DSB locus within the δβ-globin region of human chromosome 11, causing an inversion of the region between the 5' DSB locus and the 3' DSB locus that results in increased expression of γ-globin, thereby bringing about an increase in the level of HbF in the cell.

In another aspect, provided herein are methods of increasing the level of HbF in a human cell by genome editing using DNA endonuclease to effect a DSB positioned at one or more loci within the β-globin region of human chromosome 11, causing deletions or insertions of chromosomal DNA at the one or more loci that result in increased expression of γ-globin, thereby increasing the level of HbF in the cell. In one type of method exemplifying this aspect, at least one DSB is positioned within the γ-globin regulatory region of human chromosome 11. In another type of method exemplifying this aspect, at least one DSB is positioned within the δβ-globin region of human chromosome 11.

Exemplary DNA endonucleases that may be used include, e.g., a Cas9 endonuclease, a zinc finger nuclease, a transcription activator-like effector nuclease (TALEN), a homing endonuclease, a dCas9-FokI nuclease or a MegaTal nuclease. DNA endonucleases may be introduced into the cell by a variety of means, including by the introduction and/or expression one or more polynucleotides encoding the DNA endonuclease, as known in the art and as described and illustrated further herein. In certain embodiments, DNA endonucleases and/or other components of the genome editing systems, such as guide RNAs in the case of Cas9 genome editing, are encoded by RNAs introduced into the cells.

In some embodiments, the DNA endonuclease is a Cas9 endonuclease and the method comprises introducing into the cell one or more polynucleotides encoding Cas9 and two guide RNAs, the first guide RNA comprising a spacer sequence that is complementary to a segment of the 5' DSB locus, and the second guide RNA comprising a spacer sequence that is complementary to a segment of the 3' DSB locus. Both guide RNAs may be provided as single-molecule guide RNAs (comprising tracrRNA and crisprRNA), or either or both may be provided as double-molecule guide RNAs comprising a crisprRNA and a tracrRNA that are not joined to each other but rather are separate molecules.

In other embodiments, the DNA endonuclease is a zinc finger nuclease (ZFN) and the method comprises introducing into the cell one or more polynucleotides encoding a first pair of ZFNs that target a segment of the 5' DSB locus, and a second pair of ZFNs that target a segment of the 3' DSB locus. Alternatively, TALENs or other endonucleases may be used.

In some embodiments, the human cell to be modified is an isolated progenitor cell, and in some embodiments for the treatment of hemoglobinopathies it is a hematopoietic progenitor cell capable of giving rise to cells of the erythroid lineage. The isolated progenitor cell may also be an induced pluripotent stem cell.

In various embodiments, one or both DSB loci is proximal to a deletion associated with the hereditary persistence of fetal hemoglobin (HPFH) or δβ-thalassemia Corfu, as described and illustrated further herein. (The term "proximal to" refers herein to a position within, or nearby, a defined region either 5' or 3' of a particular reference point, is used herein with specific reference to these deletions, and is described in further detail below in the section entitled "Target Sequence Selection" and further illustrated by various exemplary embodiments provided herein.)

The deletions associated with HPFH and δβ-thalassemia Corfu are both associated with increases in HbF and are referred to herein collectively as HPFH deletions, a number of which are described and illustrated herein, and others are known in the art. Thus, the 5' DSB locus may be proximal to the 5' boundary of an HPFH deletion, the 3' DSB locus may be proximal to the 3' boundary of an HPFH deletion, or both, which would result in deletions that mimic naturally-occurring HPFH deletions. Exemplary deletions as illustrated herein include, e.g., the HPFH-4 deletion, the HPFH-5 deletion, the HPFH-Kenya deletion, the HPFH-Black deletion, the long Corfu deletion, and the short Corfu deletion.

Embodiments are also provided that have deletions sharing one or more segments that are deleted in HPFH, and that are associated with increased levels of HbF, but that are not co-terminus with naturally-occurring deletions.

In some aspects, deletions remove all or a portion of the δβ-globin region, as described further herein.

In some aspects, deletions remove all or a portion of the β-globin gene (HBB), as described further herein. In the context of sickle cell disease, disrupting or eliminating the β-globin gene can effectively reduce or eliminate the expression of sickle cell hemoglobin (HbS), which in addition to increasing the levels of fetal hemoglobin (HbF) can be of significant additional benefit to patients with SCD, such as sickle cell anemia. In certain embodiments, the method involves genome editing of cells from a patient with SCD, wherein HbF is increased and HbS is decreased.

In the context of β-thalassemias, problems associated with the lack of β-globin chains are exacerbated by the excess of unpaired α-globin chains, which interact with the red cell (RBC) membrane, causing oxidative damage to membrane skeletal components, and potentially other components resulting in shortened RBC survival, ineffective erythropoiesis and anemia. In certain embodiments, the method involves genome editing of cells from a patient with β-thalassemia, wherein HbF is increased and the level of unpaired α-globin chains is decreased.

Also provided are human cells that have been modified by the preceding methods to increase their levels of HbF. In certain embodiments, the cells are derived from a patient with SCD and the level of HbS in such cells is reduced. In certain other embodiments, the cells are derived from a patient with β-thalassemia and the level of unpaired α-globin chains in such cells is reduced. Such cells may be isolated progenitor cells, e.g., hematopoietic progenitor cells capable of giving rise to cells of the erythroid lineage. Isolated progenitor cells may be induced pluripotent stem cells.

Further provided herein are methods of ameliorating hemoglobinopathies by administration of cells that have been modified by the preceding methods to increase their levels of HbF. Exemplary hemoglobinopathies include, but are not limited to, sickle cell disease (including sickle cell anemia), hemoglobin C disease, hemoglobin C trait, hemoglobin S/C disease, hemoglobin D disease, hemoglobin E disease, a thalassemia, a condition associate with hemoglobin with increased oxygen affinity, a condition associated with hemoglobin with decreased oxygen affinity, unstable hemoglobin disease and methemoglobinemia.

In some aspects of the methods, the gRNA comprises a spacer sequence selected from the group consisting of the sequences in the Sequence Listing, application, or figures.

Provided herein is a guide ribonucleic acid (gRNA) comprising a spacer sequence selected from the group consisting of the sequences in the Sequence Listing, application, or figures for editing the globin locus in a cell from a hemoglobinopathy patient. In some aspects the gRNA is a single-molecule guide RNA (sgRNA). In some aspects, the gRNA or sgRNA is a modified gRNA or sgRNA.

Various other aspects are described and exemplified herein.

BRIEF DESCRIPTION OF THE DRAWINGS

FIG. 1 shows the genomic location of CRISPR target sites for the HPFH5 deletion. (A) Restriction map of the HPFH5 deletion variant (lower part) compared with wild type β-globin locus (upper part), as defined by Camaschella et al, Haematologica, 75(Suppl 5): 26-30 (1990). (B) Schematic of the human β-globin locus with hollow boxes highlighting illustrative HPFH5-like 5' and 3' target sites for CRISPR. The 12.9 kb deletion starts 3 kb 5' to the δ gene and ends 1.7 kb 3' to the end of the β gene (690 bp downstream from the β polyA signal), as described by Camaschella et al., supra.

FIG. 2 shows a schematic of PCR primer locations for detection of inversions and deletions of the 13 kb fragment.

FIG. 3 shows a schematic of the genomic location of HPFH Corfu 3.5 kb and 7.2 kb deletions.

FIG. 4 shows a schematic of the β-globin locus showing the location of the Kenya deletion, 5' (left box) and 3' (right box).

FIG. 6 shows other deletion and non-deletion modifications of the β-globin locus associated with HPFH. (A) Schematic showing location of HPFH-4 deletion. (B) Schematic showing location of the HPFH Black deletion. (C) Genomic sequence in the region of the $^G\gamma$-175 (T to C) mutation. Potential PAM sites for S. pyogenes Cas9 are circled. Nucleotide T175 is shown in bold.

FIG. 8A is an illustration depicting the type II CRISPR/Cas system.

FIG. 8B is another illustration depicting the type II CRISPR/Cas system.

FIG. 14 presents the results of the editing efficiency screen results for Corfu Small gRNA.

BRIEF DESCRIPTION OF THE SEQUENCE LISTING

Figure 5B:
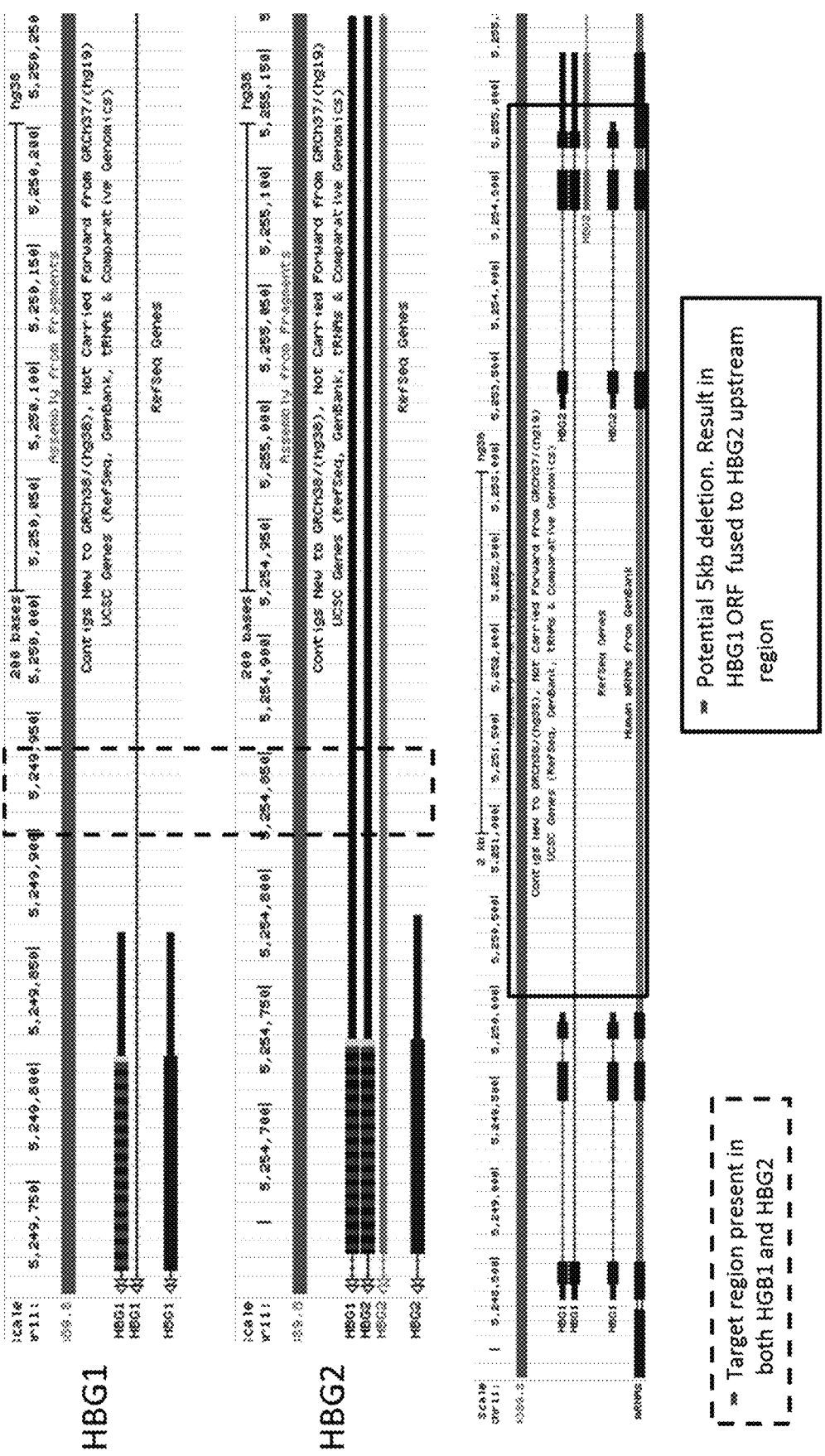
FIG. 5 shows the location of the HPFH-SD 13 bp deletion. (A) Sequence alignment of wild type and 13 bp deletion variant of human γ-globin locus. Potential PAM sites for CRISPR are circled. (B) Sequence alignment of HBG1 and HBG2 genes showing the conserved target region (dotted box), along with the potential ~5 kb deletion arising from cleavage at the target site in both genes (lower panel).
Figure 7A:
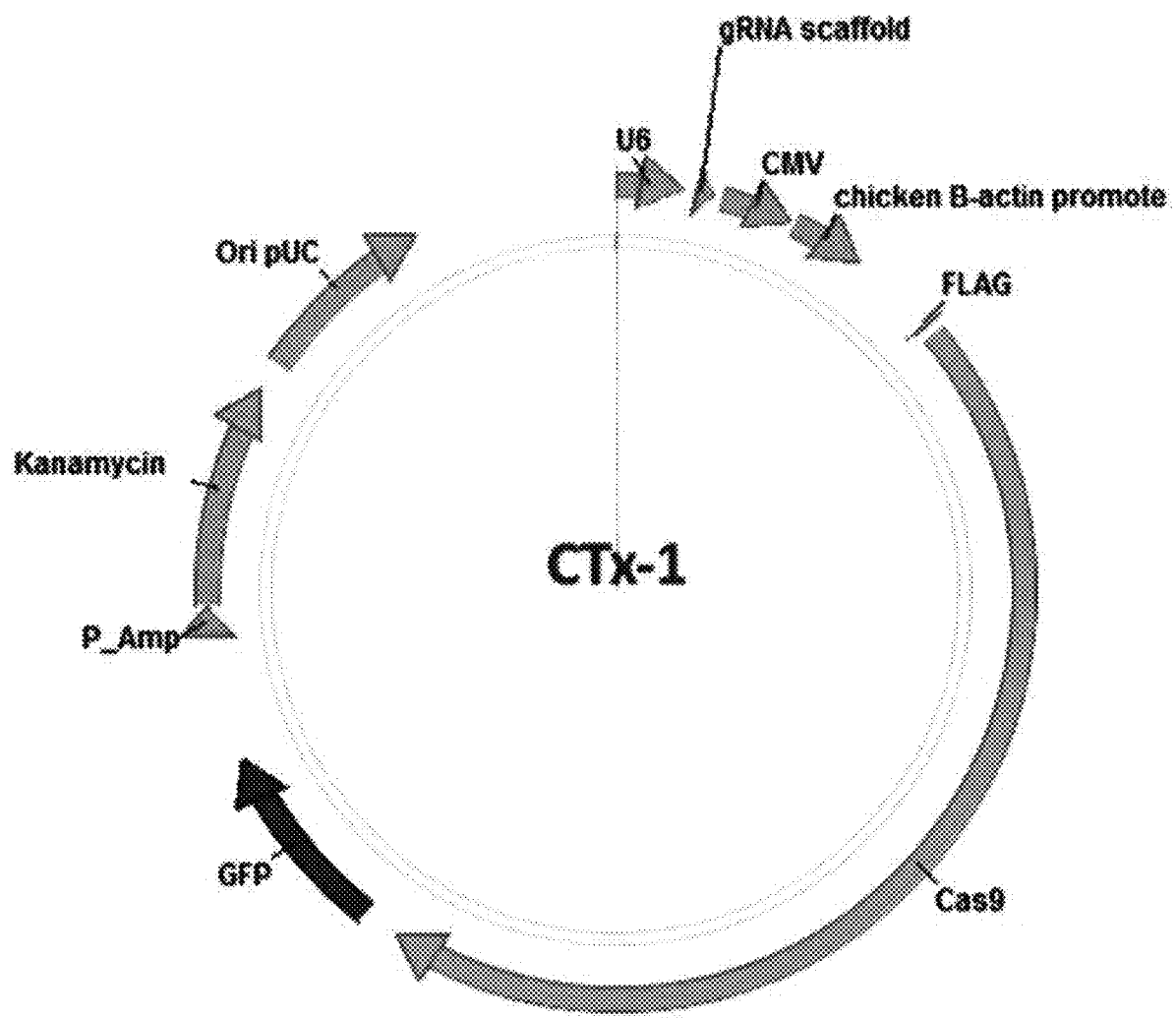
FIG. 7A is an illustration of a plasmid (referred to herein as "CTx-1") comprising a codon optimized gene for S. pyogenes Cas9 endonuclease. The CTx-1 plasmid also comprises a gRNA scaffold sequence, which includes a spacer sequence from the sequence listing.
Figure 7B:
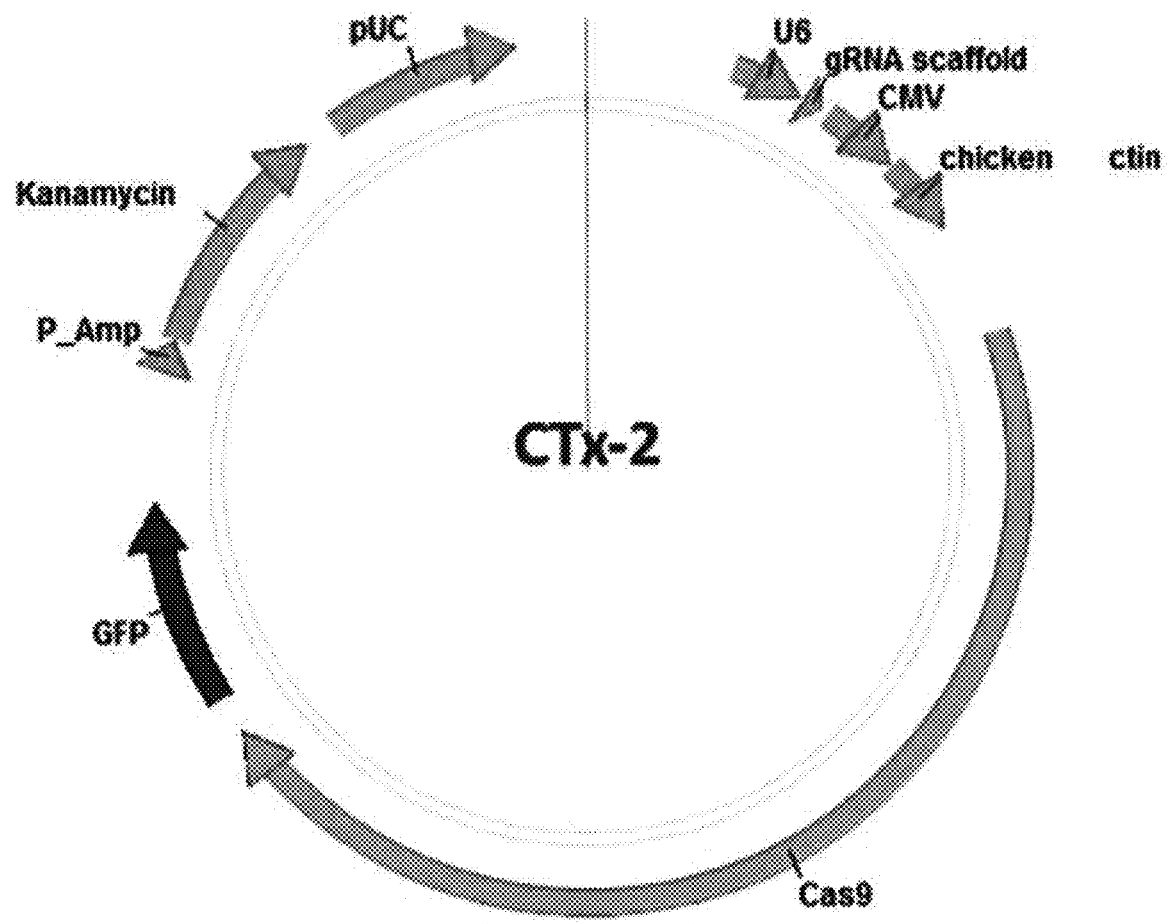
FIG. 7B is an illustration of a plasmid (referred to herein as "CTx-2") comprising a different codon optimized gene for S. pyogenes Cas9 endonuclease. The CTx21 plasmid also comprises a gRNA scaffold sequence, which includes a spacer sequence from the sequence listing.
Figure 7C:
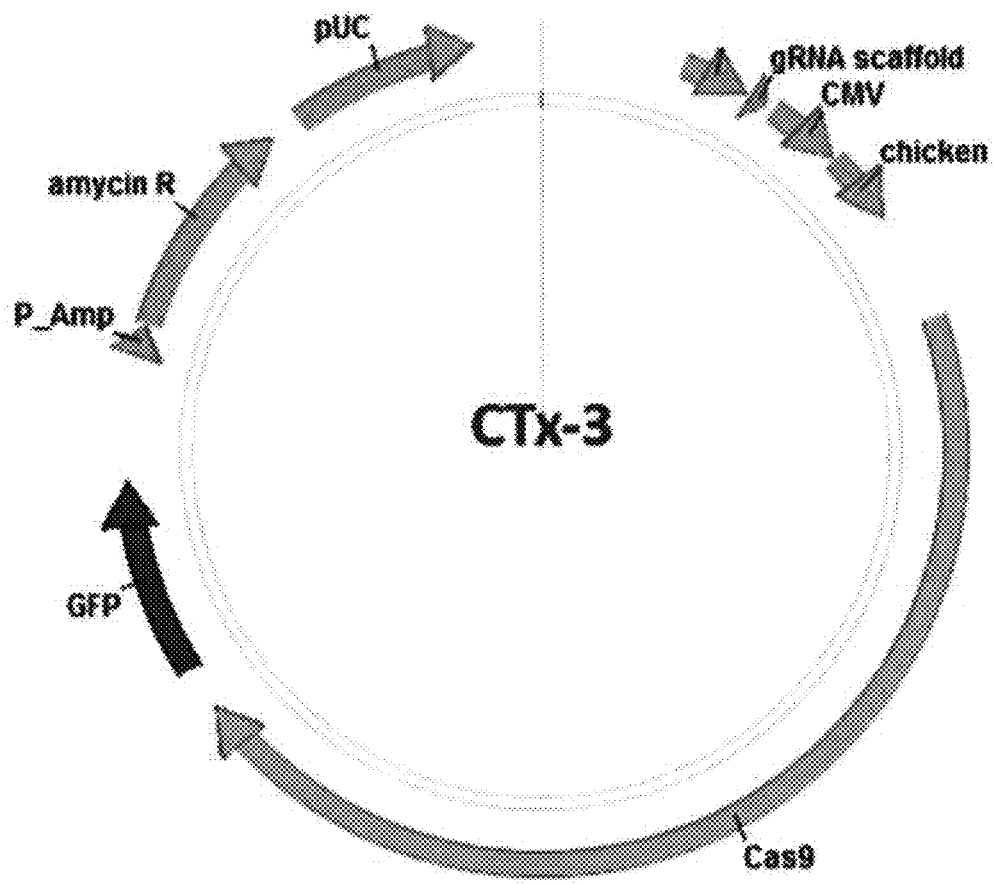
FIG. 7C is an illustration of a plasmid (referred to herein as "CTx-3") comprising yet another different codon optimized gene for S. pyogenes Cas9 endonuclease. The CTx-3 plasmid also comprises a gRNA scaffold sequence, which includes a 20 bp spacer sequence from the sequence listing.

SEQ ID NOs:1-56,961 is a list of gRNA 20 bp spacer sequences, associated with PAM (NRG), for targeting the globin locus with a *S. pyogenes* Cas9 endonuclease.

SEQ ID NOs:56,962-64,104 is a list of gRNA 20 bp spacer sequences, associated with PAM (NNGRRT), for targeting the globin locus with a *S. aureus* Cas9 endonuclease.

SEQ ID NOs:64,105-66,998 is a list of gRNA 20 bp spacer sequences, associated with PAM (NNAGAAW), for targeting the globin locus with a *S. thermophilus* Cas9 endonuclease.

SEQ ID NOs:66,999-68,146 is a list of gRNA 20 bp spacer sequences, associated with PAM (NAAAAC), for targeting the globin locus with a *T. denticola* Cas9 endonuclease.

SEQ ID NOs: 68,147-75,145 is a list of gRNA 20 bp spacer sequences, associated with PAM (NNNNGHTT), for targeting the globin locus with a *N. meningitides* Cas9 endonuclease. SEQ ID NOs:75,146-161,197 is a list of gRNA 22 bp spacer sequences, associated with PAM (YTN), for targeting the globin locus with a Cpf1 endonuclease from Acidominococcus, Lachnospiracease, and Franciscell Novicida.

SEQ ID NO:161,198 is an exemplary target nucleic acid.

SEQ ID NO:161,199 is a homing endonucleases (HE) recognition sequence.

SEQ ID NOs:161,200-161,312 are gRNA sequences for targeting the Corfu Region for deletion with a Cas9 endonuclease.

SEQ ID NOs:161,313-161,314 are sequences for HPFH-SD wild type and deletion variants of human γ-globin. See FIG. 5A and the corresponding description.

SEQ ID NO:161,315 is the genomic sequence in the region of the $^G$γ-175 (T to C) mutation. See FIG. 6C and the corresponding description.

Note that where the guides are presented as DNA sequences (complementary to the target strand and identical to the non-target strand), the gRNA is the corresponding RNA sequence.

DETAILED DESCRIPTION

Hemoglobinopathies

Fetal hemoglobin (HbF) is a tetramer of two adult α-globin polypeptides and two fetal β-like γ-globin polypeptides. The γ-globin genes (HBG1 and HBG2) are normally expressed in the fetal liver, spleen and bone marrow. A tetramer of two γ-chains together with two α-chains constitute HbF. During gestation, the duplicated γ-globin genes constitute the predominant genes transcribed from the β-globin locus. Following birth, γ-globin becomes progressively replaced by adult β-globin, a process referred to as the "fetal switch." This developmental switch from production of predominantly HbF (α2γ2) to production of adult hemoglobin or HbA (α2β2) begins at about 28 to 34 weeks of gestation and continues shortly after birth at which point HbA becomes predominant. The switch results primarily from decreased transcription of the γ-globin genes and increased transcription of β-globin genes. On average, the blood of a normal adult contains only about 2% of total hemoglobin in the form of HbF, though residual HbF levels have a variance of over 20 fold in healthy adults (Atweh, Semin. Hematol. 38(4):367-73 (2001)). The two types of γ-chains differ at residue 136 where glycine is found in the G-γ-product (HBG2) and alanine is found in the A-γ-product (HBG1). The HBG1 hemoglobin gene ($^A$γ or A-gamma [*Homo sapiens* (human)] Gene ID: 3047), was updated on 16 Apr. 2014 (ncbi.nlm.nih.gov/gene/3047).

As used herein, the term "hemoglobinopathy" means any defect in the structure, function or expression of any hemoglobin of an individual, and includes defects in the primary, secondary, tertiary or quaternary structure of hemoglobin caused by any mutation, such as deletion mutations or substitution mutations in the coding regions of the β-globin gene, or mutations in, or deletions of, the promoters or enhancers of such genes that cause a reduction in the amount of hemoglobin produced as compared to a normal or standard condition. The term further includes any decrease in the amount or effectiveness of hemoglobin, whether normal or abnormal, caused by external factors such as disease, chemotherapy, toxins, poisons, or the like. β-hemoglobinopathies contemplated herein include, but are not limited to, sickle cell disease (SCD, also referred to a sickle cell anemia or SCA), sickle cell trait, hemoglobin C disease, hemoglobin C trait, hemoglobin S/C disease, hemoglobin D disease, hemoglobin E disease, thalassemias, hemoglobins with increased oxygen affinity, hemoglobins with decreased oxygen affinity, unstable hemoglobin disease and methemoglobinemia.

The potential for addressing β-hemoglobinopathies by increasing levels of fetal hemoglobin ($α_2γ_2$; HbF) is supported by observations of the mild phenotype of individuals who have co-inherited homozygous β-thalassemia and hereditary persistence of fetal hemoglobin (HPFH), as well as by those patients with homozygous β-thalassemia who synthesize no adult hemoglobin, but in whom a reduced requirement for transfusions is observed in the presence of increased concentrations of HbF. Additional support comes from the observation that certain populations of adult patients with β chain abnormalities have higher than normal levels of HbF, and have been observed to have a milder clinical course of disease than patients with normal adult levels of HbF. For example, a group of Saudi Arabian sickle-cell anemia patients who express 20-30% HbF (as a percent of total hemoglobin) have only mild clinical manifestations of the disease [Pembrey et al., *Br. J. Haematol.* 40: 415-429 (1978)]. It is now accepted that β-hemoglobinopathies, such as sickle cell anemia and the β-thalassemias, are ameliorated by increased HbF production. [Reviewed in Jane and Cunningham, *Br. J. Haematol.* 102: 415-422 (1998) and Bunn, *N. Engl. J. Med.* 328: 129-131 (1993)].

The human β-globin locus is composed of five β-like genes and one pseudo-β gene located on a short region of chromosome 11 (approximately 45 kb), responsible for the creation of the β chains of hemoglobin. Expression of all of these genes is controlled by single locus control region (LCR), and the genes are differentially expressed throughout development. The order of the LCR and genes in the β-globin cluster, as illustrated in FIG. 1B, is as follows:

5'-[LCR]-ε (epsilon, HBE1)-Gγ (G-gamma, HBG1)-Aγ (A-gamma, HBG2)-[ψβ (psi-beta pseudogene)]-δ (delta, HBD)-β (beta, HBB)-3'.

The arrangement of the five β-like genes reflects the temporal differentiation of their expression during development, with the early-embryonic stage version HbE (encoded by the epsilon gene) being located closest to the LCR, followed by the fetal version HbF (encoded by the γ genes), the delta version, which begins shortly prior to birth and is expressed at low levels in adults as HbA-2 (constituting approximately 3% of adult hemoglobin in normal adults), and finally the beta gene, which encodes the predominant adult version HbA-1 (constituting the remaining 97% of HbA in normal adults).

Expression of the β-like genes is regulated in embryonic erythropoiesis by many transcription factors, including KLF1, which is associated with the upregulation of HbA in adult definitive erythrocytes, and KLF2, which is associated with the expression of embryonic hemoglobin. BCL11A is activated by KLF1 and is likewise known to be involved in the switch from fetal to adult hemoglobin. Down-regulation of BCL11A expression or disruption of its activity or binding to transcriptional regulatory sites has been a focus of long-terms efforts from various groups to increase levels of HbF. See, e.g., U.S. Pat. No. 8,383,604, US2014085593, US20140093913, and references cited therein.

Certain naturally-occurring genetic mutations within the human β-globin locus are associated with de-repression of γ-globin gene expression and the clinical manifestation of HPFH. Such mutations range from single base substitutions associated with various forms of non-deletional HFPF, to deletions spanning tens of kb in the case of some forms of deletional HPFH. A variety of naturally-occurring HPFHs were described in *A Syllabus of Thalassemia Mutations* (1997) by Titus H. J. Huisman, Marianne F. H. Carver, and Erol Baysal, published by The Sickle Cell Anemia Foundation in Augusta, GA, USA, and references cited therein, including both deletional and non-deletional types.

A number of different forms of deletional HPFH have been reported based on studies from individuals and families found to have deletions in a region referred to herein as the "δβ-globin region" which extends from the psi-beta pseudogene through delta, beta and the region downstream of beta that is deleted in the larger HPFH alleles such as HPFH-1, as described in the art.

In some cases of HPFH, nearly all of the hemoglobin produced is HbF. However, in most cases, HbF ranges from approximately 15-30% of total hemoglobin depending on the type of HPFH as well as variation among individuals.

Deletions Disrupting or Eliminating the β-Globin Gene and Advantages of Such Deletions in Treating SCD In certain embodiments as described and illustrated herein, in addition to increasing expression of the γ-globin gene product HbF, expression of the β-globin gene product is substantially reduced or eliminated by disruption or elimination of the β-globin gene in connection with the genome editing procedure. This occurs when the genome editing uses DNA endonuclease to effect a pair of DSBs, the first at a 5' DSB locus and the second at a 3' DSB locus within the δβ-globin region of human chromosome 11, causing a deletion of the chromosomal DNA between the 5' DSB locus and the 3' DSB locus that results in increased expression of γ-globin, the deletion also removes all or a portion of the β-globin gene (HBB) causing a concomitant decrease in expression of or elimination of the β-globin gene product, thereby resulting in a combination of (i) increasing the level of HbF in the cell, and (ii) reducing or eliminating expression of the β-globin gene product from at least one HBB allele on chromosome 11.

The combined effects of increased HbF and reduced or eliminated β-globin gene expression has particular additional advantages in the context of ameliorating hemoglobinopathies such as SCD in which the product of the variant β-globin allele (i.e. HbS) is harmful to cells expressing it, causing premature cell death (as well as other negative effects associated with HbS). Thus, not only do sickled RBCs cause multiple problems for patients, as discussed above and in the art, but sickled RBCs have a substantially reduced life span relative to normal RBCs. The presence of HbS and sickled RBCs also leads to numerous other negative effects as described herein and in the art.

In the case of embodiments in which the β-globin gene is effectively disrupted or eliminated as described herein, even "knocking down" (reducing) or "knocking out" (eliminating) only one of the β-globin alleles expressing HbS, e.g., by successfully editing only one of the two copies of the gene in homozygous SCD patients (who have two defective β-globin alleles, one on each copy of chromosome 11) can have a very substantial benefit. In particular, increasing levels of HbF to the range of about 20% is considered to substantially eliminate sickling. However, as a relatively continuous or incremental factor (often referred to as a "quantitative trait") over a significant range, even lower levels HbF can have significant beneficial effects as described herein and in the art. In these embodiments, therefore, even though the SCD patient has two defective β-globin alleles, the combination of increasing HbF (which is itself helpful for reducing the effects of SCD) along with reducing HbS (which is itself a driver of many of the deleterious effects in a quantitative manner), by genome editing using the method described and illustrated for these embodiments can bring about a combination of effects that together ameliorate one of more symptoms of the disease.

In some cases, the genome editing procedure can effectively alter both copies of an allele. Such bi-allelic editing can in some cases be screened for or selected for, but even if not selected for it can naturally occur, albeit at lower frequency as compared to mono-allelic or single allele hits, since the same target site generally exists on each member of the pairs of chromosomes.

For technical reasons as noted above, however, embodiments as described and illustrated herein in which only one of the β-globin alleles is disrupted or eliminated—in addition to increasing levels of HbF—would be expected to have significant positive effects in ameliorating one or more symptoms or conditions associated with SCD.

The ability to generate these significant "cis-type" (on the same allele) effects using the types of genome editing reflected in such embodiments can be more advantageous than approaches depending on "trans-type" effects such as those involving knock out or knock down or a trans-acting factor such as a repressor. In particular, as noted above, the genome editing in embodiments in which the β-globin gene is effectively disrupted or eliminated can substantially ameliorate effects of HbS by successfully editing on one of the two alleles. In the case of trans-acting repressors, such as a repressor of γ-globin gene expression, knocking down or knocking out one copy of the repressor gene may not be sufficient since expression of the repressor from the other copy of the gene can still reduce γ-globin gene expression limiting the levels of HbF that might be achieved.

Effects of Increased of HbF in the Context of β-Thalassemia

As noted above, β-thalassemias result from a partial or complete defect in the expression of the β-globin gene, leading to deficient or absent hemoglobin A (HbA). Since there is no production of HbS, RBCs in β-thal patients do not exhibit the sickling and associated problems associated with SCD. However, a different sort of RBC 'toxicity' and premature cell death occurs as a result of the lack of HbA in the context of β-thal. In particular, the excess of unpaired alpha globin (α-globin) chains in β thalassemia interact with the red cell (RBC) membrane, causing oxidative damage to membrane skeletal components, and potentially other components. This interaction results in a rigid, mechanically unstable membrane that causes increased apoptosis (i.e.

programmed cell death) and shortened RBC survival, marked by ineffective erythropoiesis and anemia.

Increasing the levels of HbF in RBCs of such patients can significantly ameliorate one or more symptoms of β-thalassemia because the beta-chains produced by increasing γ-globin gene expression can pair with the previously unpaired alpha-chains to produce HbF, which not only results in a functioning hemoglobin tetramer but concomitantly reduces the levels of unpaired α-globin chains that are a contributing cause of the β-thalassemia condition because of premature RBC cell death.

Positive Selective Advantages of Certain Edited Cells

In connection with the foregoing advantages provided in certain embodiments of the invention, in particular the advantages in terms of RBC survival for sickle cell RBCs that can be mediated by genome editing that not only increases levels of HbF but reduces levels of HbS, and the advantages in terms of RBC survival for β-thal RBCs that not only increases levels of HbF but reduces levels of unpaired alpha-chains, cells that are modified by such genome editing techniques as described and illustrated herein will have selective advantages relative to the population of diseased RBCs into which they may be introduced, e.g., by gene editing a patients' own HSC's or erythroid progenitor cells ex vivo and then reintroducing such cells to the patient, where reintroduced cells must generally successfully persist or "engraft" in order for beneficial effects to be sufficient and sustained.

As a result of the foregoing selective advantages, the introduction of even modest numbers of suitable stem cells edited as described herein would be expected over time to result in improved cells representing a significantly higher fraction of the overall population of RBCs than they were initially following introduction into a patient. By way of illustration, with successfully gene edited stem cells representing as few as several percent of corresponding cells initially (i.e., compared to the population of resident cells that carry the unedited hemoglobinopathy-associated alleles), the gene edited cells could come to represent a majority of cells as a result of selective survival advantages conveyed upon them through use of gene editing techniques as described further herein. The eventual numbers reflecting such positively selected engraftment will vary depending generally on both the degree to which the resident diseased cells exhibit reduced lifespan in a given patient, and the relative survival advantage exhibited by the gene edited cells. However, as noted above, the diseased cells associated with SCD and β-thalassemia have significantly reduced lifespans (due to the presence of HbS and unpaired alpha-chains respectively), and certain embodiments not only increase levels of HbF but reduce the levels of HbS (associated with SCD) or reduce the levels of unpaired alpha-chains (associated with β-thalassemia), and therefore the relative survival benefits and with them increased engraftment, are expected to be significant.

Corfu and Corfu-Like Deletions

Although the Corfu chromosomal allele first discovered in a Greek child results in a δβ-thalassemia, it shares some important characteristics with various deletional forms of HPFH, in particular increased levels of HbF, and therefore the deletion associated with Corfu is included with deletional HPFH forms as described herein.

However, Corfu is different from forms of deletional HPFH in terms of HbF levels and β-globin expression. Extremely high levels of HbF are associated with Corfu, approaching 100% of total hemoglobin in the case of the first child identified—and this was particularly surprising because Corfu heterozygotes (the child's parents in the first case) were found to have only normal very low levels of HbF (1-2% of total hemoglobin)—a situation that's been referred to by hematologists as the "Corfu Paradox."

A putative explanation is that the Corfu chromosomal allele was found to contain a splice site mutation in IVS-I position 5 ("IVS-I-5") of the β-globin gene and lower levels of the β-globin gene transcript. It has been reported that the high levels of HbF observed are contributed to post-transcriptionally by enhanced mRNA maturation and/or stabilization of the γ-globin transcript, which is apparently associated with the reduced levels of β-globin mRNA; see, e.g., Chakalova, L. et al., *Blood* 105: 2154-2160 (2005).

Since the Corfu chromosomal allele contains both the large deletion and the IVS-I-5 mutation, and reduced levels of β-globin mRNA associated with the latter are believed to independently contribute to the unusually high levels of HbF produced, the IVS-I-5 "Corfu-related β-globin mutation" could be used alone or in combination with other gene edited alterations as described herein in order to increase HbF levels for use in ameliorating hemoglobinopathies.

Target Sequence Selection

For the amelioration of hemoglobinopathies via gene editing, as described herein, it is desirable but not necessary to achieve levels of HbF at the high end of those observed in naturally-occurring cases in order to bring about relative improvements in the disease. In particular, while it had originally been assumed that relatively high levels of HbF were essential for ameliorative effects to be observed, especially with respect to certain complications, studies have shown that even small incremental increases of HbF can have beneficial effects on mortality. See, e.g., Powars et al., *Blood* 63(4):921-926 (1984); Platt et al., *N Engl J Med* 330(23):1639-1644 (1994); and Akinsheye et al., *Blood* 118: 19-27 (2011).

One reason for the beneficial effects of even low levels of HbF in the context of sickle cell disease, is that even small incremental increases in HbF have been shown to have some beneficial effects, and levels of less than 9% of HbF (relative to total hemoglobin, Hb) appear to be associated with significantly decreased mortality; see, e.g., Platt et al., supra.

Higher levels of HbF are associated with additional clinical benefits and further decreases in morbidity and mortality, as observed in the case of SCD co-inherited with certain naturally-occurring HPFH alleles and/or Corfu thalassemia alleles, in which HbF levels in the 20-30% range have been associated with very substantial to nearly complete normalization of the SCD phenotype.

Genetic modifications within the δβ-globin region that are contemplated for increasing HbF expression to ameliorate a hemoglobinopathy as described herein result in at least about 5%, at least about 9%, at least about 14%, at least about 20 at least about 25%, or above 30% HbF (relative to total Hb in a subject).

As described and illustrated further herein, exemplary genetic modifications within the δβ-globin region that are contemplated for increasing HbF expression to such levels include, but are not limited to, the following deletions, as well as variations thereof in which the size of the deletion is reduced (e.g., by shifting the 5' boundary of the deletion specified below further toward the 3' boundary of the deletion specified below or shifting the 3' boundary of the deletion further toward the 5' boundary) or increased (by shifting either boundary in the opposite direction). Deletions made by other combinations of two of the following deletion boundaries that increase HbF expression are also specifically contemplated by the disclosure.

A. Deletions in chromosome 11 within the region Chr11: 5224779-5237723 based on the GRCh38/hg38 version of the human genome assembly, wherein the 3' boundary of the deletion is proximal (as defined below) to Chr11:5224779 and the 5' boundary of the deletion is proximal to Chr11: 5237723;

B. Deletions in chromosome 11 within region Chr11: 5234665-5238138 based on the GRCh38/hg38 version of the human genome assembly, wherein the 3' boundary of the deletion is proximal to Chr11:5234665 and the 5' boundary of the deletion is proximal to Chr11:5238138;

C. Deletions in chromosome 11 within region Chr11: 5233055-5240389 based on the GRCh38/hg38 version of the human genome assembly, wherein the 3' boundary of the deletion is proximal to Chr11:5233055 and the 5' boundary of the deletion is proximal to Chr11:5240389;

D. Deletions in chromosome 11 within region Chr11: 5226631-5249422 based on the GRCh38/hg38 version of the human genome assembly, wherein the 3' boundary of the deletion is proximal to Chr11:5226631 and the 5' boundary of the deletion is proximal to Chr11:5249422;

E. Deletions in chromosome 11 within region Chr11: 5249959-5249971 based on the GRCh38/hg38 version of the human genome assembly wherein the 3' boundary of the deletion is at or adjacent to Chr11:5249959 and the 5' boundary of the deletion is at or adjacent to Chr11:5249971;

F. Deletions in chromosome 11 within region Chr11: 5196709-5239223 based on the GRCh38/hg38 version of the human genome assembly, wherein the 3' boundary of the deletion is proximal to Chr11:5196709 and the 5' boundary of the deletion is proximal to Chr11:5239223;

G. Deletions in chromosome 11 within region Chr11: 5225700-5236750 based on the GRCh38/hg38 version of the human genome assembly, wherein the 3' boundary of the deletion is proximal to Chr11:5225700 and the 5' boundary of the deletion is proximal to Chr11:5236750.

In another aspect, provided herein are methods of increasing the level of fetal hemoglobin (HbF) in a human cell by genome editing using DNA endonuclease to effect a double-strand break (DSB) positioned at one or more loci within the β-globin region of human chromosome 11, wherein at least one DSB is positioned within the γ-globin regulatory region of human chromosome 11, which is located within a region less than 2 kb, less than 1 kb, less than 0.5 kb, or less than 0.25 kb upstream of the start of one of the γ-globin genes (HBG1 or HBG2), causing deletions or insertions of chromosomal DNA at the one or more loci that results in increased expression of γ-globin, thereby increasing the level of HbF in the cell. In another type of method exemplifying this aspect, at least one DSB is positioned within the δβ-globin region of human chromosome 11.

Illustrative modifications in chromosome 11 in the γ-globin regulatory region include the creation of single base substitutions such as −175 (T to C), −202 (C to G), and −114 (C to T) in the $^G$γ gene; and −196 (C to T), −175 (T to C), −117 (G to A) in the $^A$γ gene.

Illustrative modifications within the δβ-globin region include deletions and insertions within or proximal to the HPFH deletion loci referred to above, and deletions within the δ-globin regulatory region of human chromosome 11 which is located within the region of less than 3 kb, less than 2 kb, less than 1 kb, less than 0.5 kb upstream of the start of the δ-globin gene (HBD), and deletions within the β-globin regulatory region of human chromosome 11, which is located within the region of less than 3 kb, less than 2 kb, and less than 1 kb, or less than 0.5 kb upstream of the start of the β-globin gene (HBB).

Given the relatively wide variations in deletions that are associated with various forms of HPFH, coupled with the fact that even low levels of HbF can provide significant levels of amelioration of hemoglobinopathy (as noted above), and the understanding from a variety of studies that there appear to be multiple loci and types of controls that can contribute to repression of HbF, it will be appreciated that numerous variations of the deletions referenced above (including without limitation larger as well as smaller deletions), would be expected to result in levels of HbF that are within the contemplated ranges, as noted above.

Such variants include deletions that are larger in the 5' and/or 3' direction than naturally-occurring HPFH deletions, or smaller in either direction. Accordingly, by "proximal" with respect to HPFH-like deletions, it is intended that the DSB locus associated with a desired deletion boundary (also referred to herein as an endpoint) may be within a region that is less than about 3 kb from the reference locus noted. In some embodiments, the DSB locus is more proximal and within 2 kb, within 1 kb, within 0.5 kb, or within 0.1 kb. In the case of small deletions such as that identified in group E, the desired endpoint is at or "adjacent to" the reference locus, by which it is intended that the endpoint is within 100 bp, within 50 bp, within 25 bp, or less than about 10 bp to 5 bp from the reference locus.

A group of embodiments comprise deletions within the "δ-region" (which includes the downstream half of the intergenic sequence between the ψβ1 pseudogene and the δ gene HBD, and proximal sequences downstream sequences in the δ). The δ-proximal-region appears to include a number of elements associated with repression of γ-globin. The 7.2 kb "Large Corfu" δβ thalassemia deletion described and exemplified further herein falls within the δ-region, deleting approximately 1 kb of the δ gene and 6 kb upstream, and is associated with a significant increase in levels of HbF. A 3.5 "Small Corfu" deletion, described further and illustrated herein, likewise has a deletion in the δ-region, and is also associated with increased levels of HbF. The δ-region is also deleted in all major forms of HPFH.

With respect to regions further downstream in the 3' direction, which would be associated with larger deletions as described herein, HPFH-1 through HPFH-5 all have the δ and β genes deleted. Besides regulatory elements in the δ-region that may contribute to active repression of γ-globin, activity of the δ and β promoters may also indirectly contribute to suppression via competition for transcriptional factors required for γ-globin expression.

Many HPFH types also have even larger deletions extending further downstream, and these additional downstream regions can also be incorporated into deletions as described and illustrated herein, since they are known to be associated with substantial increases of HbF, well above the ranges of HbF known to ameliorate hemoglobinopathies as noted above.

One advantage for patients with hemoglobinopathies of replicating or mimicking aspects of deletions that are found naturally in individuals with HPFH is that such deletions are already known to be both safe and associated with the amelioration of hemoglobinopathy. However, among deletional HPFH, it is also clear that smaller deletions such as HPFH-5 are effective for generating substantial increases in HbF. Other embodiments comprising smaller deletions are expected to provide substantial increases, and as noted above, even modest levels of increase of HbF have beneficial effects. It is thus expected that many variations of the deletions described and illustrated herein will be effective for ameliorating hemoglobinopathies.

Preferentially, shifts in the location of the 5' boundary and/or the 3' boundary relative to particular reference loci are used to facilitate or enhance particular applications of gene editing, which depend in part on the endonuclease system selected for the editing, as further described and illustrated herein. In a first aspect of such target sequence selection, many endonuclease systems have rules or criteria that guide the initial selection of potential target sites for cleavage, such as the requirement of a PAM sequence motif in a particular position adjacent to the DNA cleavage sites in the case of Crispr Type II endonucleases.

In another aspect of target sequence selection or optimization, the frequency of "off-target" activity for a particular combination of target sequence and gene editing endonuclease (i.e. the frequency of DSBs occurring at sites other than the selected target sequence) is assessed relative to the frequency of on-target activity. In some cases, cells that have been correctly edited at the desired locus may have a selective advantage relative to other cells. Illustrative but nonlimiting examples of a selective advantage include the acquisition of attributes such as enhanced rates of replication, persistence, resistance to certain conditions, enhanced rates of successful engraftment or persistence in vivo following introduction into a patient, and other attributes associated with the maintenance or increased numbers or viability of such cells. In other cases, cells that have been correctly edited at the desired locus may be positively selected for by one or more screening methods used to identify, sort or otherwise select for cells that have been correctly edited. Both selective advantage and directed selection methods may take advantage of the phenotype associated with the correction.

Whether or not any selective advantage is applicable or any directed selection is to be applied in a particular case, target sequence selection is can also be guided by consideration of off-target frequencies in order to enhance the effectiveness of the application and/or reduce the potential for undesired alterations at sites other than the desired target. As described further and illustrated herein and in the art, the occurrence of off-target activity is influenced by a number of factors including similarities and dissimilarities between the target site and various off target sites, as well as the particular endonuclease used. In many cases, bioinformatics tools are available that assist in the prediction of off-target activity, and frequently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein and others are known in the art.

Another aspect of target sequence selection relates to homologous recombination events. It is well known that sequences sharing regions of homology can serve as focal points for homologous recombination events that result in deletion of intervening sequences. Such recombination events occur during the normal course of replication of chromosomes and other DNA sequences, and also at other times when DNA sequences are being synthesized, such as in the case of repairs of double-strand breaks (DSBs) which occur on a regular basis during the normal cycle but may also be enhanced by the occurrence of various events (such as UV light and other inducers of DNA breakage) or the presence of certain agents (such as various chemical inducers). Many such inducers cause DSBs to occur indiscriminately in the genome, and DSBs are regularly being induced and repaired in normal cells. During repair, the original sequence may be reconstructed with complete fidelity, however, in some cases, small insertions or deletions (referred to as "indels") are introduced at the DSB site.

DSBs may also be specifically induced at particular locations, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems such as Crispr in which homology directed repair (HDR) is used to insert a sequence of interest, provided through use of a "donor" polynucleotide, into a desired chromosomal location.

Regions of homology between particular sequences, which can be small regions of "microhomology" that may comprise as few as ten basepairs or less, can also be used to bring about desired deletions. For example, in the case of the so-called "small deletion" exemplified herein, a single DSB is introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process. In the case of this small deletion, which is in the upstream region of the γ-globin gene as illustrated in FIG. 14B, the result of the deletion is to increase levels of HbF, apparently through disruption of a gene silencing sequence.

In some circumstances, however, selecting target sequences within regions of homology can also give rise to much larger deletions including gene fusions (when the deletions are in coding regions), which may or may not be desired given the particular circumstances. For example, as illustrated in FIG. 14D, the homologies that exist between the two closely-related γ-globin genes HBG1 and HBG2 can give rise to large deletions arising through homologous recombination between more distal sites of homology.

The examples provided herein further illustrate the selection of various target regions for the creation of DSBs designed to induce deletions that result in the increase of HbF levels in human cells, as well as the selection of specific target sequences within such regions that are designed to minimize off-target events relative to on-target events.

Human Cells

For ameliorating hemoglobinopathies, as described and illustrated herein, the principal targets for gene editing will be human cells which, after being modified using the techniques as described, can give rise to red blood cells (RBCs) with increased levels of HbF in a patient suffering from a hemoglobinopathy such as β-thalassemia or sickle cell disease.

As described herein and in the art, even relatively modest and incremental increases in levels of HbF in a patient suffering from a hemoglobinopathy such as β-thalassemia or sickle cell disease can be beneficial for improvement of symptoms and/or survival. In some embodiments, the levels of HbF achieved will tend toward those observed in patients with HPFH, which vary among patients and type of HPFH but in a substantial number of cases result in HbF comprising in the range of 10-30% of total hemoglobin (versus 1-2% in typical adults). However, studies have shown that lower levels of HbF can nevertheless have effects that are significant enough to be regarded as decreasing overall mortality expectations among groups of patients with SCD; see, e.g., Platt et al., *N Engl J Med.* 330(23): 1639-1644 (1994). And even modest improvements of symptoms can have beneficial effects for patients. For example, a reduction in the need for transfusions, a lessening of the incidence or severity of one or more symptoms of a hemoglobinopathy, or a reduction of side effects as a result of reduced levels or frequency of treatments or procedures can all be meaningful and beneficial for patients. Accordingly, in some embodiments, the increase in HbF may be in the range of about 80%, 60%, 40% or 20% of the levels of HbF observed in patients with HPFH. Further considerations regarding levels of HbF that may be achieved are provided herein, including the detailed description and examples, as supplemented by references cited herein and/or published in the art.

By performing gene editing as described herein in progenitor cells such as erythroid progenitor cells, such as autologous progenitor cells that are derived from and therefore already completely matched with the patient in need, it is possible to generate cells that can be safely reintroduced into a patient and effectively give rise to a population of circulating RBCs that will be effective in ameliorating one or more clinical conditions associated with the patient's disease.

While the presence of significant numbers of RBCs having elevated levels of HbF is beneficial, in some embodiments more than one quarter of circulating red blood cells (RBCs) will have significantly elevated levels of HbF, in some embodiments at least half of circulating RBCs will have significantly elevated levels of HbF, and in some embodiments at least 80% of circulating RBCs will have significantly elevated levels of HbF in order to effectively prevent clinical erythrocyte sickling.

Progenitor cells (also referred to as stem cells herein), such as erythroid or hematopoietic progenitor cells, are capable of both proliferation and giving rise to more progenitor cells, these in turn having the ability to generate a large number of mother cells that can in turn give rise to differentiated or differentiable daughter cells. The daughter cells themselves can be induced to proliferate and produce progeny that subsequently differentiate into one or more mature cell types, while also retaining one or more cells with parental developmental potential. The term "stem cell" refers then, to a cell with the capacity or potential, under particular circumstances, to differentiate to a more specialized or differentiated phenotype, and which retains the capacity, under certain circumstances, to proliferate without substantially differentiating. In one embodiment, the term progenitor or stem cell refers to a generalized mother cell whose descendants (progeny) specialize, often in different directions, by differentiation, e.g., by acquiring completely individual characters, as occurs in progressive diversification of embryonic cells and tissues. Cellular differentiation is a complex process typically occurring through many cell divisions. A differentiated cell may derive from a multipotent cell which itself is derived from a multipotent cell, and so on. While each of these multipotent cells may be considered stem cells, the range of cell types each can give rise to may vary considerably. Some differentiated cells also have the capacity to give rise to cells of greater developmental potential. Such capacity may be natural or may be induced artificially upon treatment with various factors. In many biological instances, stem cells are also "multipotent" because they can produce progeny of more than one distinct cell type, but this is not required for "stem-ness."

Self-renewal is another important aspect of the stem cell, as used in this document. In theory, self-renewal can occur by either of two major mechanisms. Stem cells may divide asymmetrically, with one daughter retaining the stem state and the other daughter expressing some distinct other specific function and phenotype. Alternatively, some of the stem cells in a population can divide symmetrically into two stems, thus maintaining some stem cells in the population as a whole, while other cells in the population give rise to differentiated progeny only. Generally, "progenitor cells" have a cellular phenotype that is more primitive (i.e., is at an earlier step along a developmental pathway or progression than is a fully differentiated cell). Often, progenitor cells also have significant or very high proliferative potential. Progenitor cells can give rise to multiple distinct differentiated cell types or to a single differentiated cell type, depending on the developmental pathway and on the environment in which the cells develop and differentiate.

In the context of cell ontogeny, the adjective "differentiated," or "differentiating" is a relative term. A "differentiated cell" is a cell that has progressed further down the developmental pathway than the cell to which it is being compared. Thus, stem cells can differentiate to lineage-restricted precursor cells (such as a hematopoietic progenitor cell), which in turn can differentiate into other types of precursor cells further down the pathway (such as an erythrocyte precursor), and then to an end-stage differentiated cell, such as an erythrocyte, which plays a characteristic role in a certain tissue type, and may or may not retain the capacity to proliferate further.

"Hematopoietic progenitor cell" as the term is used herein, refers to cells of a stem cell lineage that give rise to all the blood cell types including the erythroid (erythrocytes or red blood cells (RBCs)), myeloid (monocytes and macrophages, neutrophils, basophils, eosinophils, megakaryocytes/platelets, and dendritic cells), and lymphoid (T-cells, B-cells, NK-cells).

A "cell of the erythroid lineage" indicates that the cell being contacted is a cell that undergoes erythropoiesis such that upon final differentiation it forms an erythrocyte or red blood cell. Such cells originate from bone marrow hematopoietic progenitor cells. Upon exposure to specific growth factors and other components of the hematopoietic microenvironment, hematopoietic progenitor cells can mature through a series of intermediate differentiation cellular types, all intermediates of the erythroid lineage, into RBCs. Thus, cells of the "erythroid lineage," as the term is used herein, comprise hematopoietic progenitor cells, rubriblasts, prorubricytes, erythroblasts, metarubricytes, reticulocytes, and erythrocytes.

In some embodiments, the hematopoietic progenitor cell has at least one of the cell surface marker characteristic of hematopoietic progenitor cells: CD34+, CD59+, Thy1/CD90+, CD38lo/−, and C-kit/CDI 17+. In some embodiments, the hematopoietic progenitor are CD34+.

In some embodiments, the hematopoietic progenitor cell is a peripheral blood stem cell obtained from the patient after the patient has been treated with granulocyte colony stimulating factor (optionally in combination with Plerixaflor). In illustrative embodiments, CD34+ cells are enriched using CliniMACS® Cell Selection System (Miltenyi Biotec). In some embodiments, CD34+ cells are weakly stimulated in serum-free medium (e.g., CellGrow SCGM media, CellGenix) with cytokines (e.g., SCF, rhTPO, rhFLT3) before genome editing. In some embodiments, addition of SR1 and dmPGE2 and/or other factors is contemplated to improve long-term engraftment.

In some embodiments, the hematopoietic progenitor cells of the erythroid lineage have the cell surface marker characteristic of the erythroid lineage: such as CD71 and Ter119.

Induced Pluripotent Stem Cells

In some embodiments, the genetically engineered human cells described herein are derived from induced pluripotent stem cells (iPSCs). An advantage of using iPSCs is that the cells can be derived from the same subject to which the progenitor cells are to be administered. That is, a somatic cell can be obtained from a subject, reprogrammed to an induced pluripotent stem cell, and then re-differentiated into a hematopoietic progenitor cell to be administered to the subject (e.g., autologous cells). Since the progenitors are essentially derived from an autologous source, the risk of engraftment rejection or allergic responses is reduced compared to the use of cells from another subject or group of subjects. In some embodiments, the hematopoietic progenitors are derived from non-autologous sources. In addition, the use of iPSCs negates the need for cells obtained from an embryonic source. Thus, in one embodiment, the stem cells used in the disclosed methods are not embryonic stem cells.

Although differentiation is generally irreversible under physiological contexts, several methods have been recently developed to reprogram somatic cells to iPSCs. Exemplary methods are known to those of skill in the art and are described briefly herein below.

As used herein, the term "reprogramming" refers to a process that alters or reverses the differentiation state of a differentiated cell (e.g., a somatic cell). Stated another way, reprogramming refers to a process of driving the differentiation of a cell backwards to a more undifferentiated or more primitive type of cell. It should be noted that placing many primary cells in culture can lead to some loss of fully differentiated characteristics. Thus, simply culturing such cells included in the term differentiated cells does not render these cells non-differentiated cells (e.g., undifferentiated cells) or pluripotent cells. The transition of a differentiated cell to pluripotency requires a reprogramming stimulus beyond the stimuli that lead to partial loss of differentiated character in culture. Reprogrammed cells also have the characteristic of the capacity of extended passaging without loss of growth potential, relative to primary cell parents, which generally have capacity for only a limited number of divisions in culture.

The cell to be reprogrammed can be either partially or terminally differentiated prior to reprogramming. In some embodiments, reprogramming encompasses complete reversion of the differentiation state of a differentiated cell (e.g., a somatic cell) to a pluripotent state or a multipotent state. In some embodiments, reprogramming encompasses complete or partial reversion of the differentiation state of a differentiated cell (e.g., a somatic cell) to an undifferentiated cell (e.g., an embryonic-like cell). Reprogramming can result in expression of particular genes by the cells, the expression of which further contributes to reprogramming. In certain embodiments described herein, reprogramming of a differentiated cell (e.g., a somatic cell) causes the differentiated cell to assume an undifferentiated state (e.g., is an undifferentiated cell). The resulting cells are referred to as "reprogrammed cells," or "induced pluripotent stem cells (iPSCs or iPS cells)."

Reprogramming can involve alteration, e.g., reversal, of at least some of the heritable patterns of nucleic acid modification (e.g., methylation), chromatin condensation, epigenetic changes, genomic imprinting, etc., that occur during cellular differentiation. Reprogramming is distinct from simply maintaining the existing undifferentiated state of a cell that is already pluripotent or maintaining the existing less than fully differentiated state of a cell that is already a multipotent cell (e.g., a hematopoietic stem cell). Reprogramming is also distinct from promoting the self-renewal or proliferation of cells that are already pluripotent or multipotent, although the compositions and methods described herein can also be of use for such purposes, in some embodiments.

The specific approach or method used to generate pluripotent stem cells from somatic cells is not critical to the claimed invention. Thus, any method that reprograms a somatic cell to the pluripotent phenotype would be appropriate for use in the methods described herein.

Reprogramming methodologies for generating pluripotent cells using defined combinations of transcription factors have been described. Mouse somatic cells can be converted to ES cell-like cells with expanded developmental potential by the direct transduction of Oct4, Sox2, Klf4, and c-Myc; see, e.g., Takahashi and Yamanaka, *Cell* 126(4): 663-76 (2006). iPSCs resemble ES cells as they restore the pluripotency-associated transcriptional circuitry and much of the epigenetic landscape. In addition, mouse iPSCs satisfy all the standard assays for pluripotency: specifically, in vitro differentiation into cell types of the three germ layers, teratoma formation, contribution to chimeras, germline transmission [see, e.g., Maherali and Hochedlinger, *Cell Stem Cell.* 3(6):595-605 (2008)], and tetraploid complementation.

Human iPSCs can be obtained using similar transduction methods, and the transcription factor trio, OCT4, SOX2, and NANOG, has been established as the core set of transcription factors that govern pluripotency; see, e.g., Budniatzky and Gepstein, *Stem Cells Transl Med.* 3(4):448-57 (2014); Barrett et al., *Stem Cells Trans Med* 3:1-6 sctm.2014-0121 (2014); Focosi et al., *Blood Cancer Journal* 4: e211 (2014); and references cited therein. The production of iPSCs can be achieved by the introduction of nucleic acid sequences encoding stem cell-associated genes into an adult, somatic cell, historically using viral vectors.

iPSCs can be generated or derived from terminally differentiated somatic cells, as well as from adult stem cells, or somatic stem cells. That is, a non-pluripotent progenitor cell can be rendered pluripotent or multipotent by reprogramming. In such instances, it may not be necessary to include as many reprogramming factors as required to reprogram a terminally differentiated cell. Further, reprogramming can be induced by the non-viral introduction of reprogramming factors, e.g., by introducing the proteins themselves, or by introducing nucleic acids that encode the reprogramming factors, or by introducing messenger RNAs that upon translation produce the reprogramming factors (see e.g., Warren et al., *Cell Stem Cell,* 7(5):618-30 (2010). Reprogramming can be achieved by introducing a combination of nucleic acids encoding stem cell-associated genes including, for example Oct-4 (also known as Oct-3/4 or Pouf51), SoxI, Sox2, Sox3, Sox 15, Sox 18, NANOG, KlfI, Klf2, Klf4, Klf5, NR5A2, c-Myc, 1-Myc, n-Myc, Rem2, Tert, and LIN28. In one embodiment, reprogramming using the methods and compositions described herein can further comprise introducing one or more of Oct-3/4, a member of the Sox family, a member of the Klf family, and a member of the Myc family to a somatic cell. In one embodiment, the methods and compositions described herein further comprise introducing one or more of each of Oct 4, Sox2, Nanog, c-MYC and Klf4 for reprogramming. As noted above, the exact method used for reprogramming is not necessarily critical to the methods and compositions described herein. However, where cells differentiated from the reprogrammed cells are to be used in, e.g., human therapy, in one embodiment the reprogramming is not effected by a method that alters the genome. Thus, in such embodiments, reprogramming is achieved, e.g., without the use of viral or plasmid vectors.

The efficiency of reprogramming (i.e., the number of reprogrammed cells) derived from a population of starting cells can be enhanced by the addition of various small molecules as shown by Shi et al., *Cell-Stem Cell* 2:525-528 (2008); Huangfu et al., *Nature Biotechnology* 26(7):795-797 (2008) and Marson et al., *Cell-Stem Cell* 3: 132-135 (2008). Thus, an agent or combination of agents that enhance the efficiency or rate of induced pluripotent stem cell production can be used in the production of patient-specific or disease-specific iPSCs. Some non-limiting examples of agents that enhance reprogramming efficiency include soluble Wnt, Wnt conditioned media, BIX-01294 (a G9a histone methyltransferase), PD0325901 (a MEK inhibitor), DNA methyltransferase inhibitors, histone deacetylase (HDAC) inhibitors, valproic acid, 5'-azacytidine, dexamethasone, suberoylanilide, hydroxamic acid (SAHA), vitamin C, and trichostatin (TSA), among others.

Other non-limiting examples of reprogramming enhancing agents include: Suberoylanilide Hydroxamic Acid (SAHA (e.g., MK0683, vorinostat) and other hydroxamic acids), BML-210, Depudecin (e.g., (−)-Depudecin), HC Toxin, Nullscript (4-(I,3-Dioxo-IH,3H-benzo[de]isoquinolin-2-yl)-N-hydroxybutanamide), Phenylbutyrate (e.g., sodium phenylbutyrate) and Valproic Acid ((VPA) and other short chain fatty acids), Scriptaid, Suramin Sodium, Trichostatin A (TSA), APHA Compound 8, Apicidin, Sodium Butyrate, pivaloyloxymethyl butyrate (Pivanex, AN-9), Trapoxin B, Chlamydocin, Depsipeptide (also known as FR901228 or FK228), benzamides (e.g., CI-994 (e.g., N-acetyl dinaline) and MS-27-275), MGCD0103, NVP-LAQ-824, CBHA (m-carboxycinnaminic acid bishydroxamic acid), JNJ16241199, Tubacin, A-161906, proxamide, oxamflatin, 3-CI-UCHA (e.g., 6-(3-chlorophenylureido) caproic hydroxamic acid), AOE (2-amino-8-oxo-9, 10-epoxydecanoic acid), CHAP31 and CHAP 50. Other reprogramming enhancing agents include, for example, dominant negative forms of the HDACs (e.g., catalytically inactive forms), siRNA inhibitors of the HDACs, and antibodies that specifically bind to the HDACs. Such inhibitors are available, e.g., from BIOMOL International, Fukasawa, Merck Biosciences, Novartis, Gloucester Pharmaceuticals, Titan Pharmaceuticals, MethylGene, and Sigma Aldrich.

To confirm the induction of pluripotent stem cells for use with the methods described herein, isolated clones can be tested for the expression of a stem cell marker. Such expression in a cell derived from a somatic cell identifies the cells as induced pluripotent stem cells. Stem cell markers are selected from the non-limiting group including SSEA3, SSEA4, CD9, Nanog, FbxI5, EcatI, EsgI, Eras, Gdf3, Fgf4, Cripto, DaxI, Zpf296, Slc2a3, RexI, UtfI, and NatI. In one embodiment, a cell that expresses Oct4 or Nanog is identified as pluripotent. Methods for detecting the expression of such markers can include, for example, RT-PCR and immunological methods that detect the presence of the encoded polypeptides, such as Western blots or flow cytometric analyses. In some embodiments, detection does not involve only RT-PCR, but also includes detection of protein markers. Intracellular markers may be best identified via RT-PCR, or protein detection methods such as immunocytochemistry, while cell surface markers are readily identified, e.g., by immunochemistry.

The pluripotent stem cell character of isolated cells can be confirmed by tests evaluating the ability of the iPSCs to differentiate to cells of each of the three germ layers. As one example, teratoma formation in nude mice can be used to evaluate the pluripotent character of the isolated clones. The cells are introduced to nude mice and histology and/or immunohistochemistry is performed on a tumor arising from the cells. The growth of a tumor comprising cells from all three germ layers, for example, further indicates that the cells are pluripotent stem cells.

Genome Editing

Genome editing generally refers to the process of modifying the nucleotide sequence of a genome, preferably in a precise or predetermined manner. Examples of methods of genome editing described herein include methods of using site-directed nucleases to cut DNA at precise target locations in the genome, thereby creating double-strand or single-strand DNA breaks at particular locations within the genome. Such breaks can be and regularly are repaired by natural, endogenous cellular processes such as homology-directed repair (HDR) and non-homologous end-joining (NHEJ), as recently reviewed in Cox et al., *Nature Medicine* 21(2), 121-31 (2015). NHEJ directly joins the DNA ends resulting from a double-strand break sometimes with the loss or addition of nucleotide sequence which may disrupt or enhance gene expression. HDR utilizes a homologous sequence, or donor sequence, as a template for inserting a defined DNA sequence at the break point. The homologous sequence may be in the endogenous genome, such as a sister chromatid. Alternatively, the donor may be an exogenous nucleic acid such as a plasmid, a single-strand oligonucleotide, a duplex oligonucleotide or a virus, that has regions of high homology with the nuclease-cleaved locus, but which may also contain additional sequence or sequence changes including deletions that can be incorporated into the cleaved target locus. A third repair mechanism is microhomology-mediated end joining (MMEJ), also referred to as "Alternative NHEJ, in which the genetic outcome is similar to NHEJ in that small deletions and insertions can occur at the cleavage site. MMEJ makes use of homologous sequences of a few basepairs flanking the DNA break site to drive a more favored DNA end joining repair outcome, and recent reports have further elucidated the molecular mechanism of this process; see, e.g., Cho and Greenberg, *Nature* 518, 174-76 (2015); Kent et al., *Nature Structural and Molecular Biology*, Adv. Online doi:10.1038/nsmb.2961 (2015); Mateos-Gomez et al., *Nature* 518, 254-57 (2015); Ceccaldi et al., *Nature* 528, 258-62 (2015). In some instances it may be possible to predict likely repair outcomes based on analysis of potential microhomologies at the site of the DNA break.

Each of these genome editing mechanisms can be used to create desired genomic alterations. The first step in the genome editing process is to create typically one or two DNA breaks in the target locus as close as possible to the site of intended mutation. This can achieved via the use of targeted endonucleases, as described and illustrated herein.

Several distinct classes of nucleases have been engineered for use in genome editing. These include the zinc finger nucleases, transcription activator-like effector (TALE) nucleases, CRISPR/Cas nucleases, homing endonucleases (also termed meganucleases), and other nucleases; see, e.g., Hafez and Hausner, Genome 55, 553-69 (2012); Carroll, *Ann. Rev. Biochem.* 83, 409-39 (2014); Gupta and Musunuru, *J. Clin. Invest.* 124, 4154-61 (2014); and Cox et al., supra. These differ mainly in the way they bind DNA and create the targeted DNA double-strand (or single-strand) break (DSB). After creation of the DSB, essentially the same natural cellular DNA repair mechanisms of NHEJ or HDR are co-opted to achieve the desired genetic modification.

Therefore, it is contemplated that genome editing technologies using any of these nucleases can be used to achieve genetic and therapeutic outcomes described herein.

Zinc Finger Nucleases

Zinc finger nucleases (ZFNs) are modular proteins comprised of an engineered zinc finger DNA binding domain linked to the catalytic domain of the type II endonuclease FokI. Since FokI functions only as a dimer, a pair of ZFNs must be engineered to bind to cognate target "half-site" sequences on opposite DNA strands and with precise spacing between them to enable the catalytically active FokI dimer to form. Upon dimerization of the FokI domain, which itself has no sequence specificity per se, a DNA double-strand break is generated between the ZFN half-sites as the initiating step in genome editing.

The DNA binding domain of each ZFN is typically comprised of 3-6 zinc fingers of the abundant Cys2-His2 architecture, with each finger primarily recognizing a triplet of nucleotides on one strand of the target DNA sequence, although cross-strand interaction with a fourth nucleotide also can be important. Alteration of the amino acids of a finger in positions that make key contacts with the DNA alters the sequence specificity of a given finger. Thus, a four-finger zinc finger protein will selectively recognize a 12 bp target sequence, where the target sequence is a composite of the triplet preferences contributed by each finger, although triplet preference can be influenced to varying degrees by neighboring fingers. An important aspect then of ZFNs is that they can be readily retargeted to almost any genomic address simply by modifying individual fingers, although considerable expertise is required to do this well. In most applications of ZFNs, proteins of 4-6 fingers are used, recognizing 12-18 bp respectively. Hence, a pair of ZFNs will typically recognize a combined target sequence of 24-36 bp, not including the 5-7 bp spacer between half-sites. A target sequence of this length is likely to be unique in the human genome, assuming repetitive sequences or gene homologs are excluded during the design process. Nevertheless, the ZFN protein-DNA interactions are not absolute in their specificity and so off-target binding and cleavage events do occur, either as a heterodimer between the two ZFNs, or as a homodimer of one or other of the ZFNs. The latter possibility has been effectively eliminated by engineering the dimerization interface of the FokI domain to create "plus" and "minus" variants, also known as obligate heterodimer variants, which can only dimerize with each other and not with themselves. Forcing the obligate heterodimer prevents formation of the homodimer. This has greatly enhanced specificity of ZFNs as well as of any other nuclease that adopts these FokI variants.

A variety of ZFN-based systems have been described in the art, modifications thereof are regularly reported, and numerous references describe rules and parameters that are used to guide the design of ZFNs; see, e.g., Segal et al., *Proc Natl Acad Sci USA* 96(6):2758-63 (1999); Dreier B et al., *J Mol Biol.* 303(4):489-502 (2000); Liu Q et al., *J Biol Chem.* 277(6):3850-6 (2002); Dreier et al., *J Biol Chem* 280(42): 35588-97 (2005); and Dreier et al., *J Biol Chem.* 276(31): 29466-78 (2001).

Transcription Activator-Like Effector Nucleases (TALENs)

TALENs represent another format of modular nucleases whereby, as with ZFNs, an engineered DNA binding domain is linked to the FokI nuclease domain, and a pair of TALENs operate in tandem to achieve targeted DNA cleavage. The major difference from ZFNs is the nature of the DNA binding domain and the associated target DNA sequence recognition properties. The TALEN DNA binding domain derives from TALE proteins originally described in the plant bacterial pathogen *Xanthomonas* sp. TALEs are comprised of tandem arrays of 33-35 amino acid repeats, with each repeat recognizing a single basepair in the target DNA sequence that is typically up to 20 bp in length, giving a total target sequence length of up to 40 bp. Nucleotide specificity of each repeat is determined by the repeat variable diresidue (RVD) which includes just two amino acids at positions 12 and 13. The bases guanine, adenine, cytosine and thymine are predominantly recognized by the four RVDs Asn-Asn, Asn-Ile, His-Asp and Asn-Gly, respectively. This constitutes a much simpler recognition code than for zinc fingers and thus represents an advantage over the latter for nuclease design. Nevertheless, as with ZFNs, the protein-DNA interactions of TALENs are not absolute in their specificity and TALENs have also benefitted from use of the obligate heterodimer variants of the FokI domain to reduce off-target activity.

Additional variants of the FokI domain have been created that are deactivated in their catalytic function. If one half of either a TALEN or a ZFN pair contains an inactive FokI domain then only single-strand DNA cleavage (nicking) will occur at the target site rather than a DSB. The outcome is comparable to the use of CRISPR/Cas9 "nickase" mutants in which one of the Cas9 cleavage domains has been deactivated. DNA nicks can be used to drive genome editing by HDR, but at lower efficiency than with a DSB. The main benefit is that off-target nicks are quickly and accurately repaired, unlike the DSB which is prone to NHEJ-mediated mis-repair.

A variety of TALEN-based systems have been described in the art, and modifications thereof are regularly reported; see, e.g., Boch, *Science* 326(5959):1509-12 (2009); Mak et al., *Science* 335(6069):716-9 (2012); and Moscou et al., *Science* 326(5959):1501 (2009). The use of TALENs based on the "Golden Gate" platform has been described by multiple groups; see, e.g., Cermak et al., *Nucleic Acids Res.* 39(12):e82 (2011); Li et al., *Nucleic Acids Res.* 39(14):6315-25(2011); Weber et al., *PLoS One.* 6(2):e16765 (2011); Wang et al., *J Genet Genomics* 41(6):339-47, Epub 2014 May 17 (2014); and Cermak T et al., *Methods Mol Biol.* 1239:133-59 (2015).

Homing Endonucleases

Homing endonucleases (HE) are sequence-specific endonucleases that have long recognition sequences (14-44 base pairs) and cleave DNA with high specificity—often at sites unique in the genome. There are at least six known families of HE as classified by their structure, including LAGLIDADG (SEQ ID NO:161,199), GIY-YIG, His-Cis box, H-N-H, PD-(D/E)xK, and Vsr-like that are derived from a broad range of hosts including eukarya, protists, bacteria, archaea, cyanobacteria and phage. As with ZFNs and TALENs, HEs can be used to create a DSB at a target locus as the initial step in genome editing. In addition, some natural and engineered HEs cut only a single strand of the DNA, thereby functioning as site-specific nickases. The large target sequence of HEs and the specificity that offers has made them attractive candidates to create site-specific DSBs.

A variety of HE-based systems have been described in the art, and modifications thereof are regularly reported; see, e.g., the reviews by Steentoft et al., *Glycobiology* 24(8):663-80 (2014); Belfort and Bonocora, *Methods Mol Biol.* 1123: 1-26 (2014); Hafez and Hausner, *Genome* 55(8):553-69 (2012); and references cited therein.

MegaTAL/Tev-mTALEN/MegaTev

As further examples of hybrid nucleases, the MegaTAL platform and Tev-mTALEN platform use a fusion of the TALE DNA binding domains to catalytically active HEs, taking advantage of both the tunable DNA binding and specificity of the TALE as well as the cleavage sequence specificity of the HE; see, e.g., Boissel et al., *NAR* 42: 2591-2601 (2014); Kleinstiver et al., G3 4:1155-65 (2014); and Boissel and Scharenberg, *Methods Mol. Biol.* 1239: 171-96 (2015).

In a further variation, the MegaTev architecture is the fusion of a meganuclease (Mega) with the nuclease domain derived from the GIY-YIG homing endonuclease I-TevI (Tev). The two active sites are positioned ~30 bp apart on DNA substrate and generate two DSBs with non-compatible cohesive ends; see, e.g., Wolfs et al., *NAR* 42, 8816-29 (2014). It is anticipated that other combinations of existing nuclease-based approaches will evolve and be useful in achieving the targeted genome modifications described herein.

dCas9-FokI and Other Nucleases

Combining the structural and functional properties of the nuclease platforms described above offers a further approach to genome editing that can potentially overcome some of the inherent deficiencies. As an example, the CRISPR genome editing system typically uses a single Cas9 endonuclease to create the DSB. The specificity of targeting is driven by a 20 nucleotide sequence in the guide RNA that undergoes Watson-Crick base-pairing with the target DNA (plus an additional 2 bases in the adjacent NAG or NGG PAM sequence in the case of Cas9 from *S. pyogenes*). Such a sequence is long enough to be unique in the human genome, however, the specificity of the RNA/DNA interaction is not absolute, with significant promiscuity sometimes tolerated particularly in the 5' half of the target sequence, effectively reducing the number of bases that drive specificity. One solution to this has been to completely deactivate the Cas9 catalytic function—retaining only the RNA-guided DNA binding function—and instead fusing a FokI domain to the deactivated Cas9; see, e.g., Tsai et al., *Nature Biotech* 32: 569-76 (2014); and Guilinger et al., *Nature Biotech.* 32: 577-82 (2014). Since FokI must dimerize to become catalytically active, two guide RNAs are required to tether two Cas9-FokI fusions in close proximity to form the dimer and cleave DNA. This essentially doubles the number of bases in the combined target sites, thereby increasing the stringency of targeting by CRISPR-based systems.

As further example, fusion of the TALE DNA binding domain to a catalytically active HE such as I-TevI takes advantage of both the tunable DNA binding and specificity of the TALE as well as the cleavage sequence specificity of I-TevI, with the expectation that off-target cleavage may be further reduced.

CRISPR/Cas Endonuclease System

A CRISPR (Clustered Regularly Interspaced Short Palindromic Repeats) genomic locus can be found in the genomes of many prokaryotes (e.g., bacteria and archaea). In prokaryotes, the CRISPR locus encodes products that function as a type of immune system to help defend the prokaryotes against foreign invaders such as virus and phage. There are three stages of CRISPR locus function: integration of new sequences into the locus, biogenesis of CRISPR RNA (crRNA), and silencing of foreign invader nucleic acid. Four types of CRISPR systems (e.g., Type I, Type II, Type III, Type U) have been identified.

A CRISPR locus includes a number of short repeating sequences referred to as "repeats." The repeats can form hairpin structures and/or comprises unstructured single-stranded sequences. The repeats usually occur in clusters and frequently diverge between species. The repeats are regularly interspaced with unique intervening sequences referred to as "spacers," resulting in a repeat-spacer-repeat locus architecture. The spacers are identical to or have high homology with known foreign invader sequences. A spacer-repeat unit encodes a crisprRNA (crRNA), which is processed into a mature form of the spacer-repeat unit. A crRNA comprises a "seed" or spacer sequence that is involved in targeting a target nucleic acid (in the naturally occurring form in prokaryotes the spacer sequence targets the foreign invader nucleic acid). A spacer sequence is located at the 5' or 3' end of the crRNA.

A CRISPR locus also comprises polynucleotide sequences encoding Crispr Associated (Cas) genes. Cas genes encode endonucleases involved in the biogenesis and the interference stages of crRNA function in prokaryotes. Some Cas genes comprises homologous secondary and/or tertiary structures.

Type II CRISPR Systems crRNA biogenesis in a Type II CRISPR system in nature requires a trans-activating CRISPR RNA (tracrRNA). The tracrRNA is modified by endogenous RNaseIII and then hybridizes to a crRNA repeat in the pre-crRNA array. Endogenous RNaseIII is recruited to cleave the pre-crRNA. Cleaved crRNAs are subjected to exoribonuclease trimming to produce the mature crRNA form (e.g., 5' trimming). The tracrRNA remains hybridized to the crRNA, and the tracrRNA and the crRNA associate with a site-directed polypeptide (e.g., Cas9). The crRNA of the crRNA-tracrRNA-Cas9 complex guides the complex to a target nucleic acid to which the crRNA can hybridize. Hybridization of the crRNA to the target nucleic acid activates Cas9 for targeted nucleic acid cleavage. The target nucleic acid in a Type II CRISPR system is referred to as a protospacer adjacent motif (PAM). In nature, the PAM is essential to facilitate binding of a site-directed polypeptide (e.g., Cas9) to the target nucleic acid. Type II systems (also referred to as Nmeni or CASS4) are further subdivided into Type II-A (CASS4) and II-B (CASS4a). Jinek et al., *Science,* 337 (6096):816-821 (2012) showed the CRISPR/Cas9 system is useful for RNA-programmable genome editing, and WO2013/176772 provides numerous examples and applications of the CRISPR/Cas endonuclease system for site-specific gene editing.

Cas Genes/Polypeptides and Protospacer Adjacent Motifs

Exemplary CRISPR Cas polypeptides include Cas9 polypeptides in FIG. 1 of Fonfara et al., *Nucleic Acids Research,* 42: 2577-2590 (2014). The CRISPR-Cas gene naming system has undergone extensive rewriting since the Cas genes were discovered. FIG. 5 of Fonfara, supra, provides PAM sequences for Cas9 polypeptides from various species.

Site-Directed Polypeptides

A site-directed polypeptide in the present disclosure is a nuclease used in genome editing to cleave DNA.

In the context of a CRISPR/Cas system herein, the site-directed polypeptide can bind to a guide RNA that, in turn, specifies the site in the target DNA to which the polypeptide is directed. In embodiments of CRISPR/Cas systems herein, the site-directed polypeptide is an endonuclease.

In some embodiments, a site-directed polypeptide comprises a plurality of nucleic acid-cleaving (i.e., nuclease) domains. Two or more nucleic acid-cleaving domains can be linked together via a linker. In some embodiments, the linker comprises a flexible linker. Linkers comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length.

Naturally-occurring wild-type Cas9 enzymes comprise two nuclease domains, an HNH nuclease domain and a RuvC domain. Herein, the "Cas9" refers to both naturally-occurring and recombinant Cas9s. Cas9 enzymes contemplated herein comprises a HNH or HNH-like nuclease domain and/or a RuvC or RuvC-like nuclease domain.

HNH or HNH-like domains comprise a McrA-like fold. HNH or HNH-like domains comprises two antiparallel β-strands and an α-helix. HNH or HNH-like domains comprises a metal binding site (e.g., divalent cation binding site). HNH or HNH-like domains can cleave one strand of a target nucleic acid (e.g., complementary strand of the crRNA targeted strand).

RuvC or RuvC-like domains comprise an RNaseH or RNaseH-like fold. RuvC/RNaseH domains are involved in a diverse set of nucleic acid-based functions including acting on both RNA and DNA. The RNaseH domain comprises 5 β-strands surrounded by a plurality of α-helices. RuvC/RNaseH or RuvC/RNaseH-like domains comprise a metal binding site (e.g., divalent cation binding site). RuvC/RNaseH or RuvC/RNaseH-like domains can cleave one strand of a target nucleic acid (e.g., non-complementary strand of double-stranded target DNA).

Site-directed polypeptides can introduce double-strand breaks or single-strand breaks in nucleic acid, (e.g., genomic DNA). The double-strand break can stimulate a cell's endogenous DNA-repair pathways (e.g., homology-dependent repair (HDR) and non-homologous end joining (NHEJ) or alternative non-homologous end joining (A-NHEJ) or microhomology-mediated end joining (MMEJ)). NHEJ can repair cleaved target nucleic acid without the need for a homologous template. This can sometimes result in small deletions or insertions (indels) in the target nucleic acid at the site of cleavage and can lead to disruption or alteration of gene expression. HDR can occur when a homologous repair template, or donor, is available. The homologous donor template comprises sequences that are homologous to sequences flanking the target nucleic acid cleavage site. The sister chromatid is generally used by the cell as the repair template. However, for the purposes of genome editing, the repair template is often supplied as an exogenous nucleic acid, such as a plasmid, duplex oligonucleotide, single-strand oligonucleotide or viral nucleic acid. With exogenous donor templates it is common to introduce additional nucleic acid sequence (such as a transgene) or modification (such as a single base change or a deletion) between the flanking regions of homology so additional or altered nucleic acid sequence also becomes incorporated into the target locus. MMEJ results in a genetic outcome that is similar to NHEJ in that small deletions and insertions can occur at the cleavage site. MMEJ makes use of homologous sequences of a few basepairs flanking the cleavage site to drive a favored end-joining DNA repair outcome. In some instances it may be possible to predict likely repair outcomes based on analysis of potential microhomologies in the nuclease target regions.

Thus, in some cases, homologous recombination is used to insert an exogenous polynucleotide sequence into the target nucleic acid cleavage site. An exogenous polynucleotide sequence is termed a donor polynucleotide herein. In some embodiments, the donor polynucleotide, a portion of the donor polynucleotide, a copy of the donor polynucleotide, or a portion of a copy of the donor polynucleotide is inserted into the target nucleic acid cleavage site. In some embodiments, the donor polynucleotide is an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

In some embodiments, the site-directed polypeptide comprises an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100%, amino acid sequence identity to a wild type exemplary site-directed polypeptide [e.g., Cas9 from *S. pyogenes*, US2014/0068797 Sequence ID No. 8 or Sapranauskas et al., *Nucleic Acids Res*, 39(21): 9275-9282 (2011)], and various other site-directed polypeptides).

In some embodiments, the site-directed polypeptide comprises an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100%, amino acid sequence identity to the nuclease domain of a wild type exemplary site-directed polypeptide (e.g., Cas9 from *S. pyogenes*, supra).

In some embodiments, a site-directed polypeptide comprises at least 70, 75, 80, 85, 90, 95, 97, 99, or 100% identity to wild-type site-directed polypeptide (e.g., Cas9 from *S. pyogenes*, supra) over 10 contiguous amino acids. In some embodiments, a site-directed polypeptide comprises at most: 70, 75, 80, 85, 90, 95, 97, 99, or 100% identity to wild-type site-directed polypeptide (e.g., Cas9 from *S. pyogenes*, supra) over 10 contiguous amino acids. In some embodiments, a site-directed polypeptide comprises at least: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. In some embodiments, a site-directed polypeptide comprises at most: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. In some embodiments, a site-directed polypeptide comprises at least: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide. In some embodiments, a site-directed polypeptide comprises at most: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide.

In some embodiments, the site-directed polypeptide comprises a modified form of a wild type exemplary site-directed polypeptide. The modified form of the wild type exemplary site-directed polypeptide comprises a mutation that reduces the nucleic acid-cleaving activity of the site-directed polypeptide. In some embodiments, the modified form of the wild type exemplary site-directed polypeptide has less than 90%, less than 80%, less than 70%, less than 60%, less than 50%, less than 40%, less than 30%, less than 20%, less than 10%, less than 5%, or less than 1% of the nucleic acid-cleaving activity of the wild-type exemplary site-directed polypeptide (e.g., Cas9 from *S. pyogenes*, supra). The modified form of the site-directed polypeptide can have no substantial nucleic acid-cleaving activity. When a site-directed polypeptide is a modified form that has no substantial nucleic acid-cleaving activity, it is referred to herein as "enzymatically inactive."

In some embodiments, the modified form of the site-directed polypeptide comprises a mutation such that it can induce a single-strand break (SSB) on a target nucleic acid (e.g., by cutting only one of the sugar-phosphate backbones of a double-strand target nucleic acid). In some embodiments, the mutation results in less than 90%, less than 80%, less than 70%, less than 60%, less than 50%, less than 40%, less than 30%, less than 20%, less than 10%, less than 5%, or less than 1% of the nucleic acid-cleaving activity in one or more of the plurality of nucleic acid-cleaving domains of the wild-type site directed polypeptide (e.g., Cas9 from *S. pyogenes*, supra). In some embodiments, the mutation results in one or more of the plurality of nucleic acid-cleaving domains retaining the ability to cleave the complementary strand of the target nucleic acid but reducing its ability to cleave the non-complementary strand of the target nucleic acid. In some embodiments, the mutation results in one or more of the plurality of nucleic acid-cleaving domains retaining the ability to cleave the non-complementary strand of the target nucleic acid but reducing its ability to cleave the complementary strand of the target nucleic acid. For example, residues in the wild type exemplary *S. pyogenes* Cas9 polypeptide such as Asp10, His840, Asn854 and Asn856 are mutated to inactivate one or more of the plurality of nucleic acid-cleaving domains (e.g., nuclease domains). In some embodiments, the residues to be mutated correspond to residues Asp10, His840, Asn854 and Asn856 in the wild type exemplary *S. pyogenes* Cas9 polypeptide (e.g., as determined by sequence and/or structural alignment). Non-limiting examples of mutations can include D10A, H840A, N854A or N856A. One skilled in the art will recognize that mutations other than alanine substitutions are suitable.

In some embodiments, a D10A mutation is combined with one or more of H840A, N854A, or N856A mutations to produce a site-directed polypeptide substantially lacking DNA cleavage activity. In some embodiments, a H840A mutation is combined with one or more of D10A, N854A, or N856A mutations to produce a site-directed polypeptide substantially lacking DNA cleavage activity. In some embodiments, a N854A mutation is combined with one or more of H840A, D10A, or N856A mutations to produce a site-directed polypeptide substantially lacking DNA cleavage activity. In some embodiments, a N856A mutation is combined with one or more of H840A, N854A, or D10A mutations to produce a site-directed polypeptide substantially lacking DNA cleavage activity. Site-directed polypeptides that comprise one substantially inactive nuclease domain are referred to herein as nickases.

Nickase variants of Cas9 can be used to increase the specificity of CRISPR-mediated genome editing. Wild type Cas9 is typically guided by a single guide RNA designed to hybridize with a specified ~20nt sequence in the target sequence (such as an endogenous genomic locus). However, several mismatches can be tolerated between the guide RNA and the target locus, effectively reducing the length of required homology in the target site to, for example, as little as 13nt of homology and thereby resulting in elevated potential for binding and double-strand nucleic acid cleavage by the CRISPR/Cas9 complex elsewhere in the target genome—also known as off-target cleavage. Since nickase variants of Cas9 each only cut one strand, in order to create a double-strand break it is necessary for a pair of nickases to bind in close proximity and on opposite strands of the target nucleic acid, thereby creating a pair of nicks, which is the equivalent of a double-strand break. This requires that two separate guide RNAs—one for each nickase—must bind in close proximity and on opposite strands of the target nucleic acid. This requirement essentially doubles the minimum length of homology needed for the double-strand break to occur, thereby reducing the likelihood that a double-strand cleavage event will occur elsewhere in the genome, where the two guide RNA sites—if they exist—are unlikely to be sufficiently close to each other to enable the double-strand break to form. As described in the art, nickases can also be used to promote HDR versus NHEJ. HDR can be used to introduce selected changes into target sites in the genome through the use of specific donor sequences that effectively mediate the desired changes. Descriptions of various Crispr-Cas systems for use in gene editing can be found, e.g., in WO2013/176772, and in *Nature Biotechnology* 32, 347-355 (2014), and references cited therein.

Mutations contemplated include substitutions, additions, and deletions, or any combination thereof. In some embodiments, the mutation converts the mutated amino acid to alanine. In some embodiments, the mutation converts the mutated amino acid to another amino acid (e.g., glycine, serine, threonine, cysteine, valine, leucine, isoleucine, methionine, proline, phenylalanine, tyrosine, tryptophan, aspartic acid, glutamic acid, asparagines, glutamine, histidine, lysine, or arginine). In some embodiments, the mutation converts the mutated amino acid to a non-natural amino acid (e.g., selenomethionine). In some embodiments, the mutation converts the mutated amino acid to amino acid mimics (e.g., phosphomimics). In some embodiments, the mutation is a conservative mutation. For example, the mutation can convert the mutated amino acid to amino acids that resemble the size, shape, charge, polarity, conformation, and/or rotamers of the mutated amino acids (e.g., cysteine/serine mutation, lysine/asparagine mutation, histidine/phenylalanine mutation). In some embodiments, the mutation causes a shift in reading frame and/or the creation of a premature stop codon. In some embodiments mutations cause changes to regulatory regions of genes or loci that affect expression of one or more genes.

In some embodiments, the site-directed polypeptide (e.g., variant, mutated, enzymatically inactive and/or conditionally enzymatically inactive site-directed polypeptide) targets nucleic acid. In some embodiments, the site-directed polypeptide (e.g., variant, mutated, enzymatically inactive and/or conditionally enzymatically inactive endoribonuclease) can target RNA.

In some embodiments, the site-directed polypeptide comprises one or more non-native sequences (e.g., the site-directed polypeptide is a fusion protein).

In some embodiments, the site-directed polypeptide comprises an amino acid sequence comprising at least 15% amino acid identity to a Cas9 from a bacterium (e.g., *S. pyogenes*), a nucleic acid binding domain, and two nucleic acid cleaving domains (i.e., an HNH domain and a RuvC domain).

In some embodiments, the site-directed polypeptide comprises an amino acid sequence comprising at least 15% amino acid identity to a Cas9 from a bacterium (e.g., *S. pyogenes*), and two nucleic acid cleaving domains (i.e., an HNH domain and a RuvC domain).

In some embodiments, the site-directed polypeptide comprises an amino acid sequence comprising at least 15% amino acid identity to a Cas9 from a bacterium (e.g., *S.*

*pyogenes*), and two nucleic acid cleaving domains, wherein one or both of the nucleic acid cleaving domains comprise at least 50% amino acid identity to a nuclease domain from Cas9 from a bacterium (e.g., *S. pyogenes*).

In some embodiments, the site-directed polypeptide comprises an amino acid sequence comprising at least 15% amino acid identity to a Cas9 from a bacterium (e.g., *S. pyogenes*), two nucleic acid cleaving domains (i.e., an HNH domain and a RuvC domain), and non-native sequence (for example, a nuclear localization signal) or a linker linking the site-directed polypeptide to a non-native sequence.

In some embodiments, the site-directed polypeptide comprises an amino acid sequence comprising at least 15% amino acid identity to a Cas9 from a bacterium (e.g., *S. pyogenes*), two nucleic acid cleaving domains (i.e., an HNH domain and a RuvC domain), wherein the site-directed polypeptide comprises a mutation in one or both of the nucleic acid cleaving domains that reduces the cleaving activity of the nuclease domains by at least 50%.

In some embodiments, the site-directed polypeptide comprises an amino acid sequence comprising at least 15% amino acid identity to a Cas9 from a bacterium (e.g., *S. pyogenes*), and two nucleic acid cleaving domains (i.e., an HNH domain and a RuvC domain), wherein one of the nuclease domains comprises mutation of aspartic acid 10, and/or wherein one of the nuclease domains comprises mutation of histidine 840, and wherein the mutation reduce the cleaving activity of the nuclease domain(s) by at least 50%.

Nucleic Acid-Targeting Nucleic Acid

The present disclosure provides a nucleic acid-targeting nucleic acid that can direct the activities of an associated polypeptide (e.g., a site-directed polypeptide) to a specific target sequence within a target nucleic acid. In some embodiments, the nucleic acid-targeting nucleic acid is an RNA. A nucleic acid-targeting RNA is referred to as a "guide RNA" herein. A guide RNA comprises at least a spacer sequence that hybridizes to a target nucleic acid sequence of interest, a CRISPR repeat sequence and a tracrRNA sequence. In the guide RNA, the CRISPR repeat sequence and tracrRNA sequence hybridize to each other to form a duplex. The duplex binds a site-directed polypeptide such that the guide RNA and site-direct polypeptide form a complex. The nucleic acid-targeting nucleic acid provides target specificity to the complex by virtue of its association with the site-directed polypeptide. The nucleic acid-targeting nucleic acid thus directs the activity of the site-directed polypeptide.

gRNA spacer sequences for targeting the globin locus have been identified in SEQ ID NOs:1-161,197 and 161, 200-161,312.

In some embodiments, the nucleic acid-targeting nucleic acid is a double-molecule guide RNA. In some embodiments, the nucleic acid-targeting nucleic acid is a single-molecule guide RNA.

A double-molecule guide RNA comprises two strands of RNA. The first strand comprises in the 5' to 3' direction, an optional spacer extension sequence, a spacer sequence and a minimum CRISPR repeat sequence. The second strand comprises a minimum tracrRNA sequence (complementary to the minimum CRISPR repeat sequence), a 3' tracrRNA sequence and an optional tracrRNA extension sequence.

A single-molecule guide RNA comprises in the 5' to 3' direction, an optional spacer extension sequence, a spacer sequence, a minimum CRISPR repeat sequence, a single-molecule guide linker, a minimum tracrRNA sequence, a 3' tracrRNA sequence and an optional tracrRNA extension sequence. The optional tracrRNA extension may comprise elements that contribute additional functionality (e.g., stability) to the guide RNA. The single-molecule guide linker links the minimum CRISPR repeat and the minimum tracrRNA sequence to form a hairpin structure. The optional tracrRNA extension comprises one or more hairpins.

By way of illustration, guide RNAs used in the Crispr-Cas system, or other smaller RNAs can be readily synthesized by chemical means as illustrated below and described in the art. While chemical synthetic procedures are continually expanding, purifications of such RNAs by procedures such as high performance liquid chromatography (H PLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 endonuclease, are more readily generated enzymatically. Various types of RNA modifications can be introduced during or after chemical synthesis and/or enzymatic generation of RNAs, e.g., modifications that enhance stability, reduced the likelihood or degree of innate immune response, and/or enhance other attributes, as described in the art.

Spacer Extension Sequence

In some embodiments of nucleic acid-targeting nucleic acids, a spacer extension sequence can provide stability and/or provide a location for modifications of a nucleic acid-targeting nucleic acid. In some embodiments, a spacer extension sequence is provided. A spacer extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, or 7000 or more nucleotides. A spacer extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, 7000 or more nucleotides. In some embodiments, a spacer extension sequence comprises less than 10 nucleotides in length. In some embodiments, a spacer extension sequence comprises between 10 and 30 nucleotides in length. In some embodiments, a spacer extension sequence comprises between 30-70 nucleotides in length.

In some embodiments, the spacer extension sequence comprises another moiety (e.g., a stability control sequence, an endoribonuclease binding sequence, a ribozyme). In some embodiments, the moiety increases the stability of a nucleic acid targeting nucleic acid. In some embodiments, the moiety is a transcriptional terminator segment (i.e., a transcription termination sequence). In some embodiments, the moiety functions in a eukaryotic cell. In some embodiments, the moiety functions in a prokaryotic cell. In some embodiments, the moiety functions in both eukaryotic and prokaryotic cells.

Non-limiting examples of suitable moieties include: 5' cap (e.g., a 7-methylguanylate cap (m7 G)), a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like).

Spacer Sequence

The spacer sequence hybridizes to a sequence in a target nucleic acid of interest. The spacer of a nucleic acid-targeting nucleic acid interacts with a target nucleic acid in a sequence-specific manner via hybridization (i.e., base pairing). The nucleotide sequence of the spacer thus varies depending on the sequence of the target nucleic acid of interest.

In a CRISPR/Cas system herein, the spacer sequence is designed to hybridize to a target nucleic acid that is located 5' of a PAM of the Cas9 enzyme used in the system. Each Cas9 enzyme has a particular PAM sequence it recognizes in target DNA. For example, S. pyogenes recognizes in a target nucleic acid a PAM that comprises the sequence 5'-NRG-3', where R comprises either A or G, where N is any nucleotide and N is immediately 3' of the target nucleic acid sequence targeted by the spacer sequence.

In some embodiments, the target nucleic acid sequence comprises 20 nucleotides. In some embodiments, the target nucleic acid comprises less than 20 nucleotides. In some embodiments, the target nucleic acid comprises at least: 5, 10, 15, 16, 17, 18, 19, 20, 21, 22, 23, 24, 25, 30 or more nucleotides. In some embodiments, the target nucleic acid comprises at most: 5, 10, 15, 16, 17, 18, 19, 20, 21, 22, 23, 24, 25, 30 or more nucleotides. In some embodiments, the target nucleic acid sequence comprises 20 bases immediately 5' of the first nucleotide of the PAM. For example, in a sequence comprising 5'-NNNNNNNNNNNNNNNNNNNNNRG-3' (SEQ ID NO:161,198), the target nucleic acid comprises the sequence that corresponds to the Ns, wherein N is any nucleotide.

In some embodiments, the spacer sequence that hybridizes to the target nucleic acid has a length at least about 6 nt. The spacer sequence can be at least about 6 nt, at least about 10 nt, at least about 15 nt, at least about 18 nt, at least about 19 nt, at least about 20 nt, at least about 25 nt, at least about 30 nt, at least about 35 nt or at least about 40 nt, from about 6 nt to about 80 nt, from about 6 nt to about 50 nt, from about 6 nt to about 45 nt, from about 6 nt to about 40 nt, from about 6 nt to about 35 nt, from about 6 nt to about 30 nt, from about 6 nt to about 25 nt, from about 6 nt to about 20 nt, from about 6 nt to about 19 nt, from about 10 nt to about 50 nt, from about 10 nt to about 45 nt, from about 10 nt to about 40 nt, from about 10 nt to about 35 nt, from about 10 nt to about 30 nt, from about 10 nt to about 25 nt, from about 10 nt to about 20 nt, from about 10 nt to about 19 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some embodiments, the spacer sequence comprises 20 nucleotides. In some embodiments, the spacer comprises 19 nucleotides.

In some embodiments, the percent complementarity between the spacer sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some embodiments, the percent complementarity between the spacer sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some embodiments, the percent complementarity between the spacer sequence and the target nucleic acid is 100% over the six contiguous 5'-most nucleotides of the target sequence of the complementary strand of the target nucleic acid. In some embodiments, the percent complementarity between the spacer sequence and the target nucleic acid is at least 60% over about 20 contiguous nucleotides.

In some embodiments, a spacer sequence is designed or chosen using a computer program. The computer program can use variables such as predicted melting temperature, secondary structure formation, and predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like.

Minimum CRISPR Repeat Sequence

In some embodiments, a minimum CRISPR repeat sequence is a sequence with at least: about 30%, about 40%, about 50%, about 60%, about 65%, about 70%, about 75%, about 80%, about 85%, about 90%, about 95%, or 100% sequence identity to a reference CRISPR repeat sequence (e.g., crRNA from S. pyogenes).

A minimum CRISPR repeat comprises nucleotides that can hybridize to a minimum tracrRNA sequence in a cell. The minimum CRISPR repeat and a minimum tracrRNA sequence form a duplex, i.e. a base-paired double-stranded structure. Together, the minimum CRISPR repeat and the minimum tracrRNA sequence bind to the site-directed polypeptide. At least a part of the minimum CRISPR repeat sequence hybridizes to the minimum tracrRNA sequence. In some embodiments, at least a part of the minimum CRISPR repeat sequence comprises at least: about 30%, about 40%, about 50%, about 60%, about 65%, about 70%, about 75%, about 80%, about 85%, about 90%, about 95%, or 100% complementary to the minimum tracrRNA sequence. In some embodiments, at least a part of the minimum CRISPR repeat sequence comprises at most: about 30%, about 40%, about 50%, about 60%, about 65%, about 70%, about 75%, about 80%, about 85%, about 90%, about 95%, or 100% complementary to the minimum tracrRNA sequence.

The minimum CRISPR repeat sequence can have a length of from about 7 nucleotides to about 100 nucleotides. For example, the length of the minimum CRISPR repeat sequence is from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt or from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt. In some embodiments, the minimum CRISPR repeat sequence is approximately 9 nucleotides in length. In some embodiments, the minimum CRISPR repeat sequence is approximately 12 nucleotides in length.

In some embodiments, the minimum CRISPR repeat sequence is at least about 60% identical to a reference minimum CRISPR repeat sequence (e.g., wild type crRNA from *S. pyogenes*) over a stretch of at least 6, 7, or 8 contiguous nucleotides. For example, the minimum CRISPR repeat sequence is at least about 65% identical, at least about 70% identical, at least about 75% identical, at least about 80% identical, at least about 85% identical, at least about 90% identical, at least about 95% identical, at least about 98% identical, at least about 99% identical or 100% identical to a reference minimum CRISPR repeat sequence over a stretch of at least 6, 7, or 8 contiguous nucleotides.

Minimum tracrRNA Sequence

In some embodiments, a minimum tracrRNA sequence is a sequence with at least: about 30%, about 40%, about 50%, about 60%, about 65%, about 70%, about 75%, about 80%, about 85%, about 90%, about 95%, or 100% sequence identity to a reference tracrRNA sequence (e.g., wild type tracrRNA from *S. pyogenes*).

A minimum tracrRNA sequence comprises nucleotides that hybridize to a minimum CRISPR repeat sequence in a cell. A minimum tracrRNA sequence and a minimum CRISPR repeat sequence form a duplex, i.e. a base-paired double-stranded structure. Together, the minimum tracrRNA sequence and the minimum CRISPR repeat bind to a site-directed polypeptide. At least a part of the minimum tracrRNA sequence can hybridize to the minimum CRISPR repeat sequence. In some embodiments, the minimum tracrRNA sequence is at least: about 30%, about 40%, about 50%, about 60%, about 65%, about 70%, about 75%, about 80%, about 85%, about 90%, about 95%, or 100% complementary to the minimum CRISPR repeat sequence.

The minimum tracrRNA sequence can have a length of from about 7 nucleotides to about 100 nucleotides. For example, the minimum tracrRNA sequence can be from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt or from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt long. In some embodiments, the minimum tracrRNA sequence is approximately 9 nucleotides in length. In some embodiments, the minimum tracrRNA sequence is approximately 12 nucleotides. In some embodiments, the minimum tracrRNA consists of tracrRNA nt 23-48 described in Jinek et al., supra.

In some embodiments, the minimum tracrRNA sequence is at least about 60% identical to a reference minimum tracrRNA (e.g., wild type, tracrRNA from *S. pyogenes*) sequence over a stretch of at least: 6, 7, or 8 contiguous nucleotides. For example, the minimum tracrRNA sequence is at least: about 65% identical, about 70% identical, about 75% identical, about 80% identical, about 85% identical, about 90% identical, about 95% identical, about 98% identical, about 99% identical or 100% identical to a reference minimum tracrRNA sequence over a stretch of at least: 6, 7, or 8 contiguous nucleotides.

In some embodiments, the duplex between the minimum CRISPR RNA and the minimum tracrRNA comprises a double helix. In some embodiments, the duplex between the minimum CRISPR RNA and the minimum tracrRNA comprises at least about: 1, 2, 3, 4, 5, 6, 7, 8, 9, or 10 or more nucleotides. In some embodiments, the duplex between the minimum CRISPR RNA and the minimum tracrRNA comprises at most about: 1, 2, 3, 4, 5, 6, 7, 8, 9, or 10 or more nucleotides.

In some embodiments, the duplex comprises a mismatch (i.e., the two strands of the duplex are not 100% complementary). In some embodiments, the duplex comprises at least about: 1, 2, 3, 4, or 5 or mismatches. In some embodiments, the duplex comprises at most about: 1, 2, 3, 4, or 5 or mismatches. In some embodiments, the duplex comprises no more than 2 mismatches.

Bulges

In some embodiments, there is a "bulge" in the duplex between the minimum CRISPR RNA and the minimum tracrRNA. The bulge is an unpaired region of nucleotides within the duplex. In some embodiments, the bulge contributes to the binding of the duplex to the site-directed polypeptide. A bulge comprises, on one side of the duplex, an unpaired 5'-XXXY-3' where X is any purine and Y comprises a nucleotide that can form a wobble pair with a nucleotide on the opposite strand, and an unpaired nucleotide region on the other side of the duplex. The number of unpaired nucleotides on the two sides of the duplex can be different.

In one example, the bulge comprises an unpaired purine (e.g., adenine) on the minimum CRISPR repeat strand of the bulge. In some embodiments, a bulge comprises an unpaired 5'-AAGY-3' of the minimum tracrRNA sequence strand of the bulge, where Y comprises a nucleotide that can form a wobble pairing with a nucleotide on the minimum CRISPR repeat strand.

In some embodiments, a bulge on the minimum CRISPR repeat side of the duplex comprises at least: 1, 2, 3, 4, or 5 or more unpaired nucleotides. In some embodiments, a bulge on the minimum CRISPR repeat side of the duplex comprises at most: 1, 2, 3, 4, or 5 or more unpaired nucleotides. In some embodiments, a bulge on the minimum CRISPR repeat side of the duplex comprises 1 unpaired nucleotide.

In some embodiments, a bulge on the minimum tracrRNA sequence side of the duplex comprises at least: 1, 2, 3, 4, 5, 6, 7, 8, 9, or 10 or more unpaired nucleotides. In some embodiments, a bulge on the minimum tracrRNA sequence side of the duplex comprises at most: 1, 2, 3, 4, 5, 6, 7, 8, 9, or 10 or more unpaired nucleotides. In some embodiments, a bulge on a second side of the duplex (e.g., the minimum tracrRNA sequence side of the duplex) comprises 4 unpaired nucleotides.

In some embodiments, a bulge comprises at least one wobble pairing. In some embodiments, a bulge comprises at most one wobble pairing. In some embodiments, a bulge comprises at least one purine nucleotide. In some embodiments, a bulge comprises at least 3 purine nucleotides. In some embodiments, a bulge sequence comprises at least 5 purine nucleotides. In some embodiments, a bulge sequence comprises at least one guanine nucleotide. In some embodiments, a bulge sequence comprises at least one adenine nucleotide.

Hairpins

In various embodiments, one or more hairpins are located 3' to the minimum tracrRNA in the 3' tracrRNA sequence.

In some embodiments, the hairpin starts at least about: 1, 2, 3, 4, 5, 6, 7, 8, 9, 10, 15, or 20 or more nucleotides 3' from the last paired nucleotide in the minimum CRISPR repeat and minimum tracrRNA sequence duplex. In some embodiments, the hairpin can start at most about: 1, 2, 3, 4, 5, 6, 7, 8, 9 or 10 or more nucleotides 3' of the last paired nucleotide in the minimum CRISPR repeat and minimum tracrRNA sequence duplex.

In some embodiments, a hairpin comprises at least about: 1, 2, 3, 4, 5, 6, 7, 8, 9, 10, 15, or 20 or more consecutive nucleotides. In some embodiments, a hairpin comprises at most about: 1, 2, 3, 4, 5, 6, 7, 8, 9, 10, 15, or more consecutive nucleotides.

In some embodiments, a hairpin comprises a CC dinucleotide (i.e., two consecutive cytosine nucleotides).

In some embodiments, a hairpin comprises duplexed nucleotides (e.g., nucleotides in a hairpin, hybridized together). For example, a hairpin comprises a CC dinucleotide that is hybridized to a GG dinucleotide in a hairpin duplex of the 3' tracrRNA sequence.

One or more of the hairpins can interact with guide RNA-interacting regions of a site-directed polypeptide.

In some embodiments, there are two or more hairpins, and in some embodiments there are three or more hairpins.

3' tracrRNA Sequence

In some embodiments, a 3' tracr RNA sequence comprises a sequence with at least: about 30%, about 40%, about 50%, about 60%, about 65%, about 70%, about 75%, about 80%, about 85%, about 90%, about 95%, or 100% sequence identity to a reference tracrRNA sequence (e.g., a tracrRNA from *S. pyogenes*).

In some embodiments, the 3' tracrRNA sequence has a length of from about 6 nucleotides to about 100 nucleotides. For example, the 3' tracrRNA sequence can have a length of from about 6 nucleotides (nt) to about 50 nt, from about 6 nt to about 40 nt, from about 6 nt to about 30 nt, from about 6 nt to about 25 nt, from about 6 nt to about 20 nt, from about 6 nt to about 15 nt, from about 8 nt to about 40 nt, from about 8 nt to about 30 nt, from about 8 nt to about 25 nt, from about 8 nt to about 20 nt or from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt. In some embodiments, the 3' tracrRNA sequence has a length of approximately 14 nucleotides.

In some embodiments, the 3' tracrRNA sequence is at least about 60% identical to a reference 3' tracrRNA sequence (e.g., wild type 3' tracrRNA sequence from *S. pyogenes*) over a stretch of at least: 6, 7, or 8 contiguous nucleotides. For example, the 3' tracrRNA sequence is at least: about 60% identical, about 65% identical, about 70% identical, about 75% identical, about 80% identical, about 85% identical, about 90% identical, about 95% identical, about 98% identical, about 99% identical, or 100% identical, to a reference 3' tracrRNA sequence (e.g., wild type 3' tracrRNA sequence from *S. pyogenes*) over a stretch of at least 6, 7, or 8 contiguous nucleotides.

In some embodiments, a 3' tracrRNA sequence comprises more than one duplexed region (e.g., hairpin, hybridized region). In some embodiments, a 3' tracrRNA sequence comprises two duplexed regions.

In some embodiments, the 3' tracrRNA sequence comprises a stem loop structure. In some embodiments, a stem loop structure in the 3' tracrRNA) comprises at least: 1, 2, 3, 4, 5, 6, 7, 8, 9, 10, 15 or 20 or more nucleotides. In some embodiments, stem loop structure in the 3' tracrRNA comprises at most: 1, 2, 3, 4, 5, 6, 7, 8, 9 or 10 or more nucleotides. In some embodiments, the stem loop structure comprises a functional moiety. For example, the stem loop structure may comprise an aptamer, a ribozyme, a protein-interacting hairpin, a CRISPR array, an intron, or an exon. In some embodiments, the stem loop structure comprises at least about: 1, 2, 3, 4, or 5 or more functional moieties. In some embodiments, the stem loop structure comprises at most about: 1, 2, 3, 4, or 5 or more functional moieties.

In some embodiments, the hairpin in the 3' tracrRNA sequence comprises a P-domain. In some embodiments, the P-domain comprises a double-stranded region in the hairpin.

tracrRNA Extension Sequence

A tracrRNA extension sequence may be provided whether or not the tracrRNA is in the context of single-molecule guides or double-molecule guides. In some embodiments, a tracrRNA extension sequence has a length of from about 1 nucleotide to about 400 nucleotides. In some embodiments, a tracrRNA extension sequence has a length of more than: 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 nucleotides. In some embodiments, a tracrRNA extension sequence has a length from about 20 to about 5000 or more nucleotides. In some embodiments, a tracrRNA extension sequence has a length of more than 1000 nucleotides. In some embodiments, a tracrRNA extension sequence has a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 or more nucleotides. In some embodiments, a tracrRNA extension sequence can have a length of less than 1000 nucleotides. In some embodiments, a tracrRNA extension sequence comprises less than 10 nucleotides in length. In some embodiments, a tracrRNA extension sequence is 10-30 nucleotides in length. In some embodiments, tracrRNA extension sequence is 30-70 nucleotides in length.

In some embodiments, the tracrRNA extension sequence comprises a functional moiety (e.g., stability control sequence, ribozyme, endoribonuclease binding sequence). In some embodiments, a functional moiety comprises a transcriptional terminator segment (i.e., a transcription termination sequence). In some embodiments, the functional moiety has a total length of from about 10 nucleotides to about 100 nucleotides, from about 10 nucleotides (nt) to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt, from about 15 nucleotides (nt) to about 80 nt, from about 15 nt to about 50 nt, from about 15 nt to about 40 nt, from about 15 nt to about 30 nt or from about 15 nt to about 25 nt. In some embodiments, the functional moiety functions in a eukaryotic cell. In some embodiments, the functional moiety functions in a prokaryotic cell. In some embodiments, the functional moiety functions in both eukaryotic and prokaryotic cells.

Non-limiting examples of suitable tracrRNA extension functional moieties include: a 3' poly-adenylated tail, a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like). In some embodiments, a tracrRNA extension sequence comprises a primer binding site, a molecular index (e.g., barcode sequence). In some embodiments, the tracrRNA extension sequence comprises one or more affinity tags.

Single-Molecule Guide Linker Sequence

In some embodiments, the linker sequence of a single-molecule guide nucleic acid has a length of from about 3 nucleotides to about 100 nucleotides. In Jinek et al., supra, for example, a simple 4 nucleotide "tetraloop" (-GAAA-) was used, Science, 337(6096):816-821 (2012). An illustrative linker has a length of from about 3 nucleotides (nt) to about 90 nt, from about 3 nt to about 80 nt, from about 3 nt to about 70 nt, from about 3 nt to about 60 nt, from about 3 nt to about 50 nt, from about 3 nt to about 40 nt, from about 3 nt to about 30 nt, from about 3 nt to about 20 nt or from about 3 nt to about 10 nt. For example, the linker can have a length of from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. In some embodiments, the linker of a single-molecule guide nucleic acid is between 4 and 40 nucleotides. In some embodiments, a linker is at least about: 100, 500, 1000, 1500, 2000, 2500, 3000, 3500, 4000, 4500, 5000, 5500, 6000, 6500, or 7000 or more nucleotides. In some embodiments, a linker is at most about: 100, 500, 1000, 1500, 2000, 2500, 3000, 3500, 4000, 4500, 5000, 5500, 6000, 6500, or 7000 or more nucleotides.

Linkers can comprise any of a variety of sequences, although preferably the linker will not comprise sequences that have extensive regions of homology with other portions of the guide RNA, which might cause intramolecular binding that could interfere with other functional regions of the guide. In Jinek et al., supra, a simple 4 nucleotide sequence -GAAA- was used, Science, 337(6096):816-821 (2012), but numerous other sequences, including longer sequences can likewise be used.

In some embodiments, the linker sequence comprises a functional moiety. For example, the linker sequence may comprise an aptamer, a ribozyme, a protein-interacting hairpin, a CRISPR array, an intron, and an exon. In some embodiments, the linker sequence comprises at least about: 1, 2, 3, 4, or 5 or more functional moieties. In some embodiments, the linker sequence comprises at most about: 1, 2, 3, 4, or 5 or more functional moieties.

Complexes of a Nucleic Acid-Targeting Nucleic Acid and a Site-Directed Polypeptide A nucleic acid-targeting nucleic acid interacts with a site-directed polypeptide (e.g., a nucleic acid-guided nuclease such as Cas9), thereby forming a complex. The nucleic acid-targeting nucleic acid guides the site-directed polypeptide to a target nucleic acid.

Codon-Optimization

In some embodiments, a polynucleotide encoding a site-directed polypeptide is codon-optimized according to methods standard in the art for expression in the cell containing the target DNA of interest. For example, if the intended target nucleic acid is in a human cell, a human codon-optimized polynucleotide encoding Cas9 is contemplated for use for producing the Cas9 polypeptide.

Nucleic Acids Encoding System Components

In another aspect, the present disclosure provides a nucleic acid comprising a nucleotide sequence encoding a nucleic acid-targeting nucleic acid of the disclosure, a site-directed polypeptide of the disclosure, and/or any nucleic acid or proteinaceous molecule necessary to carry out the embodiments of the methods of the disclosure.

In some embodiments, the nucleic acid encoding a nucleic acid-targeting nucleic acid of the disclosure, a site-directed polypeptide of the disclosure, and/or any nucleic acid or proteinaceous molecule necessary to carry out the embodiments of the methods of the disclosure comprises a vector (e.g., a recombinant expression vector).

As used herein, the term "vector" refers to a nucleic acid molecule capable of transporting another nucleic acid to which it has been linked. One type of vector is a "plasmid," which refers to a circular double-stranded DNA loop into which additional nucleic acid segments can be ligated. Another type of vector is a viral vector, wherein additional nucleic acid segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some embodiments, vectors are capable of directing the expression of genes to which they are operatively linked. Such vectors are referred to herein as "recombinant expression vectors," or more simply "expression vectors," which serve equivalent functions.

The term "operably linked" is intended herein to mean that the nucleotide sequence of interest is linked to regulatory sequence(s) in a manner which allows for expression of the nucleotide sequence. The term "regulatory sequence" is intended to include, for example, promoters, enhancers and other expression control elements (e.g., polyadenylation signals). Such regulatory sequences are well known in the art and are described, for example, in Goeddel; Gene Expression Technology: Methods in Enzymology 185, Academic Press, San Diego, CA (1990). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the target cell, the level of expression desired, and the like.

Expression vectors contemplated include, but are not limited to, viral vectors based on vaccinia virus, poliovirus, adenovirus, adeno-associated virus, SV40, herpes simplex virus, human immunodeficiency virus, a retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vector contemplated for eukaryotic target cells include, but are not limited to, the vectors pXT1, pSG5, pSVK3, pBPV, pMSG, and pSVLSV40 (Pharmacia). Other vectors may be used so long as they are compatible with the host cell.

In some embodiments, a vector comprises one or more transcription and/or translation control elements. Depending on the host/vector system utilized, any of a number of suitable transcription and translation control elements, including constitutive and inducible promoters, transcription enhancer elements, transcription terminators, etc. may be used in the expression vector.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK) and mouse metallothionein-I.

For expressing small RNAs, including guide RNAs used in connection with Cas endonuclease, various promoters such as RNA polymerase III promoters, including for example U6 and H1, can be advantageous. Descriptions of and parameters for enhancing the use of such promoters are known in art and additional information and approaches are regularly being described; see, e.g., Ma, H. et al., *Molecular Therapy—Nucleic Acids* 3, e161 (2014) doi:10.1038/mtna.2014.12.

The expression vector may also contain a ribosome binding site for translation initiation and a transcription terminator. The expression vector may also include appropriate sequences for amplifying expression. The expression vector may also include nucleotide sequences encoding non-native tags (e.g., histidine tag, hemagglutinin tag, green fluorescent protein, etc.) that are fused to the site-directed polypeptide, thus resulting in a fusion protein.

In some embodiments, a promoter is an inducible promoter (e.g., heat shock promoter, tetracycline-regulated promoter, steroid-regulated promoter, metal-regulated promoter, estrogen receptor-regulated promoter, etc.). In some embodiments, a promoter is a constitutive promoter (e.g., CMV promoter, UBC promoter). In some embodiments, the promoter is a spatially restricted and/or temporally restricted promoter (e.g., a tissue specific promoter, a cell type specific promoter, etc.).

In some embodiments, the nucleic acid encoding a nucleic acid-targeting nucleic acid of the disclosure and/or a site-directed polypeptide are packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. As described in the art, a variety of targeting moieties can be used to enhance the preferential interaction of such vehicles with desired cell types or locations.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like.

Kits

The present disclosure provides kits for carrying out the methods of the disclosure A kit can include one or more of: a nucleic acid-targeting nucleic acid of the disclosure, a polynucleotide encoding a nucleic acid-targeting nucleic acid, a site-directed polypeptide of the disclosure, a polynucleotide encoding a site-directed polypeptide and/or any nucleic acid or proteinaceous molecule necessary to carry out the embodiments of the methods of the disclosure, or any combination thereof.

In some embodiments, a kit comprises: (1) a vector comprising a nucleotide sequence encoding a nucleic acid-targeting nucleic acid, and (2) a vector comprising a nucleotide sequence encoding the site-directed polypeptide and (3) a reagent for reconstitution and/or dilution of the vectors.

In some embodiments, a kit comprises: (1) a vector comprising (i) a nucleotide sequence encoding a nucleic acid-targeting nucleic acid, and (ii) a nucleotide sequence encoding the site-directed polypeptide and (2) a reagent for reconstitution and/or dilution of the vector.

In some embodiments of any of the above kits, the kit comprises a single-molecule guide nucleic acid-targeting nucleic acid. In some embodiments of any of the above kits, the kit comprises a double-molecule nucleic acid-targeting nucleic acid. In some embodiments of any of the above kits, the kit comprises two or more double-molecule guides or single-molecule guides. In some embodiments, the kits comprise a vector may encode the nucleic acid targeting nucleic acid.

In some embodiments of any of the above kits, the kit can further comprise a polynucleotide to be inserted to effect the desired genetic modification.

Components of a kit may be in separate containers; or combined in a single container.

In some embodiments, a kit described above further comprises one or more additional reagents, where such additional reagents are selected from: a buffer, a buffer for introducing the a polypeptide or polynucleotide item of the kit into a cell, a wash buffer, a control reagent, a control vector, a control RNA polynucleotide, a reagent for in vitro production of the polypeptide from DNA, adaptors for sequencing and the like. A buffer can be a stabilization buffer, a reconstituting buffer, or a diluting buffer or the like.

In addition to above-mentioned components, a kit can further include instructions for using the components of the kit to practice the methods. The instructions for practicing the methods are generally recorded on a suitable recording medium. For example, the instructions may be printed on a substrate, such as paper or plastic, etc. The instructions may be present in the kits as a package insert, in the labeling of the container of the kit or components thereof (i.e., associated with the packaging or subpackaging) etc. The instructions can be present as an electronic storage data file present on a suitable computer readable storage medium, e.g. CD-ROM, diskette, flash drive, etc. In some instances, the actual instructions are not present in the kit, but means for obtaining the instructions from a remote source (e.g. via the Internet), can be provided. An example of this embodiment is a kit that includes a web address where the instructions can be viewed and/or from which the instructions can be downloaded. As with the instructions, this means for obtaining the instructions can be recorded on a suitable substrate.

Guide RNA Formulation

Guide RNAs of the invention are formulated with pharmaceutically acceptable excipients such as carriers, solvents, stabilizers, adjuvants, diluents, etc., depending upon the particular mode of administration and dosage form. Guide RNA compositions are generally formulated to achieve a physiologically compatible pH, and range from a pH of about 3 to a pH of about 11, about pH 3 to about pH 7, depending on the formulation and route of administration. In alternative embodiments, the pH is adjusted to a range from about pH 5.0 to about pH 8. In some embodiments, the compositions comprise a therapeutically effective amount of at least one compound as described herein, together with one or more pharmaceutically acceptable excipients. Optionally, the compositions comprise a combination of the compounds described herein, or may include a second active ingredient useful in the treatment or prevention of bacterial growth (for example and without limitation, anti-bacterial or anti-microbial agents), or may include a combination of reagents of the invention.

Suitable excipients include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol) wetting or emulsifying agents, pH buffering substances, and the like.

Genetically Modified Cells

As used herein, the term "genetically modified cell" refers to a cell that comprises at least one genetic modification introduced by genome editing (e.g., using the CRISPR/Cas system). In some embodiments herein, the genetically modified cell is a genetically modified progenitor cell. A genetically modified cell comprising an exogenous nucleic acid-targeting nucleic acid and/or an exogenous nucleic acid encoding a nucleic acid-targeting nucleic acid is contemplated herein.

In connection with de-repressing γ-globin expression, the phrase "increasing γ-globin levels in a cell" or "increased γ-globin expression in a cell" indicates that γ-globin in a cell or population of cells is at least 2% higher in the cell or population of cells subject to genome editing than in a comparable, control population, in which there has been no genome editing. In some embodiments, the increase in γ-globin expression is at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, at least about 2-fold, at least about 3-fold, at least about 4-fold, at least about 5-fold, at least about 6-fold, at least about 7-fold, at least about 8-fold, at least about 9-fold, at least about 10-fold, at least about 15-fold, at least about 20-fold, at least about 25-fold, at least about 30-fold, at least about 35-fold, at least about 40-fold, at least about 45-fold, at least about 50-fold, at least about 100-fold or more than a comparable control treated population. The term "control treated population" is used herein to describe a population of cells that has been treated with identical media, viral induction, nucleic acid sequences, temperature, confluency, flask size, pH, etc., with the exception of the addition of the genome editing components. Any method known in the art can be used to measure an increase in γ-globin expression, for example, Western Blot analysis of γ-globin or quantifying γ-globin mRNA.

The term "isolated cell" as used herein refers to a cell that has been removed from an organism in which it was originally found, or a descendant of such a cell. Optionally the cell has been cultured in vitro, e.g., under defined conditions or in the presence of other cells. Optionally the cell is later introduced into a second organism or re-introduced into the organism from which it (or the cell from which it is descended) was isolated.

The term "isolated population" with respect to an isolated population of cells as used herein refers to a population of cells that has been removed and separated from a mixed or heterogeneous population of cells. In some embodiments, an isolated population is a substantially pure population of cells as compared to the heterogeneous population from which the cells were isolated or enriched. In some embodiments, the isolated population is an isolated population of human hematopoietic progenitor cells, e.g., a substantially pure population of human hematopoietic progenitor cells as compared to a heterogeneous population of cells comprising human hematopoietic progenitor cells and cells from which the human hematopoietic progenitor cells were derived.

The term "substantially enhanced," with respect to a particular cell population, refers to a population of cells in which the occurrence of a particular type of cell is increased relative to preexisting or reference levels, by at least 2-fold, at least 3-, at least 4-, at least 5-, at least 6-, at least 7-, at least 8-, at least 9, at least 10-, at least 20-, at least 50-, at least 100-, at least 400-, at least 1000-, at least 5000-, at least 20000-, at least 100000- or more fold depending, e.g., on the desired levels of such cells for ameliorating a hemoglobinopathy.

The term "substantially enriched" with respect to a particular cell population, refers to a population of cells that is at least: about 10%, about 20%, about 30%, about 40%, about 50%, about 60%, about 70% or more with respect to the cells making up a total cell population.

The terms "substantially enriched" or "substantially pure" with respect to a particular cell population, refers to a population of cells that is at least about 75%, at least about 85%, at least about 90%, or at least about 95% pure, with respect to the cells making up a total cell population. That is, the terms "substantially pure" or "essentially purified," with regard to a population of hematopoietic progenitor cells, refers to a population of cells that contain fewer than: about 20%, about 15%, about 10%, about 9%, about 8%, about 7%, about 6%, about 5%, about 4%, about 3%, about 2%, about 1%, or less than 1%, of cells that are not hematopoietic progenitor cells as defined by the terms herein.

Pharmaceutically Acceptable Carriers

The methods of administering progenitor cells to a subject contemplated herein involve the use of therapeutic compositions comprising progenitor cells.

Therapeutic compositions contain a physiologically tolerable carrier together with the cell composition and optionally at least one additional bioactive agent as described herein, dissolved or dispersed therein as an active ingredient. In some embodiments, the therapeutic composition is not substantially immunogenic when administered to a mammal or human patient for therapeutic purposes, unless so desired.

In general, the progenitor cells described herein are administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the progenitor cells as described herein using routine experimentation.

A cell composition can also be emulsified or presented as a liposome composition, provided that the emulsification procedure does not adversely affect cell viability. The cells and any other active ingredient can be mixed with excipients which are pharmaceutically acceptable and compatible with the active ingredient and in amounts suitable for use in the therapeutic methods described herein.

Additional agents included in a cell composition as described herein can include pharmaceutically acceptable salts of the components therein. Pharmaceutically acceptable salts include the acid addition salts (formed with the free amino groups of the polypeptide) that are formed with inorganic acids such as, for example, hydrochloric or phosphoric acids, or such organic acids as acetic, tartaric, mandelic and the like. Salts formed with the free carboxyl groups can also be derived from inorganic bases such as, for example, sodium, potassium, ammonium, calcium or ferric hydroxides, and such organic bases as isopropylamine, trimethylamine, 2-ethylamino ethanol, histidine, procaine and the like.

Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerin, vegetable oils such as cottonseed oil, and water-oil emulsions. The amount of an active compound used in the cell compositions as described herein that is effective in the treatment of a particular disorder or condition will depend on the nature of the disorder or condition, and can be determined by standard clinical techniques.

Administration & Efficacy

As used herein, the terms "administering," "introducing" and "transplanting" are used interchangeably in the context of the placement of cells, e.g., progenitor cells, as described herein into a subject, by a method or route which results in at least partial localization of the introduced cells at a desired site, such as a site of injury or repair, such that a desired effect(s) is produced. The cells e.g., progenitor cells, or their differentiated progeny can be administered by any appropriate route which results in delivery to a desired location in the subject where at least a portion of the implanted cells or components of the cells remain viable. The period of viability of the cells after administration to a subject can be as short as a few hours, e.g., twenty-four hours, to a few days, to as long as several years, i.e., long-term engraftment. For example, in some embodiments of the aspects described herein, an effective amount of hematopoietic progenitor cells is administered via a systemic route of administration, such as an intraperitoneal or intravenous route.

The terms "individual," "subject," "host" and "patient" are used interchangeably herein and refer to any subject for whom diagnosis, treatment or therapy is desired. In some embodiments, the subject is a mammal. In some embodiments, the subject is a human being.

When provided prophylactically, progenitor cells described herein can be administered to a subject in advance of any symptom of a hemoglobinopathy, e.g., prior to initiation of the switch from fetal γ-globin to predominantly β-globin and/or prior to the development of significant anemia or other symptom associated with the hemoglobinopathy. Accordingly, the prophylactic administration of a hematopoietic progenitor cell population serves to prevent a hemoglobinopathy, as disclosed herein.

When provided therapeutically, hematopoietic progenitor cells are provided at (or after) the onset of a symptom or indication of a hemoglobinopathy, e.g., upon the onset of sickle cell anemia or other SCD.

In some embodiments of the aspects described herein, the hematopoietic progenitor cell population being administered according to the methods described herein comprises allogeneic hematopoietic progenitor cells obtained from one or more donors. As used herein, "allogeneic" refers to a hematopoietic progenitor cell or biological samples comprising hematopoietic progenitor cells obtained from one or more different donors of the same species, where the genes at one or more loci are not identical. For example, a hematopoietic progenitor cell population being administered to a subject can be derived from umbilical cord blood obtained from one more unrelated donor subjects, or from one or more non-identical siblings. In some embodiments, syngeneic hematopoietic progenitor cell populations can be used, such as those obtained from genetically identical animals, or from identical twins. In other embodiments of this aspect, the hematopoietic progenitor cells are autologous cells; that is, the hematopoietic progenitor cells are obtained or isolated from a subject and administered to the same subject, i.e., the donor and recipient are the same.

In one embodiment, the term "effective amount" as used herein refers to the amount of a population of progenitor cells or their progeny needed to prevent or alleviate at least one or more sign or symptom of a hemoglobinopathy, and relates to a sufficient amount of a composition to provide the desired effect, e.g., treat a subject having a hemoglobinopathy. The term "therapeutically effective amount" therefore refers to an amount of progenitor cells or a composition comprising progenitor cells that is sufficient to promote a particular effect when administered to a typical subject, such as one who has or is at risk for a hemoglobinopathy. An effective amount as used herein would also include an amount sufficient to prevent or delay the development of a symptom of the disease, alter the course of a symptom disease (for example but not limited to, slow the progression of a symptom of the disease), or reverse a symptom of the disease. It is understood that for any given case, an appropriate "effective amount" can be determined by one of ordinary skill in the art using routine experimentation.

For use in the various aspects described herein, an effective amount of progenitor cells, comprises at least $10^2$ progenitor cells, at least $5 \times 10^2$ progenitor cells, at least $10^3$ progenitor cells, at least $5 \times 10^3$ progenitor cells, at least $10^4$ progenitor cells, at least $5 \times 10^4$ progenitor cells, at least $10^5$ progenitor cells, at least $2 \times 10^5$ progenitor cells, at least $3 \times 10^5$ progenitor cells, at least $4 \times 10^5$ progenitor cells, at least $5 \times 10^5$ progenitor cells, at least $6 \times 10^5$ progenitor cells, at least $7 \times 10^5$ progenitor cells, at least $8 \times 10^5$ progenitor cells, at least $9 \times 10^5$ progenitor cells, at least $1 \times 10^6$ progenitor cells, at least $2 \times 10^6$ progenitor cells, at least $3 \times 10^6$ progenitor cells, at least $4 \times 10^6$ progenitor cells, at least $5 \times 10^6$ progenitor cells, at least $6 \times 10^6$ progenitor cells, at least $7 \times 10^6$ progenitor cells, at least $8 \times 10^6$ progenitor cells, at least $9 \times 10^6$ progenitor cells, or multiples thereof. The progenitor cells are derived from one or more donors, or are obtained from an autologous source. In some embodiments of the aspects described herein, the progenitor cells are expanded in culture prior to administration to a subject in need thereof.

As discussed above, even modest and incremental increases in the levels of HbF expressed in cells of patients having a hemoglobinopathy can be beneficial for ameliorating one or more symptoms of the disease, for increasing long-term survival, and/or for reducing side effects associated with other treatments. Upon administration of such cells to human patients, the presence of RBCs that are producing increased levels of HbF is beneficial. In some embodiments, effective treatment of a subject gives rise to at least about 9% HbF relative to total Hb in the treated subject. In some embodiments, HbF will be at least about 14% of total Hb. In some embodiments HbF will be at least about 20% to 30% of total Hb. Similarly, the introduction of even relatively limited subpopulations of cells having significantly elevated levels of HbF (referred to as "F-cells") can be beneficial in various patients since in some situations normalized cells will have a selective advantage relative to diseased cells. However, even modest levels of circulating RBCs with elevated levels of HbF can be beneficial for ameliorating one or more aspects of hemoglobinopathy in patients. In some embodiments, about 10%, about 20%, about 30%, about 40%, about 50%, about 60%, about 70%, about 80%, about 90% or more of the RBCs in patients to whom such cells are administered are producing increased levels of HbF as described herein.

As used herein, "administered" refers to the delivery of a progenitor cell composition as described herein into a subject by a method or route which results in at least partial localization of the cell composition at a desired site. A cell composition can be administered by any appropriate route which results in effective treatment in the subject, i.e. administration results in delivery to a desired location in the subject where at least a portion of the composition delivered, i.e. at least $1 \times 10^4$ cells are delivered to the desired site for a period of time. Modes of administration include injection, infusion, instillation, or ingestion. "Injection" includes, without limitation, intravenous, intramuscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some embodiments, the route is intravenous. For the delivery of cells, administration by injection or infusion is generally preferred.

In one embodiment, the cells as described herein are administered systemically. The phrases "systemic administration," "administered systemically," "peripheral administration" and "administered peripherally" as used herein refer to the administration of a population of progenitor cells other than directly into a target site, tissue, or organ, such that it enters, instead, the subject's circulatory system and, thus, is subject to metabolism and other like processes.

The efficacy of a treatment comprising a composition as described herein for the treatment of a hemoglobinopathy can be determined by the skilled clinician. However, a treatment is considered "effective treatment," as the term is used herein, if any one or all of the signs or symptoms of, as but one example, levels of fetal hemoglobin are altered in a beneficial manner (e.g., increased by at least 10%), other clinically accepted symptoms or markers of disease are improved or ameliorated. Efficacy can also be measured by failure of an individual to worsen as assessed by hospitalization or need for medical interventions (e.g., reduced transfusion dependence, or progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting the disease, e.g., arresting, or slowing the progression of symptoms; or (2) relieving the disease, e.g., causing regression of symptoms; and (3) preventing or reducing the likelihood of the development of symptoms.

The treatment according to the present invention ameliorates one or more symptoms associated with a β-hemoglobinopathy by increasing the amount of fetal hemoglobin in the individual. Symptoms and signs typically associated with a hemoglobinopathy, include for example, anemia, tissue hypoxia, organ dysfunction, abnormal hematocrit values, ineffective erythropoiesis, abnormal reticulocyte (erythrocyte) count, abnormal iron load, the presence of ring sideroblasts, splenomegaly, hepatomegaly, impaired peripheral blood flow, dyspnea, increased hemolysis, jaundice, anemic pain crises, acute chest syndrome, splenic sequestration, priapism, stroke, hand-foot syndrome, and pain such as angina pectoris.

As used herein the term "comprising" or "comprises" is used in reference to compositions, methods, and respective component(s) thereof, that are essential to the invention, yet open to the inclusion of unspecified elements, whether essential or not.

As used herein the term "consisting essentially of" refers to those elements required for a given embodiment. The term permits the presence of additional elements that do not materially affect the basic and novel or functional characteristic(s) of that embodiment of the invention.

The term "consisting of" refers to compositions, methods, and respective components thereof as described herein, which are exclusive of any element not recited in that description of the embodiment.

As used in this specification and the appended claims, the singular forms "a," "an," and "the" include plural references unless the context clearly dictates otherwise.

Certain numerical values presented herein are preceded by the term "about." The term "about" is used herein to provide literal support for the numerical value the term "about" precedes, as well as a numerical value that is approximately the numerical value, that is the approximating unrecited numerical value may be a number which, in the context it is presented, is the substantial equivalent of the specifically recited numerical value.

When a range of numerical values is presented herein, it is contemplated that each intervening value between the lower and upper limit of the range, the values that are the upper and lower limits of the range, and all stated values with the range are encompassed within the disclosure. All the possible sub-ranges within the lower and upper limits of the range are also contemplated by the disclosure.

EXAMPLES

The invention will be more fully understood by reference to the following examples, which provide illustrative non-limiting embodiments of the invention.

The examples describe the use of the CRISPR/Cas system as an illustrative genome editing technique to create defined therapeutic genomic deletions or single base substitutions, collectively termed "genomic modifications" herein, in the β-globin gene cluster that lead to the upregulation of the expression of HbF. Exemplary therapeutic modifications are genetically and/or functionally similar or identical to those observed in hematopoietic cells of individuals with hemoglobinopathy such as sickle cell or β-thalassemia in which the modifications de-repress, or lead to the re-expression of, γ-globin and thus fetal hemoglobin. Introduction of the defined therapeutic modifications represents a novel therapeutic strategy for the potential amelioration of hemoglobinopathies as described and illustrated herein.

Example 1

Creation of Deletions Proximal to Chr11:5224779-5237723

In this example, we illustrate use of the methods described herein to generate certain deletions that are proximal to the region Chr11:5224779-5237723. Deletions in this region have been observed in human patients designated as HPFH-5 (or "HPFH Sicilian") described in Camaschella et al., *Haematologica*, 75(Suppl 5):26-30 (1990). The 13 kb deletion variant in the human β-globin locus observed in the human patients was associated with the clinical phenotype of hereditary persistence of fetal hemoglobin (HPFH), in which the presence of fetal hemoglobin can complement the defect in adult hemoglobin synthesis or function, and ameliorate disease, in sickle cell anemia or β-thalassemia.

In this example, we illustrate that the CRISPR/Cas system can be used to create deletions functionally resembling those associated with natural HPFH alleles such as HPFH-5. Guide RNAs were designed to eliminate the pathogenic sickle cell allele by deleting the δ and β globin genes as well as substantial portion of the γ globin gene 3' region. FIG. 1A shows the human globin locus with hollow boxes highlighting the HPFH-5 5' and 3' target sites. The 13 kb deletion starts 3 kb 5' to the ψβ1 gene and ends 1.7 kb 3' to the end of the β gene (690 bp downstream from the β gene polyA signal). See FIG. 1B. In addition, guide RNAs were designed to target sites throughout the 13 kb region in order to determine the therapeutic potential of smaller deletions within this locus.

Experimental Methods

Selection of Target Sites

Regions of the β-globin gene cluster were scanned for target sites, including the 5' and 3' regions associated with hereditary persistence of fetal hemoglobin-5 (HPFH-5). Each area was scanned for protospacer adjacent motifs (PAMs) having the sequence NGG and/or NRG. Guide strands corresponding to the PAMs were identified.

For this illustrative example, candidate guides were screened and selected in a multi-step process that involved both theoretical binding and experimentally assessed activity. By way of illustration, candidate guides having sequences that match a particular on-target site with adjacent PAM can be assessed for their potential to cleave at off-target sites having similar sequences, using one or more of a variety of bioinformatics tools available for assessing off-target binding, as described and illustrated in more detail below, in order to assess the likelihood of effects at chromosomal positions other than those intended. Candidates predicted to have relatively lower potential for off-target activity can then be assessed experimentally to measure their on-target activity, and then off-target activities at various sites. Preferred guides have sufficiently high on-target activity to achieve desired levels of gene editing at the selected locus, and relatively lower off-target activity, to reduce the likelihood of alterations at other chromosomal loci. The ratio of on-target to off-target activity is often referred to as the "specificity" of a guide.

For initial screening of predicted off-target activities, there are a number of bioinformatics tools known and publicly available that can be used to predict the most likely off-target sites; and since binding to target sites in the Crispr Cas9 nuclease system is driven by Watson-Crick base pairing between complementary sequences, the degree of dissimilarity (and therefore reduced potential for off-target binding) is essentially related to primary sequence differences: mismatches and bulges, i.e. bases that are changed to a non-complementary base, and insertions or deletions of bases in the potential off-target site relative to the target site. An exemplary bioinformatics tool called COSMID (CRISPR Off-target Sites with Mismatches, Insertions and Deletions) (available on the web at crispr.bme.gatech.edu) compiles such similarities.

CRISPR Cloning

Plasmids expressing the Cas9 protein and guide strand RNA were assembled using a vector that expressed humanized Cas9 from *S. pyogenes* and the single-molecule guide RNA. Complementary oligonucleotides corresponding to the guide strand were obtained (Operon or IDT), kinase, annealed and cloned into the vector. Guide RNAs were tested in cells The first three spacer sequences target the 5' boundary of the region to be deleted, and the last three target the 3' boundary of the region to be deleted.

Cell Transfection

K-562 cells were cultured in RPMI media supplemented with 10% FBS and 2 mM fresh L-glutamine and passaged as they approached a confluency of $1\times10^5$/ml. An Amaxa Nucleofector 4D was used to transfect 200,000 K-562 cells with 1 μg vector expressing HPFH5 targeting sgRNAs, and 1000 ng of plasmid expressing Cas9 following manufacturer's instructions. The genomic DNA was harvested after 3 days using QuickExtract DNA extraction solution (Epicentre, Madison, WI), as described.

Hek293T cells were seeded 24 hours prior to transfection in 24-well plates at a density of 80,000 cells per well and cultured in DMEM media supplemented with 10% FBS and 2 mM fresh L-glutamine. Cells were transfected with 1000 ng of plasmid expressing Cas9 and gRNA using 2 μl of Lipofectamine 2000 (Life technologies), according to manufacturer's instructions. Genomic DNA was harvested at 72 hours after transfection using QuickExtract DNA Extraction Solution (Epicenter).

On- and Off-Target Mutation Detection by Sequencing

To sequence the on-target sites and putative off-target sites, the appropriate amplification primers were identified and reactions were set up with these primers using the genomic DNA harvested using QuickExtract DNA extraction solution (Epicentre) from treated cells three days post-transfection. The amplification primers contain the gene specific portion flanked by adapters. The forward primer's 5' end includes a modified forward (read1) primer-binding site. The reverse primer's 5' end contains a combined modified reverse (read2) and barcode primer-binding site, in opposite orientation. The individual PCR reactions were validated by separating on agarose gels, then purified and re-amplified. The second round forward primers contain the Illumina P5 sequence, followed by a proportion of the modified forward (read1) primer binding site. The second round reverse primers contain the Illumina P7 sequence (at the 5' end), followed by the 6-base barcode and the combined modified reverse (read2) and barcode primer binding site. The second round amplifications were also checked on agarose gels, then purified, and quantitated using a NanoDrop spectrophotometer. The amplification products were pooled to match concentration and then submitted to the Emory Integrated Genomic core for library prepping and sequencing on an Illumina Miseq machine.

The sequencing reads were sorted by barcode and then aligned to the reference sequences supplied by bioinformatics for each product. Insertion and deletion rates in the aligned sequencing reads were detected in the region of the putative cut sites using software previously described; see, e.g., Lin et al., *Nucleic Acids Res.*, 42: 7473-7485 (2014). The levels of insertions and deletions detected in this window were then compared to the level seen in the same location in genomic DNA isolated from in mock transfected cells to minimize the effects of sequencing artifacts.

Mutation Detection Assays

The on- and off-target cleavage activities of Cas9 and guide RNA combinations were measured using the mutation rates resulting from the imperfect repair of double-strand breaks by NHEJ.

On-target loci were amplified using AccuPrime Taq DNA Polymerase High Fidelity (Life Technologies, Carlsbad, CA) following manufacturer's instructions for 40 cycles (94° C., 30 s; 52-60° C., 30 s; 68° C., 60 s) in 50 µl reactions containing 1 µl of the cell lysate, and 1 µl of each 10 µM amplification primer. T7EI mutation detection assays were performed, as per manufacturers protocol [Reyon et al., *Nat. Biotechnol.*, 30: 460-465 (2012)], with the digestions separated on 2% agarose gels and quantified using ImageJ [Guschin et al., *Methods Mol. Biol.*, 649: 247-256 (2010)]. The assays determine the percentage of insertions/deletions ("indels") in the bulk population of cells.

Detecting Inversions and Deletions by End-Point PCR

All end-point PCR reactions were performed using AccuPrime Taq DNA Polymerase High Fidelity (Life Technologies) following manufacturer's instructions for 40 cycles (94° C., 30 s; 60° C., 30 s; 68° C., 45 s) in a 50 µl reaction containing 1 µl of the cell lysate, and 1 µl of each 10 µM target region amplification primer.

Deletion Quantification Using Drop Digital PCR (ddPCR)

The level of joined chromosomal ends, indicating the intended chromosomal deletions, was quantitated using the BioRad (Hercules, CA) drop digital PCR machine (ddPCR) QX200. The machines allow absolute quantification by breaking individual PCR reactions into 20,000 droplets that are individually tested by end-point PCR using a Cyber green-like reagent and a reader that can effectively differentiate between PCR-positive and PCR-negative droplets. Genomic DNA for ddPCR was extracted from K-562 cells using the QiaAMP DNA mini kit (Qiagen, Valencia, CA). PCR reactions contained 2× ddPCR EvaGreen supermix, 200 ng of genomic DNA, primers, and HindIII (1U/reaction). Reactions were run for 40 cycles (94° C., 30 s; 55-65° C., 30 s; 72° C., 90 s).

FIG. 2 shows a schematic of PCR primer locations for detection of inversions and deletions of the 13 kb fragment.

Example 2

Creation of Deletions Proximal to Chr11:5233055-5240389

In this example, we illustrate use of the methods described herein to generate certain deletions that are proximal to the region Chr11:5233055-5240389. Deletions in this region have been observed in human patients with a 7.2 kb deletion in the human β-globin locus on chromosome 11 that is referred to herein as the "Corfu long" deletion. In the homozygous state, such a deletion is associated with a complete absence of hemoglobin A and A2 and a high level of fetal hemoglobin and HPFH [Wainscoat et al, *Ann. NY Acad Sci* 445:20 (1985) and Kulozik et al, *Blood* 71:457 (1988)]. This deletion is depicted in FIG. 3. We further determined that known binding sites for key regulators of γ-globin—BCL11a and Gata1—are located within a 3.5 kb subregion within the 7.2 kb region (FIG. 3). It is contemplated that deletion of this smaller region alone (deletion in chromosome 11 within region Chr11:5233055-5240389) might be sufficient to confer an HPFH phenotype comparable to that seen with the larger deletion and, moreover, may be achievable at a higher efficiently of genome editing than for the larger deletion. CRISPR guide RNAs were designed to effect cleavage at each end of the 7.2 kb and 3.5 kb regions and their ability to effect deletion of the intervening fragment was validated.

Individual guide RNAs directed towards the boundaries of each of the Corfu deletions were tested for their efficiency of gene editing.

Example 3

Creation of Deletions Proximal to Chr11:5226631-5249422

In this example, we illustrate use of the methods described herein to generate certain deletions that are proximal to the region Chr11:5226631-5249422. Deletions in this region have been observed in human patients with a large deletion in the human β-globin locus on chromosome 11 that is referred to herein as the HPFH Kenya-like variant [Huisman et al, *Arch. Biochem. Biophys.* 152:850 (1972) and Ojwang et al, *Hemoglobin* 7:115 (1983)]. The naturally-occurring variant appears to have resulted from non-homologous crossing over between amino acids 80-87 of the $^A\gamma$ and β-globin genes and deletion of the intervening ~23 kb of sequence in chromosome 11 within region Chr11:5226631-5249422. The Kenya fusion protein contains amino acid residues 1-80 of the $^A\gamma$ chain and 87-146 of the β chain. CRISPR guide RNAs used to effect cleavage at each boundary of the ~23 kb region (FIGS. 4 and 1B) were designed and validated. Vectors encoding the guide RNAs were generated and introduced into cells as described.

Combinations of these guides are expected to achieve the desired deletion.

Example 4

Creation of Deletions Proximal to Chr11:5249959-5249971

In this example, we illustrate use of the methods described herein to generate certain deletions that are proximal to the region Chr11:5249959-5249971. Deletions in this region have been observed in human patients with a small deletion variant of the β-globin locus in chromosome 11 within region Chr11:5249959-5249971 that was identified and shown to be associated with HPFH [Gilman et al, *Nucleic acids Research* 16(22):10635 (1988)]. This deletion spans −102 to −114 of the γ-globin gene and encompasses the distal CCAAT box believed important for regulation of the γ-gene promoter (FIG. 5A).

One approach is to cleave this locus within the 13 bp region and allow NHEJ to mis-repair the lesion with the expectation that in some instances the exact 13 bp deletion might be recapitulated. However, the repair outcome by NHEJ alone cannot be assured and it is unlikely that the precise 13 bp deletion will occur at a clinically significant frequency—rather than additional deletions or insertions, which may themselves have the desired therapeutic consequence. Alternatively, the DSB could be repaired by HDR in the presence of a co-delivered repair template donor that specifies the precise 13 bp deletion.

A third approach to creating the 13 bp deletion could be taken that makes use of microhomology at the intended mutation site and the repair pathway of MMEJ. In the present example analysis of the sequence encompassing and adjacent to the 13 bp deletion site revealed the presence of two 8 bp repeat sequences which we predicted would likely recombine during MMEJ-mediated repair to produce the 13 bp deletion in the presence of a single double-strand break.

Example 5

Creation of Deletions Proximal to Chr11:5196709-5239223

In this example, we illustrate use of the methods described herein to generate certain deletions that are proximal to the region Chr11:5196709-5239223. Deletions in this region have been observed in human patients with a large deletion in the human β-globin locus on chromosome 11 that is referred to as the HPFH-4 (or "HPFH Italian") allele [Camaschella et al, *Haematologia* 75(5):26 (1990)] and is characterized by a 40 kb deletion (FIG. 6A) in chromosome 11 within region Chr11:5196709-5239223 that fully encompasses the shorter (13 kb) HPFH-5 allele. It is contemplated that genome editing technologies such as CRISPR can be used to create a targeted deletion of the corresponding or similar genomic region, or subset thereof, in hematopoietic cells of individuals with hemoglobinopathy such as sickle cell or β-thalassemia to de-repress, or lead to the re-expression of, γ-globin and thus fetal hemoglobin.

Example 6

Creation of Deletions Proximal to Chr11:5225700-5236750

In this example, we illustrate use of the methods described herein to generate certain deletions that are proximal to the region Chr11:5225700-5236750. Deletions in this region have been observed in human patients with the HPFH Black allele [Anagnou et al., *Blood* 65:1245 (1985)], which is characterized by a large deletion (FIG. 16B) in chromosome 11 within region Chr11:5225700-5236750 that overlaps completely with the HPFH-4 and HPFH-5 deletions. It is contemplated that genome editing technologies such as CRISPR can be used to create a targeted deletion of the corresponding or similar genomic region, or subset thereof, in hematopoietic cells of individuals with hemoglobinopathy such as sickle cell or β-thalassemia to de-repress, or lead to the re-expression of, γ-globin and thus fetal hemoglobin.

Example 7

Creation of HPFH-Associated Non-Deletion Mutations

The −175 (T to C) point mutation in the $^G\gamma$ or $^A\gamma$ gene of β-globin locus is associated with a phenotype of pancellular HPFH, i.e. across many cells with fairly uniform distribution; see, e.g., Ottolenghi et al., *Blood* 71:815 (1988) and Surrey et al., *Blood* 71:807 (1988). The HPFH phenotype is believed to be due to disruption of one or more cis-elements to which regulatory factors normally bind and repress γ-globin expression, or to enhancement of binding of regulatory factors that upregulate γ-globin expression. It is contemplated that genome editing technologies such as CRISPR can be used to create the point mutation, or other modification resulting in changes in regulatory factor binding, in hematopoietic cells of individuals with hemoglobinopathy such as sickle cell or β-thalassemia to de-repress, or lead to the re-expression of, γ-globin and thus fetal hemoglobin.

Multiple putative PAM sequences for *S. pyogenes* Cas9 are located adjacent to this target site (FIG. 6C).

Example 8

Clinical Studies and Pharmacology

It is well established that an increase in HbF levels reduces HbS polymerization and thereby ameliorates the phenotype of SCA, reducing clinical complications.

In the context of the CRISPR/Cas9 technology, or by using other endonucleases for gene editing as described herein, the main objectives of primary pharmacodynamic studies in human subjects/patients will be to demonstrate successful de-repression of γ-globin and concomitant increases and beneficial effects of HbF, and to determine the safety and efficacy of such genetic modifications for the treatment of hemoglobinopathies.

Cell-based studies can include both wild-type cells, such as normal CD34+ hHSCs, which do not normally express high levels of HbF, but are edited as described herein to increase their levels of HbF; as well as cells such as CD34+ cells that are derived from patients having a hemoglobinopathy such as β-thalassemia or SCD.

Total red cell HbF will be measured by cationic HPLC and the distribution of HbF in red cells will be quantified in F-cells (cells with detectable HbF levels) using FACS. Although even small incremental increases in HbF have been shown to have beneficial effects in the context of SCD, as discussed above, in some embodiments at least about 9% of total Hb in a subject will be HbF, which is associated with decreased mortality in SCD; see, e.g., Platt et al., *N Engl J Med.* 330(23): 1639-1644 (1994). In some embodiments, HbF will be at least about 14%, which is associated with additional clinical benefits, and in some embodiments HbF will be at least about 20% to 30%, which is associated with substantial normalization of phenotype in the context of SCD. Similarly, the introduction of even relatively limited subpopulations of cells having significantly elevated levels of HbF (referred to as "F-cells") can be beneficial in various patients since in some situations normalized cells will have a selective advantage relative to diseased cells. Even modest levels of circulating RBCs with elevated levels of HbF can be beneficial for ameliorating one or more aspects of hemoglobinopathy in patients. However, it is generally contemplated that at least one tenth of circulating red blood cells (RBCs) will have elevated levels of HbF, more than one quarter of circulating RBCs will have elevated levels of HbF, or at least one third of circulating RBCs will have elevated levels of HbF. In some embodiments, at least about one half, and in some embodiments at least about three quarters or more of circulating RBCs will have elevated levels of HbF.

Example 9

Biodistribution

A preliminary feasibility study (non-GLP) will be performed to demonstrate engraftment of CD34+ hHSCs in NOD/SCID IL2Rγ mice. A GLP biodistribution and persistence study will be performed in immune-compromised NOD/SCID IL2Rγ mice. CRISPR/Cas9-modified human CD34+ HSCs will be administered by i.v. injection (or other routes, e.g. intraosseous) to NOD/SCID IL2Rγ mice. Non-modified CD34+ hHSCs will be used as a control.

Example 10

In Vivo Pharmacology Study

In an illustrative example of in vivo pharmacology, gene-edited HSCs are introduced into immunodeficient mice, and results such as HSC engraftment are assessed. For example, "NSG" or NOD scid gamma (NOD.Cg-Prkdcscid Il2rgtm1Wjl/SzJ), is a strain of inbred laboratory mice, among the most immunodeficient described to date; see, e.g., Shultz et al., *Nat. Rev. Immunol.* 7(2): 118-130 (2007). Another immune-compromised mouse model applicable for investigating hematopoietic stem cell transplantation is the NOD/MrkBomTac-Prkdc$^{scid}$ mouse (taconic.com/NODSC).

One illustrative approach employing an immune-compromised mouse model is to inject CRISPR/Cas9-modified CD34+ human HSCs into immune-compromised NOD/SCID/IL2rγ mice to demonstrate homing and engraftment capabilities.

It is also possible to consider studies in model animals, provided such models are reasonably predictive of one or more aspects of conditions in human patients. Development of animal models providing information relevant to certain aspects of various diseases continues to be the subject of regular improvements in the art, and the use of CRISPR/Cas-9 gene editing is greatly facilitating the more rapid creation of such disease-relevant animal models.

Example 11

Use of Edited Cells for the Amelioration of β-Thalassemia

Using the methods described and illustrated herein, human cells expressing increased levels of HbF can be produced. Such cells can include, for example, human hematopoietic stem cells (human HSCs) that are capable of giving rise to cells of the erythroid lineage such as red blood cells (RBCs). Such HSCs can therefore be used to ameliorate one or more symptoms associated with β-thalassemia.

For example, when the genome editing procedure is applied to increase the levels of HbF in cells of a patient suffering from a β-thalassemia, one or more symptoms or complications of the β-thalassemia can be ameliorated, as a result of the combination of two beneficial effects. First, HbF provides a functional form of hemoglobin that can play a significant role in ameliorating the anemia and associated clinical conditions of β-thalassemia (i.e. in β-thalassemia major and β-thalassemia intermedia), in which the adult β-globin chains that would normally be expressed from the HBB gene are absent or reduced. Second, the level of unpaired α-globin chains, which is a cause of a number of other problems associated clinically β-thalassemia, are reduced because the α-globin chains can be paired with β-globin chains encoded by the γ-globin genes, expression of which is increased as described herein.

As also noted herein, β-thalassemia RBCs have selective disadvantages compared to normal RBCs in terms of survival and other factors; and treatment of cells as described herein overcomes certain disadvantages by, e.g., increasing the levels of HbF, and concomitantly decreasing the levels of unpaired α-globin chains.

In addition, other techniques can be applied to enhance the delivery, expansion and/or persistence of cells modified by genome editing as described herein. These include ablation techniques in which some resident cells are eliminated prior to the introduction of cells. Such techniques are routinely used, for example, in the context of bone marrow transplantation and other procedures in which normal or corrected cells are introduced into patients. Numerous such procedures are known in the art and routinely practiced in connection with the treatment of human patients.

One illustrative and nonlimiting example of the use of such techniques for the amelioration of β-thalassemia is as follows.

In an autologous procedure, genome editing is performed on cells derived from a patient with β-thalassemia. Since the patient's own cells are already matched, they do not therefore raise the potential issues associated with use of allogeneic cells. Correction of such cells ex vivo followed by their reintroduction into the patient presents a means of ameliorating the disease.

As one illustrative example of cells that can be used, peripheral blood stem cells (PBSCs) from a patient with β-thalassemia can be derived from the bloodstream. A process called apheresis or leukapheresis can be used to obtain the PBSCs. For 4 or 5 days before apheresis, the patient may be given a medication to increase the number of stem cells released into the bloodstream. In apheresis, blood is removed through a large vein in the arm or a central venous catheter (a flexible tube that is placed in a large vein in the neck, chest, or groin area). The blood goes through a machine that removes stem cells.

As another illustrative example of cells that can be used, hematopoietic stem cells (HSCs) can be harvested from the patient's bone marrow using well known techniques.

CD34 is an antigen associated with hematopoietic stem cells, and isolation of CD34+ HSCs can likewise be accomplished by well-known and clinically-validated methods. For example, a magnetic bead separation process that has been FDA-approved for use in various transplantation contexts and that is available commercially from Miltenyi Biotec, along with preparations for the handling and maintenance of such cells, can be used.

For treating a human patient with β-thalassemia as described herein, a population of CD34+ HSCs adjusted to reflect the patient's weight can be used, e.g. a population comprising about ten million CD34+ HSCs per kilogram of weight. This population of cells is then modified using the genome editing methods described herein. By way of illustration, if Cas9 is the genome editing endonuclease, the protein can be introduced into the CD34+ HSCs by transfection of mRNA using various known techniques; along with the introduction, potentially simultaneously in the transfection, of guide RNAs (which can be single-molecule guides or double-molecule guides) that target loci as described herein. Depending on the procedure used, a portion of the cells (e.g., half the original cells) may then be used for reintroduction into the patient. If ablation is to be used to enhance engraftment of the newly-introduced cells, the patient may be subject to, e.g., mild bone marrow conditioning prior to introduction of the genome edited HSCs. Following any conditioning, the population of genome edited HSCs can be reintroduced into the patient, e.g., by transfusion. Over time, the HSCs give rise to cells of the erythroid lineage, including red blood cells (RBCs).

In the resulting RBCs, genome editing in the case of β-thalassemia results in an increase in the level of HbF, and a concomitant decrease in unpaired α-globin chains; as a result of which one or more symptoms or complications associated with the β-thalassemia are ameliorated.

Example 12

Use of Edited Cells for the Amelioration of Sickle Cell Anemia

Using the methods described and illustrated herein, human cells expressing increased levels of HbF can be produced. Such cells can include, for example, human hematopoietic stem cells (human HSCs) that are capable of giving rise to cells of the erythroid lineage such as red blood cells (RBCs). Such HSCs can therefore be used to ameliorate one or more symptoms associated with Sickle Cell Disease, such as Sickle Cell Anemia.

For example, when the genome editing procedure is applied to increase the levels of HbF in cells of a patient suffering from a Sickle Cell Anemia (SCA), one or more symptoms or complications of SCA can be ameliorated. In certain embodiments, at least one copy of the mutant β-globin gene is knocked down or eliminated, resulting in combination of two beneficial effects. First, HbF provides a functional form of hemoglobin that can play a significant role in ameliorating the anemia and associated clinical conditions of SCA. Second, the level of sickle cell hemoglobin (HbS) expressed from the mutant β-globin is reduced or eliminated. The presence of HbS causes a number of the problems associated clinically with SCA, and even modest reductions in the presence of HbS can be used to reduce or essentially prevent sickling, as described herein and in the art.

As also noted herein, sickle cell RBCs have selective disadvantages compared to normal RBCs in terms of survival and other factors; and treatment of cells as described herein overcomes certain disadvantages by, e.g., increasing the levels of HbF, and, in embodiments in which the mutant β-globin gene is knocked down or eliminated, concomitantly decreasing the levels of HbS.

In addition, other techniques can be applied to enhance the delivery, expansion and/or persistence of cells modified by genome editing as described herein. These include ablation techniques in which some resident cells are eliminated prior to the introduction of cells. Such techniques are routinely used, for example, in the context of bone marrow transplantation and other procedures in which normal or corrected cells are introduced into patients. Numerous such procedures are known in the art and routinely practiced in connection with the treatment of human patients.

One illustrative and nonlimiting example of the use of such techniques for the amelioration of SCA is as follows.

In an autologous procedure, genome editing is performed on cells derived from a patient with SCA. Since the patient's own cells are already matched, they do not therefore raise the potential issues associated with use of allogeneic cells. Correction of such cells ex vivo followed by their reintroduction into the patient presents a means of ameliorating the disease.

As one illustrative example of cells that can be used, PBSCs from a patient with SCA can be derived from the bloodstream, or HSCs can be harvested from the patient's bone marrow, each as described above in the preceding example using well-known techniques. CD34+ cells can then be derived, using procedures as described in the preceding example and well-known techniques.

For treating a human patient with SCA as described herein, a population of CD34+ HSCs adjusted to reflect the patient's weight can be used, e.g. a population comprising about ten million CD34+ HSCs per kilogram of weight. This population of cells is then modified using the genome editing methods described herein. By way of illustration, if Cas9 is the genome editing endonuclease, the protein can be introduced into the CD34+ HSCs by transfection of mRNA using various known techniques; along with the introduction, potentially simultaneously in the transfection, of guide RNAs (which can be single-molecule guides or double-molecule guides) that target loci as described herein. Depending on the procedure used, a portion of the cells (e.g., half the original cells) may then be used for reintroduction into the patient. If ablation is to be used to enhance engraftment of the newly-introduced cells, the patient may be subject to, e.g., mild bone marrow conditioning prior to introduction of the genome edited HSCs. Following any conditioning, the population of genome edited HSCs can be reintroduced into the patient, e.g., by transfusion. Over time, the HSCs give rise to cells of the erythroid lineage, including red blood cells (RBCs).

In the resulting RBCs, genome editing in the case of SCA results in an increase in the level of HbF, and in embodiments in which the mutant β-globin gene is knocked down or eliminated, concomitantly decreasing the levels of HbS; as a result of which one or more symptoms or complications associated with the β-thalassemia are ameliorated.

Example 13—CRISPR/SpCas9 Target Sites for the Globin Locus

Regions of the globin locus were scanned for target sites. Each area was scanned for a protospacer adjacent motif (PAM) having the sequence NRG. gRNA 20 bp spacer sequences corresponding to the PAM were identified, as shown in SEQ ID NOs:1-56,961 of the Sequence Listing.

Example 14—CRISPR/SaCas9 Target Sites for the Globin Locus

Regions of the globin locus were scanned for target sites. Each area was scanned for a protospacer adjacent motif (PAM) having the sequence NNGRRT. gRNA 20 bp spacer sequences corresponding to the PAM were identified, as shown in SEQ ID NOs:56,962-64,104 of the Sequence Listing.

Example 15—CRISPR/StCas9 Target Sites for the Globin Locus

Regions of the globin locus were scanned for target sites. Each area was scanned for a protospacer adjacent motif (PAM) having the sequence NNAGAAW. gRNA 20 bp spacer sequences corresponding to the PAM were identified, as shown in SEQ ID NOs:64,105-66,998 of the Sequence Listing.

Example 16—CRISPR/TdCas9 Target Sites for the Globin Locus

Regions of the globin locus were scanned for target sites. Each area was scanned for a protospacer adjacent motif (PAM) having the sequence NAAAAC. gRNA 20 bp spacer sequences corresponding to the PAM were identified, as shown in SEQ ID NOs:66,999-68,146 of the Sequence Listing.

Example 17—CRISPR/NmCas9 Target Sites for the Globin Locus

Regions of the globin locus were scanned for target sites. Each area was scanned for a protospacer adjacent motif (PAM) having the sequence (NNNNGHTT). gRNA 20 bp spacer sequences corresponding to the PAM were identified, as shown in SEQ ID NOs:68,147-75,145 of the Sequence Listing.

Example 18—CRISPR/Acidominococcus and Lachnospiracease

Cpf1 Target Sites for the Globin Locus

Regions of the globin locus were scanned for target sites. Each area was scanned for a protospacer adjacent motif (PAM) having the sequence YTN. gRNA 22 bp spacer sequences corresponding to the PAM were identified, as shown in SEQ ID NOs:75,146-161,297 of the Sequence Listing.

Example 19—Development of Corfu Guide RNA (In Vitro Transcription, IVT)

Example 19A—Development of gRNA for Corfu Large Region

In this example, we illustrate use of the methods described herein in generating gRNAs for the Corfu Patient Deletion (located about ch11:5233163-5240389). Deletion of this "Corfu Large Region," ("CL") for example using the gRNA of the invention, may confer a HPFH phenotype. CRISPR gRNAs were designed to effect cleavage at each end of the Corfu Large Region and their respective editing efficiency was assayed. Efficient gRNA pairs can be selected and used for deletion of the Corfu Large Region. Methods for further refinement and selection of the gRNA pairs are also provided.

Guide RNA Design

Guide RNAs were designed using the methods described herein. Briefly, COSMID (CRISPR Off-target Sites with Mismatches, Insertions and Deletions) (available on the web at crispr.bme.gatech.edu) was used with cutoffs >0.42, <13.0 to generate 33 gRNAs (14 AS, 19 S) for the 5' to CL deletion. COSMID was used with cutoffs >0.48, <13.0 to generate 30 gRNAs (20 AS, 10 S). gRNA positions are shown graphically in FIGS. 9-10 and gRNA sequences are listed in Tables 1-2.

Figure 9:
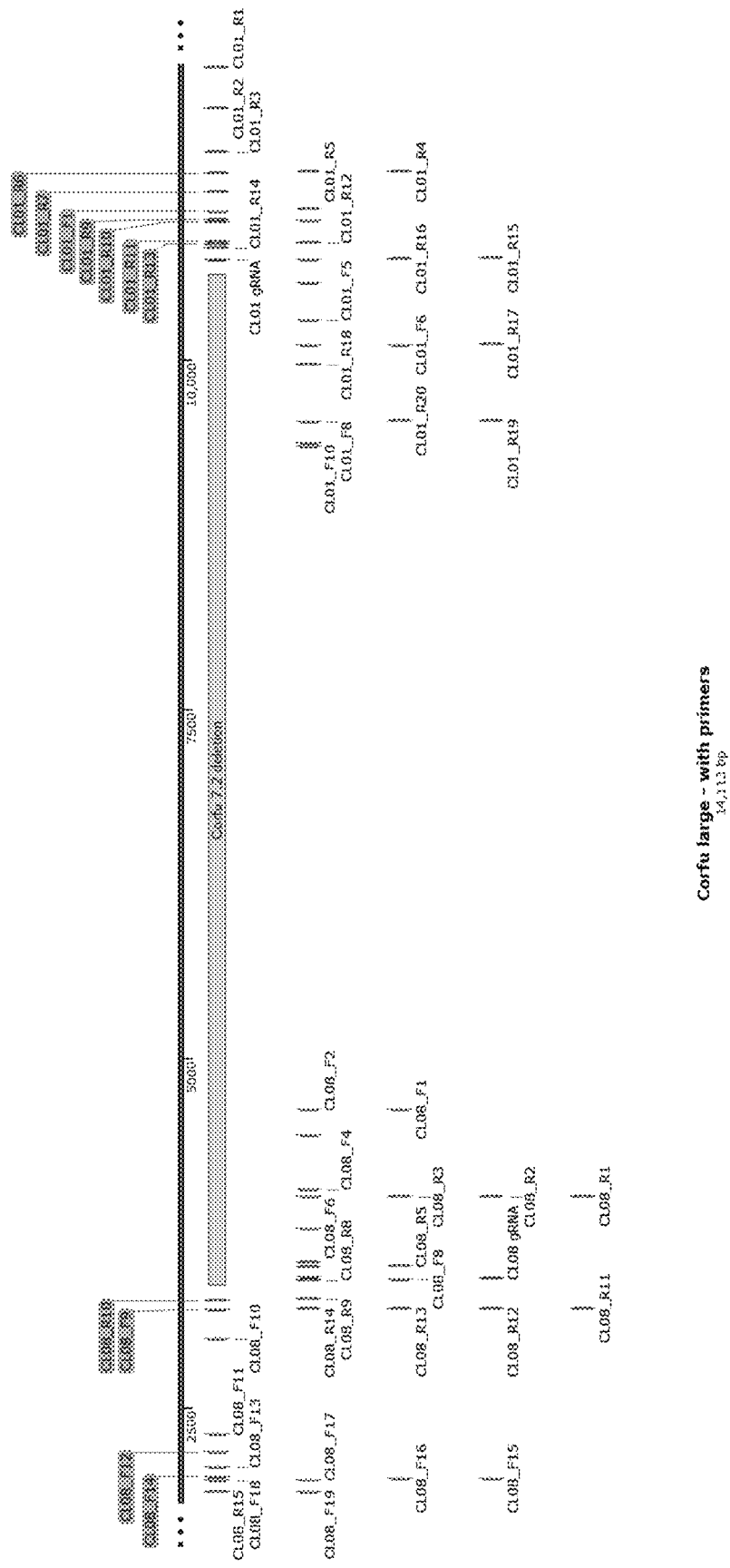
FIG. 9 presents a Corfu Large new guide map, showing 5' and 3' ends, as well as gRNA loci.

FIG. 9 presents a Corfu Large guide map, showing 5' and 3' ends, as well as gRNA loci.

Figure 10A:
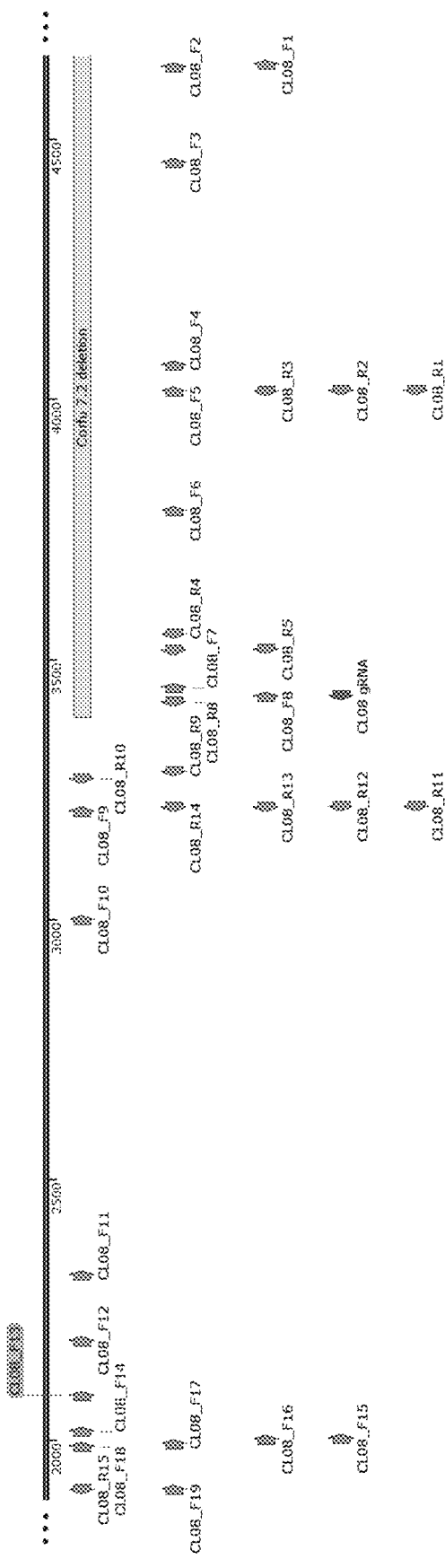
FIG. 10A presents and enlarged view of 5' end of Corfu Large new guide map (showing 33 new gRNA).

FIG. 10A presents and enlarged view of 5' end of Corfu Large guide map (showing 33 gRNA).

Figure 10B:
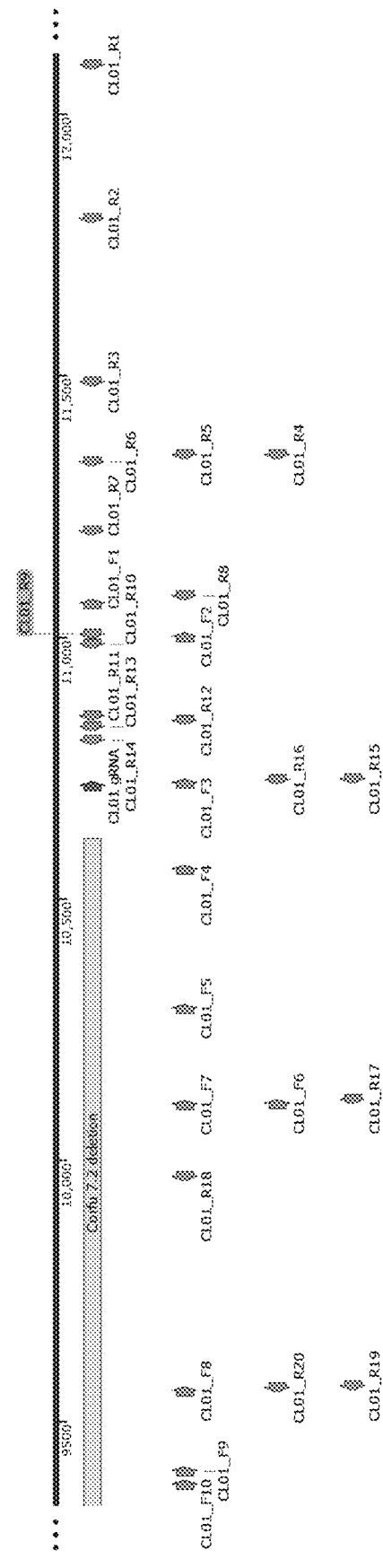
FIG. 10B presents an enlarged view of 3' end of Corfu Large new guide map (showing 30 new gRNA).

FIG. 10B presents an enlarged view of 3' end of Corfu Large guide map (showing 30 gRNA).

TABLE 1

5' gRNA. Note that where the guides are presented as DNA sequences (e.g., Tables 1-4), the gRNA is the corresponding RNA sequence.

| gRNA name | gRNA sequence | SEQ ID NO: |
|---|---|---|
| CL08_R15 | CAGAAATAGTGCGTCCTTT | 161,200 |
| CL08_F19 | AAGGACGCACTATTTCTGA | 161,201 |
| CL08_F18 | CAAGAAAAGAGAGAACTCG | 161,202 |
| CL08_F17 | AAAAGAGAGAACTCGTGGG | 161,203 |
| CL08_F16 | AACTCGTGGGTGGATTTAG | 161,204 |
| CL08_F15 | CTCGTGGGTGGATTTAGTG | 161,205 |
| CL08_F14 | TAGTGGGGTAGTTACTCCT | 161,206 |
| CL08_F13 | GGTCAATGGAGGTACTCTT | 161,207 |
| CL08_F12 | ACTCAGGATATAGCTCATT | 161,208 |
| CL08_F11 | TTTCTCTTAACGTCTTCAA | 161,209 |
| CL08_F10 | CTAACTTGGGTATAGTCAG | 161,210 |
| CL08_F9 | CAAGCCCCCTGTTTGGATC | 161,211 |
| CL08_R14 | ATTGCCAGATCCAAACAGG | 161,212 |
| CL08_R13 | CATTGCCAGATCCAAACAG | 161,213 |
| CL08_R12 | TCATTGCCAGATCCAAACA | 161,214 |
| CL08_R11 | TTCATTGCCAGATCCAAAC | 161,215 |
| CL08_R10 | TCCTAAGGGTCTTGGGTAC | 161,216 |
| CL08_R9 | GGTGCTACATACTTCCTAA | 161,217 |
| CL08_R8 | TATGGTGAGGTGAGCTCTT | 161,218 |
| CL08_F8 | CTCACCATATCTCTTGAGT | 161,219 |
| CL08_F7 | GTGGGAGCACATAGATAGG | 161,220 |
| CL08_R6 | GCTTTGTGGGTTATTAGTG | 161,221 |
| CL08_R5 | CTGCTTTGTGGGTTATTAG | 161,222 |
| CL08_R4 | ATTATTGTACATGAGCAAC | 161,223 |
| CL08_F6 | ACATAAGTACACATCTTAC | 161,224 |
| CL08_F5 | CCAGTCAATCTAGAGAATT | 161,225 |
| CL08_R3 | AAATTCTCTAGATTGACTG | 161,226 |
| CL08_R2 | CAAATTCTCTAGATTGACT | 161,227 |
| CL08_R1 | CCAAATTCTCTAGATTGAC | 161,228 |
| CL08_F4 | ACATGCTGTTCATTTACTC | 161,229 |
| CL08_F3 | ACCTAAACTGAGGAACCTT | 161,230 |
| CL08_F2 | TATCAGTTAGGGTCCATCA | 161,231 |
| CL08_F1 | GTTAGGGTCCATCAAGGAA | 161,232 |
| CL08 | CCACTCAAGAGATATGGTG | 161,309 |

TABLE 2

3' gRNA

| gRNA name | gRNA sequence | SEQ ID NO: |
|---|---|---|
| CL01_F10 | ACTGCTGTCAATGCCCTGT | 161,233 |
| CL01_F9 | AAGTGAACGTGGATGCAGT | 161,234 |
| CL01_F8 | TTTCCTACCCTCAGATTAC | 161,235 |
| CL01_R20 | CCACCAGTAATCTGAGGGT | 161,236 |
| CL01_R19 | TAGACCACCAGTAATCTGA | 161,237 |
| CL01_R18 | TTAAAATAGCAAGATTGTG | 161,238 |
| CL01_F7 | TTGTCTCTCCACATGGGTA | 161,239 |
| CL01_F6 | TGTCTCTCCACATGGGTAT | 161,240 |
| CL01_R17 | AGCCTCTCCCATACCCATG | 161,241 |
| CL01_F5 | TGGGGCAGAAGTCGTTGCT | 161,242 |
| CL01_F4 | ATGCTGATGGGAATAACCT | 161,243 |
| CL01_F3 | CTGGCCCGCAACTTTGGCA | 161,244 |
| CL01_R16 | AATTCCTTGCCAAAGTTGC | 161,245 |
| CL01_R15 | GAATTCCTTGCCAAAGTTG | 161,246 |
| CL01_R14 | CAATGGTACTTGTGAGCCA | 161,247 |
| CL01_R13 | GGTTATCAGGAAACAGTCC | 161,248 |
| CL01_R12 | GGGTCTTCTTATGGTTATC | 161,249 |
| CL01_R11 | GGGAAATAGGGTCTTCTTA | 161,250 |
| CL01_R10 | AGGAACCTTCTTACACACC | 161,251 |
| CL01_F2 | TTCCTGAGGCTCTACAGAT | 161,252 |
| CL01_R9 | TCCCTATCTGTAGAGCCTC | 161,253 |
| CL01_F1 | AAAGCAAGGGAACCGTACA | 161,254 |
| CL01_R8 | CACCCATTAATGCCTTGTA | 161,255 |
| CL01_R7 | AATCGTAGCATTACCCTTG | 161,256 |
| CL01_R6 | TTGATGGGGTATAGTATTA | 161,257 |
| CL01_R5 | GGAGCAGGAACACTTGATG | 161,258 |
| CL01_R4 | TGGAGCAGGAACACTTGAT | 161,259 |
| CL01_R3 | TAGAGAAGTTTATTGTGGC | 161,260 |
| CL01_R2 | ACAAAGAAACACTGTGCGA | 161,261 |
| CL01_R1 | ACACATTGTCAGTATATTC | 161,262 |
| CL01 | GTGTGCTGGCCCGCAACTT | 161,310 |

Experimental

The gRNA described above were ordered from Thermo Fisher (at median concentration 158.2 ng/μL). Experiments were carried out in mobilized peripheral blood CD34+ cells at 2 days post-thaw (CD34 from AllCells, Donor A5036). 5 μL of each guide was complexed with 1.9 μg of Cas9 (Feldan) for 10 min at room temperature. The resulting RNP mixture was electroporated into 50K of CD34 per guide with Lonza Amaxa 4D program CA-137, and cultured at 37° C. for 48 hours prior to genomic DNA extraction for TIDE analysis for editing efficiency. The resulting editing efficiency values are presented in FIG. 11.

Figure 11:
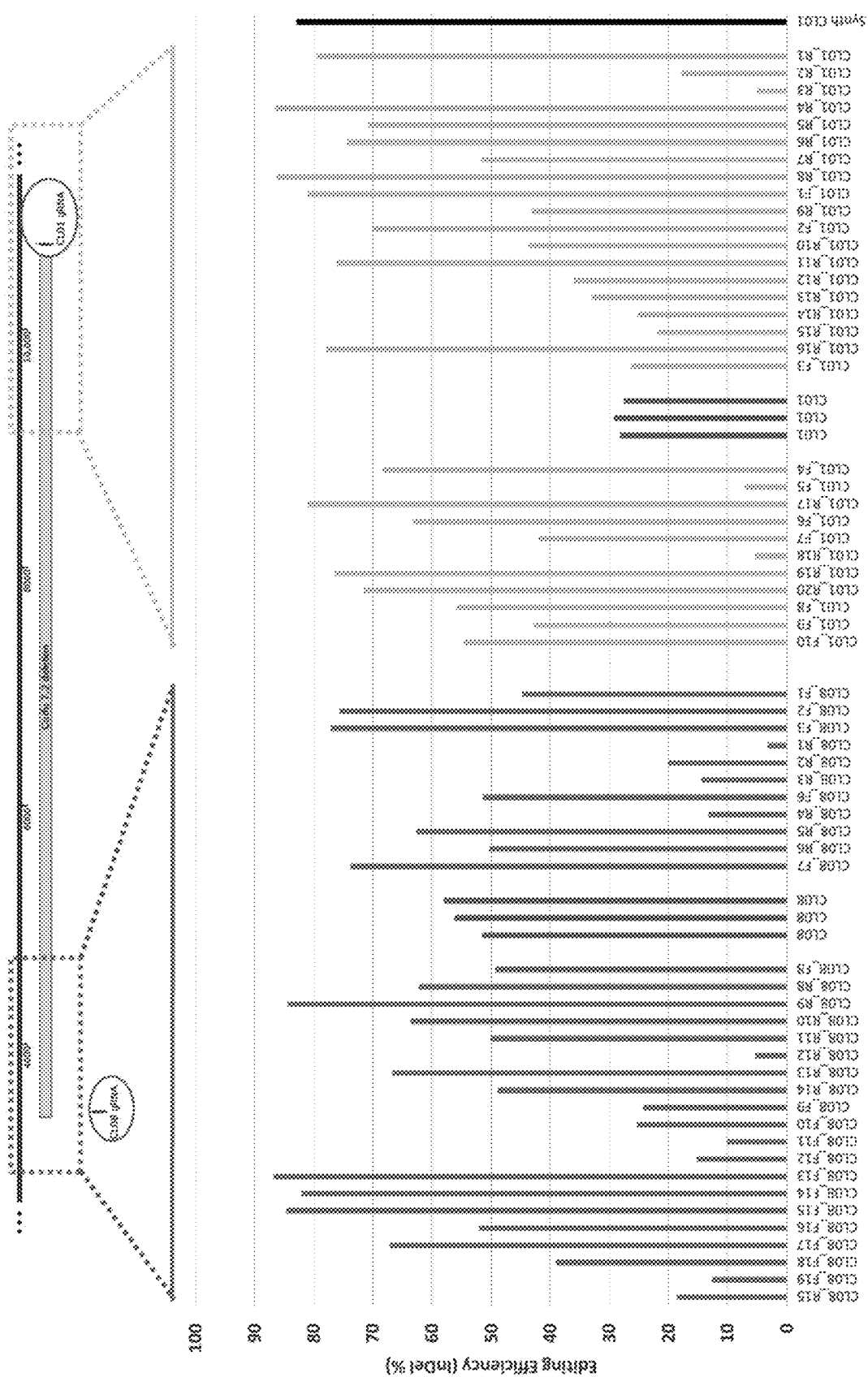
FIG. 11 presents the results of the editing efficiency screen results for Corfu Large gRNA.

FIG. 11 presents the results of the editing efficiency screen results for Corfu Large gRNA.

These data show that a number of screened sequences acted as efficient guide RNA in one CD34 donor. Notably, these guide RNA were all used at lower concentration (0.5-1 μg) than typical synthetic guides, but still resulted in high editing efficiencies. Therefore, these data identify a number of guide RNA pairs that could be used to target the Corfu Large Region.

These data also identify a number of guide RNA pairs that could be used for further development. Improved guide strands could be identified using methods described herein. One such example would be to (1) repeat the screen in a separate CD34 donor, (2) short list high efficiency gRNAs as chemically modified gRNAs and matrix for deletion strategy to screen for HbF increase upon erythroid differentiation, and (3) examine and select pairs based upon their efficiency as well as their off-target activity in CD34+ cells.

Example 19B—Development of gRNA for Corfu Small Region

In this example, we illustrate use of the methods described herein in generating gRNAs for the "Corfu Small Region" ("CS"), which is not a known naturally occurring deletion. Deletion of CS, for example using the gRNAs of the invention, may confer a HPFH phenotype. CRISPR gRNA were designed to effect cleavage at each end of the Corfu Small Region and their respective editing efficiency was assayed. Efficient gRNA pairs can be selected and used for deletion of the Corfu Small Region. Methods for further refinement and selection of the gRNA pairs are also provided.

Guide RNA Design

Guide RNAs were designed using the methods described herein. Briefly, COSMID (CRISPR Off-target Sites with Mismatches, Insertions and Deletions) (available on the web at crispr.bme.gatech.edu) was used with cutoffs >0.40, <15.0 to generate 46 gRNAs (20 AS; 26 S). gRNA positions are shown graphically in FIGS. 12-13 and gRNA sequences are listed in Tables 3-4.

Figure 12:
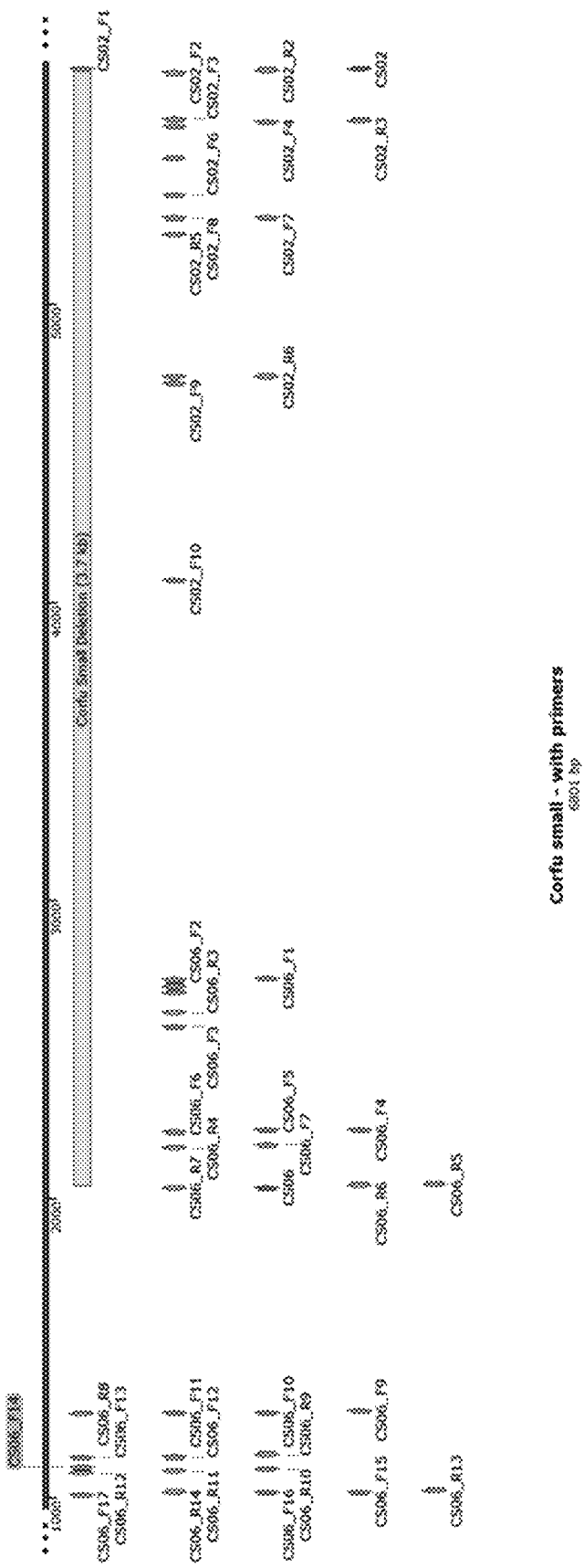
FIG. 12 presents a Corfu Small guide map, showing 5' and 3' ends, as well as gRNA loci.

FIG. 12 presents a Corfu Small guide map, showing 5' and 3' ends, as well as gRNA loci.

Figure 13A:
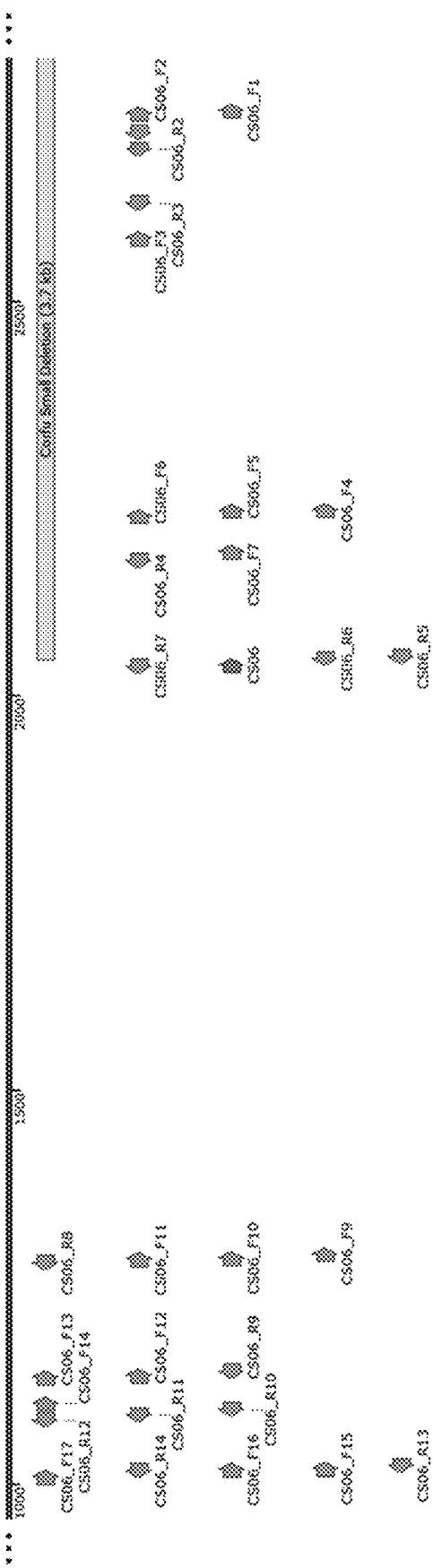
FIG. 13A presents a 5' Enlarged view of 5' end of Corfu Small guide map (showing 30 gRNA).

FIG. 13A presents a 5' Enlarged view of 5' end of Corfu Small guide map (showing 30 gRNA).

Figure 13B:
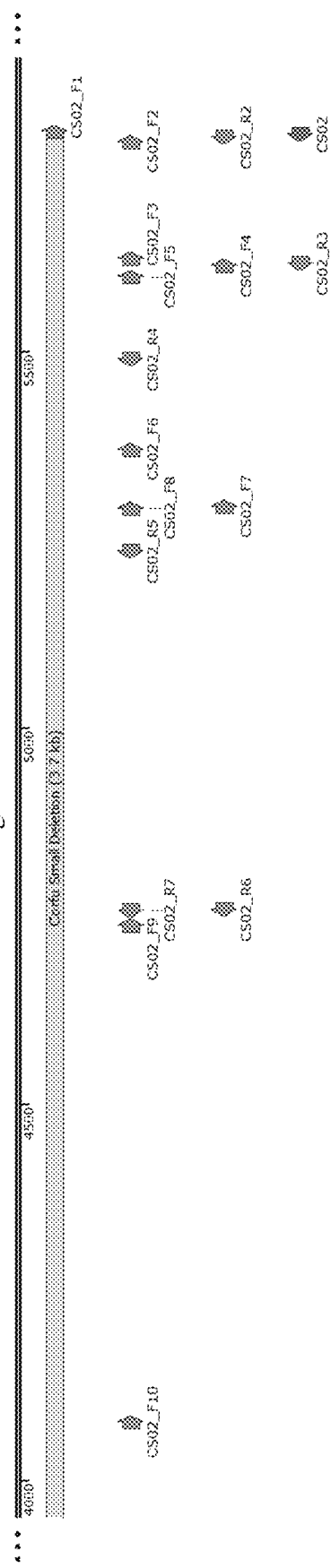
FIG. 13B presents an enlarged view of 3' end of Corfu Small guide map (showing 16 gRNA).

FIG. 13B presents an enlarged view of 3' end of Corfu Small guide map (showing 16 gRNA).

TABLE 3

5' gRNA

| gRNA name | gRNA sequence | SEQ ID NO: |
|---|---|---|
| CS06_F17 | GAAAACCTCTTCCGCCATT | 161,263 |
| CS06_R14 | CTAGGCCTAATGGCGGAAG | 161,264 |
| CS06_F16 | TTCCGCCATTAGGCCTAGA | 161,265 |
| CS06_F15 | TCCGCCATTAGGCCTAGAA | 161,266 |
| CS06_R13 | GCCCTTCTAGGCCTAATGG | 161,267 |
| CS06_R12 | GACCTCTGGTTATGGGCTC | 161,268 |
| CS06_R11 | CCAGTGGACCTCTGGTTAT | 161,269 |

TABLE 3-continued

5' gRNA

| gRNA name | gRNA sequence | SEQ ID NO: |
|---|---|---|
| CS06_R10 | ACTGAATCCAGTGGACCTC | 161,270 |
| CS06_F14 | CTGGATTCAGTGAGCTAGT | 161,271 |
| CS06_F13 | GAGAGCCAGAACTGTCTAA | 161,272 |
| CS06_F12 | GAGCCAGAACTGTCTAATG | 161,273 |
| CS06_R9 | TGCCCCATTAGACAGTTC | 161,274 |
| CS06_R8 | TCGCATGTACATTCTGCAA | 161,275 |
| CS06_F11 | GAATGTACATGCGACTGAA | 161,276 |
| CS06_F10 | AATGTACATGCGACTGAAA | 161,277 |
| CS06_F9 | ACATGCGACTGAAAGGGTG | 161,278 |
| CS06_R7 | TGGTATGGGAGGTATACTA | 161,279 |
| CS06_R6 | ATGAGCCACATGGTATGGG | 161,280 |
| CS06_R5 | AGGATGAGCCACATGGTAT | 161,281 |
| CS06_R4 | ATGGAAGTCAACTTGCTGT | 161,282 |
| CS06_F7 | CTTCCATTCTAACCCACAT | 161,283 |
| CS06_F6 | CTGAGTTCTAAAATCATCG | 161,284 |
| CS06_F5 | CTAAAATCATCGGGGATTT | 161,285 |
| CS06_F4 | TAAAATCATCGGGGATTTT | 161,286 |
| CS06_F3 | GCTACTTGCCCATTCACCA | 161,287 |
| CS06_R3 | CGAACTGTTGATTAGAGGT | 161,288 |
| CS06_R2 | GAAACAATGAGGACCTGAC | 161,289 |
| CS06_R1 | ATAGCATCTACTCTTGTTC | 161,290 |
| CS06_F2 | CCACTTTTAGACCTTATCC | 161,291 |
| CS06_F1 | TTTTAGACCTTATCCTGGC | 161,292 |
| CS06 | GTATACCTCCCATACCATG | 161,311 |

TABLE 4

3' gRNA

| gRNA name | gRNA sequence | SEQ ID NO: |
|---|---|---|
| CS02_F10 | TTAAGTGGCTACCGGTTTG | 161,293 |
| CS02_F9 | TCTGTACTAGCATATTCCC | 161,294 |
| CS02_R7 | TAAATTTAACGAAGTTCCT | 161,295 |
| CS02_R6 | TTAAATTTAACGAAGTTCC | 161,296 |
| CS02_R5 | GTGTTTTAGGCTAATATAG | 161,297 |
| CS02_F8 | ACTGCTGAAAGAGATGCGG | 161,298 |
| CS02_F7 | TGCTGAAAGAGATGCGGTG | 161,299 |
| CS02_F6 | CCAATCTCAGGGCAAGTTA | 161,300 |
| CS02_R4 | TCTGCCCTGCCTTTTATGC | 161,301 |

TABLE 4-continued

3' gRNA

| gRNA name | gRNA sequence | SEQ ID NO: |
|---|---|---|
| CS02_F5 | ACTGCTGTCAATGCCCTGT | 161,302 |
| CS02_F4 | CTGTGGGGCAAAGTGAACG | 161,303 |
| CS02_R3 | CACGTTCACTTTGCCCCAC | 161,304 |
| CS02_F3 | AAGTGAACGTGGATGCAGT | 161,305 |
| CS02_F2 | TTTCCTACCCTCAGATTAC | 161,306 |
| CS02_R2 | CCACCAGTAATCTGAGGGT | 161,307 |
| CS02_F1 | ATTACTGGTGGTCTACCCT | 161,308 |
| CS02 | TAGACCACCAGTAATCTGA | 161,312 |

Experimental

The gRNA described above were ordered from Thermo Fisher (at median concentration 160.6 ng/μL). Experiments were carried out in mobilized peripheral blood CD34$^+$ cells at 2 days post-thaw (CD34 from AllCells, Donor A5036). 5 μL of each guide was complexed with 1.9 μg of Cas9 (Feldan) for 10 min at room temperature. The resulting RNP mixture was electroporated into 50K of CD34 per guide with Lonza Amaxa 4D program CA-137, and cultured at 37° C. for 48 hours prior to genomic DNA extraction for TIDE analysis for editing efficiency. The resulting editing efficiency values are presented in FIG. 14.

FIG. 14 presents the results of the editing efficiency screen results for Corfu Small gRNA.

These data show that most screened sequences acted as efficient guide RNA in one CD34 donor. Notably, these guide RNA were all used at lower concentration (0.5-1 μg) than typical synthetic guides, but still resulted in very high editing efficiencies. Therefore, these data identify a number of guide RNA pairs that could be used to target the Corfu Small Region.

These data also identify a number of guide RNA pairs that could be used for further development. Improved guide strands could be identified using methods described herein. One such example would be to (1) repeat the screen in a separate CD34 donor, (2) short list high efficiency gRNAs as chemically modified gRNAs and matrix for deletion strategy to screen for HbF increase upon erythroid differentiation, and (3) examine and select pairs based upon their efficiency as well as their off-target activity in CD34+ cells.

Note Regarding Illustrative Embodiments

While the present disclosure provides descriptions of various specific embodiments for purpose of illustrating various aspects of the present invention and/or its potential applications, it is understood that variations and modifications will occur to those skilled in the art. Accordingly, the invention or inventions described herein should be understood to be at least as broad as they are claimed, and not as more narrowly defined by particular illustrative embodiments provided herein.

All documents cited in this application are hereby incorporated by reference in their entirety, with particular attention to the disclosure for which they are referred.

SEQUENCE LISTING (161315 sequences)

SEQ ID NO: 1 - DNA, 20 bp, Artificial Sequence
  chemically synthesized
aaaaaaatgatctatgacct

SEQ ID NO: 2 - DNA, 20 bp, Artificial Sequence
  chemically synthesized
aaaaaatgatctatgacctg

SEQ ID NO: 3 - DNA, 20 bp, Artificial Sequence
  chemically synthesized
tctatgacctgaggtttttc

SEQ ID NO: 4 - DNA, 20 bp, Artificial Sequence
  chemically synthesized
gtttttcaagaacaattgac

SEQ ID NO: 5 - DNA, 20 bp, Artificial Sequence
  chemically synthesized
aattcttatgccactaattt

SEQ ID NO: 6 - DNA, 20 bp, Artificial Sequence
  chemically synthesized
gccactaattttagacaata

SEQ ID NO: 7 - DNA, 20 bp, Artificial Sequence
  chemically synthesized
cctcctcttcactaacacaa

SEQ ID NO: 8 - DNA, 20 bp, Artificial Sequence
  chemically synthesized
cttcactaacacaatagccc

SEQ ID NO: 9 - DNA, 20 bp, Artificial Sequence
  chemically synthesized
acttatttatatttgctgtg

SEQ ID NO: 10 - DNA, 20 bp, Artificial Sequence
  chemically synthesized
tggtatgctgccacatgccc

SEQ ID NO: 11 - DNA, 20 bp, Artificial Sequence
  chemically synthesized
tatgctgccacatgcccaag

SEQ ID NO: 12 - DNA, 20 bp, Artificial Sequence
  chemically synthesized
acacacacacgtcttacttg

SEQ ID NO: 13 - DNA, 20 bp, Artificial Sequence
  chemically synthesized
acgtcttacttgtagaacac

SEQ ID NO: 14 - DNA, 20 bp, Artificial Sequence
  chemically synthesized
aacaaatgaatactctccaa

SEQ ID NO: 15 - DNA, 20 bp, Artificial Sequence
  chemically synthesized
tactctccaatggcacatta

SEQ ID NO: 16 - DNA, 20 bp, Artificial Sequence
  chemically synthesized
caatggcacattatagcttt

SEQ ID NO: 17 - DNA, 20 bp, Artificial Sequence
  chemically synthesized
acattatagcttttggaata

SEQ ID NO: 18 - DNA, 20 bp, Artificial Sequence
  chemically synthesized
atagcttttggaataaagtc

SEQ ID NO: 19 - DNA, 20 bp, Artificial Sequence
  chemically synthesized
gcaactctgcacaacattaa

SEQ ID NO: 20 - DNA, 20 bp, Artificial Sequence
  chemically synthesized
catattttccttgtctcccc

SEQ ID NO: 21 - DNA, 20 bp, Artificial Sequence
  chemically synthesized
tcataccatattgaaaaaac

SEQ ID NO: 22 - DNA, 20 bp, Artificial Sequence
  chemically synthesized
ataccatattgaaaaaacta

SEQ ID NO: 23 - DNA, 20 bp, Artificial Sequence
  chemically synthesized
ttaccttaaactacattatc

SEQ ID NO: 24 - DNA, 20 bp, Artificial Sequence
  chemically synthesized
aatctcctctactatctacc

SEQ ID NO: 25 - DNA, 20 bp, Artificial Sequence
  chemically synthesized
atgatgtgttcttacttcct

SEQ ID NO: 26 - DNA, 20 bp, Artificial Sequence
  chemically synthesized
ctactcatccatcattcctc

SEQ ID NO: 27 - DNA, 20 bp, Artificial Sequence
  chemically synthesized
atccatcattcctcaagaat

SEQ ID NO: 28 - DNA, 20 bp, Artificial Sequence
  chemically synthesized
ccatcattcctcaagaatca

SEQ ID NO: 29 - DNA, 20 bp, Artificial Sequence
  chemically synthesized
catcattcctcaagaatcag

SEQ ID NO: 30 - DNA, 20 bp, Artificial Sequence
  chemically synthesized
taaatgcaactcccctgctt

SEQ ID NO: 31 - DNA, 20 bp, Artificial Sequence
  chemically synthesized
tgcaactcccctgctttggt

SEQ ID NO: 32 - DNA, 20 bp, Artificial Sequence
  chemically synthesized
ttccccacctctcttccttt

SEQ ID NO: 33 - DNA, 20 bp, Artificial Sequence
  chemically synthesized
tcctttcagtctctcttttc

SEQ ID NO: 34 - DNA, 20 bp, Artificial Sequence
  chemically synthesized
ctctcttttccagaattaca

SEQ ID NO: 35 - DNA, 20 bp, Artificial Sequence
  chemically synthesized
tctcttttccagaattacat

SEQ ID NO: 36 - DNA, 20 bp, Artificial Sequence
  chemically synthesized
ttacataggtacaaactcat

SEQ ID NO: 37 - DNA, 20 bp, Artificial Sequence
  chemically synthesized
atgagaattattcactgtgc

SEQ ID NO: 38 - DNA, 20 bp, Artificial Sequence
  chemically synthesized
actattatgtcacgattctg

SEQ ID NO: 39 - DNA, 20 bp, Artificial Sequence
  chemically synthesized
tatgtcacgattctgtagta

SEQ ID NO: 40 - DNA, 20 bp, Artificial Sequence
  chemically synthesized
gtatagtatttttaatattg

SEQ ID NO: 41 - DNA, 20 bp, Artificial Sequence
  chemically synthesized
tatagtatttttaatattgc

SEQ ID NO: 42 - DNA, 20 bp, Artificial Sequence
  chemically synthesized
gataaaatgatgaattaata

SEQ ID NO: 43 - DNA, 20 bp, Artificial Sequence
  chemically synthesized
aaaatgatgaattaataaag

SEQ ID NO: 44 - DNA, 20 bp, Artificial Sequence
  chemically synthesized
ttaataaagaagtaaatttt

SEQ ID NO: 45 - DNA, 20 bp, Artificial Sequence
  chemically synthesized
taataaagaagtaaattttg

SEQ ID NO: 46 - DNA, 20 bp, Artificial Sequence
  chemically synthesized
aaagaagtaaattttgaggt

SEQ ID NO: 47 - DNA, 20 bp, Artificial Sequence
  chemically synthesized
gatgtgtcaaatgcaacacc

SEQ ID NO: 48 - DNA, 20 bp, Artificial Sequence
  chemically synthesized
tgaaaatgtatttaaatttt

SEQ ID NO: 49 - DNA, 20 bp, Artificial Sequence
  chemically synthesized
gaaaatgtatttaaattttt

SEQ ID NO: 50 - DNA, 20 bp, Artificial Sequence
  chemically synthesized
tattgtctcttgatattcat

SEQ ID NO: 51 - DNA, 20 bp, Artificial Sequence
  chemically synthesized
ttcataagattttctttgac

SEQ ID NO: 52 - DNA, 20 bp, Artificial Sequence
  chemically synthesized
gattttctttgacaagaaca

SEQ ID NO: 53 - DNA, 20 bp, Artificial Sequence
  chemically synthesized
ttcctttgattttttttttt

SEQ ID NO: 54 - DNA, 20 bp, Artificial Sequence
  chemically synthesized
tcctttgattttttttttta

SEQ ID NO: 55 - DNA, 20 bp, Artificial Sequence
  chemically synthesized
tttgatttttttttttaagg

SEQ ID NO: 56 - DNA, 20 bp, Artificial Sequence
  chemically synthesized
ttgatttttttttttaaggc

SEQ ID NO: 57 - DNA, 20 bp, Artificial Sequence
  chemically synthesized
tgatttttttttttaaggca

SEQ ID NO: 58 - DNA, 20 bp, Artificial Sequence
  chemically synthesized
tttttaaggcagggatgatc

SEQ ID NO: 59 - DNA, 20 bp, Artificial Sequence
  chemically synthesized
gcagggatgatcaagaaaat

SEQ ID NO: 60 - DNA, 20 bp, Artificial Sequence
  chemically synthesized
agggatgatcaagaaaatga

SEQ ID NO: 61 - DNA, 20 bp, Artificial Sequence
  chemically synthesized
gtcaacaacttgttttcatt

SEQ ID NO: 62 - DNA, 20 bp, Artificial Sequence
  chemically synthesized
acttgttttcattgagtccc

SEQ ID NO: 63 - DNA, 20 bp, Artificial Sequence
  chemically synthesized
cattgagtccctggatgttt

SEQ ID NO: 64 - DNA, 20 bp, Artificial Sequence
  chemically synthesized
cctggatgtttcagaacaac

SEQ ID NO: 65 - DNA, 20 bp, Artificial Sequence
  chemically synthesized
tgtttcagaacaacgagcct

SEQ ID NO: 66 - DNA, 20 bp, Artificial Sequence
  chemically synthesized
gtttcagaacaacgagcctt

SEQ ID NO: 67 - DNA, 20 bp, Artificial Sequence
  chemically synthesized
gccttaggtgcatttaaatt

SEQ ID NO: 68 - DNA, 20 bp, Artificial Sequence
  chemically synthesized
tgcatttaaattcagtgaca

SEQ ID NO: 69 - DNA, 20 bp, Artificial Sequence
  chemically synthesized
gcatttaaattcagtgacaa

SEQ ID NO: 70 - DNA, 20 bp, Artificial Sequence
  chemically synthesized
gcataatttataaatcctcc

SEQ ID NO: 71 - DNA, 20 bp, Artificial Sequence
  chemically synthesized
ataatttataaatcctcctg

SEQ ID NO: 72 - DNA, 20 bp, Artificial Sequence
  chemically synthesized
tcctcctggagaaatattct

SEQ ID NO: 73 - DNA, 20 bp, Artificial Sequence
  chemically synthesized
tcctggagaaatattcttag

SEQ ID NO: 74 - DNA, 20 bp, Artificial Sequence
  chemically synthesized
tcttagaagaataactcaac

SEQ ID NO: 75 - DNA, 20 bp, Artificial Sequence
  chemically synthesized
cttagaagaataactcaacc

SEQ ID NO: 76 - DNA, 20 bp, Artificial Sequence
  chemically synthesized
ttagaagaataactcaacca

SEQ ID NO: 77 - DNA, 20 bp, Artificial Sequence
  chemically synthesized
tagaagaataactcaaccag

SEQ ID NO: 78 - DNA, 20 bp, Artificial Sequence
  chemically synthesized
aataactcaaccaggggcta

SEQ ID NO: 79 - DNA, 20 bp, Artificial Sequence
  chemically synthesized
aaccaggggctaaagaataa

SEQ ID NO: 80 - DNA, 20 bp, Artificial Sequence
  chemically synthesized
ccaggggctaaagaataaaa

SEQ ID NO: 81 - DNA, 20 bp, Artificial Sequence
  chemically synthesized
ttcacacttctcactttcat

SEQ ID NO: 82 - DNA, 20 bp, Artificial Sequence
  chemically synthesized
tctcactttcattagtcacg

SEQ ID NO: 83 - DNA, 20 bp, Artificial Sequence
  chemically synthesized
acaatcccactgattgatat

SEQ ID NO: 84 - DNA, 20 bp, Artificial Sequence
  chemically synthesized
gagccatgatgatctaaaac

SEQ ID NO: 85 - DNA, 20 bp, Artificial Sequence
  chemically synthesized
tctaaaaccagctattgtgc

SEQ ID NO: 86 - DNA, 20 bp, Artificial Sequence
  chemically synthesized
aaaaccagctattgtgctgg

SEQ ID NO: 87 - DNA, 20 bp, Artificial Sequence
  chemically synthesized
gctggcagatttcacaaacc

SEQ ID NO: 88 - DNA, 20 bp, Artificial Sequence
  chemically synthesized
ttttttgttttgttttgata

SEQ ID NO: 89 - DNA, 20 bp, Artificial Sequence
  chemically synthesized
tgatatggttactactgcaa

SEQ ID NO: 90 - DNA, 20 bp, Artificial Sequence
  chemically synthesized
gttactactgcaaaagaaaa

SEQ ID NO: 91 - DNA, 20 bp, Artificial Sequence
  chemically synthesized
ctgcaaaagaaaaaagcatg

SEQ ID NO: 92 - DNA, 20 bp, Artificial Sequence
  chemically synthesized
tgcaaaagaaaaaagcatgt

SEQ ID NO: 93 - DNA, 20 bp, Artificial Sequence
  chemically synthesized
aaagcatgtaggcattaatt

SEQ ID NO: 94 - DNA, 20 bp, Artificial Sequence
  chemically synthesized
aagcatgtaggcattaatta

SEQ ID NO: 95 - DNA, 20 bp, Artificial Sequence
  chemically synthesized
catgtaggcattaattaagg

SEQ ID NO: 96 - DNA, 20 bp, Artificial Sequence
  chemically synthesized
attaaggtggattttatgaa

SEQ ID NO: 97 - DNA, 20 bp, Artificial Sequence
  chemically synthesized
cacatgaatgcgaatctgtg

SEQ ID NO: 98 - DNA, 20 bp, Artificial Sequence
  chemically synthesized
tctgtgtggtctttgcacca

SEQ ID NO: 99 - DNA, 20 bp, Artificial Sequence
  chemically synthesized
gtggtctttgcaccatagac

SEQ ID NO: 100 - DNA, 20 bp, Artificial Sequence
  chemically synthesized
gtctttgcaccatagacaag

SEQ ID NO: 101 - DNA, 20 bp, Artificial Sequence
  chemically synthesized
gcaccatagacaagtggatt

SEQ ID NO: 102 - DNA, 20 bp, Artificial Sequence
  chemically synthesized
tagacaagtggattgagaaa

SEQ ID NO: 103 - DNA, 20 bp, Artificial Sequence
  chemically synthesized
gacaagtggattgagaaatg

SEQ ID NO: 104 - DNA, 20 bp, Artificial Sequence
  chemically synthesized
acaagtggattgagaaatgg

SEQ ID NO: 105 - DNA, 20 bp, Artificial Sequence
  chemically synthesized
caagtggattgagaaatgga

SEQ ID NO: 106 - DNA, 20 bp, Artificial Sequence
  chemically synthesized
ggattgagaaatggagggac

SEQ ID NO: 107 - DNA, 20 bp, Artificial Sequence
  chemically synthesized
tgagaaatggagggaccagc

SEQ ID NO: 108 - DNA, 20 bp, Artificial Sequence
  chemically synthesized
agggaccagcaagtaaatgc

SEQ ID NO: 109 - DNA, 20 bp, Artificial Sequence
  chemically synthesized
ccagcaagtaaatgctagaa

SEQ ID NO: 110 - DNA, 20 bp, Artificial Sequence
  chemically synthesized
agcaagtaaatgctagaaaa

SEQ ID NO: 111 - DNA, 20 bp, Artificial Sequence
  chemically synthesized
aaatgctagaaaagagaata

SEQ ID NO: 112 - DNA, 20 bp, Artificial Sequence
  chemically synthesized
agaaaagagaatatggatat

SEQ ID NO: 113 - DNA, 20 bp, Artificial Sequence
  chemically synthesized
gaaaagagaatatggatata

SEQ ID NO: 114 - DNA, 20 bp, Artificial Sequence
  chemically synthesized
aaaagagaatatggatataa

SEQ ID NO: 115 - DNA, 20 bp, Artificial Sequence
  chemically synthesized
aaagagaatatggatataag

SEQ ID NO: 116 - DNA, 20 bp, Artificial Sequence
  chemically synthesized
agagaatatggatataaggg

SEQ ID NO: 117 - DNA, 20 bp, Artificial Sequence
  chemically synthesized
atggatataaggggagatgt

SEQ ID NO: 118 - DNA, 20 bp, Artificial Sequence
  chemically synthesized
gagacccaaacctatgtgtg

SEQ ID NO: 119 - DNA, 20 bp, Artificial Sequence
  chemically synthesized
acccaaacctatgtgtgaag

SEQ ID NO: 120 - DNA, 20 bp, Artificial Sequence
  chemically synthesized
cccaaacctatgtgtgaaga

SEQ ID NO: 121 - DNA, 20 bp, Artificial Sequence
  chemically synthesized
caaacctatgtgtgaagaag

SEQ ID NO: 122 - DNA, 20 bp, Artificial Sequence
  chemically synthesized
acctatgtgtgaagaaggag

SEQ ID NO: 123 - DNA, 20 bp, Artificial Sequence
  chemically synthesized
tatgtgtgaagaaggagaag

SEQ ID NO: 124 - DNA, 20 bp, Artificial Sequence
  chemically synthesized
atgtgtgaagaaggagaaga

SEQ ID NO: 125 - DNA, 20 bp, Artificial Sequence
  chemically synthesized
gtgaagaaggagaagaaggc

SEQ ID NO: 126 - DNA, 20 bp, Artificial Sequence
  chemically synthesized
tgaagaaggagaagaaggca

SEQ ID NO: 127 - DNA, 20 bp, Artificial Sequence
  chemically synthesized
aagaaggagaagaaggcaag

SEQ ID NO: 128 - DNA, 20 bp, Artificial Sequence
  chemically synthesized
agaaggagaagaaggcaagg

SEQ ID NO: 129 - DNA, 20 bp, Artificial Sequence
  chemically synthesized
aggagaagaaggcaaggagg

SEQ ID NO: 130 - DNA, 20 bp, Artificial Sequence
  chemically synthesized
agaaggcaaggaggtagaac

SEQ ID NO: 131 - DNA, 20 bp, Artificial Sequence
  chemically synthesized
aaggcaaggaggtagaactg

SEQ ID NO: 132 - DNA, 20 bp, Artificial Sequence
  chemically synthesized
aggcaaggaggtagaactgg

SEQ ID NO: 133 - DNA, 20 bp, Artificial Sequence
  chemically synthesized
caaggaggtagaactggagg

SEQ ID NO: 134 - DNA, 20 bp, Artificial Sequence
  chemically synthesized
ggtagaactggaggaagaca

SEQ ID NO: 135 - DNA, 20 bp, Artificial Sequence
  chemically synthesized
ctggaggaagacacagatgt

SEQ ID NO: 136 - DNA, 20 bp, Artificial Sequence
  chemically synthesized
agacacagatgtgagcaatg

SEQ ID NO: 137 - DNA, 20 bp, Artificial Sequence
  chemically synthesized
gacacagatgtgagcaatgc

SEQ ID NO: 138 - DNA, 20 bp, Artificial Sequence
  chemically synthesized
ggtattgaatgctttaaacc

SEQ ID NO: 139 - DNA, 20 bp, Artificial Sequence
  chemically synthesized
ctttaaacctagcctccttc

SEQ ID NO: 140 - DNA, 20 bp, Artificial Sequence
  chemically synthesized
tttaaacctagcctccttct

SEQ ID NO: 141 - DNA, 20 bp, Artificial Sequence
  chemically synthesized
ttaaacctagcctccttctg

SEQ ID NO: 142 - DNA, 20 bp, Artificial Sequence
  chemically synthesized
gaaaaactgtgataaatatc

SEQ ID NO: 143 - DNA, 20 bp, Artificial Sequence
  chemically synthesized
ctgtgataaatatctggatg

SEQ ID NO: 144 - DNA, 20 bp, Artificial Sequence
  chemically synthesized
tgtgataaatatctggatgt

SEQ ID NO: 145 - DNA, 20 bp, Artificial Sequence
  chemically synthesized
taggacaatgtgatgaatgt

SEQ ID NO: 146 - DNA, 20 bp, Artificial Sequence
  chemically synthesized
aggacaatgtgatgaatgtg

SEQ ID NO: 147 - DNA, 20 bp, Artificial Sequence
  chemically synthesized
tgtgaggtcaaatcctgcta

SEQ ID NO: 148 - DNA, 20 bp, Artificial Sequence
  chemically synthesized
ggtcaaatcctgctacagtg

SEQ ID NO: 149 - DNA, 20 bp, Artificial Sequence
  chemically synthesized
gtcaaatcctgctacagtga

SEQ ID NO: 150 - DNA, 20 bp, Artificial Sequence
  chemically synthesized
tgaaggccacaaacaaacca

SEQ ID NO: 151 - DNA, 20 bp, Artificial Sequence
  chemically synthesized
acttgaacatttgctgctgc

SEQ ID NO: 152 - DNA, 20 bp, Artificial Sequence
  chemically synthesized
tgctgctgctagtttcacaa

SEQ ID NO: 153 - DNA, 20 bp, Artificial Sequence
  chemically synthesized
tcacaatggccatatgctca

SEQ ID NO: 154 - DNA, 20 bp, Artificial Sequence
  chemically synthesized
caatggccatatgctcacag

SEQ ID NO: 155 - DNA, 20 bp, Artificial Sequence
  chemically synthesized
aatggccatatgctcacagt

SEQ ID NO: 156 - DNA, 20 bp, Artificial Sequence
  chemically synthesized
tggccatatgctcacagtag

SEQ ID NO: 157 - DNA, 20 bp, Artificial Sequence
  chemically synthesized
ccatatgctcacagtaggag

SEQ ID NO: 158 - DNA, 20 bp, Artificial Sequence
  chemically synthesized
catatgctcacagtaggagt

SEQ ID NO: 159 - DNA, 20 bp, Artificial Sequence
  chemically synthesized
tatgctcacagtaggagtgg

SEQ ID NO: 160 - DNA, 20 bp, Artificial Sequence
  chemically synthesized
ttgtgtgataaaattgaaac

SEQ ID NO: 161 - DNA, 20 bp, Artificial Sequence
  chemically synthesized
aattgaaaccggcactttat

SEQ ID NO: 162 - DNA, 20 bp, Artificial Sequence
  chemically synthesized
aaccggcactttatcagtac

SEQ ID NO: 163 - DNA, 20 bp, Artificial Sequence
  chemically synthesized
accggcactttatcagtact

SEQ ID NO: 164 - DNA, 20 bp, Artificial Sequence
  chemically synthesized
cactttatcagtactaggca

SEQ ID NO: 165 - DNA, 20 bp, Artificial Sequence
  chemically synthesized
actttatcagtactaggcat

SEQ ID NO: 166 - DNA, 20 bp, Artificial Sequence
  chemically synthesized
ctttatcagtactaggcatg

SEQ ID NO: 167 - DNA, 20 bp, Artificial Sequence
  chemically synthesized
agtactaggcatggggctac

SEQ ID NO: 168 - DNA, 20 bp, Artificial Sequence
  chemically synthesized
taggcatggggctacaagaa

SEQ ID NO: 169 - DNA, 20 bp, Artificial Sequence
  chemically synthesized
gcatggggctacaagaatag

SEQ ID NO: 170 - DNA, 20 bp, Artificial Sequence
  chemically synthesized
gctacaagaatagcagccct

SEQ ID NO: 171 - DNA, 20 bp, Artificial Sequence
  chemically synthesized
agcagccctgagtacgacca

SEQ ID NO: 172 - DNA, 20 bp, Artificial Sequence
  chemically synthesized
atagttcctatctgaatgac

SEQ ID NO: 173 - DNA, 20 bp, Artificial Sequence
  chemically synthesized
ttcctatctgaatgacaagc

SEQ ID NO: 174 - DNA, 20 bp, Artificial Sequence
  chemically synthesized
ctatctgaatgacaagctgg

SEQ ID NO: 175 - DNA, 20 bp, Artificial Sequence
  chemically synthesized
tatctgaatgacaagctggt

SEQ ID NO: 176 - DNA, 20 bp, Artificial Sequence
  chemically synthesized
gaatgacaagctggtgggtg

SEQ ID NO: 177 - DNA, 20 bp, Artificial Sequence
  chemically synthesized
aagctggtgggtgaagatgt

SEQ ID NO: 178 - DNA, 20 bp, Artificial Sequence
  chemically synthesized
gtgaagatgttggcatgtct

SEQ ID NO: 179 - DNA, 20 bp, Artificial Sequence
  chemically synthesized
aagatgttggcatgtcttag

SEQ ID NO: 180 - DNA, 20 bp, Artificial Sequence
  chemically synthesized
tggcatgtcttagtggataa

SEQ ID NO: 181 - DNA, 20 bp, Artificial Sequence
  chemically synthesized
atgtcttagtggataacaga

SEQ ID NO: 182 - DNA, 20 bp, Artificial Sequence
  chemically synthesized
gataacagatggccacataa

SEQ ID NO: 183 - DNA, 20 bp, Artificial Sequence
  chemically synthesized
cagatggccacataacggtc

SEQ ID NO: 184 - DNA, 20 bp, Artificial Sequence
  chemically synthesized
agatggccacataacggtcc

SEQ ID NO: 185 - DNA, 20 bp, Artificial Sequence
  chemically synthesized
gatggccacataacggtcca

SEQ ID NO: 186 - DNA, 20 bp, Artificial Sequence
  chemically synthesized
cacataacggtccagggcca

SEQ ID NO: 187 - DNA, 20 bp, Artificial Sequence
  chemically synthesized
cggtccagggccatggccac

SEQ ID NO: 188 - DNA, 20 bp, Artificial Sequence
  chemically synthesized
ggtccagggccatggccaca

SEQ ID NO: 189 - DNA, 20 bp, Artificial Sequence
  chemically synthesized
actctataccctgcaatgtg

SEQ ID NO: 190 - DNA, 20 bp, Artificial Sequence
  chemically synthesized
gtgtggatgaaccacatttg

SEQ ID NO: 191 - DNA, 20 bp, Artificial Sequence
  chemically synthesized
ggatgaaccacatttgaagc

SEQ ID NO: 192 - DNA, 20 bp, Artificial Sequence
  chemically synthesized
tgaaccacatttgaagcaag

SEQ ID NO: 193 - DNA, 20 bp, Artificial Sequence
  chemically synthesized
gaaccacatttgaagcaagc

SEQ ID NO: 194 - DNA, 20 bp, Artificial Sequence
  chemically synthesized
gaagcaagcaggaatcaaaa

SEQ ID NO: 195 - DNA, 20 bp, Artificial Sequence
  chemically synthesized
gcaggaatcaaaatagattt

SEQ ID NO: 196 - DNA, 20 bp, Artificial Sequence
  chemically synthesized
caggaatcaaaatagatttc

SEQ ID NO: 197 - DNA, 20 bp, Artificial Sequence
  chemically synthesized
agatttcaggcacattaaac

SEQ ID NO: 198 - DNA, 20 bp, Artificial Sequence
  chemically synthesized
acattaaaccagaatattcc

SEQ ID NO: 199 - DNA, 20 bp, Artificial Sequence
  chemically synthesized
cagaatattccaagcatctt

SEQ ID NO: 200 - DNA, 20 bp, Artificial Sequence
  chemically synthesized
catctttggcataatgctgc

SEQ ID NO: 201 - DNA, 20 bp, Artificial Sequence
  chemically synthesized
tttggcataatgctgctagc

SEQ ID NO: 202 - DNA, 20 bp, Artificial Sequence
  chemically synthesized
gctagcaagtgcaatgtctg

SEQ ID NO: 203 - DNA, 20 bp, Artificial Sequence
  chemically synthesized
agtgcaatgtctgtggctcc

SEQ ID NO: 204 - DNA, 20 bp, Artificial Sequence
  chemically synthesized
ctgtggctcctagcatgcct

SEQ ID NO: 205 - DNA, 20 bp, Artificial Sequence
  chemically synthesized
gcatgcctaagaaaatgtac

SEQ ID NO: 206 - DNA, 20 bp, Artificial Sequence
  chemically synthesized
catgcctaagaaaatgtaca

SEQ ID NO: 207 - DNA, 20 bp, Artificial Sequence
  chemically synthesized
atgcctaagaaaatgtacaa

SEQ ID NO: 208 - DNA, 20 bp, Artificial Sequence
  chemically synthesized
agaaaatgtacaagggctca

SEQ ID NO: 209 - DNA, 20 bp, Artificial Sequence
  chemically synthesized
aaaatgtacaagggctcatg

SEQ ID NO: 210 - DNA, 20 bp, Artificial Sequence
  chemically synthesized
gggctcatggagactgcgct

SEQ ID NO: 211 - DNA, 20 bp, Artificial Sequence
  chemically synthesized
cgctcagatttgatgatgct

SEQ ID NO: 212 - DNA, 20 bp, Artificial Sequence
  chemically synthesized
tcagatttgatgatgctcag

SEQ ID NO: 213 - DNA, 20 bp, Artificial Sequence
  chemically synthesized
atttgatgatgctcagaagc

SEQ ID NO: 214 - DNA, 20 bp, Artificial Sequence
  chemically synthesized
tttgatgatgctcagaagca

SEQ ID NO: 215 - DNA, 20 bp, Artificial Sequence
  chemically synthesized
aagcaaggaatttccaatca

SEQ ID NO: 216 - DNA, 20 bp, Artificial Sequence
  chemically synthesized
gaatttccaatcatagcaat

SEQ ID NO: 217 - DNA, 20 bp, Artificial Sequence
  chemically synthesized
aatcatagcaatgagataaa

SEQ ID NO: 218 - DNA, 20 bp, Artificial Sequence
  chemically synthesized
tagcaatgagataaatggca

SEQ ID NO: 219 - DNA, 20 bp, Artificial Sequence
  chemically synthesized
atgagataaatggcacagaa

SEQ ID NO: 220 - DNA, 20 bp, Artificial Sequence
  chemically synthesized
cacagaatggaatcccaatc

SEQ ID NO: 221 - DNA, 20 bp, Artificial Sequence
  chemically synthesized
aatcccaatccagcactgca

SEQ ID NO: 222 - DNA, 20 bp, Artificial Sequence
  chemically synthesized
atccagcactgcacagattc

SEQ ID NO: 223 - DNA, 20 bp, Artificial Sequence
  chemically synthesized
tccagcactgcacagattct

SEQ ID NO: 224 - DNA, 20 bp, Artificial Sequence
  chemically synthesized
cactgcacagattctaggcc

SEQ ID NO: 225 - DNA, 20 bp, Artificial Sequence
  chemically synthesized
actgcacagattctaggcct

SEQ ID NO: 226 - DNA, 20 bp, Artificial Sequence
  chemically synthesized
tctaggcctgggatccctac

SEQ ID NO: 227 - DNA, 20 bp, Artificial Sequence
  chemically synthesized
gatccctactagtgtcaaca

SEQ ID NO: 228 - DNA, 20 bp, Artificial Sequence
  chemically synthesized
tccctactagtgtcaacaca

SEQ ID NO: 229 - DNA, 20 bp, Artificial Sequence
  chemically synthesized
ccctactagtgtcaacacag

SEQ ID NO: 230 - DNA, 20 bp, Artificial Sequence
  chemically synthesized
cctactagtgtcaacacaga

SEQ ID NO: 231 - DNA, 20 bp, Artificial Sequence
  chemically synthesized
gtgtcaacacagagggcatg

SEQ ID NO: 232 - DNA, 20 bp, Artificial Sequence
  chemically synthesized
gggcatgtagactgtgatgt

SEQ ID NO: 233 - DNA, 20 bp, Artificial Sequence
  chemically synthesized
gtagactgtgatgttggaaa

SEQ ID NO: 234 - DNA, 20 bp, Artificial Sequence
  chemically synthesized
tgtgatgttggaaatggaca

SEQ ID NO: 235 - DNA, 20 bp, Artificial Sequence
  chemically synthesized
ggaaatggacatagtgtcgt

SEQ ID NO: 236 - DNA, 20 bp, Artificial Sequence
  chemically synthesized
gaaatggacatagtgtcgtt

SEQ ID NO: 237 - DNA, 20 bp, Artificial Sequence
  chemically synthesized
gggtctcctgatgcaaacaa

SEQ ID NO: 238 - DNA, 20 bp, Artificial Sequence
  chemically synthesized
tctcctgatgcaaacaaaag

SEQ ID NO: 239 - DNA, 20 bp, Artificial Sequence
  chemically synthesized
tgcaaacaaaagaagtttct

SEQ ID NO: 240 - DNA, 20 bp, Artificial Sequence
  chemically synthesized
aacaaaagaagtttctcagt

SEQ ID NO: 241 - DNA, 20 bp, Artificial Sequence
  chemically synthesized
ttctccaaactcattatatt

SEQ ID NO: 242 - DNA, 20 bp, Artificial Sequence
  chemically synthesized
tatattgagtctgtctgatt

SEQ ID NO: 243 - DNA, 20 bp, Artificial Sequence
  chemically synthesized
atattgagtctgtctgattt

SEQ ID NO: 244 - DNA, 20 bp, Artificial Sequence
  chemically synthesized
aaaatcatccatcttattca

SEQ ID NO: 245 - DNA, 20 bp, Artificial Sequence
  chemically synthesized
catcttattcacagttttga

SEQ ID NO: 246 - DNA, 20 bp, Artificial Sequence
  chemically synthesized
atcttattcacagttttgaa

SEQ ID NO: 247 - DNA, 20 bp, Artificial Sequence
  chemically synthesized
attcacagttttgaaaggaa

SEQ ID NO: 248 - DNA, 20 bp, Artificial Sequence
  chemically synthesized
acagttttgaaaggaaaaga

SEQ ID NO: 249 - DNA, 20 bp, Artificial Sequence
  chemically synthesized
gaaaggaaaagatggattca

SEQ ID NO: 250 - DNA, 20 bp, Artificial Sequence
  chemically synthesized
aaggaaaagatggattcatg

SEQ ID NO: 251 - DNA, 20 bp, Artificial Sequence
  chemically synthesized
tggagatacatcactgtttt

SEQ ID NO: 252 - DNA, 20 bp, Artificial Sequence
  chemically synthesized
ggagatacatcactgttttc

SEQ ID NO: 253 - DNA, 20 bp, Artificial Sequence
  chemically synthesized
gatacatcactgttttcagg

SEQ ID NO: 254 - DNA, 20 bp, Artificial Sequence
  chemically synthesized
atacatcactgttttcaggt

SEQ ID NO: 255 - DNA, 20 bp, Artificial Sequence
  chemically synthesized
tacatcactgttttcaggtg

SEQ ID NO: 256 - DNA, 20 bp, Artificial Sequence
  chemically synthesized
gttttcaggtggggcattca

SEQ ID NO: 257 - DNA, 20 bp, Artificial Sequence
  chemically synthesized
ttttcaggtggggcattcac

SEQ ID NO: 258 - DNA, 20 bp, Artificial Sequence
  chemically synthesized
tcacaggcactgtgccataa

SEQ ID NO: 259 - DNA, 20 bp, Artificial Sequence
  chemically synthesized
cacaggcactgtgccataat

SEQ ID NO: 260 - DNA, 20 bp, Artificial Sequence
  chemically synthesized
ataataggatgttatgtgca

SEQ ID NO: 261 - DNA, 20 bp, Artificial Sequence
  chemically synthesized
gcatggcaatccaaatacat

SEQ ID NO: 262 - DNA, 20 bp, Artificial Sequence
  chemically synthesized
caatccaaatacattagaac

SEQ ID NO: 263 - DNA, 20 bp, Artificial Sequence
  chemically synthesized
ttagaaccagcaaaatcacc

SEQ ID NO: 264 - DNA, 20 bp, Artificial Sequence
  chemically synthesized
aaccagcaaaatcacctgga

SEQ ID NO: 265 - DNA, 20 bp, Artificial Sequence
  chemically synthesized
accagcaaaatcacctggac

SEQ ID NO: 266 - DNA, 20 bp, Artificial Sequence
  chemically synthesized
ccagcaaaatcacctggaca

SEQ ID NO: 267 - DNA, 20 bp, Artificial Sequence
  chemically synthesized
cagcaaaatcacctggacag

SEQ ID NO: 268 - DNA, 20 bp, Artificial Sequence
  chemically synthesized
aaatcacctggacaggggat

SEQ ID NO: 269 - DNA, 20 bp, Artificial Sequence
  chemically synthesized
tggacaggggattggactac

SEQ ID NO: 270 - DNA, 20 bp, Artificial Sequence
  chemically synthesized
caggggattggactactggc

SEQ ID NO: 271 - DNA, 20 bp, Artificial Sequence
  chemically synthesized
gccagtctgttatttctttc

SEQ ID NO: 272 - DNA, 20 bp, Artificial Sequence
  chemically synthesized
gttatttctttccagacctg

SEQ ID NO: 273 - DNA, 20 bp, Artificial Sequence
  chemically synthesized
gacctgtggacaaaaaaaaa

SEQ ID NO: 274 - DNA, 20 bp, Artificial Sequence
  chemically synthesized
ctgtggacaaaaaaaaaaag

SEQ ID NO: 275 - DNA, 20 bp, Artificial Sequence
  chemically synthesized
aaaaagaagtttatttttat

SEQ ID NO: 276 - DNA, 20 bp, Artificial Sequence
  chemically synthesized
ttggacattgcattttaatt

SEQ ID NO: 277 - DNA, 20 bp, Artificial Sequence
  chemically synthesized
cctctccatatttcacattt

SEQ ID NO: 278 - DNA, 20 bp, Artificial Sequence
  chemically synthesized
tcacatttcagctattcctc

SEQ ID NO: 279 - DNA, 20 bp, Artificial Sequence
  chemically synthesized
aactatttccaattttcttt

SEQ ID NO: 280 - DNA, 20 bp, Artificial Sequence
  chemically synthesized
aattttctttaagaacattt

SEQ ID NO: 281 - DNA, 20 bp, Artificial Sequence
  chemically synthesized
tctttaagaacattttagac

SEQ ID NO: 282 - DNA, 20 bp, Artificial Sequence
  chemically synthesized
attttagacaagcaaattaa

SEQ ID NO: 283 - DNA, 20 bp, Artificial Sequence
  chemically synthesized
gcaaattaacagactctgac

SEQ ID NO: 284 - DNA, 20 bp, Artificial Sequence
  chemically synthesized
acagactctgaccagtacat

SEQ ID NO: 285 - DNA, 20 bp, Artificial Sequence
  chemically synthesized
tgaccagtacattggtgtaa

SEQ ID NO: 286 - DNA, 20 bp, Artificial Sequence
  chemically synthesized
gtgtaaaagattcccaatga

SEQ ID NO: 287 - DNA, 20 bp, Artificial Sequence
  chemically synthesized
gtaaaagattcccaatgaaa

SEQ ID NO: 288 - DNA, 20 bp, Artificial Sequence
  chemically synthesized
agattcccaatgaaagagaa

SEQ ID NO: 289 - DNA, 20 bp, Artificial Sequence
  chemically synthesized
attcccaatgaaagagaata

SEQ ID NO: 290 - DNA, 20 bp, Artificial Sequence
  chemically synthesized
ttcccaatgaaagagaatag

SEQ ID NO: 291 - DNA, 20 bp, Artificial Sequence
  chemically synthesized
ccaatgaaagagaatagagg

SEQ ID NO: 292 - DNA, 20 bp, Artificial Sequence
  chemically synthesized
ggtagaaataattgacaccc

SEQ ID NO: 293 - DNA, 20 bp, Artificial Sequence
  chemically synthesized
aatatatttctttttatatt

SEQ ID NO: 294 - DNA, 20 bp, Artificial Sequence
  chemically synthesized
tttatattcagaataatgta

SEQ ID NO: 295 - DNA, 20 bp, Artificial Sequence
  chemically synthesized
tatattcagaataatgtaaa

SEQ ID NO: 296 - DNA, 20 bp, Artificial Sequence
  chemically synthesized
ataatgtaaagagaatgctt

SEQ ID NO: 297 - DNA, 20 bp, Artificial Sequence
  chemically synthesized
tttatacttttgacaaatct

SEQ ID NO: 298 - DNA, 20 bp, Artificial Sequence
  chemically synthesized
cttttgacaaatctgagcca

SEQ ID NO: 299 - DNA, 20 bp, Artificial Sequence
  chemically synthesized
caaatctgagccaaagctcc

SEQ ID NO: 300 - DNA, 20 bp, Artificial Sequence
  chemically synthesized
ttgctttttatatttcttta

SEQ ID NO: 301 - DNA, 20 bp, Artificial Sequence
  chemically synthesized
tttatatttctttaaagtta

SEQ ID NO: 302 - DNA, 20 bp, Artificial Sequence
  chemically synthesized
ttatatttctttaaagttaa

SEQ ID NO: 303 - DNA, 20 bp, Artificial Sequence
  chemically synthesized
tatatttctttaaagttaaa

SEQ ID NO: 304 - DNA, 20 bp, Artificial Sequence
  chemically synthesized
tttttcctatatattttaaa

SEQ ID NO: 305 - DNA, 20 bp, Artificial Sequence
  chemically synthesized
tgaaactcttgaaatgttgt

SEQ ID NO: 306 - DNA, 20 bp, Artificial Sequence
  chemically synthesized
taaaattttaatacacttta

SEQ ID NO: 307 - DNA, 20 bp, Artificial Sequence
  chemically synthesized
aatacactttatggaatatc

SEQ ID NO: 308 - DNA, 20 bp, Artificial Sequence
  chemically synthesized
tacactttatggaatatcta

SEQ ID NO: 309 - DNA, 20 bp, Artificial Sequence
  chemically synthesized
cactttatggaatatctaga

SEQ ID NO: 310 - DNA, 20 bp, Artificial Sequence
  chemically synthesized
tttatggaatatctagagag

SEQ ID NO: 311 - DNA, 20 bp, Artificial Sequence
  chemically synthesized
ttatggaatatctagagaga

SEQ ID NO: 312 - DNA, 20 bp, Artificial Sequence
  chemically synthesized
tctagagagaaggaactgct

SEQ ID NO: 313 - DNA, 20 bp, Artificial Sequence
  chemically synthesized
ctagagagaaggaactgcta

SEQ ID NO: 314 - DNA, 20 bp, Artificial Sequence
  chemically synthesized
tagagagaaggaactgctaa

SEQ ID NO: 315 - DNA, 20 bp, Artificial Sequence
  chemically synthesized
agaaggaactgctaagggac

SEQ ID NO: 316 - DNA, 20 bp, Artificial Sequence
  chemically synthesized
gaactgctaagggacaagat

SEQ ID NO: 317 - DNA, 20 bp, Artificial Sequence
  chemically synthesized
ctgctaagggacaagatgag

SEQ ID NO: 318 - DNA, 20 bp, Artificial Sequence
  chemically synthesized
ctaagggacaagatgagcag

SEQ ID NO: 319 - DNA, 20 bp, Artificial Sequence
  chemically synthesized
atgagcagcagcaatgccta

SEQ ID NO: 320 - DNA, 20 bp, Artificial Sequence
  chemically synthesized
gcagcagcaatgcctacggc

SEQ ID NO: 321 - DNA, 20 bp, Artificial Sequence
  chemically synthesized
agcagcaatgcctacggcaa

SEQ ID NO: 322 - DNA, 20 bp, Artificial Sequence
  chemically synthesized
aacttgctcctgataaacca

SEQ ID NO: 323 - DNA, 20 bp, Artificial Sequence
  chemically synthesized
aaaccacagatactgaataa

SEQ ID NO: 324 - DNA, 20 bp, Artificial Sequence
  chemically synthesized
aaccacagatactgaataat

SEQ ID NO: 325 - DNA, 20 bp, Artificial Sequence
  chemically synthesized
taatgggcaaatgaatcatt

SEQ ID NO: 326 - DNA, 20 bp, Artificial Sequence
  chemically synthesized
gggcaaatgaatcatttagc

SEQ ID NO: 327 - DNA, 20 bp, Artificial Sequence
  chemically synthesized
aatgaatcatttagccagaa

SEQ ID NO: 328 - DNA, 20 bp, Artificial Sequence
  chemically synthesized
tgaatcatttagccagaata

SEQ ID NO: 329 - DNA, 20 bp, Artificial Sequence
  chemically synthesized
catttagccagaatagagtc

SEQ ID NO: 330 - DNA, 20 bp, Artificial Sequence
  chemically synthesized
cagaatagagtccagtttcc

SEQ ID NO: 331 - DNA, 20 bp, Artificial Sequence
  chemically synthesized
tttcctggttttaaaatgtt

SEQ ID NO: 332 - DNA, 20 bp, Artificial Sequence
  chemically synthesized
tcctggttttaaaatgttca

SEQ ID NO: 333 - DNA, 20 bp, Artificial Sequence
  chemically synthesized
aaaatgttcagagttataat

SEQ ID NO: 334 - DNA, 20 bp, Artificial Sequence
  chemically synthesized
gagttataattagcataata

SEQ ID NO: 335 - DNA, 20 bp, Artificial Sequence
  chemically synthesized
tagcataatatagcccaata

SEQ ID NO: 336 - DNA, 20 bp, Artificial Sequence
  chemically synthesized
agcataatatagcccaataa

SEQ ID NO: 337 - DNA, 20 bp, Artificial Sequence
  chemically synthesized
atagcccaataaaggctcat

SEQ ID NO: 338 - DNA, 20 bp, Artificial Sequence
  chemically synthesized
cattagttcttaatgaaata

SEQ ID NO: 339 - DNA, 20 bp, Artificial Sequence
  chemically synthesized
attagttcttaatgaaatat

SEQ ID NO: 340 - DNA, 20 bp, Artificial Sequence
  chemically synthesized
gttcttaatgaaatataggt

SEQ ID NO: 341 - DNA, 20 bp, Artificial Sequence
  chemically synthesized
agatgcttatataattttgt

SEQ ID NO: 342 - DNA, 20 bp, Artificial Sequence
  chemically synthesized
aattttgtgagctctgacat

SEQ ID NO: 343 - DNA, 20 bp, Artificial Sequence
  chemically synthesized
tgagctctgacataagaaat

SEQ ID NO: 344 - DNA, 20 bp, Artificial Sequence
  chemically synthesized
agaaattagtaaaaataaaa

SEQ ID NO: 345 - DNA, 20 bp, Artificial Sequence
  chemically synthesized
tagtaaaaataaaaaagcta

SEQ ID NO: 346 - DNA, 20 bp, Artificial Sequence
  chemically synthesized
agtaaaaataaaaaagctaa

SEQ ID NO: 347 - DNA, 20 bp, Artificial Sequence
  chemically synthesized
aaaataaaaaagctaaagga

SEQ ID NO: 348 - DNA, 20 bp, Artificial Sequence
  chemically synthesized
aagctaaaggacagatttct

SEQ ID NO: 349 - DNA, 20 bp, Artificial Sequence
  chemically synthesized
ctaaaggacagatttcttag

SEQ ID NO: 350 - DNA, 20 bp, Artificial Sequence
  chemically synthesized
aaggacagatttcttagaag

SEQ ID NO: 351 - DNA, 20 bp, Artificial Sequence
  chemically synthesized
ttcttagaagaagtcaaatg

SEQ ID NO: 352 - DNA, 20 bp, Artificial Sequence
  chemically synthesized
gaagaagtcaaatgtagaac

SEQ ID NO: 353 - DNA, 20 bp, Artificial Sequence
  chemically synthesized
aagtcaaatgtagaactaga

SEQ ID NO: 354 - DNA, 20 bp, Artificial Sequence
  chemically synthesized
agtcaaatgtagaactagac

SEQ ID NO: 355 - DNA, 20 bp, Artificial Sequence
  chemically synthesized
gtcaaatgtagaactagaca

SEQ ID NO: 356 - DNA, 20 bp, Artificial Sequence
  chemically synthesized
aaatgtagaactagacaggg

SEQ ID NO: 357 - DNA, 20 bp, Artificial Sequence
  chemically synthesized
gtagaactagacagggaaga

SEQ ID NO: 358 - DNA, 20 bp, Artificial Sequence
  chemically synthesized
tagaactagacagggaagac

SEQ ID NO: 359 - DNA, 20 bp, Artificial Sequence
  chemically synthesized
cagggaagacaggacaaact

SEQ ID NO: 360 - DNA, 20 bp, Artificial Sequence
  chemically synthesized
agggaagacaggacaaactt

SEQ ID NO: 361 - DNA, 20 bp, Artificial Sequence
  chemically synthesized
gggaagacaggacaaacttg

SEQ ID NO: 362 - DNA, 20 bp, Artificial Sequence
  chemically synthesized
gaagacaggacaaacttggg

SEQ ID NO: 363 - DNA, 20 bp, Artificial Sequence
  chemically synthesized
aacttggggagactaaaatt

SEQ ID NO: 364 - DNA, 20 bp, Artificial Sequence
  chemically synthesized
acttggggagactaaaattg

SEQ ID NO: 365 - DNA, 20 bp, Artificial Sequence
  chemically synthesized
ggggagactaaaattgagga

SEQ ID NO: 366 - DNA, 20 bp, Artificial Sequence
  chemically synthesized
gaaagcactatgaataacca

SEQ ID NO: 367 - DNA, 20 bp, Artificial Sequence
  chemically synthesized
atgaataaccaaagaaaatt

SEQ ID NO: 368 - DNA, 20 bp, Artificial Sequence
  chemically synthesized
attgaattttctgaaaaacc

SEQ ID NO: 369 - DNA, 20 bp, Artificial Sequence
  chemically synthesized
ttgaattttctgaaaaacct

SEQ ID NO: 370 - DNA, 20 bp, Artificial Sequence
  chemically synthesized
ggctcttatgctttatataa

SEQ ID NO: 371 - DNA, 20 bp, Artificial Sequence
  chemically synthesized
taaaagttctctgatcaaaa

SEQ ID NO: 372 - DNA, 20 bp, Artificial Sequence
  chemically synthesized
aaaaattacatattttgaat

SEQ ID NO: 373 - DNA, 20 bp, Artificial Sequence
  chemically synthesized
attttgaatcagtacatttt

SEQ ID NO: 374 - DNA, 20 bp, Artificial Sequence
  chemically synthesized
gtacattttaagctatacat

SEQ ID NO: 375 - DNA, 20 bp, Artificial Sequence
  chemically synthesized
acattttaagctatacatta

SEQ ID NO: 376 - DNA, 20 bp, Artificial Sequence
  chemically synthesized
ttagagaaatgtttgtgata

SEQ ID NO: 377 - DNA, 20 bp, Artificial Sequence
  chemically synthesized
aatgtttgtgatacagtgaa

SEQ ID NO: 378 - DNA, 20 bp, Artificial Sequence
  chemically synthesized
ttgtgatacagtgaaaagta

SEQ ID NO: 379 - DNA, 20 bp, Artificial Sequence
  chemically synthesized
aaagttacttcattctttcc

SEQ ID NO: 380 - DNA, 20 bp, Artificial Sequence
  chemically synthesized
ctttcctagacacttcaata

SEQ ID NO: 381 - DNA, 20 bp, Artificial Sequence
  chemically synthesized
tcaataaagttgttttatct

SEQ ID NO: 382 - DNA, 20 bp, Artificial Sequence
  chemically synthesized
taaagttgttttatctcagt

SEQ ID NO: 383 - DNA, 20 bp, Artificial Sequence
  chemically synthesized
atctcagtaagctcatgaat

SEQ ID NO: 384 - DNA, 20 bp, Artificial Sequence
  chemically synthesized
gcttcatgtcaccaatatgc

SEQ ID NO: 385 - DNA, 20 bp, Artificial Sequence
  chemically synthesized
tcaccaatatgctggaaatt

SEQ ID NO: 386 - DNA, 20 bp, Artificial Sequence
  chemically synthesized
caccaatatgctggaaattc

SEQ ID NO: 387 - DNA, 20 bp, Artificial Sequence
  chemically synthesized
caatatgctggaaattcagg

SEQ ID NO: 388 - DNA, 20 bp, Artificial Sequence
  chemically synthesized
tatgctggaaattcaggaag

SEQ ID NO: 389 - DNA, 20 bp, Artificial Sequence
  chemically synthesized
aggaagtagctgttctttga

SEQ ID NO: 390 - DNA, 20 bp, Artificial Sequence
  chemically synthesized
tagctgttctttgaaagaaa

SEQ ID NO: 391 - DNA, 20 bp, Artificial Sequence
  chemically synthesized
ctgttctttgaaagaaaaag

SEQ ID NO: 392 - DNA, 20 bp, Artificial Sequence
  chemically synthesized
ttttttttttttttttttga

SEQ ID NO: 393 - DNA, 20 bp, Artificial Sequence
  chemically synthesized
tttttttttttttgaaagaa

SEQ ID NO: 394 - DNA, 20 bp, Artificial Sequence
  chemically synthesized
ttttttttttttgaaagaaa

SEQ ID NO: 395 - DNA, 20 bp, Artificial Sequence
  chemically synthesized
tttttttttgaaagaaaagg

SEQ ID NO: 396 - DNA, 20 bp, Artificial Sequence
  chemically synthesized
ttttttttgaaagaaaagga

SEQ ID NO: 397 - DNA, 20 bp, Artificial Sequence
  chemically synthesized
ttttgaaagaaaaggaaggt

SEQ ID NO: 398 - DNA, 20 bp, Artificial Sequence
  chemically synthesized
agaaaaggaaggtaagtaac

SEQ ID NO: 399 - DNA, 20 bp, Artificial Sequence
  chemically synthesized
gaaaaggaaggtaagtaaca

SEQ ID NO: 400 - DNA, 20 bp, Artificial Sequence
  chemically synthesized
aaggaaggtaagtaacaagg

SEQ ID NO: 401 - DNA, 20 bp, Artificial Sequence
  chemically synthesized
aaggtaagtaacaaggaaga

SEQ ID NO: 402 - DNA, 20 bp, Artificial Sequence
  chemically synthesized
ggtaagtaacaaggaagaaa

SEQ ID NO: 403 - DNA, 20 bp, Artificial Sequence
  chemically synthesized
gtaacaaggaagaaagagaa

SEQ ID NO: 404 - DNA, 20 bp, Artificial Sequence
  chemically synthesized
aacaaggaagaaagagaaaa

SEQ ID NO: 405 - DNA, 20 bp, Artificial Sequence
  chemically synthesized
acaaggaagaaagagaaaag

SEQ ID NO: 406 - DNA, 20 bp, Artificial Sequence
  chemically synthesized
aagaaagagaaaagaggaaa

SEQ ID NO: 407 - DNA, 20 bp, Artificial Sequence
  chemically synthesized
agaaaagaggaaatggatac

SEQ ID NO: 408 - DNA, 20 bp, Artificial Sequence
  chemically synthesized
tgctgctaaacttcaaatga

SEQ ID NO: 409 - DNA, 20 bp, Artificial Sequence
  chemically synthesized
ttcaaatgaaagaaccaaat

SEQ ID NO: 410 - DNA, 20 bp, Artificial Sequence
  chemically synthesized
aaatgaaagaaccaaatcag

SEQ ID NO: 411 - DNA, 20 bp, Artificial Sequence
  chemically synthesized
atgaaagaaccaaatcagca

SEQ ID NO: 412 - DNA, 20 bp, Artificial Sequence
  chemically synthesized
tgaaagaaccaaatcagcag

SEQ ID NO: 413 - DNA, 20 bp, Artificial Sequence
  chemically synthesized
cagcagaggacatttcatga

SEQ ID NO: 414 - DNA, 20 bp, Artificial Sequence
  chemically synthesized
agcagaggacatttcatgac

SEQ ID NO: 415 - DNA, 20 bp, Artificial Sequence
  chemically synthesized
gcagaggacatttcatgaca

SEQ ID NO: 416 - DNA, 20 bp, Artificial Sequence
  chemically synthesized
agaggacatttcatgacagg

SEQ ID NO: 417 - DNA, 20 bp, Artificial Sequence
  chemically synthesized
gaggacatttcatgacaggg

SEQ ID NO: 418 - DNA, 20 bp, Artificial Sequence
  chemically synthesized
tcatgacagggaggctgtat

SEQ ID NO: 419 - DNA, 20 bp, Artificial Sequence
  chemically synthesized
aacatacatttaccgtaaac

SEQ ID NO: 420 - DNA, 20 bp, Artificial Sequence
  chemically synthesized
atacatttaccgtaaactag

SEQ ID NO: 421 - DNA, 20 bp, Artificial Sequence
  chemically synthesized
tacatttaccgtaaactagt

SEQ ID NO: 422 - DNA, 20 bp, Artificial Sequence
  chemically synthesized
attaaatactttgatttcca

SEQ ID NO: 423 - DNA, 20 bp, Artificial Sequence
  chemically synthesized
cagatttgatccccaatgct

SEQ ID NO: 424 - DNA, 20 bp, Artificial Sequence
  chemically synthesized
tttatgacactcccatccat

SEQ ID NO: 425 - DNA, 20 bp, Artificial Sequence
  chemically synthesized
cactcccatccataagtcac

SEQ ID NO: 426 - DNA, 20 bp, Artificial Sequence
  chemically synthesized
aagtcactggctttttctaa

SEQ ID NO: 427 - DNA, 20 bp, Artificial Sequence
  chemically synthesized
agtcactggctttttctaat

SEQ ID NO: 428 - DNA, 20 bp, Artificial Sequence
  chemically synthesized
gtcactggctttttctaata

SEQ ID NO: 429 - DNA, 20 bp, Artificial Sequence
  chemically synthesized
tcactggctttttctaatag

SEQ ID NO: 430 - DNA, 20 bp, Artificial Sequence
  chemically synthesized
ggcaaattttttcttctcca

SEQ ID NO: 431 - DNA, 20 bp, Artificial Sequence
  chemically synthesized
tctccaaagataatcacaat

SEQ ID NO: 432 - DNA, 20 bp, Artificial Sequence
  chemically synthesized
aagataatcacaattagaat

SEQ ID NO: 433 - DNA, 20 bp, Artificial Sequence
  chemically synthesized
ttagaataagaatcctttaa

SEQ ID NO: 434 - DNA, 20 bp, Artificial Sequence
  chemically synthesized
tcacaatgtctgacttattc

SEQ ID NO: 435 - DNA, 20 bp, Artificial Sequence
  chemically synthesized
gtctgacttattcaagacca

SEQ ID NO: 436 - DNA, 20 bp, Artificial Sequence
  chemically synthesized
ctgacttattcaagaccaaa

SEQ ID NO: 437 - DNA, 20 bp, Artificial Sequence
  chemically synthesized
agaccaaagagctgacatgt

SEQ ID NO: 438 - DNA, 20 bp, Artificial Sequence
  chemically synthesized
gacatgtgagtactacctga

SEQ ID NO: 439 - DNA, 20 bp, Artificial Sequence
  chemically synthesized
acatgtgagtactacctgac

SEQ ID NO: 440 - DNA, 20 bp, Artificial Sequence
  chemically synthesized
tgagtactacctgacaggca

SEQ ID NO: 441 - DNA, 20 bp, Artificial Sequence
  chemically synthesized
tactacctgacaggcacaga

SEQ ID NO: 442 - DNA, 20 bp, Artificial Sequence
  chemically synthesized
tacctgacaggcacagatag

SEQ ID NO: 443 - DNA, 20 bp, Artificial Sequence
  chemically synthesized
acctgacaggcacagatagc

SEQ ID NO: 444 - DNA, 20 bp, Artificial Sequence
  chemically synthesized
cctgacaggcacagatagca

SEQ ID NO: 445 - DNA, 20 bp, Artificial Sequence
  chemically synthesized
aggcacagatagcagggttg

SEQ ID NO: 446 - DNA, 20 bp, Artificial Sequence
  chemically synthesized
ggcacagatagcagggttgc

SEQ ID NO: 447 - DNA, 20 bp, Artificial Sequence
  chemically synthesized
acagatagcagggttgcagg

SEQ ID NO: 448 - DNA, 20 bp, Artificial Sequence
  chemically synthesized
gatagcagggttgcaggtgg

SEQ ID NO: 449 - DNA, 20 bp, Artificial Sequence
  chemically synthesized
ttgcaggtggtggtgtatgt

SEQ ID NO: 450 - DNA, 20 bp, Artificial Sequence
  chemically synthesized
tggtggtgtatgtaagttcc

SEQ ID NO: 451 - DNA, 20 bp, Artificial Sequence
  chemically synthesized
ggtgtatgtaagttcctggt

SEQ ID NO: 452 - DNA, 20 bp, Artificial Sequence
  chemically synthesized
tatgtaagttcctggttagt

SEQ ID NO: 453 - DNA, 20 bp, Artificial Sequence
  chemically synthesized
taagttcctggttagttgga

SEQ ID NO: 454 - DNA, 20 bp, Artificial Sequence
  chemically synthesized
agttcctggttagttggata

SEQ ID NO: 455 - DNA, 20 bp, Artificial Sequence
  chemically synthesized
ttggatagagtgattgttat

SEQ ID NO: 456 - DNA, 20 bp, Artificial Sequence
  chemically synthesized
ggatagagtgattgttattg

SEQ ID NO: 457 - DNA, 20 bp, Artificial Sequence
  chemically synthesized
tagagtgattgttattggag

SEQ ID NO: 458 - DNA, 20 bp, Artificial Sequence
  chemically synthesized
gtgattgttattggagaagc

SEQ ID NO: 459 - DNA, 20 bp, Artificial Sequence
  chemically synthesized
agaagctggtaattaaatta

SEQ ID NO: 460 - DNA, 20 bp, Artificial Sequence
  chemically synthesized
aagctggtaattaaattatg

SEQ ID NO: 461 - DNA, 20 bp, Artificial Sequence
  chemically synthesized
gctggtaattaaattatgga

SEQ ID NO: 462 - DNA, 20 bp, Artificial Sequence
  chemically synthesized
ctggtaattaaattatggag

SEQ ID NO: 463 - DNA, 20 bp, Artificial Sequence
  chemically synthesized
taaattatggagaggaaact

SEQ ID NO: 464 - DNA, 20 bp, Artificial Sequence
  chemically synthesized
gagaggaaacttggaatcgt

SEQ ID NO: 465 - DNA, 20 bp, Artificial Sequence
  chemically synthesized
cttactcctcaattattatt

SEQ ID NO: 466 - DNA, 20 bp, Artificial Sequence
  chemically synthesized
tactcctcaattattattga

SEQ ID NO: 467 - DNA, 20 bp, Artificial Sequence
  chemically synthesized
cctcaattattattgagagc

SEQ ID NO: 468 - DNA, 20 bp, Artificial Sequence
  chemically synthesized
agagctggttttgctcttac

SEQ ID NO: 469 - DNA, 20 bp, Artificial Sequence
  chemically synthesized
ttgctcttaccagatacctg

SEQ ID NO: 470 - DNA, 20 bp, Artificial Sequence
  chemically synthesized
ctcaccaatttttcttctcc

SEQ ID NO: 471 - DNA, 20 bp, Artificial Sequence
  chemically synthesized
tcaccaatttttcttctcca

SEQ ID NO: 472 - DNA, 20 bp, Artificial Sequence
  chemically synthesized
tttttcttctccaaggattc

SEQ ID NO: 473 - DNA, 20 bp, Artificial Sequence
  chemically synthesized
gattccagcttcattccctt

SEQ ID NO: 474 - DNA, 20 bp, Artificial Sequence
  chemically synthesized
agcttcattcccttaagttg

SEQ ID NO: 475 - DNA, 20 bp, Artificial Sequence
  chemically synthesized
gcttcattcccttaagttgt

SEQ ID NO: 476 - DNA, 20 bp, Artificial Sequence
  chemically synthesized
ttaagttgtgggttctgtga

SEQ ID NO: 477 - DNA, 20 bp, Artificial Sequence
  chemically synthesized
tctgtctgcactctgtgtaa

SEQ ID NO: 478 - DNA, 20 bp, Artificial Sequence
  chemically synthesized
gcactctgtgtaacagcatc

SEQ ID NO: 479 - DNA, 20 bp, Artificial Sequence
  chemically synthesized
gtcataaattttactctgtt

SEQ ID NO: 480 - DNA, 20 bp, Artificial Sequence
  chemically synthesized
aattttactctgtttggtgc

SEQ ID NO: 481 - DNA, 20 bp, Artificial Sequence
  chemically synthesized
attttactctgtttggtgcc

SEQ ID NO: 482 - DNA, 20 bp, Artificial Sequence
  chemically synthesized
tgtgccaatataatatactg

SEQ ID NO: 483 - DNA, 20 bp, Artificial Sequence
  chemically synthesized
aatatactgtggacattttg

SEQ ID NO: 484 - DNA, 20 bp, Artificial Sequence
  chemically synthesized
cttttcatttatctctaaca

SEQ ID NO: 485 - DNA, 20 bp, Artificial Sequence
  chemically synthesized
cggacatcttcttcttcttc

SEQ ID NO: 486 - DNA, 20 bp, Artificial Sequence
  chemically synthesized
acatcttcttcttcttctgg

SEQ ID NO: 487 - DNA, 20 bp, Artificial Sequence
  chemically synthesized
cttcttctggaagtctgtct

SEQ ID NO: 488 - DNA, 20 bp, Artificial Sequence
  chemically synthesized
atctttgtgtgctcatcccc

SEQ ID NO: 489 - DNA, 20 bp, Artificial Sequence
  chemically synthesized
tcatcccccagtaaaactca

SEQ ID NO: 490 - DNA, 20 bp, Artificial Sequence
  chemically synthesized
cccccagtaaaactcatagt

SEQ ID NO: 491 - DNA, 20 bp, Artificial Sequence
  chemically synthesized
ccccagtaaaactcatagtg

SEQ ID NO: 492 - DNA, 20 bp, Artificial Sequence
  chemically synthesized
aaaactcatagtgaggtctg

SEQ ID NO: 493 - DNA, 20 bp, Artificial Sequence
  chemically synthesized
gtctgtagcattctgaaaca

SEQ ID NO: 494 - DNA, 20 bp, Artificial Sequence
  chemically synthesized
tctgtagcattctgaaacac

SEQ ID NO: 495 - DNA, 20 bp, Artificial Sequence
  chemically synthesized
aaacacgggatgaatttatt

SEQ ID NO: 496 - DNA, 20 bp, Artificial Sequence
  chemically synthesized
tgaatttattgagctcaaat

SEQ ID NO: 497 - DNA, 20 bp, Artificial Sequence
  chemically synthesized
aatttattgagctcaaattg

SEQ ID NO: 498 - DNA, 20 bp, Artificial Sequence
  chemically synthesized
tgagctcaaattggagaaaa

SEQ ID NO: 499 - DNA, 20 bp, Artificial Sequence
  chemically synthesized
gctcaaattggagaaaaaag

SEQ ID NO: 500 - DNA, 20 bp, Artificial Sequence
  chemically synthesized
aatattcctttatgaatgtg

SEQ ID NO: 501 - DNA, 20 bp, Artificial Sequence
  chemically synthesized
tattcctttatgaatgtgtg

SEQ ID NO: 502 - DNA, 20 bp, Artificial Sequence
  chemically synthesized
tcctttatgaatgtgtggag

SEQ ID NO: 503 - DNA, 20 bp, Artificial Sequence
  chemically synthesized
tttatgaatgtgtggagaag

SEQ ID NO: 504 - DNA, 20 bp, Artificial Sequence
  chemically synthesized
ttatgaatgtgtggagaagt

SEQ ID NO: 505 - DNA, 20 bp, Artificial Sequence
  chemically synthesized
atgaatgtgtggagaagtag

SEQ ID NO: 506 - DNA, 20 bp, Artificial Sequence
  chemically synthesized
tgaatgtgtggagaagtagg

SEQ ID NO: 507 - DNA, 20 bp, Artificial Sequence
  chemically synthesized
aatgtgtggagaagtaggag

SEQ ID NO: 508 - DNA, 20 bp, Artificial Sequence
  chemically synthesized
ggagaagtaggaggagttat

SEQ ID NO: 509 - DNA, 20 bp, Artificial Sequence
  chemically synthesized
aggagttatgagcatgaaat

SEQ ID NO: 510 - DNA, 20 bp, Artificial Sequence
  chemically synthesized
ggagttatgagcatgaaatg

SEQ ID NO: 511 - DNA, 20 bp, Artificial Sequence
  chemically synthesized
gagttatgagcatgaaatga

SEQ ID NO: 512 - DNA, 20 bp, Artificial Sequence
  chemically synthesized
gcatgaaatgagggatttcc

SEQ ID NO: 513 - DNA, 20 bp, Artificial Sequence
  chemically synthesized
atgagggatttcctagttga

SEQ ID NO: 514 - DNA, 20 bp, Artificial Sequence
  chemically synthesized
tagttgatagccaaaaccac

SEQ ID NO: 515 - DNA, 20 bp, Artificial Sequence
  chemically synthesized
agttgatagccaaaaccacg

SEQ ID NO: 516 - DNA, 20 bp, Artificial Sequence
  chemically synthesized
gttgatagccaaaaccacga

SEQ ID NO: 517 - DNA, 20 bp, Artificial Sequence
  chemically synthesized
agccaaaaccacgagggacc

SEQ ID NO: 518 - DNA, 20 bp, Artificial Sequence
  chemically synthesized
cgagggacccagcaaatttt

SEQ ID NO: 519 - DNA, 20 bp, Artificial Sequence
  chemically synthesized
ggacccagcaaattttaagt

SEQ ID NO: 520 - DNA, 20 bp, Artificial Sequence
  chemically synthesized
aaattttaagtcagccctct

SEQ ID NO: 521 - DNA, 20 bp, Artificial Sequence
  chemically synthesized
aattttaagtcagccctctt

SEQ ID NO: 522 - DNA, 20 bp, Artificial Sequence
  chemically synthesized
gtcagccctcttgggttcac

SEQ ID NO: 523 - DNA, 20 bp, Artificial Sequence
  chemically synthesized
cgtaattatttctacacttg

SEQ ID NO: 524 - DNA, 20 bp, Artificial Sequence
  chemically synthesized
tctctttttctcttttccca

SEQ ID NO: 525 - DNA, 20 bp, Artificial Sequence
  chemically synthesized
ctctttttctcttttcccac

SEQ ID NO: 526 - DNA, 20 bp, Artificial Sequence
  chemically synthesized
cttttcccacaggctaaatg

SEQ ID NO: 527 - DNA, 20 bp, Artificial Sequence
  chemically synthesized
tatgcaaaaaatttttttac

SEQ ID NO: 528 - DNA, 20 bp, Artificial Sequence
  chemically synthesized
tttctatttgcaaaattcta

SEQ ID NO: 529 - DNA, 20 bp, Artificial Sequence
  chemically synthesized
tcctatttaaataaatatct

SEQ ID NO: 530 - DNA, 20 bp, Artificial Sequence
  chemically synthesized
atcttggtgacattttcact

SEQ ID NO: 531 - DNA, 20 bp, Artificial Sequence
  chemically synthesized
tcttggtgacattttcactg

SEQ ID NO: 532 - DNA, 20 bp, Artificial Sequence
  chemically synthesized
ggtgacattttcactgaggc

SEQ ID NO: 533 - DNA, 20 bp, Artificial Sequence
  chemically synthesized
gtgacattttcactgaggca

SEQ ID NO: 534 - DNA, 20 bp, Artificial Sequence
  chemically synthesized
aaggtttttctctttttatt

SEQ ID NO: 535 - DNA, 20 bp, Artificial Sequence
  chemically synthesized
ttttctctttttattcagaa

SEQ ID NO: 536 - DNA, 20 bp, Artificial Sequence
  chemically synthesized
ttaccacacaattacttcct

SEQ ID NO: 537 - DNA, 20 bp, Artificial Sequence
  chemically synthesized
attacttcctcagtcttctt

SEQ ID NO: 538 - DNA, 20 bp, Artificial Sequence
  chemically synthesized
cttcccattttattttattg

SEQ ID NO: 539 - DNA, 20 bp, Artificial Sequence
  chemically synthesized
ttgaagttttttttatcttt

SEQ ID NO: 540 - DNA, 20 bp, Artificial Sequence
  chemically synthesized
tttttatcttttagtaaatt

SEQ ID NO: 541 - DNA, 20 bp, Artificial Sequence
  chemically synthesized
taaattaagtaacattctta

SEQ ID NO: 542 - DNA, 20 bp, Artificial Sequence
  chemically synthesized
cttatagtgacaaattataa

SEQ ID NO: 543 - DNA, 20 bp, Artificial Sequence
  chemically synthesized
aaattataatggacatttct

SEQ ID NO: 544 - DNA, 20 bp, Artificial Sequence
  chemically synthesized
ttctaagtcctacaaatgta

SEQ ID NO: 545 - DNA, 20 bp, Artificial Sequence
  chemically synthesized
aagtcctacaaatgtaaagc

SEQ ID NO: 546 - DNA, 20 bp, Artificial Sequence
  chemically synthesized
tcctacaaatgtaaagctgg

SEQ ID NO: 547 - DNA, 20 bp, Artificial Sequence
  chemically synthesized
acaaatgtaaagctggaagc

SEQ ID NO: 548 - DNA, 20 bp, Artificial Sequence
  chemically synthesized
aagcaagttgttgaacattt

SEQ ID NO: 549 - DNA, 20 bp, Artificial Sequence
  chemically synthesized
tgttgaacatttgagtaaac

SEQ ID NO: 550 - DNA, 20 bp, Artificial Sequence
  chemically synthesized
cttctttttctttcaaaaaa

SEQ ID NO: 551 - DNA, 20 bp, Artificial Sequence
  chemically synthesized
attatattcctactatttat

SEQ ID NO: 552 - DNA, 20 bp, Artificial Sequence
  chemically synthesized
tattcctactatttatgagt

SEQ ID NO: 553 - DNA, 20 bp, Artificial Sequence
  chemically synthesized
aaatgaaatgaaaaaaatta

SEQ ID NO: 554 - DNA, 20 bp, Artificial Sequence
  chemically synthesized
tagtcttacctttaaattat

SEQ ID NO: 555 - DNA, 20 bp, Artificial Sequence
  chemically synthesized
cctttaaattattagtaaaa

SEQ ID NO: 556 - DNA, 20 bp, Artificial Sequence
  chemically synthesized
ctttaaattattagtaaaat

SEQ ID NO: 557 - DNA, 20 bp, Artificial Sequence
  chemically synthesized
tacaatttcatttatcacgt

SEQ ID NO: 558 - DNA, 20 bp, Artificial Sequence
  chemically synthesized
gtaagtatctgataaattct

SEQ ID NO: 559 - DNA, 20 bp, Artificial Sequence
  chemically synthesized
gtatctgataaattctaagc

SEQ ID NO: 560 - DNA, 20 bp, Artificial Sequence
  chemically synthesized
ctattctccttgacatttta

SEQ ID NO: 561 - DNA, 20 bp, Artificial Sequence
  chemically synthesized
tctccttgacattttacagc

SEQ ID NO: 562 - DNA, 20 bp, Artificial Sequence
  chemically synthesized
gacattttacagctggtttc

SEQ ID NO: 563 - DNA, 20 bp, Artificial Sequence
  chemically synthesized
acattttacagctggtttct

SEQ ID NO: 564 - DNA, 20 bp, Artificial Sequence
  chemically synthesized
tttctaggctttcttgaatg

SEQ ID NO: 565 - DNA, 20 bp, Artificial Sequence
  chemically synthesized
aggctttcttgaatgtagct

SEQ ID NO: 566 - DNA, 20 bp, Artificial Sequence
  chemically synthesized
gctttcttgaatgtagctaa

SEQ ID NO: 567 - DNA, 20 bp, Artificial Sequence
  chemically synthesized
gagacacttgatataatgtt

SEQ ID NO: 568 - DNA, 20 bp, Artificial Sequence
  chemically synthesized
ttgatataatgtttagacat

SEQ ID NO: 569 - DNA, 20 bp, Artificial Sequence
  chemically synthesized
tgtttagacattggcaaatt

SEQ ID NO: 570 - DNA, 20 bp, Artificial Sequence
  chemically synthesized
gtttagacattggcaaattt

SEQ ID NO: 571 - DNA, 20 bp, Artificial Sequence
  chemically synthesized
tagacattggcaaatttagg

SEQ ID NO: 572 - DNA, 20 bp, Artificial Sequence
  chemically synthesized
aaatttaggaagcatactaa

SEQ ID NO: 573 - DNA, 20 bp, Artificial Sequence
  chemically synthesized
tttaggaagcatactaatgg

SEQ ID NO: 574 - DNA, 20 bp, Artificial Sequence
  chemically synthesized
taggaagcatactaatggtg

SEQ ID NO: 575 - DNA, 20 bp, Artificial Sequence
  chemically synthesized
atggtggagaatatttataa

SEQ ID NO: 576 - DNA, 20 bp, Artificial Sequence
  chemically synthesized
gaatatttataatggatttc

SEQ ID NO: 577 - DNA, 20 bp, Artificial Sequence
  chemically synthesized
aatatttataatggatttcc

SEQ ID NO: 578 - DNA, 20 bp, Artificial Sequence
  chemically synthesized
tatttataatggatttccag

SEQ ID NO: 579 - DNA, 20 bp, Artificial Sequence
  chemically synthesized
taatggatttccaggagaac

SEQ ID NO: 580 - DNA, 20 bp, Artificial Sequence
  chemically synthesized
aatggatttccaggagaaca

SEQ ID NO: 581 - DNA, 20 bp, Artificial Sequence
  chemically synthesized
ttccaggagaacaaggaata

SEQ ID NO: 582 - DNA, 20 bp, Artificial Sequence
  chemically synthesized
gaacaaggaatacagatgaa

SEQ ID NO: 583 - DNA, 20 bp, Artificial Sequence
  chemically synthesized
aacaaggaatacagatgaaa

SEQ ID NO: 584 - DNA, 20 bp, Artificial Sequence
  chemically synthesized
aggaatacagatgaaaaggc

SEQ ID NO: 585 - DNA, 20 bp, Artificial Sequence
  chemically synthesized
ggaatacagatgaaaaggca

SEQ ID NO: 586 - DNA, 20 bp, Artificial Sequence
  chemically synthesized
ggaaccccatgtgctctttc

SEQ ID NO: 587 - DNA, 20 bp, Artificial Sequence
  chemically synthesized
tttccagaatttcctctgtg

SEQ ID NO: 588 - DNA, 20 bp, Artificial Sequence
  chemically synthesized
ttccagaatttcctctgtga

SEQ ID NO: 589 - DNA, 20 bp, Artificial Sequence
  chemically synthesized
ccagaatttcctctgtgaag

SEQ ID NO: 590 - DNA, 20 bp, Artificial Sequence
  chemically synthesized
tgtgaaggagcataaaacaa

SEQ ID NO: 591 - DNA, 20 bp, Artificial Sequence
  chemically synthesized
catgttgaatgaaattgatt

SEQ ID NO: 592 - DNA, 20 bp, Artificial Sequence
  chemically synthesized
tgttgaatgaaattgattca

SEQ ID NO: 593 - DNA, 20 bp, Artificial Sequence
  chemically synthesized
ttgaatgaaattgattcaga

SEQ ID NO: 594 - DNA, 20 bp, Artificial Sequence
  chemically synthesized
aaattgattcagagagcata

SEQ ID NO: 595 - DNA, 20 bp, Artificial Sequence
  chemically synthesized
aattgattcagagagcatat

SEQ ID NO: 596 - DNA, 20 bp, Artificial Sequence
  chemically synthesized
tgattcagagagcatatagg

SEQ ID NO: 597 - DNA, 20 bp, Artificial Sequence
  chemically synthesized
taggcagctaatctaatatt

SEQ ID NO: 598 - DNA, 20 bp, Artificial Sequence
  chemically synthesized
aggcagctaatctaatattc

SEQ ID NO: 599 - DNA, 20 bp, Artificial Sequence
  chemically synthesized
caggttattcttttgtcact

SEQ ID NO: 600 - DNA, 20 bp, Artificial Sequence
  chemically synthesized
tttgtcactaagaaacaatt

SEQ ID NO: 601 - DNA, 20 bp, Artificial Sequence
  chemically synthesized
cactaagaaacaatttagac

SEQ ID NO: 602 - DNA, 20 bp, Artificial Sequence
  chemically synthesized
atttagactagtataccatt

SEQ ID NO: 603 - DNA, 20 bp, Artificial Sequence
  chemically synthesized
atactgattttatttaaatt

SEQ ID NO: 604 - DNA, 20 bp, Artificial Sequence
  chemically synthesized
tactgattttatttaaattt

SEQ ID NO: 605 - DNA, 20 bp, Artificial Sequence
  chemically synthesized
actgattttatttaaatttg

SEQ ID NO: 606 - DNA, 20 bp, Artificial Sequence
  chemically synthesized
ctgattttatttaaatttgg

SEQ ID NO: 607 - DNA, 20 bp, Artificial Sequence
  chemically synthesized
ttaaatttgggggctctcca

SEQ ID NO: 608 - DNA, 20 bp, Artificial Sequence
  chemically synthesized
ggctctccaaagttctatct

SEQ ID NO: 609 - DNA, 20 bp, Artificial Sequence
  chemically synthesized
gctctccaaagttctatctt

SEQ ID NO: 610 - DNA, 20 bp, Artificial Sequence
  chemically synthesized
ctaaaactattcacatgtgc

SEQ ID NO: 611 - DNA, 20 bp, Artificial Sequence
  chemically synthesized
tccatctactccaaataatt

SEQ ID NO: 612 - DNA, 20 bp, Artificial Sequence
  chemically synthesized
aactcctataacaatatttc

SEQ ID NO: 613 - DNA, 20 bp, Artificial Sequence
  chemically synthesized
ctataacaatatttccagcc

SEQ ID NO: 614 - DNA, 20 bp, Artificial Sequence
  chemically synthesized
agattttctccctctgttcc

SEQ ID NO: 615 - DNA, 20 bp, Artificial Sequence
  chemically synthesized
ctccctctgttccaagtaca

SEQ ID NO: 616 - DNA, 20 bp, Artificial Sequence
  chemically synthesized
tccctctgttccaagtacac

SEQ ID NO: 617 - DNA, 20 bp, Artificial Sequence
  chemically synthesized
ctgttccaagtacacaggaa

SEQ ID NO: 618 - DNA, 20 bp, Artificial Sequence
  chemically synthesized
agcatgtactgcccaaattt

SEQ ID NO: 619 - DNA, 20 bp, Artificial Sequence
  chemically synthesized
tcctttgaaacattgtcaat

SEQ ID NO: 620 - DNA, 20 bp, Artificial Sequence
  chemically synthesized
atgagttctacacttaattc

SEQ ID NO: 621 - DNA, 20 bp, Artificial Sequence
  chemically synthesized
tgagttctacacttaattca

SEQ ID NO: 622 - DNA, 20 bp, Artificial Sequence
  chemically synthesized
ttcattgtacttgtaaatat

SEQ ID NO: 623 - DNA, 20 bp, Artificial Sequence
  chemically synthesized
attgtacttgtaaatattgg

SEQ ID NO: 624 - DNA, 20 bp, Artificial Sequence
  chemically synthesized
tatgcatcaataactatctc

SEQ ID NO: 625 - DNA, 20 bp, Artificial Sequence
  chemically synthesized
taactatctctggatttttt

SEQ ID NO: 626 - DNA, 20 bp, Artificial Sequence
  chemically synthesized
tatctctggatttttttagc

SEQ ID NO: 627 - DNA, 20 bp, Artificial Sequence
  chemically synthesized
attttttttttctttttttt

SEQ ID NO: 628 - DNA, 20 bp, Artificial Sequence
  chemically synthesized
tttttttcttttttttgaga

SEQ ID NO: 629 - DNA, 20 bp, Artificial Sequence
  chemically synthesized
tttttcttttttttgagaca

SEQ ID NO: 630 - DNA, 20 bp, Artificial Sequence
  chemically synthesized
cagagtctctctctgtcgcc

SEQ ID NO: 631 - DNA, 20 bp, Artificial Sequence
  chemically synthesized
agagtctctctctgtcgccc

SEQ ID NO: 632 - DNA, 20 bp, Artificial Sequence
  chemically synthesized
tctctctctgtcgcccaggc

SEQ ID NO: 633 - DNA, 20 bp, Artificial Sequence
  chemically synthesized
tctctctgtcgcccaggctg

SEQ ID NO: 634 - DNA, 20 bp, Artificial Sequence
  chemically synthesized
ctgtcgcccaggctggagtg

SEQ ID NO: 635 - DNA, 20 bp, Artificial Sequence
  chemically synthesized
tcgcccaggctggagtgcag

SEQ ID NO: 636 - DNA, 20 bp, Artificial Sequence
  chemically synthesized
ccctgatctctgctcactgc

SEQ ID NO: 637 - DNA, 20 bp, Artificial Sequence
  chemically synthesized
ttcacgccattctcccgcct

SEQ ID NO: 638 - DNA, 20 bp, Artificial Sequence
  chemically synthesized
ttctcccgcctcagcctcca

SEQ ID NO: 639 - DNA, 20 bp, Artificial Sequence
  chemically synthesized
tcccgcctcagcctccatag

SEQ ID NO: 640 - DNA, 20 bp, Artificial Sequence
  chemically synthesized
gcctcagcctccatagtagc

SEQ ID NO: 641 - DNA, 20 bp, Artificial Sequence
  chemically synthesized
cctcagcctccatagtagct

SEQ ID NO: 642 - DNA, 20 bp, Artificial Sequence
  chemically synthesized
ctccatagtagctgggacta

SEQ ID NO: 643 - DNA, 20 bp, Artificial Sequence
  chemically synthesized
tccatagtagctgggactac

SEQ ID NO: 644 - DNA, 20 bp, Artificial Sequence
  chemically synthesized
gactacaggcacccgccacc

SEQ ID NO: 645 - DNA, 20 bp, Artificial Sequence
  chemically synthesized
caggcacccgccaccaagcc

SEQ ID NO: 646 - DNA, 20 bp, Artificial Sequence
  chemically synthesized
gctaattttttgtatttttt

SEQ ID NO: 647 - DNA, 20 bp, Artificial Sequence
  chemically synthesized
aattttttgtatttttttag

SEQ ID NO: 648 - DNA, 20 bp, Artificial Sequence
  chemically synthesized
ttttttgtatttttttagta

SEQ ID NO: 649 - DNA, 20 bp, Artificial Sequence
  chemically synthesized
ttgtatttttttagtagaga

SEQ ID NO: 650 - DNA, 20 bp, Artificial Sequence
  chemically synthesized
tgtatttttttagtagagac

SEQ ID NO: 651 - DNA, 20 bp, Artificial Sequence
  chemically synthesized
gtatttttttagtagagacg

SEQ ID NO: 652 - DNA, 20 bp, Artificial Sequence
  chemically synthesized
gagacggggtttcactgtgt

SEQ ID NO: 653 - DNA, 20 bp, Artificial Sequence
  chemically synthesized
cggggtttcactgtgttagc

SEQ ID NO: 654 - DNA, 20 bp, Artificial Sequence
  chemically synthesized
ggggtttcactgtgttagcc

SEQ ID NO: 655 - DNA, 20 bp, Artificial Sequence
  chemically synthesized
tttcactgtgttagccagga

SEQ ID NO: 656 - DNA, 20 bp, Artificial Sequence
  chemically synthesized
ccacccgcctccgcctccca

SEQ ID NO: 657 - DNA, 20 bp, Artificial Sequence
  chemically synthesized
gcctccgcctcccaaagtgc

SEQ ID NO: 658 - DNA, 20 bp, Artificial Sequence
  chemically synthesized
cctccgcctcccaaagtgct

SEQ ID NO: 659 - DNA, 20 bp, Artificial Sequence
  chemically synthesized
ctcccaaagtgctgggatca

SEQ ID NO: 660 - DNA, 20 bp, Artificial Sequence
  chemically synthesized
tcccaaagtgctgggatcac

SEQ ID NO: 661 - DNA, 20 bp, Artificial Sequence
  chemically synthesized
agtgctgggatcacaggcgt

SEQ ID NO: 662 - DNA, 20 bp, Artificial Sequence
  chemically synthesized
caggcgtgagccactgcacc

SEQ ID NO: 663 - DNA, 20 bp, Artificial Sequence
  chemically synthesized
tttttaaatttatttttatt

SEQ ID NO: 664 - DNA, 20 bp, Artificial Sequence
  chemically synthesized
ttttaaatttatttttatta

SEQ ID NO: 665 - DNA, 20 bp, Artificial Sequence
  chemically synthesized
tttactttttttttttcctt

SEQ ID NO: 666 - DNA, 20 bp, Artificial Sequence
  chemically synthesized
ctttttttttttccttgaga

SEQ ID NO: 667 - DNA, 20 bp, Artificial Sequence
  chemically synthesized
ttttttttttccttgagacg

SEQ ID NO: 668 - DNA, 20 bp, Artificial Sequence
  chemically synthesized
cggagtctcgctccgtcatc

SEQ ID NO: 669 - DNA, 20 bp, Artificial Sequence
  chemically synthesized
ggagtctcgctccgtcatcc

SEQ ID NO: 670 - DNA, 20 bp, Artificial Sequence
  chemically synthesized
tctcgctccgtcatccaggc

SEQ ID NO: 671 - DNA, 20 bp, Artificial Sequence
  chemically synthesized
tcgctccgtcatccaggctg

SEQ ID NO: 672 - DNA, 20 bp, Artificial Sequence
  chemically synthesized
ccgtcatccaggctggagtg

SEQ ID NO: 673 - DNA, 20 bp, Artificial Sequence
  chemically synthesized
tcatccaggctggagtgcag

SEQ ID NO: 674 - DNA, 20 bp, Artificial Sequence
  chemically synthesized
tccaggctggagtgcagtgg

SEQ ID NO: 675 - DNA, 20 bp, Artificial Sequence
  chemically synthesized
ccaggctggagtgcagtggt

SEQ ID NO: 676 - DNA, 20 bp, Artificial Sequence
  chemically synthesized
ggagtgcagtggtaggatct

SEQ ID NO: 677 - DNA, 20 bp, Artificial Sequence
  chemically synthesized
actgcaacctccgcccccac

SEQ ID NO: 678 - DNA, 20 bp, Artificial Sequence
  chemically synthesized
ctgcaacctccgcccccacc

SEQ ID NO: 679 - DNA, 20 bp, Artificial Sequence
  chemically synthesized
cctccgcccccaccaggttc

SEQ ID NO: 680 - DNA, 20 bp, Artificial Sequence
  chemically synthesized
ttcaagcgattctcctgccc

SEQ ID NO: 681 - DNA, 20 bp, Artificial Sequence
  chemically synthesized
ttctcctgcccaagcctccc

SEQ ID NO: 682 - DNA, 20 bp, Artificial Sequence
  chemically synthesized
tcctgcccaagcctcccaag

SEQ ID NO: 683 - DNA, 20 bp, Artificial Sequence
  chemically synthesized
cctgcccaagcctcccaagt

SEQ ID NO: 684 - DNA, 20 bp, Artificial Sequence
  chemically synthesized
gcccaagcctcccaagtagg

SEQ ID NO: 685 - DNA, 20 bp, Artificial Sequence
  chemically synthesized
cccaagcctcccaagtaggt

SEQ ID NO: 686 - DNA, 20 bp, Artificial Sequence
  chemically synthesized
ctcccaagtaggtgggatta

SEQ ID NO: 687 - DNA, 20 bp, Artificial Sequence
  chemically synthesized
tcccaagtaggtgggattac

SEQ ID NO: 688 - DNA, 20 bp, Artificial Sequence
  chemically synthesized
caggcgcctgccaccacgcc

SEQ ID NO: 689 - DNA, 20 bp, Artificial Sequence
  chemically synthesized
tggctaattttttgtatttt

SEQ ID NO: 690 - DNA, 20 bp, Artificial Sequence
  chemically synthesized
ctaattttttgtatttttag

SEQ ID NO: 691 - DNA, 20 bp, Artificial Sequence
  chemically synthesized
aattttttgtatttttagta

SEQ ID NO: 692 - DNA, 20 bp, Artificial Sequence
  chemically synthesized
ttttgtatttttagtagaga

SEQ ID NO: 693 - DNA, 20 bp, Artificial Sequence
  chemically synthesized
tttgtatttttagtagagac

SEQ ID NO: 694 - DNA, 20 bp, Artificial Sequence
  chemically synthesized
ttgtatttttagtagagaca

SEQ ID NO: 695 - DNA, 20 bp, Artificial Sequence
  chemically synthesized
gagacagggtttcaccatgt

SEQ ID NO: 696 - DNA, 20 bp, Artificial Sequence
  chemically synthesized
cagggtttcaccatgttggt

SEQ ID NO: 697 - DNA, 20 bp, Artificial Sequence
  chemically synthesized
agggtttcaccatgttggtc

SEQ ID NO: 698 - DNA, 20 bp, Artificial Sequence
  chemically synthesized
tttcaccatgttggtcaggc

SEQ ID NO: 699 - DNA, 20 bp, Artificial Sequence
  chemically synthesized
catgttggtcaggctggtct

SEQ ID NO: 700 - DNA, 20 bp, Artificial Sequence
  chemically synthesized
acctcatgatccacctgcct

SEQ ID NO: 701 - DNA, 20 bp, Artificial Sequence
  chemically synthesized
ccacctgccttggcctccca

SEQ ID NO: 702 - DNA, 20 bp, Artificial Sequence
  chemically synthesized
ccttggcctcccaaagtgct

SEQ ID NO: 703 - DNA, 20 bp, Artificial Sequence
  chemically synthesized
ctcccaaagtgctgagatta

SEQ ID NO: 704 - DNA, 20 bp, Artificial Sequence
  chemically synthesized
tcccaaagtgctgagattac

SEQ ID NO: 705 - DNA, 20 bp, Artificial Sequence
  chemically synthesized
agtgctgagattacaggcat

SEQ ID NO: 706 - DNA, 20 bp, Artificial Sequence
  chemically synthesized
caggcattggccaccgcacc

SEQ ID NO: 707 - DNA, 20 bp, Artificial Sequence
  chemically synthesized
agcccatctttaccattttt

SEQ ID NO: 708 - DNA, 20 bp, Artificial Sequence
  chemically synthesized
ctttaccatttttgagtgta

SEQ ID NO: 709 - DNA, 20 bp, Artificial Sequence
  chemically synthesized
ccatttttgagtgtacggtt

SEQ ID NO: 710 - DNA, 20 bp, Artificial Sequence
  chemically synthesized
tttttgagtgtacggttcag

SEQ ID NO: 711 - DNA, 20 bp, Artificial Sequence
  chemically synthesized
tacatatgcacacatacaca

SEQ ID NO: 712 - DNA, 20 bp, Artificial Sequence
  chemically synthesized
catatgcacacatacacaca

SEQ ID NO: 713 - DNA, 20 bp, Artificial Sequence
  chemically synthesized
atatgcacacatacacacag

SEQ ID NO: 714 - DNA, 20 bp, Artificial Sequence
  chemically synthesized
tatgcacacatacacacaga

SEQ ID NO: 715 - DNA, 20 bp, Artificial Sequence
  chemically synthesized
tgcacacatacacacagagg

SEQ ID NO: 716 - DNA, 20 bp, Artificial Sequence
  chemically synthesized
cacacatacacacagaggga

SEQ ID NO: 717 - DNA, 20 bp, Artificial Sequence
  chemically synthesized
cacatacacacagagggaga

SEQ ID NO: 718 - DNA, 20 bp, Artificial Sequence
  chemically synthesized
catacacacagagggagaga

SEQ ID NO: 719 - DNA, 20 bp, Artificial Sequence
  chemically synthesized
tacacacagagggagagaga

SEQ ID NO: 720 - DNA, 20 bp, Artificial Sequence
  chemically synthesized
cacacagagggagagagaga

SEQ ID NO: 721 - DNA, 20 bp, Artificial Sequence
  chemically synthesized
acagagggagagagagagag

SEQ ID NO: 722 - DNA, 20 bp, Artificial Sequence
  chemically synthesized
cagagggagagagagagagt

SEQ ID NO: 723 - DNA, 20 bp, Artificial Sequence
  chemically synthesized
gagggagagagagagagtgg

SEQ ID NO: 724 - DNA, 20 bp, Artificial Sequence
  chemically synthesized
agggagagagagagagtggg

SEQ ID NO: 725 - DNA, 20 bp, Artificial Sequence
  chemically synthesized
gggagagagagagagtggga

SEQ ID NO: 726 - DNA, 20 bp, Artificial Sequence
  chemically synthesized
cctttcttccctcccgccgc

SEQ ID NO: 727 - DNA, 20 bp, Artificial Sequence
  chemically synthesized
aatctactctctgtcttcat

SEQ ID NO: 728 - DNA, 20 bp, Artificial Sequence
  chemically synthesized
cacgtttttaacttccacac

SEQ ID NO: 729 - DNA, 20 bp, Artificial Sequence
  chemically synthesized
tttttaacttccacacgagt

SEQ ID NO: 730 - DNA, 20 bp, Artificial Sequence
  chemically synthesized
gatatttttctttctgtgct

SEQ ID NO: 731 - DNA, 20 bp, Artificial Sequence
  chemically synthesized
tcacttaacgtaattgcttt

SEQ ID NO: 732 - DNA, 20 bp, Artificial Sequence
  chemically synthesized
taatatttcattctttttta

SEQ ID NO: 733 - DNA, 20 bp, Artificial Sequence
  chemically synthesized
ttatctgttgacgaatacat

SEQ ID NO: 734 - DNA, 20 bp, Artificial Sequence
  chemically synthesized
catcagttgatttcaaatct

SEQ ID NO: 735 - DNA, 20 bp, Artificial Sequence
  chemically synthesized
caaatcttggcgtttgtgaa

SEQ ID NO: 736 - DNA, 20 bp, Artificial Sequence
  chemically synthesized
ttgtgaatagtgctataata

SEQ ID NO: 737 - DNA, 20 bp, Artificial Sequence
  chemically synthesized
gaatagtgctataataaaga

SEQ ID NO: 738 - DNA, 20 bp, Artificial Sequence
  chemically synthesized
aatagtgctataataaagat

SEQ ID NO: 739 - DNA, 20 bp, Artificial Sequence
  chemically synthesized
tagtgctataataaagatgg

SEQ ID NO: 740 - DNA, 20 bp, Artificial Sequence
  chemically synthesized
acatactaatttattctttt

SEQ ID NO: 741 - DNA, 20 bp, Artificial Sequence
  chemically synthesized
catactaatttattctttta

SEQ ID NO: 742 - DNA, 20 bp, Artificial Sequence
  chemically synthesized
atactaatttattcttttaa

SEQ ID NO: 743 - DNA, 20 bp, Artificial Sequence
  chemically synthesized
ttcttttaagggtatatacc

SEQ ID NO: 744 - DNA, 20 bp, Artificial Sequence
  chemically synthesized
tcttttaagggtatatacct

SEQ ID NO: 745 - DNA, 20 bp, Artificial Sequence
  chemically synthesized
ttttaagggtatatacctag

SEQ ID NO: 746 - DNA, 20 bp, Artificial Sequence
  chemically synthesized
atacctaggagtgatattgc

SEQ ID NO: 747 - DNA, 20 bp, Artificial Sequence
  chemically synthesized
agtgatattgctggatcata

SEQ ID NO: 748 - DNA, 20 bp, Artificial Sequence
  chemically synthesized
gatattgctggatcatatgg

SEQ ID NO: 749 - DNA, 20 bp, Artificial Sequence
  chemically synthesized
ccaatttgtactcccaccaa

SEQ ID NO: 750 - DNA, 20 bp, Artificial Sequence
  chemically synthesized
tgtactcccaccaacagtgt

SEQ ID NO: 751 - DNA, 20 bp, Artificial Sequence
  chemically synthesized
tactcccaccaacagtgtaa

SEQ ID NO: 752 - DNA, 20 bp, Artificial Sequence
  chemically synthesized
actcccaccaacagtgtaag

SEQ ID NO: 753 - DNA, 20 bp, Artificial Sequence
  chemically synthesized
ctcccaccaacagtgtaaga

SEQ ID NO: 754 - DNA, 20 bp, Artificial Sequence
  chemically synthesized
ccctttgtccacatccacac

SEQ ID NO: 755 - DNA, 20 bp, Artificial Sequence
  chemically synthesized
atttccttttgttttgttat

SEQ ID NO: 756 - DNA, 20 bp, Artificial Sequence
  chemically synthesized
tgttataagctattttaact

SEQ ID NO: 757 - DNA, 20 bp, Artificial Sequence
  chemically synthesized
gttataagctattttaacta

SEQ ID NO: 758 - DNA, 20 bp, Artificial Sequence
  chemically synthesized
taagctattttaactaaggt

SEQ ID NO: 759 - DNA, 20 bp, Artificial Sequence
  chemically synthesized
ggtgagatgatatcacattg

SEQ ID NO: 760 - DNA, 20 bp, Artificial Sequence
  chemically synthesized
cattgtggttttgatttatc

SEQ ID NO: 761 - DNA, 20 bp, Artificial Sequence
  chemically synthesized
gttttgatttatctggtgat

SEQ ID NO: 762 - DNA, 20 bp, Artificial Sequence
  chemically synthesized
aacattttttcaaatacctc

SEQ ID NO: 763 - DNA, 20 bp, Artificial Sequence
  chemically synthesized
acattttttcaaatacctct

SEQ ID NO: 764 - DNA, 20 bp, Artificial Sequence
  chemically synthesized
atacctctgggccatttgta

SEQ ID NO: 765 - DNA, 20 bp, Artificial Sequence
  chemically synthesized
ccatttgtatggcttctttt

SEQ ID NO: 766 - DNA, 20 bp, Artificial Sequence
  chemically synthesized
tcttttgagaaatatctatt

SEQ ID NO: 767 - DNA, 20 bp, Artificial Sequence
  chemically synthesized
cttttgagaaatatctattc

SEQ ID NO: 768 - DNA, 20 bp, Artificial Sequence
  chemically synthesized
aaatatctattcaggtcttt

SEQ ID NO: 769 - DNA, 20 bp, Artificial Sequence
  chemically synthesized
ttatttatttattttctgtt

SEQ ID NO: 770 - DNA, 20 bp, Artificial Sequence
  chemically synthesized
tattttctgttgagttgctt

SEQ ID NO: 771 - DNA, 20 bp, Artificial Sequence
  chemically synthesized
cttgagtttcttgcatattc

SEQ ID NO: 772 - DNA, 20 bp, Artificial Sequence
  chemically synthesized
tcaattccttgtaaaatata

SEQ ID NO: 773 - DNA, 20 bp, Artificial Sequence
  chemically synthesized
aaatattttctcccattctt

SEQ ID NO: 774 - DNA, 20 bp, Artificial Sequence
  chemically synthesized
aatattttctcccattcttt

SEQ ID NO: 775 - DNA, 20 bp, Artificial Sequence
  chemically synthesized
ttattattttctttgctgtg

SEQ ID NO: 776 - DNA, 20 bp, Artificial Sequence
  chemically synthesized
attattttctttgctgtgca

SEQ ID NO: 777 - DNA, 20 bp, Artificial Sequence
  chemically synthesized
ccaattgtctatttttgttt

SEQ ID NO: 778 - DNA, 20 bp, Artificial Sequence
  chemically synthesized
tttggttatttgtgcttttg

SEQ ID NO: 779 - DNA, 20 bp, Artificial Sequence
  chemically synthesized
tttgtgcttttgaagtctca

SEQ ID NO: 780 - DNA, 20 bp, Artificial Sequence
  chemically synthesized
tgcttttgaagtctcataga

SEQ ID NO: 781 - DNA, 20 bp, Artificial Sequence
  chemically synthesized
gcccaaatcaatgaatgccc

SEQ ID NO: 782 - DNA, 20 bp, Artificial Sequence
  chemically synthesized
ccaaatcaatgaatgccctg

SEQ ID NO: 783 - DNA, 20 bp, Artificial Sequence
  chemically synthesized
caaatcaatgaatgccctgg

SEQ ID NO: 784 - DNA, 20 bp, Artificial Sequence
  chemically synthesized
aaatcaatgaatgccctgga

SEQ ID NO: 785 - DNA, 20 bp, Artificial Sequence
  chemically synthesized
gtttccccactgttttcttc

SEQ ID NO: 786 - DNA, 20 bp, Artificial Sequence
  chemically synthesized
tccccactgttttcttccag

SEQ ID NO: 787 - DNA, 20 bp, Artificial Sequence
  chemically synthesized
ttccagtagtttcataattt

SEQ ID NO: 788 - DNA, 20 bp, Artificial Sequence
  chemically synthesized
tccagtagtttcataatttc

SEQ ID NO: 789 - DNA, 20 bp, Artificial Sequence
  chemically synthesized
agtttcataatttcaggtat

SEQ ID NO: 790 - DNA, 20 bp, Artificial Sequence
  chemically synthesized
taatttcaggtattggattc

SEQ ID NO: 791 - DNA, 20 bp, Artificial Sequence
  chemically synthesized
cttgatttgatttttgtata

SEQ ID NO: 792 - DNA, 20 bp, Artificial Sequence
  chemically synthesized
atttgatttttgtatatagt

SEQ ID NO: 793 - DNA, 20 bp, Artificial Sequence
  chemically synthesized
ttgatttttgtatatagtga

SEQ ID NO: 794 - DNA, 20 bp, Artificial Sequence
  chemically synthesized
tttttgtatatagtgagaga

SEQ ID NO: 795 - DNA, 20 bp, Artificial Sequence
  chemically synthesized
ttttgtatatagtgagagat

SEQ ID NO: 796 - DNA, 20 bp, Artificial Sequence
  chemically synthesized
tttgtatatagtgagagata

SEQ ID NO: 797 - DNA, 20 bp, Artificial Sequence
  chemically synthesized
ttgtatatagtgagagatag

SEQ ID NO: 798 - DNA, 20 bp, Artificial Sequence
  chemically synthesized
cgattttactcttttgcaaa

SEQ ID NO: 799 - DNA, 20 bp, Artificial Sequence
  chemically synthesized
ctcttttgcaaatggatatc

SEQ ID NO: 800 - DNA, 20 bp, Artificial Sequence
  chemically synthesized
aaatggatatccagttttcc

SEQ ID NO: 801 - DNA, 20 bp, Artificial Sequence
  chemically synthesized
tcctagcactgtttcttgaa

SEQ ID NO: 802 - DNA, 20 bp, Artificial Sequence
  chemically synthesized
cctttttttttttttttttt

SEQ ID NO: 803 - DNA, 20 bp, Artificial Sequence
  chemically synthesized
ttttttttttttttttgaga

SEQ ID NO: 804 - DNA, 20 bp, Artificial Sequence
  chemically synthesized
ttttttttttttttgagatg

SEQ ID NO: 805 - DNA, 20 bp, Artificial Sequence
  chemically synthesized
gatggagtctcactgttgcc

SEQ ID NO: 806 - DNA, 20 bp, Artificial Sequence
  chemically synthesized
atggagtctcactgttgccc

SEQ ID NO: 807 - DNA, 20 bp, Artificial Sequence
  chemically synthesized
agtctcactgttgcccaggc

SEQ ID NO: 808 - DNA, 20 bp, Artificial Sequence
  chemically synthesized
tctcactgttgcccaggctg

SEQ ID NO: 809 - DNA, 20 bp, Artificial Sequence
  chemically synthesized
ctgttgcccaggctggagtg

SEQ ID NO: 810 - DNA, 20 bp, Artificial Sequence
  chemically synthesized
ttgcccaggctggagtgcag

SEQ ID NO: 811 - DNA, 20 bp, Artificial Sequence
  chemically synthesized
cccaggctggagtgcagtgg

SEQ ID NO: 812 - DNA, 20 bp, Artificial Sequence
  chemically synthesized
gtgcagtggcagcacaatct

SEQ ID NO: 813 - DNA, 20 bp, Artificial Sequence
  chemically synthesized
tcactgcaacttctgcctcc

SEQ ID NO: 814 - DNA, 20 bp, Artificial Sequence
  chemically synthesized
cactgcaacttctgcctccc

SEQ ID NO: 815 - DNA, 20 bp, Artificial Sequence
  chemically synthesized
aacttctgcctcccaggttc

SEQ ID NO: 816 - DNA, 20 bp, Artificial Sequence
  chemically synthesized
ttcaagcgattctcctgcct

SEQ ID NO: 817 - DNA, 20 bp, Artificial Sequence
  chemically synthesized
ttctcctgcctcagcctcct

SEQ ID NO: 818 - DNA, 20 bp, Artificial Sequence
  chemically synthesized
gcctcagcctcctgagtatc

SEQ ID NO: 819 - DNA, 20 bp, Artificial Sequence
  chemically synthesized
cctcagcctcctgagtatct

SEQ ID NO: 820 - DNA, 20 bp, Artificial Sequence
  chemically synthesized
ctcctgagtatctgggatta

SEQ ID NO: 821 - DNA, 20 bp, Artificial Sequence
  chemically synthesized
tcctgagtatctgggattac

SEQ ID NO: 822 - DNA, 20 bp, Artificial Sequence
  chemically synthesized
ctgagtatctgggattacag

SEQ ID NO: 823 - DNA, 20 bp, Artificial Sequence
  chemically synthesized
caggagcgccccaccatgcc

SEQ ID NO: 824 - DNA, 20 bp, Artificial Sequence
  chemically synthesized
ctggctaatttttgtatttt

SEQ ID NO: 825 - DNA, 20 bp, Artificial Sequence
  chemically synthesized
gctaatttttgtatttttag

SEQ ID NO: 826 - DNA, 20 bp, Artificial Sequence
  chemically synthesized
taatttttgtatttttagta

SEQ ID NO: 827 - DNA, 20 bp, Artificial Sequence
  chemically synthesized
ttttgtatttttagtagaga

SEQ ID NO: 828 - DNA, 20 bp, Artificial Sequence
  chemically synthesized
ttgtatttttagtagagacg

SEQ ID NO: 829 - DNA, 20 bp, Artificial Sequence
  chemically synthesized
gagacggagtgtcaccacgt

SEQ ID NO: 830 - DNA, 20 bp, Artificial Sequence
  chemically synthesized
cggagtgtcaccacgttggt

SEQ ID NO: 831 - DNA, 20 bp, Artificial Sequence
  chemically synthesized
ggagtgtcaccacgttggtc

SEQ ID NO: 832 - DNA, 20 bp, Artificial Sequence
  chemically synthesized
tgtcaccacgttggtcaggc

SEQ ID NO: 833 - DNA, 20 bp, Artificial Sequence
  chemically synthesized
acctcgtgatccccccacct

SEQ ID NO: 834 - DNA, 20 bp, Artificial Sequence
  chemically synthesized
ccccccacctcagcctcaca

SEQ ID NO: 835 - DNA, 20 bp, Artificial Sequence
  chemically synthesized
acctcagcctcacaaagtgc

SEQ ID NO: 836 - DNA, 20 bp, Artificial Sequence
  chemically synthesized
cctcagcctcacaaagtgct

SEQ ID NO: 837 - DNA, 20 bp, Artificial Sequence
  chemically synthesized
ctcacaaagtgctgggatta

SEQ ID NO: 838 - DNA, 20 bp, Artificial Sequence
  chemically synthesized
tcacaaagtgctgggattac

SEQ ID NO: 839 - DNA, 20 bp, Artificial Sequence
  chemically synthesized
agtgctgggattacaggtgt

SEQ ID NO: 840 - DNA, 20 bp, Artificial Sequence
  chemically synthesized
caggtgtgagccactgcacc

SEQ ID NO: 841 - DNA, 20 bp, Artificial Sequence
  chemically synthesized
tgttcttgatgcctttgtta

SEQ ID NO: 842 - DNA, 20 bp, Artificial Sequence
  chemically synthesized
tgcctttgttaaagatgact

SEQ ID NO: 843 - DNA, 20 bp, Artificial Sequence
  chemically synthesized
ttaaagatgacttggttgtt

SEQ ID NO: 844 - DNA, 20 bp, Artificial Sequence
  chemically synthesized
tgacttggttgttaagtgcc

SEQ ID NO: 845 - DNA, 20 bp, Artificial Sequence
  chemically synthesized
taagtgcctggatttgcatc

SEQ ID NO: 846 - DNA, 20 bp, Artificial Sequence
  chemically synthesized
aagtgcctggatttgcatct

SEQ ID NO: 847 - DNA, 20 bp, Artificial Sequence
  chemically synthesized
ggttctctatgctgttccat

SEQ ID NO: 848 - DNA, 20 bp, Artificial Sequence
  chemically synthesized
gttctctatgctgttccatt

SEQ ID NO: 849 - DNA, 20 bp, Artificial Sequence
  chemically synthesized
gctgtatgtctgtctttatg

SEQ ID NO: 850 - DNA, 20 bp, Artificial Sequence
  chemically synthesized
ttatgcagtactgtgctgtt

SEQ ID NO: 851 - DNA, 20 bp, Artificial Sequence
  chemically synthesized
actgtgctgtttggctactg

SEQ ID NO: 852 - DNA, 20 bp, Artificial Sequence
  chemically synthesized
gtttggctactgtagctttg

SEQ ID NO: 853 - DNA, 20 bp, Artificial Sequence
  chemically synthesized
tggctactgtagctttgtag

SEQ ID NO: 854 - DNA, 20 bp, Artificial Sequence
  chemically synthesized
tagctttgtagtagattttg

SEQ ID NO: 855 - DNA, 20 bp, Artificial Sequence
  chemically synthesized
tagtagattttgaagtcata

SEQ ID NO: 856 - DNA, 20 bp, Artificial Sequence
  chemically synthesized
tttgaagtcatatagtgtga

SEQ ID NO: 857 - DNA, 20 bp, Artificial Sequence
  chemically synthesized
gtcatatagtgtgatagctt

SEQ ID NO: 858 - DNA, 20 bp, Artificial Sequence
  chemically synthesized
ttggttttgttctttttgct

SEQ ID NO: 859 - DNA, 20 bp, Artificial Sequence
  chemically synthesized
tggttttgttctttttgctc

SEQ ID NO: 860 - DNA, 20 bp, Artificial Sequence
  chemically synthesized
ctttttgctcaggattgctt

SEQ ID NO: 861 - DNA, 20 bp, Artificial Sequence
  chemically synthesized
ctcaggattgctttagctat

SEQ ID NO: 862 - DNA, 20 bp, Artificial Sequence
  chemically synthesized
tcaggattgctttagctatt

SEQ ID NO: 863 - DNA, 20 bp, Artificial Sequence
  chemically synthesized
caggattgctttagctattg

SEQ ID NO: 864 - DNA, 20 bp, Artificial Sequence
  chemically synthesized
tagctattggggatcttttg

SEQ ID NO: 865 - DNA, 20 bp, Artificial Sequence
  chemically synthesized
ttgtggttccatataaatat

SEQ ID NO: 866 - DNA, 20 bp, Artificial Sequence
  chemically synthesized
tgtggttccatataaatatt

SEQ ID NO: 867 - DNA, 20 bp, Artificial Sequence
  chemically synthesized
tctatttctgtgaatgccat

SEQ ID NO: 868 - DNA, 20 bp, Artificial Sequence
  chemically synthesized
gaatgccattggtattttga

SEQ ID NO: 869 - DNA, 20 bp, Artificial Sequence
  chemically synthesized
actgaatctgtacattgctt

SEQ ID NO: 870 - DNA, 20 bp, Artificial Sequence
  chemically synthesized
ctgaatctgtacattgcttt

SEQ ID NO: 871 - DNA, 20 bp, Artificial Sequence
  chemically synthesized
aatctgtacattgctttggg

SEQ ID NO: 872 - DNA, 20 bp, Artificial Sequence
  chemically synthesized
cattttaatattaattcttc

SEQ ID NO: 873 - DNA, 20 bp, Artificial Sequence
  chemically synthesized
tattaattcttctagttcat

SEQ ID NO: 874 - DNA, 20 bp, Artificial Sequence
  chemically synthesized
attcttctagttcatgagca

SEQ ID NO: 875 - DNA, 20 bp, Artificial Sequence
  chemically synthesized
ccctcttctatttctttcac

SEQ ID NO: 876 - DNA, 20 bp, Artificial Sequence
  chemically synthesized
ctcttctatttctttcacca

SEQ ID NO: 877 - DNA, 20 bp, Artificial Sequence
  chemically synthesized
gagttttataatttttctta

SEQ ID NO: 878 - DNA, 20 bp, Artificial Sequence
  chemically synthesized
gttttataatttttcttata

SEQ ID NO: 879 - DNA, 20 bp, Artificial Sequence
  chemically synthesized
tatagagatcttttacttct

SEQ ID NO: 880 - DNA, 20 bp, Artificial Sequence
  chemically synthesized
atagagatcttttacttctt

SEQ ID NO: 881 - DNA, 20 bp, Artificial Sequence
  chemically synthesized
agatcttttacttcttgggt

SEQ ID NO: 882 - DNA, 20 bp, Artificial Sequence
  chemically synthesized
tcttgggttagattgactcc

SEQ ID NO: 883 - DNA, 20 bp, Artificial Sequence
  chemically synthesized
cttgggttagattgactcct

SEQ ID NO: 884 - DNA, 20 bp, Artificial Sequence
  chemically synthesized
tttttattgctattgtaaat

SEQ ID NO: 885 - DNA, 20 bp, Artificial Sequence
  chemically synthesized
tgttttattgattttttttg

SEQ ID NO: 886 - DNA, 20 bp, Artificial Sequence
  chemically synthesized
atttttttaaatcgttttaa

SEQ ID NO: 887 - DNA, 20 bp, Artificial Sequence
  chemically synthesized
taaatcgttttaatagtatt

SEQ ID NO: 888 - DNA, 20 bp, Artificial Sequence
  chemically synthesized
cgttttaatagtatttagtg

SEQ ID NO: 889 - DNA, 20 bp, Artificial Sequence
  chemically synthesized
atagtatttagtgaagtttt

SEQ ID NO: 890 - DNA, 20 bp, Artificial Sequence
  chemically synthesized
tagtatttagtgaagttttt

SEQ ID NO: 891 - DNA, 20 bp, Artificial Sequence
  chemically synthesized
gaagtttttaggttttttct

SEQ ID NO: 892 - DNA, 20 bp, Artificial Sequence
  chemically synthesized
tttaggttttttctaagtat

SEQ ID NO: 893 - DNA, 20 bp, Artificial Sequence
  chemically synthesized
agatcatgtcatctacaaac

SEQ ID NO: 894 - DNA, 20 bp, Artificial Sequence
  chemically synthesized
gatcatgtcatctacaaact

SEQ ID NO: 895 - DNA, 20 bp, Artificial Sequence
  chemically synthesized
taacttcttcctttccaatt

SEQ ID NO: 896 - DNA, 20 bp, Artificial Sequence
  chemically synthesized
cttcctgaatttctctttcc

SEQ ID NO: 897 - DNA, 20 bp, Artificial Sequence
  chemically synthesized
tccaatattatgttaaataa

SEQ ID NO: 898 - DNA, 20 bp, Artificial Sequence
  chemically synthesized
atgttaaataatggcaatga

SEQ ID NO: 899 - DNA, 20 bp, Artificial Sequence
  chemically synthesized
taaataatggcaatgaaagt

SEQ ID NO: 900 - DNA, 20 bp, Artificial Sequence
  chemically synthesized
tgagcattcttgccttattt

SEQ ID NO: 901 - DNA, 20 bp, Artificial Sequence
  chemically synthesized
tcttgccttatttcagtcct

SEQ ID NO: 902 - DNA, 20 bp, Artificial Sequence
  chemically synthesized
ttgccttatttcagtcctta

SEQ ID NO: 903 - DNA, 20 bp, Artificial Sequence
  chemically synthesized
tgccttatttcagtccttag

SEQ ID NO: 904 - DNA, 20 bp, Artificial Sequence
  chemically synthesized
ttatttcagtccttagagga

SEQ ID NO: 905 - DNA, 20 bp, Artificial Sequence
  chemically synthesized
tatttcagtccttagaggaa

SEQ ID NO: 906 - DNA, 20 bp, Artificial Sequence
  chemically synthesized
gccttcaatgtttctctgtt

SEQ ID NO: 907 - DNA, 20 bp, Artificial Sequence
  chemically synthesized
ttctctgttcagcataatgt

SEQ ID NO: 908 - DNA, 20 bp, Artificial Sequence
  chemically synthesized
ttcagcataatgttagcact

SEQ ID NO: 909 - DNA, 20 bp, Artificial Sequence
  chemically synthesized
agcacttggtttgtcctata

SEQ ID NO: 910 - DNA, 20 bp, Artificial Sequence
  chemically synthesized
tatatggtttttattatttt

SEQ ID NO: 911 - DNA, 20 bp, Artificial Sequence
  chemically synthesized
atatggtttttattattttg

SEQ ID NO: 912 - DNA, 20 bp, Artificial Sequence
  chemically synthesized
gttcctactgtacctccttt

SEQ ID NO: 913 - DNA, 20 bp, Artificial Sequence
  chemically synthesized
ttcctactgtacctcctttg

SEQ ID NO: 914 - DNA, 20 bp, Artificial Sequence
  chemically synthesized
gtgcatttgttgttgtgtcc

SEQ ID NO: 915 - DNA, 20 bp, Artificial Sequence
  chemically synthesized
tttgttgttgtgtcctggtc

SEQ ID NO: 916 - DNA, 20 bp, Artificial Sequence
  chemically synthesized
tgttgtgtcctggtctggtt

SEQ ID NO: 917 - DNA, 20 bp, Artificial Sequence
  chemically synthesized
gttgtgtcctggtctggttt

SEQ ID NO: 918 - DNA, 20 bp, Artificial Sequence
  chemically synthesized
ctggtctggtttgggtatat

SEQ ID NO: 919 - DNA, 20 bp, Artificial Sequence
  chemically synthesized
ggtctggtttgggtatatta

SEQ ID NO: 920 - DNA, 20 bp, Artificial Sequence
  chemically synthesized
ttagagtaatgcttgcctca

SEQ ID NO: 921 - DNA, 20 bp, Artificial Sequence
  chemically synthesized
taatgcttgcctcatagaat

SEQ ID NO: 922 - DNA, 20 bp, Artificial Sequence
  chemically synthesized
cttgcctcatagaataagtt

SEQ ID NO: 923 - DNA, 20 bp, Artificial Sequence
  chemically synthesized
gcctcatagaataagtttag

SEQ ID NO: 924 - DNA, 20 bp, Artificial Sequence
  chemically synthesized
tcatagaataagtttagaag

SEQ ID NO: 925 - DNA, 20 bp, Artificial Sequence
  chemically synthesized
catagaataagtttagaagt

SEQ ID NO: 926 - DNA, 20 bp, Artificial Sequence
  chemically synthesized
tagaagtaggcccttctttt

SEQ ID NO: 927 - DNA, 20 bp, Artificial Sequence
  chemically synthesized
ttttatttgtttgtttgttt

SEQ ID NO: 928 - DNA, 20 bp, Artificial Sequence
  chemically synthesized
tttatttgtttgtttgtttg

SEQ ID NO: 929 - DNA, 20 bp, Artificial Sequence
  chemically synthesized
tttgtttgtttgaggaattt

SEQ ID NO: 930 - DNA, 20 bp, Artificial Sequence
  chemically synthesized
ttgaggaatttgagtacgat

SEQ ID NO: 931 - DNA, 20 bp, Artificial Sequence
  chemically synthesized
aatttgagtacgattagtat

SEQ ID NO: 932 - DNA, 20 bp, Artificial Sequence
  chemically synthesized
ttagttctacttgaaatgtt

SEQ ID NO: 933 - DNA, 20 bp, Artificial Sequence
  chemically synthesized
gttctacttgaaatgtttgg

SEQ ID NO: 934 - DNA, 20 bp, Artificial Sequence
  chemically synthesized
gaaatgtttggtagcccatc

SEQ ID NO: 935 - DNA, 20 bp, Artificial Sequence
  chemically synthesized
tttggtagcccatcgagtcc

SEQ ID NO: 936 - DNA, 20 bp, Artificial Sequence
  chemically synthesized
ttggtagcccatcgagtcct

SEQ ID NO: 937 - DNA, 20 bp, Artificial Sequence
  chemically synthesized
agtcctgggcttttctttaa

SEQ ID NO: 938 - DNA, 20 bp, Artificial Sequence
  chemically synthesized
gtcctgggcttttctttaat

SEQ ID NO: 939 - DNA, 20 bp, Artificial Sequence
  chemically synthesized
ttattcattattgttctatt

SEQ ID NO: 940 - DNA, 20 bp, Artificial Sequence
  chemically synthesized
tattcattattgttctattg

SEQ ID NO: 941 - DNA, 20 bp, Artificial Sequence
  chemically synthesized
ttttctgtttctacatgctt

SEQ ID NO: 942 - DNA, 20 bp, Artificial Sequence
  chemically synthesized
tctacatgcttcagtcttgc

SEQ ID NO: 943 - DNA, 20 bp, Artificial Sequence
  chemically synthesized
ctacatgcttcagtcttgct

SEQ ID NO: 944 - DNA, 20 bp, Artificial Sequence
  chemically synthesized
cttgctaggctgtatgtgtc

SEQ ID NO: 945 - DNA, 20 bp, Artificial Sequence
  chemically synthesized
ttgctaggctgtatgtgtcc

SEQ ID NO: 946 - DNA, 20 bp, Artificial Sequence
  chemically synthesized
aggaatttatccatttattc

SEQ ID NO: 947 - DNA, 20 bp, Artificial Sequence
  chemically synthesized
ttctagattttccaatttgt

SEQ ID NO: 948 - DNA, 20 bp, Artificial Sequence
  chemically synthesized
ttttccaatttgttggaata

SEQ ID NO: 949 - DNA, 20 bp, Artificial Sequence
  chemically synthesized
tggaatacagttgttcataa

SEQ ID NO: 950 - DNA, 20 bp, Artificial Sequence
  chemically synthesized
tgttcataatagtatctaat

SEQ ID NO: 951 - DNA, 20 bp, Artificial Sequence
  chemically synthesized
taatgagtctttgtgttgct

SEQ ID NO: 952 - DNA, 20 bp, Artificial Sequence
  chemically synthesized
aatgagtctttgtgttgctg

SEQ ID NO: 953 - DNA, 20 bp, Artificial Sequence
  chemically synthesized
tatttgactcttttttctta

SEQ ID NO: 954 - DNA, 20 bp, Artificial Sequence
  chemically synthesized
ttgattttgtttacctttcc

SEQ ID NO: 955 - DNA, 20 bp, Artificial Sequence
  chemically synthesized
ttttgtttacctttccaaga

SEQ ID NO: 956 - DNA, 20 bp, Artificial Sequence
  chemically synthesized
taatgattttctgtattttt

SEQ ID NO: 957 - DNA, 20 bp, Artificial Sequence
  chemically synthesized
ccttctattaattttgcatt

SEQ ID NO: 958 - DNA, 20 bp, Artificial Sequence
  chemically synthesized
tcttgctttcctatttcctt

SEQ ID NO: 959 - DNA, 20 bp, Artificial Sequence
  chemically synthesized
cttgctttcctatttccttg

SEQ ID NO: 960 - DNA, 20 bp, Artificial Sequence
  chemically synthesized
tttccttgaggtacattgtt

SEQ ID NO: 961 - DNA, 20 bp, Artificial Sequence
  chemically synthesized
aggtacattgtttggttgct

SEQ ID NO: 962 - DNA, 20 bp, Artificial Sequence
  chemically synthesized
attgtttggttgcttagttg

SEQ ID NO: 963 - DNA, 20 bp, Artificial Sequence
  chemically synthesized
ttgaagcctttctacttttt

SEQ ID NO: 964 - DNA, 20 bp, Artificial Sequence
  chemically synthesized
cctttctacttttttggata

SEQ ID NO: 965 - DNA, 20 bp, Artificial Sequence
  chemically synthesized
ctttctacttttttggatat

SEQ ID NO: 966 - DNA, 20 bp, Artificial Sequence
  chemically synthesized
attgctatgaacttccctct

SEQ ID NO: 967 - DNA, 20 bp, Artificial Sequence
  chemically synthesized
actgcttttgccatatcctg

SEQ ID NO: 968 - DNA, 20 bp, Artificial Sequence
  chemically synthesized
ctgcttttgccatatcctgt

SEQ ID NO: 969 - DNA, 20 bp, Artificial Sequence
  chemically synthesized
ttgccatatcctgtaggttt

SEQ ID NO: 970 - DNA, 20 bp, Artificial Sequence
  chemically synthesized
tttccattttcacttgtttc

SEQ ID NO: 971 - DNA, 20 bp, Artificial Sequence
  chemically synthesized
ccattttcacttgtttcaag

SEQ ID NO: 972 - DNA, 20 bp, Artificial Sequence
  chemically synthesized
aatttccttcttaatttctt

SEQ ID NO: 973 - DNA, 20 bp, Artificial Sequence
  chemically synthesized
taatttctttagtgactcat

SEQ ID NO: 974 - DNA, 20 bp, Artificial Sequence
  chemically synthesized
ttagtgactcattggttatt

SEQ ID NO: 975 - DNA, 20 bp, Artificial Sequence
  chemically synthesized
agtttcatgcgcatccctgt

SEQ ID NO: 976 - DNA, 20 bp, Artificial Sequence
  chemically synthesized
gtttcatgcgcatccctgtg

SEQ ID NO: 977 - DNA, 20 bp, Artificial Sequence
  chemically synthesized
ttcatgcgcatccctgtgag

SEQ ID NO: 978 - DNA, 20 bp, Artificial Sequence
  chemically synthesized
cctgtgaggagactaccaaa

SEQ ID NO: 979 - DNA, 20 bp, Artificial Sequence
  chemically synthesized
ctgtgaggagactaccaaac

SEQ ID NO: 980 - DNA, 20 bp, Artificial Sequence
  chemically synthesized
ctaccaaacaggctttgtgt

SEQ ID NO: 981 - DNA, 20 bp, Artificial Sequence
  chemically synthesized
caggctttgtgtgagcaata

SEQ ID NO: 982 - DNA, 20 bp, Artificial Sequence
  chemically synthesized
caataaagctttttatcacc

SEQ ID NO: 983 - DNA, 20 bp, Artificial Sequence
  chemically synthesized
aataaagctttttatcacct

SEQ ID NO: 984 - DNA, 20 bp, Artificial Sequence
  chemically synthesized
agctttttatcacctgggtg

SEQ ID NO: 985 - DNA, 20 bp, Artificial Sequence
  chemically synthesized
gctttttatcacctgggtgc

SEQ ID NO: 986 - DNA, 20 bp, Artificial Sequence
  chemically synthesized
ttttatcacctgggtgcagg

SEQ ID NO: 987 - DNA, 20 bp, Artificial Sequence
  chemically synthesized
tttatcacctgggtgcaggc

SEQ ID NO: 988 - DNA, 20 bp, Artificial Sequence
  chemically synthesized
cacctgggtgcaggcgggct

SEQ ID NO: 989 - DNA, 20 bp, Artificial Sequence
  chemically synthesized
gcaggcgggctgagtccgaa

SEQ ID NO: 990 - DNA, 20 bp, Artificial Sequence
  chemically synthesized
aggcgggctgagtccgaaaa

SEQ ID NO: 991 - DNA, 20 bp, Artificial Sequence
  chemically synthesized
gcgggctgagtccgaaaaga

SEQ ID NO: 992 - DNA, 20 bp, Artificial Sequence
  chemically synthesized
gctgagtccgaaaagagagt

SEQ ID NO: 993 - DNA, 20 bp, Artificial Sequence
  chemically synthesized
gtccgaaaagagagtcagca

SEQ ID NO: 994 - DNA, 20 bp, Artificial Sequence
  chemically synthesized
tccgaaaagagagtcagcaa

SEQ ID NO: 995 - DNA, 20 bp, Artificial Sequence
  chemically synthesized
ccgaaaagagagtcagcaaa

SEQ ID NO: 996 - DNA, 20 bp, Artificial Sequence
  chemically synthesized
gaaaagagagtcagcaaagg

SEQ ID NO: 997 - DNA, 20 bp, Artificial Sequence
  chemically synthesized
agagagtcagcaaagggaga

SEQ ID NO: 998 - DNA, 20 bp, Artificial Sequence
  chemically synthesized
gagagtcagcaaagggagat

SEQ ID NO: 999 - DNA, 20 bp, Artificial Sequence
  chemically synthesized
gagtcagcaaagggagatag

SEQ ID NO: 1000 - DNA, 20 bp, Artificial Sequence
  chemically synthesized
tcagcaaagggagataggag

SEQ ID NO: 1001 - DNA, 20 bp, Artificial Sequence
  chemically synthesized
cagcaaagggagataggagt

SEQ ID NO: 1002 - DNA, 20 bp, Artificial Sequence
  chemically synthesized
agcaaagggagataggagtg

SEQ ID NO: 1003 - DNA, 20 bp, Artificial Sequence
  chemically synthesized
taggagtggggctgttttat

SEQ ID NO: 1004 - DNA, 20 bp, Artificial Sequence
  chemically synthesized
tggggctgttttataagatt

SEQ ID NO: 1005 - DNA, 20 bp, Artificial Sequence
  chemically synthesized
ggggctgttttataagattt

SEQ ID NO: 1006 - DNA, 20 bp, Artificial Sequence
  chemically synthesized
gctgttttataagatttggg

SEQ ID NO: 1007 - DNA, 20 bp, Artificial Sequence
  chemically synthesized
ctgttttataagatttgggt

SEQ ID NO: 1008 - DNA, 20 bp, Artificial Sequence
  chemically synthesized
ttataagatttgggtaggta

SEQ ID NO: 1009 - DNA, 20 bp, Artificial Sequence
  chemically synthesized
tataagatttgggtaggtaa

SEQ ID NO: 1010 - DNA, 20 bp, Artificial Sequence
  chemically synthesized
gggtaggtaaaggaaaatta

SEQ ID NO: 1011 - DNA, 20 bp, Artificial Sequence
  chemically synthesized
gtaaaggaaaattacagtca

SEQ ID NO: 1012 - DNA, 20 bp, Artificial Sequence
  chemically synthesized
taaaggaaaattacagtcaa

SEQ ID NO: 1013 - DNA, 20 bp, Artificial Sequence
  chemically synthesized
aaaggaaaattacagtcaaa

SEQ ID NO: 1014 - DNA, 20 bp, Artificial Sequence
  chemically synthesized
aaggaaaattacagtcaaag

SEQ ID NO: 1015 - DNA, 20 bp, Artificial Sequence
  chemically synthesized
aggaaaattacagtcaaagg

SEQ ID NO: 1016 - DNA, 20 bp, Artificial Sequence
  chemically synthesized
ggaaaattacagtcaaaggg

SEQ ID NO: 1017 - DNA, 20 bp, Artificial Sequence
  chemically synthesized
gtcaaaggggggttgttctc

SEQ ID NO: 1018 - DNA, 20 bp, Artificial Sequence
  chemically synthesized
aaaggggggttgttctctgg

SEQ ID NO: 1019 - DNA, 20 bp, Artificial Sequence
  chemically synthesized
aaggggggttgttctctggc

SEQ ID NO: 1020 - DNA, 20 bp, Artificial Sequence
  chemically synthesized
gggggttgttctctggcggg

SEQ ID NO: 1021 - DNA, 20 bp, Artificial Sequence
  chemically synthesized
ggggttgttctctggcgggc

SEQ ID NO: 1022 - DNA, 20 bp, Artificial Sequence
  chemically synthesized
ggttgttctctggcgggcag

SEQ ID NO: 1023 - DNA, 20 bp, Artificial Sequence
  chemically synthesized
tgttctctggcgggcaggag

SEQ ID NO: 1024 - DNA, 20 bp, Artificial Sequence
  chemically synthesized
gttctctggcgggcaggagt

SEQ ID NO: 1025 - DNA, 20 bp, Artificial Sequence
  chemically synthesized
ttctctggcgggcaggagtg

SEQ ID NO: 1026 - DNA, 20 bp, Artificial Sequence
  chemically synthesized
tctctggcgggcaggagtgg

SEQ ID NO: 1027 - DNA, 20 bp, Artificial Sequence
  chemically synthesized
ctctggcgggcaggagtggg

SEQ ID NO: 1028 - DNA, 20 bp, Artificial Sequence
  chemically synthesized
gggcaggagtggggggtcac

SEQ ID NO: 1029 - DNA, 20 bp, Artificial Sequence
  chemically synthesized
ggcaggagtggggggtcaca

SEQ ID NO: 1030 - DNA, 20 bp, Artificial Sequence
  chemically synthesized
gtggggggtcacaaggtgct

SEQ ID NO: 1031 - DNA, 20 bp, Artificial Sequence
  chemically synthesized
gggggtcacaaggtgctcag

SEQ ID NO: 1032 - DNA, 20 bp, Artificial Sequence
  chemically synthesized
ggggtcacaaggtgctcagt

SEQ ID NO: 1033 - DNA, 20 bp, Artificial Sequence
  chemically synthesized
gggtcacaaggtgctcagta

SEQ ID NO: 1034 - DNA, 20 bp, Artificial Sequence
  chemically synthesized
ggtcacaaggtgctcagtag

SEQ ID NO: 1035 - DNA, 20 bp, Artificial Sequence
  chemically synthesized
tcacaaggtgctcagtaggg

SEQ ID NO: 1036 - DNA, 20 bp, Artificial Sequence
  chemically synthesized
tgctcagtaggggagctttt

SEQ ID NO: 1037 - DNA, 20 bp, Artificial Sequence
  chemically synthesized
cagtaggggagcttttgagc

SEQ ID NO: 1038 - DNA, 20 bp, Artificial Sequence
  chemically synthesized
agtaggggagcttttgagcc

SEQ ID NO: 1039 - DNA, 20 bp, Artificial Sequence
  chemically synthesized
gggagcttttgagccaggat

SEQ ID NO: 1040 - DNA, 20 bp, Artificial Sequence
  chemically synthesized
gcttttgagccaggatgagc

SEQ ID NO: 1041 - DNA, 20 bp, Artificial Sequence
  chemically synthesized
cttttgagccaggatgagcc

SEQ ID NO: 1042 - DNA, 20 bp, Artificial Sequence
  chemically synthesized
tttgagccaggatgagccag

SEQ ID NO: 1043 - DNA, 20 bp, Artificial Sequence
  chemically synthesized
gagccaggatgagccaggag

SEQ ID NO: 1044 - DNA, 20 bp, Artificial Sequence
  chemically synthesized
agccaggatgagccaggaga

SEQ ID NO: 1045 - DNA, 20 bp, Artificial Sequence
  chemically synthesized
gccaggagaaggactttcac

SEQ ID NO: 1046 - DNA, 20 bp, Artificial Sequence
  chemically synthesized
ctttcacaagacaatgtcat

SEQ ID NO: 1047 - DNA, 20 bp, Artificial Sequence
  chemically synthesized
acaagacaatgtcatcagtt

SEQ ID NO: 1048 - DNA, 20 bp, Artificial Sequence
  chemically synthesized
caagacaatgtcatcagtta

SEQ ID NO: 1049 - DNA, 20 bp, Artificial Sequence
  chemically synthesized
gacaatgtcatcagttaagg

SEQ ID NO: 1050 - DNA, 20 bp, Artificial Sequence
  chemically synthesized
acaatgtcatcagttaaggc

SEQ ID NO: 1051 - DNA, 20 bp, Artificial Sequence
  chemically synthesized
gtcatcagttaaggcaggaa

SEQ ID NO: 1052 - DNA, 20 bp, Artificial Sequence
  chemically synthesized
tcatcagttaaggcaggaac

SEQ ID NO: 1053 - DNA, 20 bp, Artificial Sequence
  chemically synthesized
ggccattttcacttcttttg

SEQ ID NO: 1054 - DNA, 20 bp, Artificial Sequence
  chemically synthesized
cattttcacttcttttgtgg

SEQ ID NO: 1055 - DNA, 20 bp, Artificial Sequence
  chemically synthesized
cttttgtggtggaatgtcat

SEQ ID NO: 1056 - DNA, 20 bp, Artificial Sequence
  chemically synthesized
gtggtggaatgtcatcagtt

SEQ ID NO: 1057 - DNA, 20 bp, Artificial Sequence
  chemically synthesized
tggtggaatgtcatcagtta

SEQ ID NO: 1058 - DNA, 20 bp, Artificial Sequence
  chemically synthesized
tggaatgtcatcagttaagg

SEQ ID NO: 1059 - DNA, 20 bp, Artificial Sequence
  chemically synthesized
ggaatgtcatcagttaaggc

SEQ ID NO: 1060 - DNA, 20 bp, Artificial Sequence
  chemically synthesized
tcatcagttaaggcaggaac

SEQ ID NO: 1061 - DNA, 20 bp, Artificial Sequence
  chemically synthesized
gccatctgtatgtgtacctg

SEQ ID NO: 1062 - DNA, 20 bp, Artificial Sequence
  chemically synthesized
ccatctgtatgtgtacctgc

SEQ ID NO: 1063 - DNA, 20 bp, Artificial Sequence
  chemically synthesized
gtatgtgtacctgcaggtca

SEQ ID NO: 1064 - DNA, 20 bp, Artificial Sequence
  chemically synthesized
tatgtgtacctgcaggtcac

SEQ ID NO: 1065 - DNA, 20 bp, Artificial Sequence
  chemically synthesized
atgtgtacctgcaggtcaca

SEQ ID NO: 1066 - DNA, 20 bp, Artificial Sequence
  chemically synthesized
tgtgtacctgcaggtcacag

SEQ ID NO: 1067 - DNA, 20 bp, Artificial Sequence
  chemically synthesized
gcaggtcacaggggacatga

SEQ ID NO: 1068 - DNA, 20 bp, Artificial Sequence
  chemically synthesized
tcacaggggacatgatggct

SEQ ID NO: 1069 - DNA, 20 bp, Artificial Sequence
  chemically synthesized
ggggacatgatggcttagct

SEQ ID NO: 1070 - DNA, 20 bp, Artificial Sequence
  chemically synthesized
gggacatgatggcttagctt

SEQ ID NO: 1071 - DNA, 20 bp, Artificial Sequence
  chemically synthesized
atgatggcttagcttgggct

SEQ ID NO: 1072 - DNA, 20 bp, Artificial Sequence
  chemically synthesized
gatggcttagcttgggctca

SEQ ID NO: 1073 - DNA, 20 bp, Artificial Sequence
  chemically synthesized
atggcttagcttgggctcag

SEQ ID NO: 1074 - DNA, 20 bp, Artificial Sequence
  chemically synthesized
tcctgtcttcttatattaat

SEQ ID NO: 1075 - DNA, 20 bp, Artificial Sequence
  chemically synthesized
ataagaaaaataaaacataa

SEQ ID NO: 1076 - DNA, 20 bp, Artificial Sequence
  chemically synthesized
aataaaacataatagtgttg

SEQ ID NO: 1077 - DNA, 20 bp, Artificial Sequence
  chemically synthesized
acataatagtgttgaagtgt

SEQ ID NO: 1078 - DNA, 20 bp, Artificial Sequence
  chemically synthesized
cataatagtgttgaagtgtt

SEQ ID NO: 1079 - DNA, 20 bp, Artificial Sequence
  chemically synthesized
ataatagtgttgaagtgttg

SEQ ID NO: 1080 - DNA, 20 bp, Artificial Sequence
  chemically synthesized
atagtgttgaagtgttgggg

SEQ ID NO: 1081 - DNA, 20 bp, Artificial Sequence
  chemically synthesized
tgttggggcagcgaaaattt

SEQ ID NO: 1082 - DNA, 20 bp, Artificial Sequence
  chemically synthesized
gttggggcagcgaaaatttt

SEQ ID NO: 1083 - DNA, 20 bp, Artificial Sequence
  chemically synthesized
ttggggcagcgaaaattttg

SEQ ID NO: 1084 - DNA, 20 bp, Artificial Sequence
  chemically synthesized
tggggcagcgaaaattttgg

SEQ ID NO: 1085 - DNA, 20 bp, Artificial Sequence
  chemically synthesized
gcagcgaaaattttggggga

SEQ ID NO: 1086 - DNA, 20 bp, Artificial Sequence
  chemically synthesized
gaaaattttgggggatggta

SEQ ID NO: 1087 - DNA, 20 bp, Artificial Sequence
  chemically synthesized
aaattttgggggatggtatg

SEQ ID NO: 1088 - DNA, 20 bp, Artificial Sequence
  chemically synthesized
attttgggggatggtatgga

SEQ ID NO: 1089 - DNA, 20 bp, Artificial Sequence
  chemically synthesized
gggatggtatggagagataa

SEQ ID NO: 1090 - DNA, 20 bp, Artificial Sequence
  chemically synthesized
ggatggtatggagagataat

SEQ ID NO: 1091 - DNA, 20 bp, Artificial Sequence
  chemically synthesized
agataatgggcgatatttct

SEQ ID NO: 1092 - DNA, 20 bp, Artificial Sequence
  chemically synthesized
gataatgggcgatatttctc

SEQ ID NO: 1093 - DNA, 20 bp, Artificial Sequence
  chemically synthesized
ataatgggcgatatttctca

SEQ ID NO: 1094 - DNA, 20 bp, Artificial Sequence
  chemically synthesized
atatttctcagggctgcttc

SEQ ID NO: 1095 - DNA, 20 bp, Artificial Sequence
  chemically synthesized
tttctcagggctgcttcgag

SEQ ID NO: 1096 - DNA, 20 bp, Artificial Sequence
  chemically synthesized
ttctcagggctgcttcgagc

SEQ ID NO: 1097 - DNA, 20 bp, Artificial Sequence
  chemically synthesized
agggctgcttcgagcgggat

SEQ ID NO: 1098 - DNA, 20 bp, Artificial Sequence
  chemically synthesized
gggctgcttcgagcgggatt

SEQ ID NO: 1099 - DNA, 20 bp, Artificial Sequence
  chemically synthesized
ggctgcttcgagcgggatta

SEQ ID NO: 1100 - DNA, 20 bp, Artificial Sequence
  chemically synthesized
gctgcttcgagcgggattag

SEQ ID NO: 1101 - DNA, 20 bp, Artificial Sequence
  chemically synthesized
gcttcgagcgggattagggg

SEQ ID NO: 1102 - DNA, 20 bp, Artificial Sequence
  chemically synthesized
gagcgggattaggggcggcg

SEQ ID NO: 1103 - DNA, 20 bp, Artificial Sequence
  chemically synthesized
agcgggattaggggcggcgt

SEQ ID NO: 1104 - DNA, 20 bp, Artificial Sequence
  chemically synthesized
ttaggggcggcgtgggaacc

SEQ ID NO: 1105 - DNA, 20 bp, Artificial Sequence
  chemically synthesized
aggggcggcgtgggaaccta

SEQ ID NO: 1106 - DNA, 20 bp, Artificial Sequence
  chemically synthesized
ggcggcgtgggaacctagag

SEQ ID NO: 1107 - DNA, 20 bp, Artificial Sequence
  chemically synthesized
gcggcgtgggaacctagagt

SEQ ID NO: 1108 - DNA, 20 bp, Artificial Sequence
  chemically synthesized
ggcgtgggaacctagagtgg

SEQ ID NO: 1109 - DNA, 20 bp, Artificial Sequence
  chemically synthesized
cgtgggaacctagagtggga

SEQ ID NO: 1110 - DNA, 20 bp, Artificial Sequence
  chemically synthesized
aacctagagtgggagagatt

SEQ ID NO: 1111 - DNA, 20 bp, Artificial Sequence
  chemically synthesized
gagtgggagagattaagctg

SEQ ID NO: 1112 - DNA, 20 bp, Artificial Sequence
  chemically synthesized
agtgggagagattaagctga

SEQ ID NO: 1113 - DNA, 20 bp, Artificial Sequence
  chemically synthesized
gggagagattaagctgaagg

SEQ ID NO: 1114 - DNA, 20 bp, Artificial Sequence
  chemically synthesized
taagctgaaggaagattttg

SEQ ID NO: 1115 - DNA, 20 bp, Artificial Sequence
  chemically synthesized
ctgaaggaagattttgtggt

SEQ ID NO: 1116 - DNA, 20 bp, Artificial Sequence
  chemically synthesized
tgaaggaagattttgtggta

SEQ ID NO: 1117 - DNA, 20 bp, Artificial Sequence
  chemically synthesized
gaaggaagattttgtggtaa

SEQ ID NO: 1118 - DNA, 20 bp, Artificial Sequence
  chemically synthesized
aaggaagattttgtggtaag

SEQ ID NO: 1119 - DNA, 20 bp, Artificial Sequence
  chemically synthesized
tgtggtaaggggtgatattg

SEQ ID NO: 1120 - DNA, 20 bp, Artificial Sequence
  chemically synthesized
gtggtaaggggtgatattgt

SEQ ID NO: 1121 - DNA, 20 bp, Artificial Sequence
  chemically synthesized
tggtaaggggtgatattgtg

SEQ ID NO: 1122 - DNA, 20 bp, Artificial Sequence
  chemically synthesized
gggtgatattgtggggttgt

SEQ ID NO: 1123 - DNA, 20 bp, Artificial Sequence
  chemically synthesized
tgatattgtggggttgttag

SEQ ID NO: 1124 - DNA, 20 bp, Artificial Sequence
  chemically synthesized
tagaagaaacatttgtcatg

SEQ ID NO: 1125 - DNA, 20 bp, Artificial Sequence
  chemically synthesized
catttgtcatgtagaattat

SEQ ID NO: 1126 - DNA, 20 bp, Artificial Sequence
  chemically synthesized
tcatgtagaattattggtga

SEQ ID NO: 1127 - DNA, 20 bp, Artificial Sequence
  chemically synthesized
tagaattattggtgatggcc

SEQ ID NO: 1128 - DNA, 20 bp, Artificial Sequence
  chemically synthesized
tattggtgatggcctggata

SEQ ID NO: 1129 - DNA, 20 bp, Artificial Sequence
  chemically synthesized
ggcctggatacggttttgta

SEQ ID NO: 1130 - DNA, 20 bp, Artificial Sequence
  chemically synthesized
gtatggattgaaaaaccaaa

SEQ ID NO: 1131 - DNA, 20 bp, Artificial Sequence
  chemically synthesized
attgaaaaaccaaatggaat

SEQ ID NO: 1132 - DNA, 20 bp, Artificial Sequence
  chemically synthesized
tgaaaaaccaaatggaataa

SEQ ID NO: 1133 - DNA, 20 bp, Artificial Sequence
  chemically synthesized
aaaaccaaatggaataagag

SEQ ID NO: 1134 - DNA, 20 bp, Artificial Sequence
  chemically synthesized
aaaccaaatggaataagaga

SEQ ID NO: 1135 - DNA, 20 bp, Artificial Sequence
  chemically synthesized
accaaatggaataagagaag

SEQ ID NO: 1136 - DNA, 20 bp, Artificial Sequence
  chemically synthesized
gaataagagaaggagaaaaa

SEQ ID NO: 1137 - DNA, 20 bp, Artificial Sequence
  chemically synthesized
aataagagaaggagaaaaac

SEQ ID NO: 1138 - DNA, 20 bp, Artificial Sequence
  chemically synthesized
aaggagaaaaacaggtatta

SEQ ID NO: 1139 - DNA, 20 bp, Artificial Sequence
  chemically synthesized
aggagaaaaacaggtattaa

SEQ ID NO: 1140 - DNA, 20 bp, Artificial Sequence
  chemically synthesized
aaaacaggtattaaaggact

SEQ ID NO: 1141 - DNA, 20 bp, Artificial Sequence
  chemically synthesized
acaggtattaaaggactaag

SEQ ID NO: 1142 - DNA, 20 bp, Artificial Sequence
  chemically synthesized
ggtattaaaggactaagaag

SEQ ID NO: 1143 - DNA, 20 bp, Artificial Sequence
  chemically synthesized
gtattaaaggactaagaagt

SEQ ID NO: 1144 - DNA, 20 bp, Artificial Sequence
  chemically synthesized
attaaaggactaagaagtgg

SEQ ID NO: 1145 - DNA, 20 bp, Artificial Sequence
  chemically synthesized
ttaaaggactaagaagtggg

SEQ ID NO: 1146 - DNA, 20 bp, Artificial Sequence
  chemically synthesized
gactaagaagtgggaggacc

SEQ ID NO: 1147 - DNA, 20 bp, Artificial Sequence
  chemically synthesized
actaagaagtgggaggacct

SEQ ID NO: 1148 - DNA, 20 bp, Artificial Sequence
  chemically synthesized
ggacctaggacatctgatta

SEQ ID NO: 1149 - DNA, 20 bp, Artificial Sequence
  chemically synthesized
acctaggacatctgattaaa

SEQ ID NO: 1150 - DNA, 20 bp, Artificial Sequence
  chemically synthesized
catctgattaaagagtgcct

SEQ ID NO: 1151 - DNA, 20 bp, Artificial Sequence
  chemically synthesized
atctgattaaagagtgccta

SEQ ID NO: 1152 - DNA, 20 bp, Artificial Sequence
  chemically synthesized
ctgattaaagagtgcctaag

SEQ ID NO: 1153 - DNA, 20 bp, Artificial Sequence
  chemically synthesized
gtgcctaaggagattcaaca

SEQ ID NO: 1154 - DNA, 20 bp, Artificial Sequence
  chemically synthesized
gagattcaacatagtcctgc

SEQ ID NO: 1155 - DNA, 20 bp, Artificial Sequence
  chemically synthesized
tcaacatagtcctgccagca

SEQ ID NO: 1156 - DNA, 20 bp, Artificial Sequence
  chemically synthesized
aaagattatttatttacttc

SEQ ID NO: 1157 - DNA, 20 bp, Artificial Sequence
  chemically synthesized
agattatttatttacttcaa

SEQ ID NO: 1158 - DNA, 20 bp, Artificial Sequence
  chemically synthesized
atttatttacttcaagagtt

SEQ ID NO: 1159 - DNA, 20 bp, Artificial Sequence
  chemically synthesized
ttatttacttcaagagttaa

SEQ ID NO: 1160 - DNA, 20 bp, Artificial Sequence
  chemically synthesized
tttacttcaagagttaagag

SEQ ID NO: 1161 - DNA, 20 bp, Artificial Sequence
  chemically synthesized
acttcaagagttaagagtgg

SEQ ID NO: 1162 - DNA, 20 bp, Artificial Sequence
  chemically synthesized
aagagttaagagtggcagtt

SEQ ID NO: 1163 - DNA, 20 bp, Artificial Sequence
  chemically synthesized
agagttaagagtggcagttt

SEQ ID NO: 1164 - DNA, 20 bp, Artificial Sequence
  chemically synthesized
gagttaagagtggcagtttg

SEQ ID NO: 1165 - DNA, 20 bp, Artificial Sequence
  chemically synthesized
taagagtggcagtttgggga

SEQ ID NO: 1166 - DNA, 20 bp, Artificial Sequence
  chemically synthesized
tggcagtttggggatagcac

SEQ ID NO: 1167 - DNA, 20 bp, Artificial Sequence
  chemically synthesized
ggcagtttggggatagcacc

SEQ ID NO: 1168 - DNA, 20 bp, Artificial Sequence
  chemically synthesized
cagtttggggatagcaccag

SEQ ID NO: 1169 - DNA, 20 bp, Artificial Sequence
  chemically synthesized
gggatagcaccaggagatat

SEQ ID NO: 1170 - DNA, 20 bp, Artificial Sequence
  chemically synthesized
ccaggagatatcagctgtga

SEQ ID NO: 1171 - DNA, 20 bp, Artificial Sequence
  chemically synthesized
agatatcagctgtgatggct

SEQ ID NO: 1172 - DNA, 20 bp, Artificial Sequence
  chemically synthesized
gctgtgatggcttggaaaaa

SEQ ID NO: 1173 - DNA, 20 bp, Artificial Sequence
  chemically synthesized
cttggaaaaacagtgtaaac

SEQ ID NO: 1174 - DNA, 20 bp, Artificial Sequence
  chemically synthesized
ggaaaaacagtgtaaaccgg

SEQ ID NO: 1175 - DNA, 20 bp, Artificial Sequence
  chemically synthesized
tgtaaaccggcagtgtaaac

SEQ ID NO: 1176 - DNA, 20 bp, Artificial Sequence
  chemically synthesized
taaaccggcagtgtaaacaa

SEQ ID NO: 1177 - DNA, 20 bp, Artificial Sequence
  chemically synthesized
accggcagtgtaaacaagag

SEQ ID NO: 1178 - DNA, 20 bp, Artificial Sequence
  chemically synthesized
ccggcagtgtaaacaagagc

SEQ ID NO: 1179 - DNA, 20 bp, Artificial Sequence
  chemically synthesized
cggcagtgtaaacaagagca

SEQ ID NO: 1180 - DNA, 20 bp, Artificial Sequence
  chemically synthesized
aacaagagcagggcatgtat

SEQ ID NO: 1181 - DNA, 20 bp, Artificial Sequence
  chemically synthesized
aagagcagggcatgtatgag

SEQ ID NO: 1182 - DNA, 20 bp, Artificial Sequence
  chemically synthesized
cagggcatgtatgagtagtt

SEQ ID NO: 1183 - DNA, 20 bp, Artificial Sequence
  chemically synthesized
catgtatgagtagttgagaa

SEQ ID NO: 1184 - DNA, 20 bp, Artificial Sequence
  chemically synthesized
gagtagttgagaatggtgaa

SEQ ID NO: 1185 - DNA, 20 bp, Artificial Sequence
  chemically synthesized
agtagttgagaatggtgaat

SEQ ID NO: 1186 - DNA, 20 bp, Artificial Sequence
  chemically synthesized
tagttgagaatggtgaatag

SEQ ID NO: 1187 - DNA, 20 bp, Artificial Sequence
  chemically synthesized
atggtgaataggagtatgac

SEQ ID NO: 1188 - DNA, 20 bp, Artificial Sequence
  chemically synthesized
tgaataggagtatgactaga

SEQ ID NO: 1189 - DNA, 20 bp, Artificial Sequence
  chemically synthesized
ataggagtatgactagacag

SEQ ID NO: 1190 - DNA, 20 bp, Artificial Sequence
  chemically synthesized
gagtatgactagacagaaga

SEQ ID NO: 1191 - DNA, 20 bp, Artificial Sequence
  chemically synthesized
tatgactagacagaagatag

SEQ ID NO: 1192 - DNA, 20 bp, Artificial Sequence
  chemically synthesized
atgactagacagaagatagc

SEQ ID NO: 1193 - DNA, 20 bp, Artificial Sequence
  chemically synthesized
tgactagacagaagatagca

SEQ ID NO: 1194 - DNA, 20 bp, Artificial Sequence
  chemically synthesized
cagaagatagcagggatgac

SEQ ID NO: 1195 - DNA, 20 bp, Artificial Sequence
  chemically synthesized
gcagggatgacaagtttttt

SEQ ID NO: 1196 - DNA, 20 bp, Artificial Sequence
  chemically synthesized
cagggatgacaagttttttt

SEQ ID NO: 1197 - DNA, 20 bp, Artificial Sequence
  chemically synthesized
agggatgacaagtttttttg

SEQ ID NO: 1198 - DNA, 20 bp, Artificial Sequence
  chemically synthesized
gtttttttggggcacattct

SEQ ID NO: 1199 - DNA, 20 bp, Artificial Sequence
  chemically synthesized
ttttggggcacattctaagt

SEQ ID NO: 1200 - DNA, 20 bp, Artificial Sequence
  chemically synthesized
gggcacattctaagttggtc

SEQ ID NO: 1201 - DNA, 20 bp, Artificial Sequence
  chemically synthesized
ttctaagttggtctggtgtc

SEQ ID NO: 1202 - DNA, 20 bp, Artificial Sequence
  chemically synthesized
gttggtctggtgtctggaat

SEQ ID NO: 1203 - DNA, 20 bp, Artificial Sequence
  chemically synthesized
tctggtgtctggaattagac

SEQ ID NO: 1204 - DNA, 20 bp, Artificial Sequence
  chemically synthesized
ctggtgtctggaattagact

SEQ ID NO: 1205 - DNA, 20 bp, Artificial Sequence
  chemically synthesized
tggtgtctggaattagactg

SEQ ID NO: 1206 - DNA, 20 bp, Artificial Sequence
  chemically synthesized
ttagactggggcctaataaa

SEQ ID NO: 1207 - DNA, 20 bp, Artificial Sequence
  chemically synthesized
tagactggggcctaataaaa

SEQ ID NO: 1208 - DNA, 20 bp, Artificial Sequence
  chemically synthesized
aataaaaaggcaaatctata

SEQ ID NO: 1209 - DNA, 20 bp, Artificial Sequence
  chemically synthesized
ataaaaaggcaaatctatac

SEQ ID NO: 1210 - DNA, 20 bp, Artificial Sequence
  chemically synthesized
aaaaaggcaaatctatacag

SEQ ID NO: 1211 - DNA, 20 bp, Artificial Sequence
  chemically synthesized
aatctatacaggagctcaaa

SEQ ID NO: 1212 - DNA, 20 bp, Artificial Sequence
  chemically synthesized
atctatacaggagctcaaat

SEQ ID NO: 1213 - DNA, 20 bp, Artificial Sequence
  chemically synthesized
ctcaaatgggctgtaccctg

SEQ ID NO: 1214 - DNA, 20 bp, Artificial Sequence
  chemically synthesized
gctgtaccctgtagcattct

SEQ ID NO: 1215 - DNA, 20 bp, Artificial Sequence
  chemically synthesized
ctgtaccctgtagcattctg

SEQ ID NO: 1216 - DNA, 20 bp, Artificial Sequence
  chemically synthesized
accctgtagcattctgagga

SEQ ID NO: 1217 - DNA, 20 bp, Artificial Sequence
  chemically synthesized
ccctgtagcattctgaggac

SEQ ID NO: 1218 - DNA, 20 bp, Artificial Sequence
  chemically synthesized
tgaggacaggtctgacttct

SEQ ID NO: 1219 - DNA, 20 bp, Artificial Sequence
  chemically synthesized
gacaggtctgacttctgaga

SEQ ID NO: 1220 - DNA, 20 bp, Artificial Sequence
  chemically synthesized
gtctgacttctgagaaagaa

SEQ ID NO: 1221 - DNA, 20 bp, Artificial Sequence
  chemically synthesized
tgacttctgagaaagaaaag

SEQ ID NO: 1222 - DNA, 20 bp, Artificial Sequence
  chemically synthesized
ctgagaaagaaaagtggtaa

SEQ ID NO: 1223 - DNA, 20 bp, Artificial Sequence
  chemically synthesized
aaagtggtaaaagtattgtc

SEQ ID NO: 1224 - DNA, 20 bp, Artificial Sequence
  chemically synthesized
agtattgtccagtccttttt

SEQ ID NO: 1225 - DNA, 20 bp, Artificial Sequence
  chemically synthesized
ttgtccagtcctttttaagt

SEQ ID NO: 1226 - DNA, 20 bp, Artificial Sequence
  chemically synthesized
tccagtcctttttaagttgg

SEQ ID NO: 1227 - DNA, 20 bp, Artificial Sequence
  chemically synthesized
tcctttttaagttggtggct

SEQ ID NO: 1228 - DNA, 20 bp, Artificial Sequence
  chemically synthesized
tttaagttggtggctgagct

SEQ ID NO: 1229 - DNA, 20 bp, Artificial Sequence
  chemically synthesized
agttggtggctgagcttggt

SEQ ID NO: 1230 - DNA, 20 bp, Artificial Sequence
  chemically synthesized
gttggtggctgagcttggtg

SEQ ID NO: 1231 - DNA, 20 bp, Artificial Sequence
  chemically synthesized
ttggtgaggtgtgtttttaa

SEQ ID NO: 1232 - DNA, 20 bp, Artificial Sequence
  chemically synthesized
gtgtgtttttaaaagacatt

SEQ ID NO: 1233 - DNA, 20 bp, Artificial Sequence
  chemically synthesized
agtccgttctacttttcctg

SEQ ID NO: 1234 - DNA, 20 bp, Artificial Sequence
  chemically synthesized
cgttctacttttcctgaaga

SEQ ID NO: 1235 - DNA, 20 bp, Artificial Sequence
  chemically synthesized
ttctacttttcctgaagacg

SEQ ID NO: 1236 - DNA, 20 bp, Artificial Sequence
  chemically synthesized
tctacttttcctgaagacgg

SEQ ID NO: 1237 - DNA, 20 bp, Artificial Sequence
  chemically synthesized
tcctgaagacggaggaccgt

SEQ ID NO: 1238 - DNA, 20 bp, Artificial Sequence
  chemically synthesized
cctgaagacggaggaccgta

SEQ ID NO: 1239 - DNA, 20 bp, Artificial Sequence
  chemically synthesized
ctgaagacggaggaccgtaa

SEQ ID NO: 1240 - DNA, 20 bp, Artificial Sequence
  chemically synthesized
ggaggaccgtaagggatata

SEQ ID NO: 1241 - DNA, 20 bp, Artificial Sequence
  chemically synthesized
gaggaccgtaagggatataa

SEQ ID NO: 1242 - DNA, 20 bp, Artificial Sequence
  chemically synthesized
taaaggttttactgaatact

SEQ ID NO: 1243 - DNA, 20 bp, Artificial Sequence
  chemically synthesized
aaggttttactgaatactaa

SEQ ID NO: 1244 - DNA, 20 bp, Artificial Sequence
  chemically synthesized
taagagcctgaaaaactgct

SEQ ID NO: 1245 - DNA, 20 bp, Artificial Sequence
  chemically synthesized
cttggctgatttgactaata

SEQ ID NO: 1246 - DNA, 20 bp, Artificial Sequence
  chemically synthesized
ttggctgatttgactaataa

SEQ ID NO: 1247 - DNA, 20 bp, Artificial Sequence
  chemically synthesized
ctgatttgactaataaaggc

SEQ ID NO: 1248 - DNA, 20 bp, Artificial Sequence
  chemically synthesized
aataaaggctggtctgttat

SEQ ID NO: 1249 - DNA, 20 bp, Artificial Sequence
  chemically synthesized
tggtctgttatcagactgta

SEQ ID NO: 1250 - DNA, 20 bp, Artificial Sequence
  chemically synthesized
gtctgttatcagactgtata

SEQ ID NO: 1251 - DNA, 20 bp, Artificial Sequence
  chemically synthesized
tctgttatcagactgtatag

SEQ ID NO: 1252 - DNA, 20 bp, Artificial Sequence
  chemically synthesized
gttatcagactgtatagagg

SEQ ID NO: 1253 - DNA, 20 bp, Artificial Sequence
  chemically synthesized
ttatcagactgtatagaggt

SEQ ID NO: 1254 - DNA, 20 bp, Artificial Sequence
  chemically synthesized
tcagactgtatagaggtagg

SEQ ID NO: 1255 - DNA, 20 bp, Artificial Sequence
  chemically synthesized
cagactgtatagaggtagga

SEQ ID NO: 1256 - DNA, 20 bp, Artificial Sequence
  chemically synthesized
agaggtaggaaggctaaact

SEQ ID NO: 1257 - DNA, 20 bp, Artificial Sequence
  chemically synthesized
gaggtaggaaggctaaactg

SEQ ID NO: 1258 - DNA, 20 bp, Artificial Sequence
  chemically synthesized
aactgaggaattatgtctga

SEQ ID NO: 1259 - DNA, 20 bp, Artificial Sequence
  chemically synthesized
tgaggaattatgtctgacag

SEQ ID NO: 1260 - DNA, 20 bp, Artificial Sequence
  chemically synthesized
gaggaattatgtctgacaga

SEQ ID NO: 1261 - DNA, 20 bp, Artificial Sequence
  chemically synthesized
aggaattatgtctgacagaa

SEQ ID NO: 1262 - DNA, 20 bp, Artificial Sequence
  chemically synthesized
aattatgtctgacagaaggg

SEQ ID NO: 1263 - DNA, 20 bp, Artificial Sequence
  chemically synthesized
cagaagggaagaaatgactg

SEQ ID NO: 1264 - DNA, 20 bp, Artificial Sequence
  chemically synthesized
aagggaagaaatgactgcgg

SEQ ID NO: 1265 - DNA, 20 bp, Artificial Sequence
  chemically synthesized
aatgactgcggtggccttct

SEQ ID NO: 1266 - DNA, 20 bp, Artificial Sequence
  chemically synthesized
ggtggccttctcagaccctg

SEQ ID NO: 1267 - DNA, 20 bp, Artificial Sequence
  chemically synthesized
gtggccttctcagaccctgt

SEQ ID NO: 1268 - DNA, 20 bp, Artificial Sequence
  chemically synthesized
ccttctcagaccctgtagga

SEQ ID NO: 1269 - DNA, 20 bp, Artificial Sequence
  chemically synthesized
aggaaagacctctacttatc

SEQ ID NO: 1270 - DNA, 20 bp, Artificial Sequence
  chemically synthesized
gacctctacttatccagtga

SEQ ID NO: 1271 - DNA, 20 bp, Artificial Sequence
  chemically synthesized
atccagtgaaagtgtctacc

SEQ ID NO: 1272 - DNA, 20 bp, Artificial Sequence
  chemically synthesized
tgaaagtgtctacctagact

SEQ ID NO: 1273 - DNA, 20 bp, Artificial Sequence
  chemically synthesized
aaagtgtctacctagactaa

SEQ ID NO: 1274 - DNA, 20 bp, Artificial Sequence
  chemically synthesized
aagtgtctacctagactaag

SEQ ID NO: 1275 - DNA, 20 bp, Artificial Sequence
  chemically synthesized
acctagactaagaggtattt

SEQ ID NO: 1276 - DNA, 20 bp, Artificial Sequence
  chemically synthesized
ggtattttagttatctgact

SEQ ID NO: 1277 - DNA, 20 bp, Artificial Sequence
  chemically synthesized
gtattttagttatctgactc

SEQ ID NO: 1278 - DNA, 20 bp, Artificial Sequence
  chemically synthesized
tattttagttatctgactca

SEQ ID NO: 1279 - DNA, 20 bp, Artificial Sequence
  chemically synthesized
tatctgactcagggcatgtt

SEQ ID NO: 1280 - DNA, 20 bp, Artificial Sequence
  chemically synthesized
gttgagtaaatctaatttgc

SEQ ID NO: 1281 - DNA, 20 bp, Artificial Sequence
  chemically synthesized
taaatctaatttgccagtcc

SEQ ID NO: 1282 - DNA, 20 bp, Artificial Sequence
  chemically synthesized
aaatctaatttgccagtcct

SEQ ID NO: 1283 - DNA, 20 bp, Artificial Sequence
  chemically synthesized
tctaatttgccagtcctggg

SEQ ID NO: 1284 - DNA, 20 bp, Artificial Sequence
  chemically synthesized
ctaatttgccagtcctgggt

SEQ ID NO: 1285 - DNA, 20 bp, Artificial Sequence
  chemically synthesized
taatttgccagtcctgggtg

SEQ ID NO: 1286 - DNA, 20 bp, Artificial Sequence
  chemically synthesized
aatttgccagtcctgggtgg

SEQ ID NO: 1287 - DNA, 20 bp, Artificial Sequence
  chemically synthesized
ctgggtgggggcaaatcctc

SEQ ID NO: 1288 - DNA, 20 bp, Artificial Sequence
  chemically synthesized
aaatcctcgagcttgatgtg

SEQ ID NO: 1289 - DNA, 20 bp, Artificial Sequence
  chemically synthesized
aatcctcgagcttgatgtgt

SEQ ID NO: 1290 - DNA, 20 bp, Artificial Sequence
  chemically synthesized
atcctcgagcttgatgtgta

SEQ ID NO: 1291 - DNA, 20 bp, Artificial Sequence
  chemically synthesized
ctcgagcttgatgtgtaggg

SEQ ID NO: 1292 - DNA, 20 bp, Artificial Sequence
  chemically synthesized
tcgagcttgatgtgtaggga

SEQ ID NO: 1293 - DNA, 20 bp, Artificial Sequence
  chemically synthesized
cgagcttgatgtgtagggaa

SEQ ID NO: 1294 - DNA, 20 bp, Artificial Sequence
  chemically synthesized
agcttgatgtgtagggaagg

SEQ ID NO: 1295 - DNA, 20 bp, Artificial Sequence
  chemically synthesized
gcttgatgtgtagggaaggg

SEQ ID NO: 1296 - DNA, 20 bp, Artificial Sequence
  chemically synthesized
cttgatgtgtagggaaggga

SEQ ID NO: 1297 - DNA, 20 bp, Artificial Sequence
  chemically synthesized
ttgatgtgtagggaagggag

SEQ ID NO: 1298 - DNA, 20 bp, Artificial Sequence
  chemically synthesized
tgatgtgtagggaagggagg

SEQ ID NO: 1299 - DNA, 20 bp, Artificial Sequence
  chemically synthesized
agggggcctgaataatccct

SEQ ID NO: 1300 - DNA, 20 bp, Artificial Sequence
  chemically synthesized
gggggcctgaataatccctg

SEQ ID NO: 1301 - DNA, 20 bp, Artificial Sequence
  chemically synthesized
gggcctgaataatccctgag

SEQ ID NO: 1302 - DNA, 20 bp, Artificial Sequence
  chemically synthesized
cctgaataatccctgaggag

SEQ ID NO: 1303 - DNA, 20 bp, Artificial Sequence
  chemically synthesized
gaataatccctgaggagtag

SEQ ID NO: 1304 - DNA, 20 bp, Artificial Sequence
  chemically synthesized
atccctgaggagtagcagaa

SEQ ID NO: 1305 - DNA, 20 bp, Artificial Sequence
  chemically synthesized
cctgaggagtagcagaatag

SEQ ID NO: 1306 - DNA, 20 bp, Artificial Sequence
  chemically synthesized
aggagtagcagaatagcaga

SEQ ID NO: 1307 - DNA, 20 bp, Artificial Sequence
  chemically synthesized
agaatagcagatggaacact

SEQ ID NO: 1308 - DNA, 20 bp, Artificial Sequence
  chemically synthesized
atagcagatggaacactgag

SEQ ID NO: 1309 - DNA, 20 bp, Artificial Sequence
  chemically synthesized
cactgagaagttatttcttt

SEQ ID NO: 1310 - DNA, 20 bp, Artificial Sequence
  chemically synthesized
actgagaagttatttctttg

SEQ ID NO: 1311 - DNA, 20 bp, Artificial Sequence
  chemically synthesized
agaagttatttctttgagga

SEQ ID NO: 1312 - DNA, 20 bp, Artificial Sequence
  chemically synthesized
ttgaggatagatttctacga

SEQ ID NO: 1313 - DNA, 20 bp, Artificial Sequence
  chemically synthesized
ggatagatttctacgatgga

SEQ ID NO: 1314 - DNA, 20 bp, Artificial Sequence
  chemically synthesized
gatagatttctacgatggaa

SEQ ID NO: 1315 - DNA, 20 bp, Artificial Sequence
  chemically synthesized
ttctacgatggaaaggaaat

SEQ ID NO: 1316 - DNA, 20 bp, Artificial Sequence
  chemically synthesized
ctacgatggaaaggaaatga

SEQ ID NO: 1317 - DNA, 20 bp, Artificial Sequence
  chemically synthesized
tacgatggaaaggaaatgag

SEQ ID NO: 1318 - DNA, 20 bp, Artificial Sequence
  chemically synthesized
gaaaggaaatgagaggttcg

SEQ ID NO: 1319 - DNA, 20 bp, Artificial Sequence
  chemically synthesized
aaggaaatgagaggttcgaa

SEQ ID NO: 1320 - DNA, 20 bp, Artificial Sequence
  chemically synthesized
aggaaatgagaggttcgaag

SEQ ID NO: 1321 - DNA, 20 bp, Artificial Sequence
  chemically synthesized
aaatgagaggttcgaagagg

SEQ ID NO: 1322 - DNA, 20 bp, Artificial Sequence
  chemically synthesized
aatgagaggttcgaagaggc

SEQ ID NO: 1323 - DNA, 20 bp, Artificial Sequence
  chemically synthesized
agaggttcgaagaggcaggc

SEQ ID NO: 1324 - DNA, 20 bp, Artificial Sequence
  chemically synthesized
ggttcgaagaggcaggctag

SEQ ID NO: 1325 - DNA, 20 bp, Artificial Sequence
  chemically synthesized
caggctagtggtttgtacta

SEQ ID NO: 1326 - DNA, 20 bp, Artificial Sequence
  chemically synthesized
tagtggtttgtactatagca

SEQ ID NO: 1327 - DNA, 20 bp, Artificial Sequence
  chemically synthesized
atagcatagcctgcctttgc

SEQ ID NO: 1328 - DNA, 20 bp, Artificial Sequence
  chemically synthesized
agcctgcctttgctggtgtg

SEQ ID NO: 1329 - DNA, 20 bp, Artificial Sequence
  chemically synthesized
ctttgctggtgtgtggctat

SEQ ID NO: 1330 - DNA, 20 bp, Artificial Sequence
  chemically synthesized
tttgctggtgtgtggctatt

SEQ ID NO: 1331 - DNA, 20 bp, Artificial Sequence
  chemically synthesized
tggtgtgtggctattaggcc

SEQ ID NO: 1332 - DNA, 20 bp, Artificial Sequence
  chemically synthesized
tgtgtggctattaggcctgg

SEQ ID NO: 1333 - DNA, 20 bp, Artificial Sequence
  chemically synthesized
ggctattaggcctggtggaa

SEQ ID NO: 1334 - DNA, 20 bp, Artificial Sequence
  chemically synthesized
ggaacggccatcaataaatc

SEQ ID NO: 1335 - DNA, 20 bp, Artificial Sequence
  chemically synthesized
atcaataaatcaagtgtgat

SEQ ID NO: 1336 - DNA, 20 bp, Artificial Sequence
  chemically synthesized
tcaataaatcaagtgtgatc

SEQ ID NO: 1337 - DNA, 20 bp, Artificial Sequence
  chemically synthesized
caataaatcaagtgtgatca

SEQ ID NO: 1338 - DNA, 20 bp, Artificial Sequence
  chemically synthesized
aaatcaagtgtgatcagggt

SEQ ID NO: 1339 - DNA, 20 bp, Artificial Sequence
  chemically synthesized
aatcaagtgtgatcagggtg

SEQ ID NO: 1340 - DNA, 20 bp, Artificial Sequence
  chemically synthesized
agtgtgatcagggtgaggaa

SEQ ID NO: 1341 - DNA, 20 bp, Artificial Sequence
  chemically synthesized
gtgtgatcagggtgaggaac

SEQ ID NO: 1342 - DNA, 20 bp, Artificial Sequence
  chemically synthesized
gatcagggtgaggaacagga

SEQ ID NO: 1343 - DNA, 20 bp, Artificial Sequence
  chemically synthesized
cagggtgaggaacaggaaag

SEQ ID NO: 1344 - DNA, 20 bp, Artificial Sequence
  chemically synthesized
agggtgaggaacaggaaaga

SEQ ID NO: 1345 - DNA, 20 bp, Artificial Sequence
  chemically synthesized
tgaggaacaggaaagaagga

SEQ ID NO: 1346 - DNA, 20 bp, Artificial Sequence
  chemically synthesized
ggaacaggaaagaaggaaag

SEQ ID NO: 1347 - DNA, 20 bp, Artificial Sequence
  chemically synthesized
gaacaggaaagaaggaaaga

SEQ ID NO: 1348 - DNA, 20 bp, Artificial Sequence
  chemically synthesized
aagaaggaaagaaggaaata

SEQ ID NO: 1349 - DNA, 20 bp, Artificial Sequence
  chemically synthesized
agaaggaaagaaggaaatat

SEQ ID NO: 1350 - DNA, 20 bp, Artificial Sequence
  chemically synthesized
gaaggaaagaaggaaatatg

SEQ ID NO: 1351 - DNA, 20 bp, Artificial Sequence
  chemically synthesized
aagaaggaaatatggggaaa

SEQ ID NO: 1352 - DNA, 20 bp, Artificial Sequence
  chemically synthesized
agaaggaaatatggggaaat

SEQ ID NO: 1353 - DNA, 20 bp, Artificial Sequence
  chemically synthesized
gaaggaaatatggggaaatg

SEQ ID NO: 1354 - DNA, 20 bp, Artificial Sequence
  chemically synthesized
tggggaaatggggtgaatgt

SEQ ID NO: 1355 - DNA, 20 bp, Artificial Sequence
  chemically synthesized
ggggaaatggggtgaatgtc

SEQ ID NO: 1356 - DNA, 20 bp, Artificial Sequence
  chemically synthesized
gaaatggggtgaatgtcagg

SEQ ID NO: 1357 - DNA, 20 bp, Artificial Sequence
  chemically synthesized
ggggtgaatgtcaggtggat

SEQ ID NO: 1358 - DNA, 20 bp, Artificial Sequence
  chemically synthesized
ggtgaatgtcaggtggatca

SEQ ID NO: 1359 - DNA, 20 bp, Artificial Sequence
  chemically synthesized
tgaatgtcaggtggatcaga

SEQ ID NO: 1360 - DNA, 20 bp, Artificial Sequence
  chemically synthesized
ggatcagagagatacaatca

SEQ ID NO: 1361 - DNA, 20 bp, Artificial Sequence
  chemically synthesized
gatcagagagatacaatcat

SEQ ID NO: 1362 - DNA, 20 bp, Artificial Sequence
  chemically synthesized
atcagagagatacaatcatg

SEQ ID NO: 1363 - DNA, 20 bp, Artificial Sequence
  chemically synthesized
tcagagagatacaatcatgg

SEQ ID NO: 1364 - DNA, 20 bp, Artificial Sequence
  chemically synthesized
agagatacaatcatgggggt

SEQ ID NO: 1365 - DNA, 20 bp, Artificial Sequence
  chemically synthesized
gagatacaatcatgggggtc

SEQ ID NO: 1366 - DNA, 20 bp, Artificial Sequence
  chemically synthesized
acaatcatgggggtcaggtg

SEQ ID NO: 1367 - DNA, 20 bp, Artificial Sequence
  chemically synthesized
atgggggtcaggtgtggtat

SEQ ID NO: 1368 - DNA, 20 bp, Artificial Sequence
  chemically synthesized
tgggggtcaggtgtggtatc

SEQ ID NO: 1369 - DNA, 20 bp, Artificial Sequence
  chemically synthesized
gtgtggtatcaggaataatg

SEQ ID NO: 1370 - DNA, 20 bp, Artificial Sequence
  chemically synthesized
tgtggtatcaggaataatgt

SEQ ID NO: 1371 - DNA, 20 bp, Artificial Sequence
  chemically synthesized
tggtatcaggaataatgtgg

SEQ ID NO: 1372 - DNA, 20 bp, Artificial Sequence
  chemically synthesized
ggtatcaggaataatgtggg

SEQ ID NO: 1373 - DNA, 20 bp, Artificial Sequence
  chemically synthesized
tcaggaataatgtgggaggc

SEQ ID NO: 1374 - DNA, 20 bp, Artificial Sequence
  chemically synthesized
taatgtgggaggccggattg

SEQ ID NO: 1375 - DNA, 20 bp, Artificial Sequence
  chemically synthesized
tgggaggccggattgaagtc

SEQ ID NO: 1376 - DNA, 20 bp, Artificial Sequence
  chemically synthesized
gggaggccggattgaagtcc

SEQ ID NO: 1377 - DNA, 20 bp, Artificial Sequence
  chemically synthesized
ggccggattgaagtccgggc

SEQ ID NO: 1378 - DNA, 20 bp, Artificial Sequence
  chemically synthesized
gccggattgaagtccgggcc

SEQ ID NO: 1379 - DNA, 20 bp, Artificial Sequence
  chemically synthesized
gaagtccgggccaggaccaa

SEQ ID NO: 1380 - DNA, 20 bp, Artificial Sequence
  chemically synthesized
gccaggaccaatggtaattg

SEQ ID NO: 1381 - DNA, 20 bp, Artificial Sequence
  chemically synthesized
ccaggaccaatggtaattgt

SEQ ID NO: 1382 - DNA, 20 bp, Artificial Sequence
  chemically synthesized
ggtaattgtgggacttaaca

SEQ ID NO: 1383 - DNA, 20 bp, Artificial Sequence
  chemically synthesized
taattgtgggacttaacaaa

SEQ ID NO: 1384 - DNA, 20 bp, Artificial Sequence
  chemically synthesized
tgtgggacttaacaaagagt

SEQ ID NO: 1385 - DNA, 20 bp, Artificial Sequence
  chemically synthesized
gacttaacaaagagtgagta

SEQ ID NO: 1386 - DNA, 20 bp, Artificial Sequence
  chemically synthesized
acaaagagtgagtacagctg

SEQ ID NO: 1387 - DNA, 20 bp, Artificial Sequence
  chemically synthesized
caaagagtgagtacagctga

SEQ ID NO: 1388 - DNA, 20 bp, Artificial Sequence
  chemically synthesized
aagagtgagtacagctgaag

SEQ ID NO: 1389 - DNA, 20 bp, Artificial Sequence
  chemically synthesized
gtgagtacagctgaaggagc

SEQ ID NO: 1390 - DNA, 20 bp, Artificial Sequence
  chemically synthesized
tgagtacagctgaaggagcc

SEQ ID NO: 1391 - DNA, 20 bp, Artificial Sequence
  chemically synthesized
gagtacagctgaaggagccg

SEQ ID NO: 1392 - DNA, 20 bp, Artificial Sequence
  chemically synthesized
cagctgaaggagccggggat

SEQ ID NO: 1393 - DNA, 20 bp, Artificial Sequence
  chemically synthesized
tgaaggagccggggatcaga

SEQ ID NO: 1394 - DNA, 20 bp, Artificial Sequence
  chemically synthesized
ggatcagaaagtatatgcat

SEQ ID NO: 1395 - DNA, 20 bp, Artificial Sequence
  chemically synthesized
gatcagaaagtatatgcatc

SEQ ID NO: 1396 - DNA, 20 bp, Artificial Sequence
  chemically synthesized
aaagtatatgcatcaggtat

SEQ ID NO: 1397 - DNA, 20 bp, Artificial Sequence
  chemically synthesized
aagtatatgcatcaggtatg

SEQ ID NO: 1398 - DNA, 20 bp, Artificial Sequence
  chemically synthesized
tatatgcatcaggtatgagg

SEQ ID NO: 1399 - DNA, 20 bp, Artificial Sequence
  chemically synthesized
atcaggtatgaggaagaaaa

SEQ ID NO: 1400 - DNA, 20 bp, Artificial Sequence
  chemically synthesized
atgaggaagaaaatagattt

SEQ ID NO: 1401 - DNA, 20 bp, Artificial Sequence
  chemically synthesized
aggaagaaaatagattttag

SEQ ID NO: 1402 - DNA, 20 bp, Artificial Sequence
  chemically synthesized
aaatagattttagaagttat

SEQ ID NO: 1403 - DNA, 20 bp, Artificial Sequence
  chemically synthesized
tagaagttatgagaaatgtg

SEQ ID NO: 1404 - DNA, 20 bp, Artificial Sequence
  chemically synthesized
gaagttatgagaaatgtgaa

SEQ ID NO: 1405 - DNA, 20 bp, Artificial Sequence
  chemically synthesized
ttatgagaaatgtgaagagt

SEQ ID NO: 1406 - DNA, 20 bp, Artificial Sequence
  chemically synthesized
agaaatgtgaagagtgagct

SEQ ID NO: 1407 - DNA, 20 bp, Artificial Sequence
  chemically synthesized
tgtgaagagtgagctaagca

SEQ ID NO: 1408 - DNA, 20 bp, Artificial Sequence
  chemically synthesized
taagcatagtttgtgatttt

SEQ ID NO: 1409 - DNA, 20 bp, Artificial Sequence
  chemically synthesized
aagcatagtttgtgattttt

SEQ ID NO: 1410 - DNA, 20 bp, Artificial Sequence
  chemically synthesized
agcatagtttgtgattttta

SEQ ID NO: 1411 - DNA, 20 bp, Artificial Sequence
  chemically synthesized
gtgatttttagggcctctaa

SEQ ID NO: 1412 - DNA, 20 bp, Artificial Sequence
  chemically synthesized
tagggcctctaaaagtatta

SEQ ID NO: 1413 - DNA, 20 bp, Artificial Sequence
  chemically synthesized
ggcctctaaaagtattaaag

SEQ ID NO: 1414 - DNA, 20 bp, Artificial Sequence
  chemically synthesized
ctctaaaagtattaaagcag

SEQ ID NO: 1415 - DNA, 20 bp, Artificial Sequence
  chemically synthesized
taaaagtattaaagcagcgg

SEQ ID NO: 1416 - DNA, 20 bp, Artificial Sequence
  chemically synthesized
gcagcggcagccactgcatg

SEQ ID NO: 1417 - DNA, 20 bp, Artificial Sequence
  chemically synthesized
cagccactgcatgcagacct

SEQ ID NO: 1418 - DNA, 20 bp, Artificial Sequence
  chemically synthesized
agccactgcatgcagacctg

SEQ ID NO: 1419 - DNA, 20 bp, Artificial Sequence
  chemically synthesized
gccactgcatgcagacctga

SEQ ID NO: 1420 - DNA, 20 bp, Artificial Sequence
  chemically synthesized
ctgcatgcagacctgagggc

SEQ ID NO: 1421 - DNA, 20 bp, Artificial Sequence
  chemically synthesized
tgcatgcagacctgagggct

SEQ ID NO: 1422 - DNA, 20 bp, Artificial Sequence
  chemically synthesized
acctgagggctaggctaaaa

SEQ ID NO: 1423 - DNA, 20 bp, Artificial Sequence
  chemically synthesized
gagggctaggctaaaacagt

SEQ ID NO: 1424 - DNA, 20 bp, Artificial Sequence
  chemically synthesized
agggctaggctaaaacagta

SEQ ID NO: 1425 - DNA, 20 bp, Artificial Sequence
  chemically synthesized
taggctaaaacagtaaggtc

SEQ ID NO: 1426 - DNA, 20 bp, Artificial Sequence
  chemically synthesized
aacagtaaggtcaagttatt

SEQ ID NO: 1427 - DNA, 20 bp, Artificial Sequence
  chemically synthesized
gtaaggtcaagttatttgga

SEQ ID NO: 1428 - DNA, 20 bp, Artificial Sequence
  chemically synthesized
ggtcaagttatttggacaga

SEQ ID NO: 1429 - DNA, 20 bp, Artificial Sequence
  chemically synthesized
gtcaagttatttggacagaa

SEQ ID NO: 1430 - DNA, 20 bp, Artificial Sequence
  chemically synthesized
ttatttggacagaaaggcta

SEQ ID NO: 1431 - DNA, 20 bp, Artificial Sequence
  chemically synthesized
tatttggacagaaaggctac

SEQ ID NO: 1432 - DNA, 20 bp, Artificial Sequence
  chemically synthesized
atttggacagaaaggctaca

SEQ ID NO: 1433 - DNA, 20 bp, Artificial Sequence
  chemically synthesized
gacagaaaggctacagggtg

SEQ ID NO: 1434 - DNA, 20 bp, Artificial Sequence
  chemically synthesized
aaggctacagggtgcagtcc

SEQ ID NO: 1435 - DNA, 20 bp, Artificial Sequence
  chemically synthesized
tgcagtcctggatcttgtgt

SEQ ID NO: 1436 - DNA, 20 bp, Artificial Sequence
  chemically synthesized
ctgaccgcactaactatgcc

SEQ ID NO: 1437 - DNA, 20 bp, Artificial Sequence
  chemically synthesized
tgaccgcactaactatgcct

SEQ ID NO: 1438 - DNA, 20 bp, Artificial Sequence
  chemically synthesized
ccgcactaactatgcctagg

SEQ ID NO: 1439 - DNA, 20 bp, Artificial Sequence
  chemically synthesized
cgcactaactatgcctagga

SEQ ID NO: 1440 - DNA, 20 bp, Artificial Sequence
  chemically synthesized
ctaactatgcctaggaagga

SEQ ID NO: 1441 - DNA, 20 bp, Artificial Sequence
  chemically synthesized
taactatgcctaggaaggaa

SEQ ID NO: 1442 - DNA, 20 bp, Artificial Sequence
  chemically synthesized
actatgcctaggaaggaaag

SEQ ID NO: 1443 - DNA, 20 bp, Artificial Sequence
  chemically synthesized
ggaaaggagttgttgttttg

SEQ ID NO: 1444 - DNA, 20 bp, Artificial Sequence
  chemically synthesized
aaggagttgttgttttgtag

SEQ ID NO: 1445 - DNA, 20 bp, Artificial Sequence
  chemically synthesized
aggagttgttgttttgtaga

SEQ ID NO: 1446 - DNA, 20 bp, Artificial Sequence
  chemically synthesized
ggagttgttgttttgtagaa

SEQ ID NO: 1447 - DNA, 20 bp, Artificial Sequence
  chemically synthesized
gttgttttgtagaagggatt

SEQ ID NO: 1448 - DNA, 20 bp, Artificial Sequence
  chemically synthesized
ttgttttgtagaagggattg

SEQ ID NO: 1449 - DNA, 20 bp, Artificial Sequence
  chemically synthesized
ttgtagaagggattgaggtt

SEQ ID NO: 1450 - DNA, 20 bp, Artificial Sequence
  chemically synthesized
tgtagaagggattgaggttt

SEQ ID NO: 1451 - DNA, 20 bp, Artificial Sequence
  chemically synthesized
tagaagggattgaggtttgg

SEQ ID NO: 1452 - DNA, 20 bp, Artificial Sequence
  chemically synthesized
ttgaggtttgggagattaat

SEQ ID NO: 1453 - DNA, 20 bp, Artificial Sequence
  chemically synthesized
ggagattaatcggacacaat

SEQ ID NO: 1454 - DNA, 20 bp, Artificial Sequence
  chemically synthesized
gattaatcggacacaatcag

SEQ ID NO: 1455 - DNA, 20 bp, Artificial Sequence
  chemically synthesized
attaatcggacacaatcagc

SEQ ID NO: 1456 - DNA, 20 bp, Artificial Sequence
  chemically synthesized
ttaatcggacacaatcagca

SEQ ID NO: 1457 - DNA, 20 bp, Artificial Sequence
  chemically synthesized
aatcggacacaatcagcagg

SEQ ID NO: 1458 - DNA, 20 bp, Artificial Sequence
  chemically synthesized
tcggacacaatcagcaggga

SEQ ID NO: 1459 - DNA, 20 bp, Artificial Sequence
  chemically synthesized
gagagcacgtgtgtttttat

SEQ ID NO: 1460 - DNA, 20 bp, Artificial Sequence
  chemically synthesized
gtttttatgagaattatgcc

SEQ ID NO: 1461 - DNA, 20 bp, Artificial Sequence
  chemically synthesized
ttatgagaattatgccgaga

SEQ ID NO: 1462 - DNA, 20 bp, Artificial Sequence
  chemically synthesized
tatgagaattatgccgagat

SEQ ID NO: 1463 - DNA, 20 bp, Artificial Sequence
  chemically synthesized
tgccgagataggtaacacat

SEQ ID NO: 1464 - DNA, 20 bp, Artificial Sequence
  chemically synthesized
gccgagataggtaacacatg

SEQ ID NO: 1465 - DNA, 20 bp, Artificial Sequence
  chemically synthesized
taacacatgaggatgaaatt

SEQ ID NO: 1466 - DNA, 20 bp, Artificial Sequence
  chemically synthesized
aacacatgaggatgaaattt

SEQ ID NO: 1467 - DNA, 20 bp, Artificial Sequence
  chemically synthesized
atgaaatttgggcttgactg

SEQ ID NO: 1468 - DNA, 20 bp, Artificial Sequence
  chemically synthesized
tttgggcttgactgaagtaa

SEQ ID NO: 1469 - DNA, 20 bp, Artificial Sequence
  chemically synthesized
ttgggcttgactgaagtaat

SEQ ID NO: 1470 - DNA, 20 bp, Artificial Sequence
  chemically synthesized
tgggcttgactgaagtaatg

SEQ ID NO: 1471 - DNA, 20 bp, Artificial Sequence
  chemically synthesized
agtaatggggtctgtctgtg

SEQ ID NO: 1472 - DNA, 20 bp, Artificial Sequence
  chemically synthesized
ggtctgtctgtgaagccttg

SEQ ID NO: 1473 - DNA, 20 bp, Artificial Sequence
  chemically synthesized
ctgtctgtgaagccttgcag

SEQ ID NO: 1474 - DNA, 20 bp, Artificial Sequence
  chemically synthesized
tgtgaagccttgcagcagta

SEQ ID NO: 1475 - DNA, 20 bp, Artificial Sequence
  chemically synthesized
agccttgcagcagtacagcc

SEQ ID NO: 1476 - DNA, 20 bp, Artificial Sequence
  chemically synthesized
gccttgcagcagtacagccc

SEQ ID NO: 1477 - DNA, 20 bp, Artificial Sequence
  chemically synthesized
tacagcccaggtaatttgct

SEQ ID NO: 1478 - DNA, 20 bp, Artificial Sequence
  chemically synthesized
aggtaatttgctgagcctaa

SEQ ID NO: 1479 - DNA, 20 bp, Artificial Sequence
  chemically synthesized
ggtaatttgctgagcctaat

SEQ ID NO: 1480 - DNA, 20 bp, Artificial Sequence
  chemically synthesized
ttgctgagcctaatgggtgt

SEQ ID NO: 1481 - DNA, 20 bp, Artificial Sequence
  chemically synthesized
agcctaatgggtgtcagtgt

SEQ ID NO: 1482 - DNA, 20 bp, Artificial Sequence
  chemically synthesized
atgggtgtcagtgtcagtcc

SEQ ID NO: 1483 - DNA, 20 bp, Artificial Sequence
  chemically synthesized
gtcagtgtcagtccaagtga

SEQ ID NO: 1484 - DNA, 20 bp, Artificial Sequence
  chemically synthesized
tgtcagtccaagtgaaagcg

SEQ ID NO: 1485 - DNA, 20 bp, Artificial Sequence
  chemically synthesized
tcagtccaagtgaaagcgaa

SEQ ID NO: 1486 - DNA, 20 bp, Artificial Sequence
  chemically synthesized
agtccaagtgaaagcgaaga

SEQ ID NO: 1487 - DNA, 20 bp, Artificial Sequence
  chemically synthesized
gtccaagtgaaagcgaagag

SEQ ID NO: 1488 - DNA, 20 bp, Artificial Sequence
  chemically synthesized
aagtgaaagcgaagagaggc

SEQ ID NO: 1489 - DNA, 20 bp, Artificial Sequence
  chemically synthesized
agcgaagagaggctggaatg

SEQ ID NO: 1490 - DNA, 20 bp, Artificial Sequence
  chemically synthesized
gcgaagagaggctggaatga

SEQ ID NO: 1491 - DNA, 20 bp, Artificial Sequence
  chemically synthesized
cgaagagaggctggaatgaa

SEQ ID NO: 1492 - DNA, 20 bp, Artificial Sequence
  chemically synthesized
aggctggaatgaagggtgca

SEQ ID NO: 1493 - DNA, 20 bp, Artificial Sequence
  chemically synthesized
ggctggaatgaagggtgcaa

SEQ ID NO: 1494 - DNA, 20 bp, Artificial Sequence
  chemically synthesized
gaatgaagggtgcaaaggaa

SEQ ID NO: 1495 - DNA, 20 bp, Artificial Sequence
  chemically synthesized
aagggtgcaaaggaatagta

SEQ ID NO: 1496 - DNA, 20 bp, Artificial Sequence
  chemically synthesized
gtgcaaaggaatagtaaaga

SEQ ID NO: 1497 - DNA, 20 bp, Artificial Sequence
  chemically synthesized
atagtaaagaaagcatgttt

SEQ ID NO: 1498 - DNA, 20 bp, Artificial Sequence
  chemically synthesized
aagaaagcatgtttgagatc

SEQ ID NO: 1499 - DNA, 20 bp, Artificial Sequence
  chemically synthesized
agcatgtttgagatccagaa

SEQ ID NO: 1500 - DNA, 20 bp, Artificial Sequence
  chemically synthesized
tgagatccagaacagaataa

SEQ ID NO: 1501 - DNA, 20 bp, Artificial Sequence
  chemically synthesized
gagatccagaacagaataat

SEQ ID NO: 1502 - DNA, 20 bp, Artificial Sequence
  chemically synthesized
cagaacagaataatgggtta

SEQ ID NO: 1503 - DNA, 20 bp, Artificial Sequence
  chemically synthesized
acagaataatgggttataga

SEQ ID NO: 1504 - DNA, 20 bp, Artificial Sequence
  chemically synthesized
agaataatgggttatagatg

SEQ ID NO: 1505 - DNA, 20 bp, Artificial Sequence
  chemically synthesized
gaataatgggttatagatgg

SEQ ID NO: 1506 - DNA, 20 bp, Artificial Sequence
  chemically synthesized
gggttatagatggaggtatt

SEQ ID NO: 1507 - DNA, 20 bp, Artificial Sequence
  chemically synthesized
ggttatagatggaggtattg

SEQ ID NO: 1508 - DNA, 20 bp, Artificial Sequence
  chemically synthesized
atagatggaggtattgagga

SEQ ID NO: 1509 - DNA, 20 bp, Artificial Sequence
  chemically synthesized
tagatggaggtattgaggat

SEQ ID NO: 1510 - DNA, 20 bp, Artificial Sequence
  chemically synthesized
gatggaggtattgaggatag

SEQ ID NO: 1511 - DNA, 20 bp, Artificial Sequence
  chemically synthesized
tggaggtattgaggatagga

SEQ ID NO: 1512 - DNA, 20 bp, Artificial Sequence
  chemically synthesized
attgaggataggagagtata

SEQ ID NO: 1513 - DNA, 20 bp, Artificial Sequence
  chemically synthesized
ttgaggataggagagtatat

SEQ ID NO: 1514 - DNA, 20 bp, Artificial Sequence
  chemically synthesized
gataggagagtatatgggtt

SEQ ID NO: 1515 - DNA, 20 bp, Artificial Sequence
  chemically synthesized
agtatatgggtttggcacca

SEQ ID NO: 1516 - DNA, 20 bp, Artificial Sequence
  chemically synthesized
gtatatgggtttggcaccat

SEQ ID NO: 1517 - DNA, 20 bp, Artificial Sequence
  chemically synthesized
tatatgggtttggcaccatg

SEQ ID NO: 1518 - DNA, 20 bp, Artificial Sequence
  chemically synthesized
atgggtttggcaccatgggg

SEQ ID NO: 1519 - DNA, 20 bp, Artificial Sequence
  chemically synthesized
gtttggcaccatggggtgga

SEQ ID NO: 1520 - DNA, 20 bp, Artificial Sequence
  chemically synthesized
tttggcaccatggggtggat

SEQ ID NO: 1521 - DNA, 20 bp, Artificial Sequence
  chemically synthesized
ggtggataggcaaaacaatt

SEQ ID NO: 1522 - DNA, 20 bp, Artificial Sequence
  chemically synthesized
ggcaaaacaatttggttgat

SEQ ID NO: 1523 - DNA, 20 bp, Artificial Sequence
  chemically synthesized
acaatttggttgataagatg

SEQ ID NO: 1524 - DNA, 20 bp, Artificial Sequence
  chemically synthesized
cagattctgaactaacctgt

SEQ ID NO: 1525 - DNA, 20 bp, Artificial Sequence
  chemically synthesized
agattctgaactaacctgta

SEQ ID NO: 1526 - DNA, 20 bp, Artificial Sequence
  chemically synthesized
actaacctgtaaggcttgtc

SEQ ID NO: 1527 - DNA, 20 bp, Artificial Sequence
  chemically synthesized
ctgtaaggcttgtctggttt

SEQ ID NO: 1528 - DNA, 20 bp, Artificial Sequence
  chemically synthesized
tgtaaggcttgtctggtttt

SEQ ID NO: 1529 - DNA, 20 bp, Artificial Sequence
  chemically synthesized
aggcttgtctggttttagga

SEQ ID NO: 1530 - DNA, 20 bp, Artificial Sequence
  chemically synthesized
ggcttgtctggttttaggac

SEQ ID NO: 1531 - DNA, 20 bp, Artificial Sequence
  chemically synthesized
tggttttaggacaggtaaaa

SEQ ID NO: 1532 - DNA, 20 bp, Artificial Sequence
  chemically synthesized
ggttttaggacaggtaaaat

SEQ ID NO: 1533 - DNA, 20 bp, Artificial Sequence
  chemically synthesized
gttttaggacaggtaaaatg

SEQ ID NO: 1534 - DNA, 20 bp, Artificial Sequence
  chemically synthesized
ttttaggacaggtaaaatgg

SEQ ID NO: 1535 - DNA, 20 bp, Artificial Sequence
  chemically synthesized
ggacaggtaaaatgggggaa

SEQ ID NO: 1536 - DNA, 20 bp, Artificial Sequence
  chemically synthesized
aggtaaaatgggggaatggt

SEQ ID NO: 1537 - DNA, 20 bp, Artificial Sequence
  chemically synthesized
ggtaaaatgggggaatggta

SEQ ID NO: 1538 - DNA, 20 bp, Artificial Sequence
  chemically synthesized
taaaatgggggaatggtaag

SEQ ID NO: 1539 - DNA, 20 bp, Artificial Sequence
  chemically synthesized
aaatgggggaatggtaagga

SEQ ID NO: 1540 - DNA, 20 bp, Artificial Sequence
  chemically synthesized
ggaatggtaaggagagttta

SEQ ID NO: 1541 - DNA, 20 bp, Artificial Sequence
  chemically synthesized
gaatggtaaggagagtttat

SEQ ID NO: 1542 - DNA, 20 bp, Artificial Sequence
  chemically synthesized
ggagagtttataggctttaa

SEQ ID NO: 1543 - DNA, 20 bp, Artificial Sequence
  chemically synthesized
gagagtttataggctttaaa

SEQ ID NO: 1544 - DNA, 20 bp, Artificial Sequence
  chemically synthesized
tttaaaaggccatgctgtaa

SEQ ID NO: 1545 - DNA, 20 bp, Artificial Sequence
  chemically synthesized
ttaaaaggccatgctgtaac

SEQ ID NO: 1546 - DNA, 20 bp, Artificial Sequence
  chemically synthesized
aaggccatgctgtaacaggc

SEQ ID NO: 1547 - DNA, 20 bp, Artificial Sequence
  chemically synthesized
ctgtaacaggcaagtaataa

SEQ ID NO: 1548 - DNA, 20 bp, Artificial Sequence
  chemically synthesized
tgtaacaggcaagtaataac

SEQ ID NO: 1549 - DNA, 20 bp, Artificial Sequence
  chemically synthesized
aacaggctttaatcctttca

SEQ ID NO: 1550 - DNA, 20 bp, Artificial Sequence
  chemically synthesized
aatcctttcaaagcatgctg

SEQ ID NO: 1551 - DNA, 20 bp, Artificial Sequence
  chemically synthesized
atcctttcaaagcatgctgt

SEQ ID NO: 1552 - DNA, 20 bp, Artificial Sequence
  chemically synthesized
tttcaaagcatgctgtggga

SEQ ID NO: 1553 - DNA, 20 bp, Artificial Sequence
  chemically synthesized
ttcaaagcatgctgtgggat

SEQ ID NO: 1554 - DNA, 20 bp, Artificial Sequence
  chemically synthesized
catgctgtgggatgggatac

SEQ ID NO: 1555 - DNA, 20 bp, Artificial Sequence
  chemically synthesized
tgggatgggatactggcatt

SEQ ID NO: 1556 - DNA, 20 bp, Artificial Sequence
  chemically synthesized
gatgggatactggcattgag

SEQ ID NO: 1557 - DNA, 20 bp, Artificial Sequence
  chemically synthesized
atgggatactggcattgagc

SEQ ID NO: 1558 - DNA, 20 bp, Artificial Sequence
  chemically synthesized
tgggatactggcattgagcg

SEQ ID NO: 1559 - DNA, 20 bp, Artificial Sequence
  chemically synthesized
atactggcattgagcggggt

SEQ ID NO: 1560 - DNA, 20 bp, Artificial Sequence
  chemically synthesized
actggcattgagcggggtaa

SEQ ID NO: 1561 - DNA, 20 bp, Artificial Sequence
  chemically synthesized
ttgagcggggtaagagtgat

SEQ ID NO: 1562 - DNA, 20 bp, Artificial Sequence
  chemically synthesized
tgagcggggtaagagtgatt

SEQ ID NO: 1563 - DNA, 20 bp, Artificial Sequence
  chemically synthesized
taagagtgattaggttttaa

SEQ ID NO: 1564 - DNA, 20 bp, Artificial Sequence
  chemically synthesized
aagagtgattaggttttaat

SEQ ID NO: 1565 - DNA, 20 bp, Artificial Sequence
  chemically synthesized
gtgattaggttttaatggga

SEQ ID NO: 1566 - DNA, 20 bp, Artificial Sequence
  chemically synthesized
ttaggttttaatgggatggt

SEQ ID NO: 1567 - DNA, 20 bp, Artificial Sequence
  chemically synthesized
taggttttaatgggatggta

SEQ ID NO: 1568 - DNA, 20 bp, Artificial Sequence
  chemically synthesized
aggttttaatgggatggtaa

SEQ ID NO: 1569 - DNA, 20 bp, Artificial Sequence
  chemically synthesized
ggttttaatgggatggtaag

SEQ ID NO: 1570 - DNA, 20 bp, Artificial Sequence
  chemically synthesized
gatggtaaggggcgcatgat

SEQ ID NO: 1571 - DNA, 20 bp, Artificial Sequence
  chemically synthesized
ggggcgcatgatcggtcgcg

SEQ ID NO: 1572 - DNA, 20 bp, Artificial Sequence
  chemically synthesized
gggcgcatgatcggtcgcga

SEQ ID NO: 1573 - DNA, 20 bp, Artificial Sequence
  chemically synthesized
gcgcatgatcggtcgcgaag

SEQ ID NO: 1574 - DNA, 20 bp, Artificial Sequence
  chemically synthesized
cgcatgatcggtcgcgaagg

SEQ ID NO: 1575 - DNA, 20 bp, Artificial Sequence
  chemically synthesized
atgatcggtcgcgaaggagg

SEQ ID NO: 1576 - DNA, 20 bp, Artificial Sequence
  chemically synthesized
atcggtcgcgaaggaggaag

SEQ ID NO: 1577 - DNA, 20 bp, Artificial Sequence
  chemically synthesized
cggtcgcgaaggaggaagta

SEQ ID NO: 1578 - DNA, 20 bp, Artificial Sequence
  chemically synthesized
ggtcgcgaaggaggaagtag

SEQ ID NO: 1579 - DNA, 20 bp, Artificial Sequence
  chemically synthesized
gtagaggtgtcttatacttg

SEQ ID NO: 1580 - DNA, 20 bp, Artificial Sequence
  chemically synthesized
gtgtcttatacttgtggatt

SEQ ID NO: 1581 - DNA, 20 bp, Artificial Sequence
  chemically synthesized
tgtcttatacttgtggatta

SEQ ID NO: 1582 - DNA, 20 bp, Artificial Sequence
  chemically synthesized
cttatacttgtggattaagg

SEQ ID NO: 1583 - DNA, 20 bp, Artificial Sequence
  chemically synthesized
ttatacttgtggattaaggt

SEQ ID NO: 1584 - DNA, 20 bp, Artificial Sequence
  chemically synthesized
tatacttgtggattaaggtg

SEQ ID NO: 1585 - DNA, 20 bp, Artificial Sequence
  chemically synthesized
tacttgtggattaaggtggg

SEQ ID NO: 1586 - DNA, 20 bp, Artificial Sequence
  chemically synthesized
ggattaaggtggggagatac

SEQ ID NO: 1587 - DNA, 20 bp, Artificial Sequence
  chemically synthesized
gattaaggtggggagataca

SEQ ID NO: 1588 - DNA, 20 bp, Artificial Sequence
  chemically synthesized
attaaggtggggagatacaa

SEQ ID NO: 1589 - DNA, 20 bp, Artificial Sequence
  chemically synthesized
ttaaggtggggagatacaag

SEQ ID NO: 1590 - DNA, 20 bp, Artificial Sequence
  chemically synthesized
aaggtggggagatacaaggg

SEQ ID NO: 1591 - DNA, 20 bp, Artificial Sequence
  chemically synthesized
aggtggggagatacaagggg

SEQ ID NO: 1592 - DNA, 20 bp, Artificial Sequence
  chemically synthesized
agatacaaggggaggatgtg

SEQ ID NO: 1593 - DNA, 20 bp, Artificial Sequence
  chemically synthesized
gatacaaggggaggatgtga

SEQ ID NO: 1594 - DNA, 20 bp, Artificial Sequence
  chemically synthesized
tacaaggggaggatgtgaag

SEQ ID NO: 1595 - DNA, 20 bp, Artificial Sequence
  chemically synthesized
acaaggggaggatgtgaagg

SEQ ID NO: 1596 - DNA, 20 bp, Artificial Sequence
  chemically synthesized
atgtgaaggaggctttgaac

SEQ ID NO: 1597 - DNA, 20 bp, Artificial Sequence
  chemically synthesized
tgtgaaggaggctttgaact

SEQ ID NO: 1598 - DNA, 20 bp, Artificial Sequence
  chemically synthesized
gtgaaggaggctttgaactg

SEQ ID NO: 1599 - DNA, 20 bp, Artificial Sequence
  chemically synthesized
tgaaggaggctttgaactgg

SEQ ID NO: 1600 - DNA, 20 bp, Artificial Sequence
  chemically synthesized
ctttgaactgggggaaaaca

SEQ ID NO: 1601 - DNA, 20 bp, Artificial Sequence
  chemically synthesized
ctgggggaaaacatggcaat

SEQ ID NO: 1602 - DNA, 20 bp, Artificial Sequence
  chemically synthesized
tgggggaaaacatggcaatg

SEQ ID NO: 1603 - DNA, 20 bp, Artificial Sequence
  chemically synthesized
gaaaacatggcaatgaggta

SEQ ID NO: 1604 - DNA, 20 bp, Artificial Sequence
  chemically synthesized
atggcaatgaggtatggctg

SEQ ID NO: 1605 - DNA, 20 bp, Artificial Sequence
  chemically synthesized
aatgaggtatggctgtagcc

SEQ ID NO: 1606 - DNA, 20 bp, Artificial Sequence
  chemically synthesized
atgaggtatggctgtagccc

SEQ ID NO: 1607 - DNA, 20 bp, Artificial Sequence
  chemically synthesized
gtatggctgtagcccaggaa

SEQ ID NO: 1608 - DNA, 20 bp, Artificial Sequence
  chemically synthesized
ggctgtagcccaggaatagt

SEQ ID NO: 1609 - DNA, 20 bp, Artificial Sequence
  chemically synthesized
gctgtagcccaggaatagtc

SEQ ID NO: 1610 - DNA, 20 bp, Artificial Sequence
  chemically synthesized
ctgtagcccaggaatagtca

SEQ ID NO: 1611 - DNA, 20 bp, Artificial Sequence
  chemically synthesized
tagcccaggaatagtcaggg

SEQ ID NO: 1612 - DNA, 20 bp, Artificial Sequence
  chemically synthesized
cccaggaatagtcagggaag

SEQ ID NO: 1613 - DNA, 20 bp, Artificial Sequence
  chemically synthesized
agtcagggaagcagataatt

SEQ ID NO: 1614 - DNA, 20 bp, Artificial Sequence
  chemically synthesized
ggaagcagataatttagtta

SEQ ID NO: 1615 - DNA, 20 bp, Artificial Sequence
  chemically synthesized
ataatttagttaaagtgtct

SEQ ID NO: 1616 - DNA, 20 bp, Artificial Sequence
  chemically synthesized
ttaaagtgtctcggcctaat

SEQ ID NO: 1617 - DNA, 20 bp, Artificial Sequence
  chemically synthesized
taaagtgtctcggcctaata

SEQ ID NO: 1618 - DNA, 20 bp, Artificial Sequence
  chemically synthesized
aaagtgtctcggcctaataa

SEQ ID NO: 1619 - DNA, 20 bp, Artificial Sequence
  chemically synthesized
tctcggcctaataagggaac

SEQ ID NO: 1620 - DNA, 20 bp, Artificial Sequence
  chemically synthesized
cggcctaataagggaactgg

SEQ ID NO: 1621 - DNA, 20 bp, Artificial Sequence
  chemically synthesized
ggcctaataagggaactggc

SEQ ID NO: 1622 - DNA, 20 bp, Artificial Sequence
  chemically synthesized
ctaataagggaactggcagg

SEQ ID NO: 1623 - DNA, 20 bp, Artificial Sequence
  chemically synthesized
taataagggaactggcaggt

SEQ ID NO: 1624 - DNA, 20 bp, Artificial Sequence
  chemically synthesized
aataagggaactggcaggtg

SEQ ID NO: 1625 - DNA, 20 bp, Artificial Sequence
  chemically synthesized
ggcaggtggggataatgaaa

SEQ ID NO: 1626 - DNA, 20 bp, Artificial Sequence
  chemically synthesized
gcaggtggggataatgaaaa

SEQ ID NO: 1627 - DNA, 20 bp, Artificial Sequence
  chemically synthesized
aggtggggataatgaaaaag

SEQ ID NO: 1628 - DNA, 20 bp, Artificial Sequence
  chemically synthesized
aatgaaaaaggagtgcttaa

SEQ ID NO: 1629 - DNA, 20 bp, Artificial Sequence
  chemically synthesized
tgaaaaaggagtgcttaaaa

SEQ ID NO: 1630 - DNA, 20 bp, Artificial Sequence
  chemically synthesized
tgcttaaaagagtatcgtct

SEQ ID NO: 1631 - DNA, 20 bp, Artificial Sequence
  chemically synthesized
taaaagagtatcgtctcggt

SEQ ID NO: 1632 - DNA, 20 bp, Artificial Sequence
  chemically synthesized
agtatcgtctcggttagcac

SEQ ID NO: 1633 - DNA, 20 bp, Artificial Sequence
  chemically synthesized
tatcgtctcggttagcacca

SEQ ID NO: 1634 - DNA, 20 bp, Artificial Sequence
  chemically synthesized
gtctcggttagcaccagagt

SEQ ID NO: 1635 - DNA, 20 bp, Artificial Sequence
  chemically synthesized
tctcggttagcaccagagtt

SEQ ID NO: 1636 - DNA, 20 bp, Artificial Sequence
  chemically synthesized
ctcggttagcaccagagttg

SEQ ID NO: 1637 - DNA, 20 bp, Artificial Sequence
  chemically synthesized
caccagagttggggaatttt

SEQ ID NO: 1638 - DNA, 20 bp, Artificial Sequence
  chemically synthesized
ccagagttggggaattttaa

SEQ ID NO: 1639 - DNA, 20 bp, Artificial Sequence
  chemically synthesized
cagagttggggaattttaag

SEQ ID NO: 1640 - DNA, 20 bp, Artificial Sequence
  chemically synthesized
ttggggaattttaagaggtt

SEQ ID NO: 1641 - DNA, 20 bp, Artificial Sequence
  chemically synthesized
gggaattttaagaggtttag

SEQ ID NO: 1642 - DNA, 20 bp, Artificial Sequence
  chemically synthesized
ttttaagaggtttagaagcc

SEQ ID NO: 1643 - DNA, 20 bp, Artificial Sequence
  chemically synthesized
ctggccatcaatacctacaa

SEQ ID NO: 1644 - DNA, 20 bp, Artificial Sequence
  chemically synthesized
atcaatacctacaacagtta

SEQ ID NO: 1645 - DNA, 20 bp, Artificial Sequence
  chemically synthesized
caatacctacaacagttatg

SEQ ID NO: 1646 - DNA, 20 bp, Artificial Sequence
  chemically synthesized
aatacctacaacagttatgg

SEQ ID NO: 1647 - DNA, 20 bp, Artificial Sequence
  chemically synthesized
cctacaacagttatggaggc

SEQ ID NO: 1648 - DNA, 20 bp, Artificial Sequence
  chemically synthesized
ctacaacagttatggaggca

SEQ ID NO: 1649 - DNA, 20 bp, Artificial Sequence
  chemically synthesized
tacaacagttatggaggcaa

SEQ ID NO: 1650 - DNA, 20 bp, Artificial Sequence
  chemically synthesized
agttatggaggcaagggaaa

SEQ ID NO: 1651 - DNA, 20 bp, Artificial Sequence
  chemically synthesized
gttatggaggcaagggaaac

SEQ ID NO: 1652 - DNA, 20 bp, Artificial Sequence
  chemically synthesized
aagggaaacaggcctttgaa

SEQ ID NO: 1653 - DNA, 20 bp, Artificial Sequence
  chemically synthesized
ggaaacaggcctttgaaaag

SEQ ID NO: 1654 - DNA, 20 bp, Artificial Sequence
  chemically synthesized
gaaacaggcctttgaaaaga

SEQ ID NO: 1655 - DNA, 20 bp, Artificial Sequence
  chemically synthesized
cctttgaaaagaaggtaatg

SEQ ID NO: 1656 - DNA, 20 bp, Artificial Sequence
  chemically synthesized
tttgaaaagaaggtaatgtg

SEQ ID NO: 1657 - DNA, 20 bp, Artificial Sequence
  chemically synthesized
gaaaagaaggtaatgtggag

SEQ ID NO: 1658 - DNA, 20 bp, Artificial Sequence
  chemically synthesized
aaaagaaggtaatgtggagt

SEQ ID NO: 1659 - DNA, 20 bp, Artificial Sequence
  chemically synthesized
agaaggtaatgtggagtggg

SEQ ID NO: 1660 - DNA, 20 bp, Artificial Sequence
  chemically synthesized
gggtagcctccatactgatt

SEQ ID NO: 1661 - DNA, 20 bp, Artificial Sequence
  chemically synthesized
tagcctccatactgattaag

SEQ ID NO: 1662 - DNA, 20 bp, Artificial Sequence
  chemically synthesized
agcctccatactgattaaga

SEQ ID NO: 1663 - DNA, 20 bp, Artificial Sequence
  chemically synthesized
gcctccatactgattaagaa

SEQ ID NO: 1664 - DNA, 20 bp, Artificial Sequence
  chemically synthesized
catactgattaagaagggta

SEQ ID NO: 1665 - DNA, 20 bp, Artificial Sequence
  chemically synthesized
acagacttaccctccactgt

SEQ ID NO: 1666 - DNA, 20 bp, Artificial Sequence
  chemically synthesized
tccactgtgagaattaccta

SEQ ID NO: 1667 - DNA, 20 bp, Artificial Sequence
  chemically synthesized
tgtgagaattacctaaagct

SEQ ID NO: 1668 - DNA, 20 bp, Artificial Sequence
  chemically synthesized
ctaaagctcggtgtctgtga

SEQ ID NO: 1669 - DNA, 20 bp, Artificial Sequence
  chemically synthesized
tcggtgtctgtgatggtcta

SEQ ID NO: 1670 - DNA, 20 bp, Artificial Sequence
  chemically synthesized
cggtgtctgtgatggtctac

SEQ ID NO: 1671 - DNA, 20 bp, Artificial Sequence
  chemically synthesized
ggtgtctgtgatggtctaca

SEQ ID NO: 1672 - DNA, 20 bp, Artificial Sequence
  chemically synthesized
tgatggtctacagggcttcc

SEQ ID NO: 1673 - DNA, 20 bp, Artificial Sequence
  chemically synthesized
gatggtctacagggcttccg

SEQ ID NO: 1674 - DNA, 20 bp, Artificial Sequence
  chemically synthesized
tacagggcttccgaggcgat

SEQ ID NO: 1675 - DNA, 20 bp, Artificial Sequence
  chemically synthesized
acagggcttccgaggcgatc

SEQ ID NO: 1676 - DNA, 20 bp, Artificial Sequence
  chemically synthesized
gggcttccgaggcgatcagg

SEQ ID NO: 1677 - DNA, 20 bp, Artificial Sequence
  chemically synthesized
cttccgaggcgatcaggcag

SEQ ID NO: 1678 - DNA, 20 bp, Artificial Sequence
  chemically synthesized
ccgaggcgatcaggcagtgg

SEQ ID NO: 1679 - DNA, 20 bp, Artificial Sequence
  chemically synthesized
gatcaggcagtggcagtctt

SEQ ID NO: 1680 - DNA, 20 bp, Artificial Sequence
  chemically synthesized
agtggcagtcttcagctgca

SEQ ID NO: 1681 - DNA, 20 bp, Artificial Sequence
  chemically synthesized
cagtcttcagctgcaaagcc

SEQ ID NO: 1682 - DNA, 20 bp, Artificial Sequence
  chemically synthesized
tcttcagctgcaaagccgag

SEQ ID NO: 1683 - DNA, 20 bp, Artificial Sequence
  chemically synthesized
gctgcaaagccgagaagatc

SEQ ID NO: 1684 - DNA, 20 bp, Artificial Sequence
  chemically synthesized
ctgcaaagccgagaagatct

SEQ ID NO: 1685 - DNA, 20 bp, Artificial Sequence
  chemically synthesized
caaagccgagaagatctggg

SEQ ID NO: 1686 - DNA, 20 bp, Artificial Sequence
  chemically synthesized
aaagccgagaagatctggga

SEQ ID NO: 1687 - DNA, 20 bp, Artificial Sequence
  chemically synthesized
agccgagaagatctgggaag

SEQ ID NO: 1688 - DNA, 20 bp, Artificial Sequence
  chemically synthesized
gagaagatctgggaaggagt

SEQ ID NO: 1689 - DNA, 20 bp, Artificial Sequence
  chemically synthesized
agatctgggaaggagtcagt

SEQ ID NO: 1690 - DNA, 20 bp, Artificial Sequence
  chemically synthesized
gatctgggaaggagtcagtc

SEQ ID NO: 1691 - DNA, 20 bp, Artificial Sequence
  chemically synthesized
atctgggaaggagtcagtca

SEQ ID NO: 1692 - DNA, 20 bp, Artificial Sequence
  chemically synthesized
ctgggaaggagtcagtcagg

SEQ ID NO: 1693 - DNA, 20 bp, Artificial Sequence
  chemically synthesized
aggagtcagtcagggagcct

SEQ ID NO: 1694 - DNA, 20 bp, Artificial Sequence
  chemically synthesized
ggagtcagtcagggagcctt

SEQ ID NO: 1695 - DNA, 20 bp, Artificial Sequence
  chemically synthesized
tcagtcagggagccttgggc

SEQ ID NO: 1696 - DNA, 20 bp, Artificial Sequence
  chemically synthesized
agtcagggagccttgggcca

SEQ ID NO: 1697 - DNA, 20 bp, Artificial Sequence
  chemically synthesized
ggagccttgggccagagttc

SEQ ID NO: 1698 - DNA, 20 bp, Artificial Sequence
  chemically synthesized
gagccttgggccagagttcc

SEQ ID NO: 1699 - DNA, 20 bp, Artificial Sequence
  chemically synthesized
agccttgggccagagttcca

SEQ ID NO: 1700 - DNA, 20 bp, Artificial Sequence
  chemically synthesized
gccttgggccagagttccag

SEQ ID NO: 1701 - DNA, 20 bp, Artificial Sequence
  chemically synthesized
ggccagagttccaggggctc

SEQ ID NO: 1702 - DNA, 20 bp, Artificial Sequence
  chemically synthesized
gccagagttccaggggctct

SEQ ID NO: 1703 - DNA, 20 bp, Artificial Sequence
  chemically synthesized
cagagttccaggggctctag

SEQ ID NO: 1704 - DNA, 20 bp, Artificial Sequence
  chemically synthesized
agttccaggggctctaggag

SEQ ID NO: 1705 - DNA, 20 bp, Artificial Sequence
  chemically synthesized
ggggctctaggagtggctgc

SEQ ID NO: 1706 - DNA, 20 bp, Artificial Sequence
  chemically synthesized
gggctctaggagtggctgcc

SEQ ID NO: 1707 - DNA, 20 bp, Artificial Sequence
  chemically synthesized
tctaggagtggctgccaggt

SEQ ID NO: 1708 - DNA, 20 bp, Artificial Sequence
  chemically synthesized
tggctgccaggtgagttgaa

SEQ ID NO: 1709 - DNA, 20 bp, Artificial Sequence
  chemically synthesized
gagttgaacagtccgatttc

SEQ ID NO: 1710 - DNA, 20 bp, Artificial Sequence
  chemically synthesized
ttgaacagtccgatttctag

SEQ ID NO: 1711 - DNA, 20 bp, Artificial Sequence
  chemically synthesized
tgaacagtccgatttctagt

SEQ ID NO: 1712 - DNA, 20 bp, Artificial Sequence
  chemically synthesized
gaacagtccgatttctagtg

SEQ ID NO: 1713 - DNA, 20 bp, Artificial Sequence
  chemically synthesized
atttctagtggggtcctgca

SEQ ID NO: 1714 - DNA, 20 bp, Artificial Sequence
  chemically synthesized
ctagtggggtcctgcacaga

SEQ ID NO: 1715 - DNA, 20 bp, Artificial Sequence
  chemically synthesized
tagtggggtcctgcacagat

SEQ ID NO: 1716 - DNA, 20 bp, Artificial Sequence
  chemically synthesized
ggtcctgcacagatgggaca

SEQ ID NO: 1717 - DNA, 20 bp, Artificial Sequence
  chemically synthesized
tgcacagatgggacacggct

SEQ ID NO: 1718 - DNA, 20 bp, Artificial Sequence
  chemically synthesized
gcacagatgggacacggctt

SEQ ID NO: 1719 - DNA, 20 bp, Artificial Sequence
  chemically synthesized
acagatgggacacggcttag

SEQ ID NO: 1720 - DNA, 20 bp, Artificial Sequence
  chemically synthesized
cagatgggacacggcttagg

SEQ ID NO: 1721 - DNA, 20 bp, Artificial Sequence
  chemically synthesized
acacggcttaggaggaatcc

SEQ ID NO: 1722 - DNA, 20 bp, Artificial Sequence
  chemically synthesized
cacggcttaggaggaatcct

SEQ ID NO: 1723 - DNA, 20 bp, Artificial Sequence
  chemically synthesized
ttaggaggaatcctgggctg

SEQ ID NO: 1724 - DNA, 20 bp, Artificial Sequence
  chemically synthesized
taggaggaatcctgggctgc

SEQ ID NO: 1725 - DNA, 20 bp, Artificial Sequence
  chemically synthesized
cctgggctgcgggcattcct

SEQ ID NO: 1726 - DNA, 20 bp, Artificial Sequence
  chemically synthesized
gctgcgggcattccttggcc

SEQ ID NO: 1727 - DNA, 20 bp, Artificial Sequence
  chemically synthesized
gcgggcattccttggcctgg

SEQ ID NO: 1728 - DNA, 20 bp, Artificial Sequence
  chemically synthesized
gcattccttggcctggtggc

SEQ ID NO: 1729 - DNA, 20 bp, Artificial Sequence
  chemically synthesized
tggcctggtggccagatttc

SEQ ID NO: 1730 - DNA, 20 bp, Artificial Sequence
  chemically synthesized
ggccagatttctggcacttg

SEQ ID NO: 1731 - DNA, 20 bp, Artificial Sequence
  chemically synthesized
agatttctggcacttgtagc

SEQ ID NO: 1732 - DNA, 20 bp, Artificial Sequence
  chemically synthesized
tggcacttgtagcaagctcc

SEQ ID NO: 1733 - DNA, 20 bp, Artificial Sequence
  chemically synthesized
ggcacttgtagcaagctcct

SEQ ID NO: 1734 - DNA, 20 bp, Artificial Sequence
  chemically synthesized
gcacttgtagcaagctcctg

SEQ ID NO: 1735 - DNA, 20 bp, Artificial Sequence
  chemically synthesized
cacttgtagcaagctcctgg

SEQ ID NO: 1736 - DNA, 20 bp, Artificial Sequence
  chemically synthesized
cttgtagcaagctcctgggg

SEQ ID NO: 1737 - DNA, 20 bp, Artificial Sequence
  chemically synthesized
ttgtagcaagctcctggggg

SEQ ID NO: 1738 - DNA, 20 bp, Artificial Sequence
  chemically synthesized
tagcaagctcctgggggagg

SEQ ID NO: 1739 - DNA, 20 bp, Artificial Sequence
  chemically synthesized
gctcctgggggaggtggttc

SEQ ID NO: 1740 - DNA, 20 bp, Artificial Sequence
  chemically synthesized
tcctgggggaggtggttccg

SEQ ID NO: 1741 - DNA, 20 bp, Artificial Sequence
  chemically synthesized
cctgggggaggtggttccgg

SEQ ID NO: 1742 - DNA, 20 bp, Artificial Sequence
  chemically synthesized
ggtggttccggaggaacgcc

SEQ ID NO: 1743 - DNA, 20 bp, Artificial Sequence
  chemically synthesized
ggaggaacgcctggccactg

SEQ ID NO: 1744 - DNA, 20 bp, Artificial Sequence
  chemically synthesized
aacgcctggccactgcggtt

SEQ ID NO: 1745 - DNA, 20 bp, Artificial Sequence
  chemically synthesized
acgcctggccactgcggttt

SEQ ID NO: 1746 - DNA, 20 bp, Artificial Sequence
  chemically synthesized
gccactgcggtttaggcatt

SEQ ID NO: 1747 - DNA, 20 bp, Artificial Sequence
  chemically synthesized
actgcggtttaggcatttgg

SEQ ID NO: 1748 - DNA, 20 bp, Artificial Sequence
  chemically synthesized
atttggaagttcttgtgtgc

SEQ ID NO: 1749 - DNA, 20 bp, Artificial Sequence
  chemically synthesized
ttggaagttcttgtgtgctg

SEQ ID NO: 1750 - DNA, 20 bp, Artificial Sequence
  chemically synthesized
gttcttgtgtgctggagatg

SEQ ID NO: 1751 - DNA, 20 bp, Artificial Sequence
  chemically synthesized
ttgtgtgctggagatgtggc

SEQ ID NO: 1752 - DNA, 20 bp, Artificial Sequence
  chemically synthesized
tgtgtgctggagatgtggct

SEQ ID NO: 1753 - DNA, 20 bp, Artificial Sequence
  chemically synthesized
gtgtgctggagatgtggctg

SEQ ID NO: 1754 - DNA, 20 bp, Artificial Sequence
  chemically synthesized
tgtggctggggtttgtctca

SEQ ID NO: 1755 - DNA, 20 bp, Artificial Sequence
  chemically synthesized
ggctggggtttgtctcacag

SEQ ID NO: 1756 - DNA, 20 bp, Artificial Sequence
  chemically synthesized
ctggggtttgtctcacagtg

SEQ ID NO: 1757 - DNA, 20 bp, Artificial Sequence
  chemically synthesized
tggggtttgtctcacagtgg

SEQ ID NO: 1758 - DNA, 20 bp, Artificial Sequence
  chemically synthesized
gtttgtctcacagtggaggc

SEQ ID NO: 1759 - DNA, 20 bp, Artificial Sequence
  chemically synthesized
tttgtctcacagtggaggca

SEQ ID NO: 1760 - DNA, 20 bp, Artificial Sequence
  chemically synthesized
ctcaaaaatatgttgctact

SEQ ID NO: 1761 - DNA, 20 bp, Artificial Sequence
  chemically synthesized
ctctattattgtacaccttg

SEQ ID NO: 1762 - DNA, 20 bp, Artificial Sequence
  chemically synthesized
tctattattgtacaccttga

SEQ ID NO: 1763 - DNA, 20 bp, Artificial Sequence
  chemically synthesized
ttattgtacaccttgaaggt

SEQ ID NO: 1764 - DNA, 20 bp, Artificial Sequence
  chemically synthesized
tattgtacaccttgaaggtg

SEQ ID NO: 1765 - DNA, 20 bp, Artificial Sequence
  chemically synthesized
ccttgaaggtgaggttaatt

SEQ ID NO: 1766 - DNA, 20 bp, Artificial Sequence
  chemically synthesized
aggttaattgagtcctgttg

SEQ ID NO: 1767 - DNA, 20 bp, Artificial Sequence
  chemically synthesized
ggttaattgagtcctgttgt

SEQ ID NO: 1768 - DNA, 20 bp, Artificial Sequence
  chemically synthesized
gttaattgagtcctgttgtg

SEQ ID NO: 1769 - DNA, 20 bp, Artificial Sequence
  chemically synthesized
tgagtcctgttgtggggttt

SEQ ID NO: 1770 - DNA, 20 bp, Artificial Sequence
  chemically synthesized
gagtcctgttgtggggtttg

SEQ ID NO: 1771 - DNA, 20 bp, Artificial Sequence
  chemically synthesized
ctgttgtggggtttgaggtc

SEQ ID NO: 1772 - DNA, 20 bp, Artificial Sequence
  chemically synthesized
gaggtccagaatttaatttt

SEQ ID NO: 1773 - DNA, 20 bp, Artificial Sequence
  chemically synthesized
ggtccagaatttaatttttg

SEQ ID NO: 1774 - DNA, 20 bp, Artificial Sequence
  chemically synthesized
tttggagttttatttaatgt

SEQ ID NO: 1775 - DNA, 20 bp, Artificial Sequence
  chemically synthesized
ttggagttttatttaatgtc

SEQ ID NO: 1776 - DNA, 20 bp, Artificial Sequence
  chemically synthesized
ggagttttatttaatgtcag

SEQ ID NO: 1777 - DNA, 20 bp, Artificial Sequence
  chemically synthesized
gttttatttaatgtcaggag

SEQ ID NO: 1778 - DNA, 20 bp, Artificial Sequence
  chemically synthesized
atttaatgtcaggagcagat

SEQ ID NO: 1779 - DNA, 20 bp, Artificial Sequence
  chemically synthesized
tttaatgtcaggagcagatt

SEQ ID NO: 1780 - DNA, 20 bp, Artificial Sequence
  chemically synthesized
tgggtaataaaatgtatatt

SEQ ID NO: 1781 - DNA, 20 bp, Artificial Sequence
  chemically synthesized
taaaatgtatattgagaata

SEQ ID NO: 1782 - DNA, 20 bp, Artificial Sequence
  chemically synthesized
aatgtatattgagaataaag

SEQ ID NO: 1783 - DNA, 20 bp, Artificial Sequence
  chemically synthesized
aaagtggccttttgtccttt

SEQ ID NO: 1784 - DNA, 20 bp, Artificial Sequence
  chemically synthesized
aagtggccttttgtcctttt

SEQ ID NO: 1785 - DNA, 20 bp, Artificial Sequence
  chemically synthesized
agtggccttttgtcctttta

SEQ ID NO: 1786 - DNA, 20 bp, Artificial Sequence
  chemically synthesized
ccttttgtccttttagggtc

SEQ ID NO: 1787 - DNA, 20 bp, Artificial Sequence
  chemically synthesized
cttttgtccttttagggtct

SEQ ID NO: 1788 - DNA, 20 bp, Artificial Sequence
  chemically synthesized
ttttgtccttttagggtcta

SEQ ID NO: 1789 - DNA, 20 bp, Artificial Sequence
  chemically synthesized
ttttagggtctagggctgta

SEQ ID NO: 1790 - DNA, 20 bp, Artificial Sequence
  chemically synthesized
tctagggctgtaaagcgtct

SEQ ID NO: 1791 - DNA, 20 bp, Artificial Sequence
  chemically synthesized
ctagggctgtaaagcgtctc

SEQ ID NO: 1792 - DNA, 20 bp, Artificial Sequence
  chemically synthesized
tagggctgtaaagcgtctca

SEQ ID NO: 1793 - DNA, 20 bp, Artificial Sequence
  chemically synthesized
tctcagggttgctgccgaac

SEQ ID NO: 1794 - DNA, 20 bp, Artificial Sequence
  chemically synthesized
ctgccgaacgagccatgaac

SEQ ID NO: 1795 - DNA, 20 bp, Artificial Sequence
  chemically synthesized
tgccgaacgagccatgaact

SEQ ID NO: 1796 - DNA, 20 bp, Artificial Sequence
  chemically synthesized
gaacgagccatgaactgggc

SEQ ID NO: 1797 - DNA, 20 bp, Artificial Sequence
  chemically synthesized
aacgagccatgaactgggct

SEQ ID NO: 1798 - DNA, 20 bp, Artificial Sequence
  chemically synthesized
gggtttttcatatttgatga

SEQ ID NO: 1799 - DNA, 20 bp, Artificial Sequence
  chemically synthesized
gtttttcatatttgatgaaa

SEQ ID NO: 1800 - DNA, 20 bp, Artificial Sequence
  chemically synthesized
agagcctaaacgctctgatt

SEQ ID NO: 1801 - DNA, 20 bp, Artificial Sequence
  chemically synthesized
gagcctaaacgctctgattc

SEQ ID NO: 1802 - DNA, 20 bp, Artificial Sequence
  chemically synthesized
gcctaaacgctctgattcgg

SEQ ID NO: 1803 - DNA, 20 bp, Artificial Sequence
  chemically synthesized
ctaaacgctctgattcggga

SEQ ID NO: 1804 - DNA, 20 bp, Artificial Sequence
  chemically synthesized
taaacgctctgattcgggag

SEQ ID NO: 1805 - DNA, 20 bp, Artificial Sequence
  chemically synthesized
cgctctgattcgggagaggt

SEQ ID NO: 1806 - DNA, 20 bp, Artificial Sequence
  chemically synthesized
gattcgggagaggtcggata

SEQ ID NO: 1807 - DNA, 20 bp, Artificial Sequence
  chemically synthesized
ggagaggtcggataaagaaa

SEQ ID NO: 1808 - DNA, 20 bp, Artificial Sequence
  chemically synthesized
gagaggtcggataaagaaaa

SEQ ID NO: 1809 - DNA, 20 bp, Artificial Sequence
  chemically synthesized
gaggtcggataaagaaaaag

SEQ ID NO: 1810 - DNA, 20 bp, Artificial Sequence
  chemically synthesized
attaaccttgactacgcctt

SEQ ID NO: 1811 - DNA, 20 bp, Artificial Sequence
  chemically synthesized
cttgactacgcctttagctt

SEQ ID NO: 1812 - DNA, 20 bp, Artificial Sequence
  chemically synthesized
agcttcagccaccttcttaa

SEQ ID NO: 1813 - DNA, 20 bp, Artificial Sequence
  chemically synthesized
gcttcagccaccttcttaat

SEQ ID NO: 1814 - DNA, 20 bp, Artificial Sequence
  chemically synthesized
ccttcttaataggaaattgc

SEQ ID NO: 1815 - DNA, 20 bp, Artificial Sequence
  chemically synthesized
cttcttaataggaaattgct

SEQ ID NO: 1816 - DNA, 20 bp, Artificial Sequence
  chemically synthesized
cttaataggaaattgctggg

SEQ ID NO: 1817 - DNA, 20 bp, Artificial Sequence
  chemically synthesized
ttaataggaaattgctgggc

SEQ ID NO: 1818 - DNA, 20 bp, Artificial Sequence
  chemically synthesized
taggaaattgctgggcaggt

SEQ ID NO: 1819 - DNA, 20 bp, Artificial Sequence
  chemically synthesized
aggaaattgctgggcaggtt

SEQ ID NO: 1820 - DNA, 20 bp, Artificial Sequence
  chemically synthesized
ggaaattgctgggcaggttg

SEQ ID NO: 1821 - DNA, 20 bp, Artificial Sequence
  chemically synthesized
aaattgctgggcaggttggg

SEQ ID NO: 1822 - DNA, 20 bp, Artificial Sequence
  chemically synthesized
aattgctgggcaggttgggg

SEQ ID NO: 1823 - DNA, 20 bp, Artificial Sequence
  chemically synthesized
attgctgggcaggttgggga

SEQ ID NO: 1824 - DNA, 20 bp, Artificial Sequence
  chemically synthesized
ctgggcaggttggggagggc

SEQ ID NO: 1825 - DNA, 20 bp, Artificial Sequence
  chemically synthesized
aggttggggagggctagtca

SEQ ID NO: 1826 - DNA, 20 bp, Artificial Sequence
  chemically synthesized
cacggaatgaaactgtaaac

SEQ ID NO: 1827 - DNA, 20 bp, Artificial Sequence
  chemically synthesized
aatgaaactgtaaaccggac

SEQ ID NO: 1828 - DNA, 20 bp, Artificial Sequence
  chemically synthesized
atgaaactgtaaaccggacc

SEQ ID NO: 1829 - DNA, 20 bp, Artificial Sequence
  chemically synthesized
ctgtaaaccggaccgggtgt

SEQ ID NO: 1830 - DNA, 20 bp, Artificial Sequence
  chemically synthesized
tgtaaaccggaccgggtgtg

SEQ ID NO: 1831 - DNA, 20 bp, Artificial Sequence
  chemically synthesized
taaaccggaccgggtgtgag

SEQ ID NO: 1832 - DNA, 20 bp, Artificial Sequence
  chemically synthesized
aaaccggaccgggtgtgagg

SEQ ID NO: 1833 - DNA, 20 bp, Artificial Sequence
  chemically synthesized
aaccggaccgggtgtgagga

SEQ ID NO: 1834 - DNA, 20 bp, Artificial Sequence
  chemically synthesized
accggaccgggtgtgaggag

SEQ ID NO: 1835 - DNA, 20 bp, Artificial Sequence
  chemically synthesized
cggaccgggtgtgaggaggg

SEQ ID NO: 1836 - DNA, 20 bp, Artificial Sequence
  chemically synthesized
ggaccgggtgtgaggagggg

SEQ ID NO: 1837 - DNA, 20 bp, Artificial Sequence
  chemically synthesized
tgaggaggggaggtgataaa

SEQ ID NO: 1838 - DNA, 20 bp, Artificial Sequence
  chemically synthesized
gggaggtgataaaaagatta

SEQ ID NO: 1839 - DNA, 20 bp, Artificial Sequence
  chemically synthesized
ggaggtgataaaaagattac

SEQ ID NO: 1840 - DNA, 20 bp, Artificial Sequence
  chemically synthesized
gaggtgataaaaagattaca

SEQ ID NO: 1841 - DNA, 20 bp, Artificial Sequence
  chemically synthesized
gtgataaaaagattacaggg

SEQ ID NO: 1842 - DNA, 20 bp, Artificial Sequence
  chemically synthesized
gataaaaagattacagggtg

SEQ ID NO: 1843 - DNA, 20 bp, Artificial Sequence
  chemically synthesized
ataaaaagattacagggtgg

SEQ ID NO: 1844 - DNA, 20 bp, Artificial Sequence
  chemically synthesized
aaaaagattacagggtggag

SEQ ID NO: 1845 - DNA, 20 bp, Artificial Sequence
  chemically synthesized
gattacagggtggaggagct

SEQ ID NO: 1846 - DNA, 20 bp, Artificial Sequence
  chemically synthesized
attacagggtggaggagctg

SEQ ID NO: 1847 - DNA, 20 bp, Artificial Sequence
  chemically synthesized
agggtggaggagctgaggct

SEQ ID NO: 1848 - DNA, 20 bp, Artificial Sequence
  chemically synthesized
gggtggaggagctgaggctg

SEQ ID NO: 1849 - DNA, 20 bp, Artificial Sequence
  chemically synthesized
tggaggagctgaggctgagg

SEQ ID NO: 1850 - DNA, 20 bp, Artificial Sequence
  chemically synthesized
agctgaggctgaggaagatt

SEQ ID NO: 1851 - DNA, 20 bp, Artificial Sequence
  chemically synthesized
gctgaggctgaggaagattt

SEQ ID NO: 1852 - DNA, 20 bp, Artificial Sequence
  chemically synthesized
gctgaggaagatttgggacc

SEQ ID NO: 1853 - DNA, 20 bp, Artificial Sequence
  chemically synthesized
ggaagatttgggacctagct

SEQ ID NO: 1854 - DNA, 20 bp, Artificial Sequence
  chemically synthesized
atttgggacctagctcggcc

SEQ ID NO: 1855 - DNA, 20 bp, Artificial Sequence
  chemically synthesized
gggacctagctcggcctggc

SEQ ID NO: 1856 - DNA, 20 bp, Artificial Sequence
  chemically synthesized
ggacctagctcggcctggca

SEQ ID NO: 1857 - DNA, 20 bp, Artificial Sequence
  chemically synthesized
acctagctcggcctggcaag

SEQ ID NO: 1858 - DNA, 20 bp, Artificial Sequence
  chemically synthesized
tagctcggcctggcaaggag

SEQ ID NO: 1859 - DNA, 20 bp, Artificial Sequence
  chemically synthesized
cggcctggcaaggagcagcc

SEQ ID NO: 1860 - DNA, 20 bp, Artificial Sequence
  chemically synthesized
ggcctggcaaggagcagcct

SEQ ID NO: 1861 - DNA, 20 bp, Artificial Sequence
  chemically synthesized
gcctggcaaggagcagcctg

SEQ ID NO: 1862 - DNA, 20 bp, Artificial Sequence
  chemically synthesized
ctggcaaggagcagcctggg

SEQ ID NO: 1863 - DNA, 20 bp, Artificial Sequence
  chemically synthesized
tggcaaggagcagcctgggg

SEQ ID NO: 1864 - DNA, 20 bp, Artificial Sequence
  chemically synthesized
gcaaggagcagcctggggag

SEQ ID NO: 1865 - DNA, 20 bp, Artificial Sequence
  chemically synthesized
caaggagcagcctggggagg

SEQ ID NO: 1866 - DNA, 20 bp, Artificial Sequence
  chemically synthesized
aaggagcagcctggggagga

SEQ ID NO: 1867 - DNA, 20 bp, Artificial Sequence
  chemically synthesized
aggagcagcctggggaggag

SEQ ID NO: 1868 - DNA, 20 bp, Artificial Sequence
  chemically synthesized
gagcagcctggggaggaggg

SEQ ID NO: 1869 - DNA, 20 bp, Artificial Sequence
  chemically synthesized
ctggggaggaggggagacgt

SEQ ID NO: 1870 - DNA, 20 bp, Artificial Sequence
  chemically synthesized
ggaggaggggagacgtcaga

SEQ ID NO: 1871 - DNA, 20 bp, Artificial Sequence
  chemically synthesized
gaggaggggagacgtcagat

SEQ ID NO: 1872 - DNA, 20 bp, Artificial Sequence
  chemically synthesized
ggagacgtcagatgggtctg

SEQ ID NO: 1873 - DNA, 20 bp, Artificial Sequence
  chemically synthesized
cgtcagatgggtctgtagaa

SEQ ID NO: 1874 - DNA, 20 bp, Artificial Sequence
  chemically synthesized
gtcagatgggtctgtagaaa

SEQ ID NO: 1875 - DNA, 20 bp, Artificial Sequence
  chemically synthesized
agatgggtctgtagaaaagg

SEQ ID NO: 1876 - DNA, 20 bp, Artificial Sequence
  chemically synthesized
ggtctgtagaaaaggaagat

SEQ ID NO: 1877 - DNA, 20 bp, Artificial Sequence
  chemically synthesized
tgtagaaaaggaagattaga

SEQ ID NO: 1878 - DNA, 20 bp, Artificial Sequence
  chemically synthesized
aaaggaagattagaaagact

SEQ ID NO: 1879 - DNA, 20 bp, Artificial Sequence
  chemically synthesized
tagaaagactcagcgacgct

SEQ ID NO: 1880 - DNA, 20 bp, Artificial Sequence
  chemically synthesized
gaaagactcagcgacgcttg

SEQ ID NO: 1881 - DNA, 20 bp, Artificial Sequence
  chemically synthesized
gactcagcgacgcttggagt

SEQ ID NO: 1882 - DNA, 20 bp, Artificial Sequence
  chemically synthesized
actcagcgacgcttggagtt

SEQ ID NO: 1883 - DNA, 20 bp, Artificial Sequence
  chemically synthesized
cgacgcttggagttgggact

SEQ ID NO: 1884 - DNA, 20 bp, Artificial Sequence
  chemically synthesized
gacgcttggagttgggactg

SEQ ID NO: 1885 - DNA, 20 bp, Artificial Sequence
  chemically synthesized
acgcttggagttgggactga

SEQ ID NO: 1886 - DNA, 20 bp, Artificial Sequence
  chemically synthesized
cgcttggagttgggactgag

SEQ ID NO: 1887 - DNA, 20 bp, Artificial Sequence
  chemically synthesized
tggagttgggactgagggga

SEQ ID NO: 1888 - DNA, 20 bp, Artificial Sequence
  chemically synthesized
ggagttgggactgaggggac

SEQ ID NO: 1889 - DNA, 20 bp, Artificial Sequence
  chemically synthesized
gttgggactgaggggacagg

SEQ ID NO: 1890 - DNA, 20 bp, Artificial Sequence
  chemically synthesized
ttgggactgaggggacaggc

SEQ ID NO: 1891 - DNA, 20 bp, Artificial Sequence
  chemically synthesized
gggactgaggggacaggcgg

SEQ ID NO: 1892 - DNA, 20 bp, Artificial Sequence
  chemically synthesized
ggactgaggggacaggcggg

SEQ ID NO: 1893 - DNA, 20 bp, Artificial Sequence
  chemically synthesized
gactgaggggacaggcggga

SEQ ID NO: 1894 - DNA, 20 bp, Artificial Sequence
  chemically synthesized
gaggggacaggcgggaggga

SEQ ID NO: 1895 - DNA, 20 bp, Artificial Sequence
  chemically synthesized
gggacaggcgggagggaaag

SEQ ID NO: 1896 - DNA, 20 bp, Artificial Sequence
  chemically synthesized
ggacaggcgggagggaaaga

SEQ ID NO: 1897 - DNA, 20 bp, Artificial Sequence
  chemically synthesized
caggcgggagggaaagaagg

SEQ ID NO: 1898 - DNA, 20 bp, Artificial Sequence
  chemically synthesized
ggagggaaagaaggaagatt

SEQ ID NO: 1899 - DNA, 20 bp, Artificial Sequence
  chemically synthesized
gagggaaagaaggaagattt

SEQ ID NO: 1900 - DNA, 20 bp, Artificial Sequence
  chemically synthesized
aaagaaggaagatttgggac

SEQ ID NO: 1901 - DNA, 20 bp, Artificial Sequence
  chemically synthesized
agatttgggacaagttgcat

SEQ ID NO: 1902 - DNA, 20 bp, Artificial Sequence
  chemically synthesized
gatttgggacaagttgcatt

SEQ ID NO: 1903 - DNA, 20 bp, Artificial Sequence
  chemically synthesized
ttgggacaagttgcattggg

SEQ ID NO: 1904 - DNA, 20 bp, Artificial Sequence
  chemically synthesized
gggacaagttgcattgggaa

SEQ ID NO: 1905 - DNA, 20 bp, Artificial Sequence
  chemically synthesized
aagttgcattgggaagagac

SEQ ID NO: 1906 - DNA, 20 bp, Artificial Sequence
  chemically synthesized
agttgcattgggaagagact

SEQ ID NO: 1907 - DNA, 20 bp, Artificial Sequence
  chemically synthesized
gttgcattgggaagagacta

SEQ ID NO: 1908 - DNA, 20 bp, Artificial Sequence
  chemically synthesized
tgcattgggaagagactagg

SEQ ID NO: 1909 - DNA, 20 bp, Artificial Sequence
  chemically synthesized
gcattgggaagagactaggg

SEQ ID NO: 1910 - DNA, 20 bp, Artificial Sequence
  chemically synthesized
cattgggaagagactaggga

SEQ ID NO: 1911 - DNA, 20 bp, Artificial Sequence
  chemically synthesized
agggagggaccaatgtgtaa

SEQ ID NO: 1912 - DNA, 20 bp, Artificial Sequence
  chemically synthesized
ccaatgtgtaaaagaatgcc

SEQ ID NO: 1913 - DNA, 20 bp, Artificial Sequence
  chemically synthesized
gtaaaagaatgcctggacgt

SEQ ID NO: 1914 - DNA, 20 bp, Artificial Sequence
  chemically synthesized
taaaagaatgcctggacgtc

SEQ ID NO: 1915 - DNA, 20 bp, Artificial Sequence
  chemically synthesized
tgcctggacgtcaggcacct

SEQ ID NO: 1916 - DNA, 20 bp, Artificial Sequence
  chemically synthesized
gttttacgacaaaaattatt

SEQ ID NO: 1917 - DNA, 20 bp, Artificial Sequence
  chemically synthesized
caaaaattatttagatcttg

SEQ ID NO: 1918 - DNA, 20 bp, Artificial Sequence
  chemically synthesized
attatttagatcttgaagaa

SEQ ID NO: 1919 - DNA, 20 bp, Artificial Sequence
  chemically synthesized
ttgaagaatggaaaaattga

SEQ ID NO: 1920 - DNA, 20 bp, Artificial Sequence
  chemically synthesized
aaattgaaagtgccattttc

SEQ ID NO: 1921 - DNA, 20 bp, Artificial Sequence
  chemically synthesized
agtgccattttctggctatt

SEQ ID NO: 1922 - DNA, 20 bp, Artificial Sequence
  chemically synthesized
ggctatttggaaccactgtc

SEQ ID NO: 1923 - DNA, 20 bp, Artificial Sequence
  chemically synthesized
aaccactgtcgagtttgtat

SEQ ID NO: 1924 - DNA, 20 bp, Artificial Sequence
  chemically synthesized
ccactgtcgagtttgtattg

SEQ ID NO: 1925 - DNA, 20 bp, Artificial Sequence
  chemically synthesized
gtcgagtttgtattggagtc

SEQ ID NO: 1926 - DNA, 20 bp, Artificial Sequence
  chemically synthesized
gagtttgtattggagtcaag

SEQ ID NO: 1927 - DNA, 20 bp, Artificial Sequence
  chemically synthesized
attggagtcaagcggccttg

SEQ ID NO: 1928 - DNA, 20 bp, Artificial Sequence
  chemically synthesized
ggagtcaagcggccttgcag

SEQ ID NO: 1929 - DNA, 20 bp, Artificial Sequence
  chemically synthesized
gcggccttgcagaagaaaat

SEQ ID NO: 1930 - DNA, 20 bp, Artificial Sequence
  chemically synthesized
cggccttgcagaagaaaata

SEQ ID NO: 1931 - DNA, 20 bp, Artificial Sequence
  chemically synthesized
gcagaagaaaataaggcatt

SEQ ID NO: 1932 - DNA, 20 bp, Artificial Sequence
  chemically synthesized
cagaagaaaataaggcattt

SEQ ID NO: 1933 - DNA, 20 bp, Artificial Sequence
  chemically synthesized
aaaataaggcatttaggttt

SEQ ID NO: 1934 - DNA, 20 bp, Artificial Sequence
  chemically synthesized
aaataaggcatttaggtttt

SEQ ID NO: 1935 - DNA, 20 bp, Artificial Sequence
  chemically synthesized
aaggcatttaggttttaggt

SEQ ID NO: 1936 - DNA, 20 bp, Artificial Sequence
  chemically synthesized
aggcatttaggttttaggtc

SEQ ID NO: 1937 - DNA, 20 bp, Artificial Sequence
  chemically synthesized
ttaggttttaggtcaggtgt

SEQ ID NO: 1938 - DNA, 20 bp, Artificial Sequence
  chemically synthesized
tttaggtcaggtgtgagttg

SEQ ID NO: 1939 - DNA, 20 bp, Artificial Sequence
  chemically synthesized
taggtcaggtgtgagttgaa

SEQ ID NO: 1940 - DNA, 20 bp, Artificial Sequence
  chemically synthesized
aggtcaggtgtgagttgaag

SEQ ID NO: 1941 - DNA, 20 bp, Artificial Sequence
  chemically synthesized
gtgtgagttgaagaggtttt

SEQ ID NO: 1942 - DNA, 20 bp, Artificial Sequence
  chemically synthesized
tgaagaggttttaagttctt

SEQ ID NO: 1943 - DNA, 20 bp, Artificial Sequence
  chemically synthesized
aagaggttttaagttcttga

SEQ ID NO: 1944 - DNA, 20 bp, Artificial Sequence
  chemically synthesized
gttttaagttcttgagagca

SEQ ID NO: 1945 - DNA, 20 bp, Artificial Sequence
  chemically synthesized
ttttaagttcttgagagcac

SEQ ID NO: 1946 - DNA, 20 bp, Artificial Sequence
  chemically synthesized
agttcttgagagcacaggct

SEQ ID NO: 1947 - DNA, 20 bp, Artificial Sequence
  chemically synthesized
gttcttgagagcacaggcta

SEQ ID NO: 1948 - DNA, 20 bp, Artificial Sequence
  chemically synthesized
ttcttgagagcacaggctaa

SEQ ID NO: 1949 - DNA, 20 bp, Artificial Sequence
  chemically synthesized
cttgagagcacaggctaagg

SEQ ID NO: 1950 - DNA, 20 bp, Artificial Sequence
  chemically synthesized
tgagagcacaggctaaggga

SEQ ID NO: 1951 - DNA, 20 bp, Artificial Sequence
  chemically synthesized
gagagcacaggctaagggag

SEQ ID NO: 1952 - DNA, 20 bp, Artificial Sequence
  chemically synthesized
agagcacaggctaagggaga

SEQ ID NO: 1953 - DNA, 20 bp, Artificial Sequence
  chemically synthesized
agcacaggctaagggagagg

SEQ ID NO: 1954 - DNA, 20 bp, Artificial Sequence
  chemically synthesized
gcacaggctaagggagaggg

SEQ ID NO: 1955 - DNA, 20 bp, Artificial Sequence
  chemically synthesized
ggctaagggagagggaggaa

SEQ ID NO: 1956 - DNA, 20 bp, Artificial Sequence
  chemically synthesized
ctaagggagagggaggaatg

SEQ ID NO: 1957 - DNA, 20 bp, Artificial Sequence
  chemically synthesized
taagggagagggaggaatgg

SEQ ID NO: 1958 - DNA, 20 bp, Artificial Sequence
  chemically synthesized
aagggagagggaggaatgga

SEQ ID NO: 1959 - DNA, 20 bp, Artificial Sequence
  chemically synthesized
ggagagggaggaatggaggg

SEQ ID NO: 1960 - DNA, 20 bp, Artificial Sequence
  chemically synthesized
gagggaggaatggagggtgg

SEQ ID NO: 1961 - DNA, 20 bp, Artificial Sequence
  chemically synthesized
agggaggaatggagggtgga

SEQ ID NO: 1962 - DNA, 20 bp, Artificial Sequence
  chemically synthesized
ggagggtggaaggttgcccc

SEQ ID NO: 1963 - DNA, 20 bp, Artificial Sequence
  chemically synthesized
gtggaaggttgcccctagtg

SEQ ID NO: 1964 - DNA, 20 bp, Artificial Sequence
  chemically synthesized
tggaaggttgcccctagtga

SEQ ID NO: 1965 - DNA, 20 bp, Artificial Sequence
  chemically synthesized
gaaggttgcccctagtgaag

SEQ ID NO: 1966 - DNA, 20 bp, Artificial Sequence
  chemically synthesized
aaggttgcccctagtgaagg

SEQ ID NO: 1967 - DNA, 20 bp, Artificial Sequence
  chemically synthesized
ttgcccctagtgaaggaggc

SEQ ID NO: 1968 - DNA, 20 bp, Artificial Sequence
  chemically synthesized
cctagtgaaggaggcaagcc

SEQ ID NO: 1969 - DNA, 20 bp, Artificial Sequence
  chemically synthesized
tagtgaaggaggcaagccca

SEQ ID NO: 1970 - DNA, 20 bp, Artificial Sequence
  chemically synthesized
aaggaggcaagcccagagaa

SEQ ID NO: 1971 - DNA, 20 bp, Artificial Sequence
  chemically synthesized
aggcaagcccagagaaaaga

SEQ ID NO: 1972 - DNA, 20 bp, Artificial Sequence
  chemically synthesized
gcaagcccagagaaaagaaa

SEQ ID NO: 1973 - DNA, 20 bp, Artificial Sequence
  chemically synthesized
cccagagaaaagaaagagta

SEQ ID NO: 1974 - DNA, 20 bp, Artificial Sequence
  chemically synthesized
gaaaagaaagagtacagaca

SEQ ID NO: 1975 - DNA, 20 bp, Artificial Sequence
  chemically synthesized
aaagaaagagtacagacacg

SEQ ID NO: 1976 - DNA, 20 bp, Artificial Sequence
  chemically synthesized
aagaaagagtacagacacgg

SEQ ID NO: 1977 - DNA, 20 bp, Artificial Sequence
  chemically synthesized
agaaagagtacagacacgga

SEQ ID NO: 1978 - DNA, 20 bp, Artificial Sequence
  chemically synthesized
aagagtacagacacggaggg

SEQ ID NO: 1979 - DNA, 20 bp, Artificial Sequence
  chemically synthesized
agagtacagacacggaggga

SEQ ID NO: 1980 - DNA, 20 bp, Artificial Sequence
  chemically synthesized
gagtacagacacggagggaa

SEQ ID NO: 1981 - DNA, 20 bp, Artificial Sequence
  chemically synthesized
agtacagacacggagggaag

SEQ ID NO: 1982 - DNA, 20 bp, Artificial Sequence
  chemically synthesized
agacacggagggaaggggtt

SEQ ID NO: 1983 - DNA, 20 bp, Artificial Sequence
  chemically synthesized
gacacggagggaaggggttc

SEQ ID NO: 1984 - DNA, 20 bp, Artificial Sequence
  chemically synthesized
acacggagggaaggggttcg

SEQ ID NO: 1985 - DNA, 20 bp, Artificial Sequence
  chemically synthesized
cacggagggaaggggttcgg

SEQ ID NO: 1986 - DNA, 20 bp, Artificial Sequence
  chemically synthesized
gttcgggggttcttactcac

SEQ ID NO: 1987 - DNA, 20 bp, Artificial Sequence
  chemically synthesized
gttcttactcaccagaaaaa

SEQ ID NO: 1988 - DNA, 20 bp, Artificial Sequence
  chemically synthesized
ttcttactcaccagaaaaat

SEQ ID NO: 1989 - DNA, 20 bp, Artificial Sequence
  chemically synthesized
tactcaccagaaaaatgggc

SEQ ID NO: 1990 - DNA, 20 bp, Artificial Sequence
  chemically synthesized
actcaccagaaaaatgggca

SEQ ID NO: 1991 - DNA, 20 bp, Artificial Sequence
  chemically synthesized
ctcaccagaaaaatgggcaa

SEQ ID NO: 1992 - DNA, 20 bp, Artificial Sequence
  chemically synthesized
tcaccagaaaaatgggcaag

SEQ ID NO: 1993 - DNA, 20 bp, Artificial Sequence
  chemically synthesized
cagaaaaatgggcaaggggt

SEQ ID NO: 1994 - DNA, 20 bp, Artificial Sequence
  chemically synthesized
agaaaaatgggcaaggggtt

SEQ ID NO: 1995 - DNA, 20 bp, Artificial Sequence
  chemically synthesized
gaaaaatgggcaaggggttg

SEQ ID NO: 1996 - DNA, 20 bp, Artificial Sequence
  chemically synthesized
atgggcaaggggttggggca

SEQ ID NO: 1997 - DNA, 20 bp, Artificial Sequence
  chemically synthesized
aggggttggggcacggaaat

SEQ ID NO: 1998 - DNA, 20 bp, Artificial Sequence
  chemically synthesized
ggggttggggcacggaaata

SEQ ID NO: 1999 - DNA, 20 bp, Artificial Sequence
  chemically synthesized
gggttggggcacggaaataa

SEQ ID NO: 2000 - DNA, 20 bp, Artificial Sequence
  chemically synthesized
ggttggggcacggaaataag

SEQ ID NO: 2001 - DNA, 20 bp, Artificial Sequence
  chemically synthesized
ggggcacggaaataaggggt

SEQ ID NO: 2002 - DNA, 20 bp, Artificial Sequence
  chemically synthesized
gggcacggaaataaggggtt

SEQ ID NO: 2003 - DNA, 20 bp, Artificial Sequence
  chemically synthesized
ggcacggaaataaggggttg

SEQ ID NO: 2004 - DNA, 20 bp, Artificial Sequence
  chemically synthesized
ggaaataaggggttggggtg

SEQ ID NO: 2005 - DNA, 20 bp, Artificial Sequence
  chemically synthesized
aaataaggggttggggtgca

SEQ ID NO: 2006 - DNA, 20 bp, Artificial Sequence
  chemically synthesized
aggggttggggtgcagagat

SEQ ID NO: 2007 - DNA, 20 bp, Artificial Sequence
  chemically synthesized
gggttggggtgcagagataa

SEQ ID NO: 2008 - DNA, 20 bp, Artificial Sequence
  chemically synthesized
ggttggggtgcagagataag

SEQ ID NO: 2009 - DNA, 20 bp, Artificial Sequence
  chemically synthesized
ggggtgcagagataagaggt

SEQ ID NO: 2010 - DNA, 20 bp, Artificial Sequence
  chemically synthesized
gggtgcagagataagaggtc

SEQ ID NO: 2011 - DNA, 20 bp, Artificial Sequence
  chemically synthesized
ggtgcagagataagaggtca

SEQ ID NO: 2012 - DNA, 20 bp, Artificial Sequence
  chemically synthesized
agagataagaggtcagggca

SEQ ID NO: 2013 - DNA, 20 bp, Artificial Sequence
  chemically synthesized
agaggtcagggcacagaaat

SEQ ID NO: 2014 - DNA, 20 bp, Artificial Sequence
  chemically synthesized
gaggtcagggcacagaaata

SEQ ID NO: 2015 - DNA, 20 bp, Artificial Sequence
  chemically synthesized
aggtcagggcacagaaataa

SEQ ID NO: 2016 - DNA, 20 bp, Artificial Sequence
  chemically synthesized
ggtcagggcacagaaataag

SEQ ID NO: 2017 - DNA, 20 bp, Artificial Sequence
  chemically synthesized
agggcacagaaataaggggt

SEQ ID NO: 2018 - DNA, 20 bp, Artificial Sequence
  chemically synthesized
gggcacagaaataaggggtt

SEQ ID NO: 2019 - DNA, 20 bp, Artificial Sequence
  chemically synthesized
ggcacagaaataaggggttg

SEQ ID NO: 2020 - DNA, 20 bp, Artificial Sequence
  chemically synthesized
agaaataaggggttggggtg

SEQ ID NO: 2021 - DNA, 20 bp, Artificial Sequence
  chemically synthesized
aaataaggggttggggtgca

SEQ ID NO: 2022 - DNA, 20 bp, Artificial Sequence
  chemically synthesized
aggggttggggtgcagagat

SEQ ID NO: 2023 - DNA, 20 bp, Artificial Sequence
  chemically synthesized
gggttggggtgcagagataa

SEQ ID NO: 2024 - DNA, 20 bp, Artificial Sequence
  chemically synthesized
ggttggggtgcagagataag

SEQ ID NO: 2025 - DNA, 20 bp, Artificial Sequence
  chemically synthesized
ggggtgcagagataagaggt

SEQ ID NO: 2026 - DNA, 20 bp, Artificial Sequence
  chemically synthesized
gggtgcagagataagaggtt

SEQ ID NO: 2027 - DNA, 20 bp, Artificial Sequence
  chemically synthesized
ggtgcagagataagaggttg

SEQ ID NO: 2028 - DNA, 20 bp, Artificial Sequence
  chemically synthesized
agagataagaggttggggca

SEQ ID NO: 2029 - DNA, 20 bp, Artificial Sequence
  chemically synthesized
agaggttggggcacagaaat

SEQ ID NO: 2030 - DNA, 20 bp, Artificial Sequence
  chemically synthesized
gaggttggggcacagaaata

SEQ ID NO: 2031 - DNA, 20 bp, Artificial Sequence
  chemically synthesized
aggttggggcacagaaataa

SEQ ID NO: 2032 - DNA, 20 bp, Artificial Sequence
  chemically synthesized
ggggcacagaaataagggat

SEQ ID NO: 2033 - DNA, 20 bp, Artificial Sequence
  chemically synthesized
gggcacagaaataagggatc

SEQ ID NO: 2034 - DNA, 20 bp, Artificial Sequence
  chemically synthesized
ggcacagaaataagggatcg

SEQ ID NO: 2035 - DNA, 20 bp, Artificial Sequence
  chemically synthesized
agaaataagggatcggggtg

SEQ ID NO: 2036 - DNA, 20 bp, Artificial Sequence
  chemically synthesized
aaataagggatcggggtgca

SEQ ID NO: 2037 - DNA, 20 bp, Artificial Sequence
  chemically synthesized
agggatcggggtgcagagat

SEQ ID NO: 2038 - DNA, 20 bp, Artificial Sequence
  chemically synthesized
ggatcggggtgcagagataa

SEQ ID NO: 2039 - DNA, 20 bp, Artificial Sequence
  chemically synthesized
gatcggggtgcagagataag

SEQ ID NO: 2040 - DNA, 20 bp, Artificial Sequence
  chemically synthesized
ggggtgcagagataagaggt

SEQ ID NO: 2041 - DNA, 20 bp, Artificial Sequence
  chemically synthesized
gggtgcagagataagaggtt

SEQ ID NO: 2042 - DNA, 20 bp, Artificial Sequence
  chemically synthesized
ggtgcagagataagaggttg

SEQ ID NO: 2043 - DNA, 20 bp, Artificial Sequence
  chemically synthesized
agagataagaggttggggtg

SEQ ID NO: 2044 - DNA, 20 bp, Artificial Sequence
  chemically synthesized
agaggttggggtgcagaaat

SEQ ID NO: 2045 - DNA, 20 bp, Artificial Sequence
  chemically synthesized
gaggttggggtgcagaaata

SEQ ID NO: 2046 - DNA, 20 bp, Artificial Sequence
  chemically synthesized
aggttggggtgcagaaataa

SEQ ID NO: 2047 - DNA, 20 bp, Artificial Sequence
  chemically synthesized
ggggtgcagaaataagggat

SEQ ID NO: 2048 - DNA, 20 bp, Artificial Sequence
  chemically synthesized
gggtgcagaaataagggatc

SEQ ID NO: 2049 - DNA, 20 bp, Artificial Sequence
  chemically synthesized
ggtgcagaaataagggatca

SEQ ID NO: 2050 - DNA, 20 bp, Artificial Sequence
  chemically synthesized
agaaataagggatcagggtg

SEQ ID NO: 2051 - DNA, 20 bp, Artificial Sequence
  chemically synthesized
aaataagggatcagggtgca

SEQ ID NO: 2052 - DNA, 20 bp, Artificial Sequence
  chemically synthesized
agggatcagggtgcagagat

SEQ ID NO: 2053 - DNA, 20 bp, Artificial Sequence
  chemically synthesized
ggatcagggtgcagagataa

SEQ ID NO: 2054 - DNA, 20 bp, Artificial Sequence
  chemically synthesized
gatcagggtgcagagataag

SEQ ID NO: 2055 - DNA, 20 bp, Artificial Sequence
  chemically synthesized
agggtgcagagataagaggt

SEQ ID NO: 2056 - DNA, 20 bp, Artificial Sequence
  chemically synthesized
gggtgcagagataagaggtc

SEQ ID NO: 2057 - DNA, 20 bp, Artificial Sequence
  chemically synthesized
ggtgcagagataagaggtcg

SEQ ID NO: 2058 - DNA, 20 bp, Artificial Sequence
  chemically synthesized
agagataagaggtcggggtg

SEQ ID NO: 2059 - DNA, 20 bp, Artificial Sequence
  chemically synthesized
agaggtcggggtgcagaaat

SEQ ID NO: 2060 - DNA, 20 bp, Artificial Sequence
  chemically synthesized
gaggtcggggtgcagaaata

SEQ ID NO: 2061 - DNA, 20 bp, Artificial Sequence
  chemically synthesized
aggtcggggtgcagaaataa

SEQ ID NO: 2062 - DNA, 20 bp, Artificial Sequence
  chemically synthesized
ggggtgcagaaataagggat

SEQ ID NO: 2063 - DNA, 20 bp, Artificial Sequence
  chemically synthesized
gggtgcagaaataagggatt

SEQ ID NO: 2064 - DNA, 20 bp, Artificial Sequence
  chemically synthesized
ggtgcagaaataagggattg

SEQ ID NO: 2065 - DNA, 20 bp, Artificial Sequence
  chemically synthesized
agaaataagggattggggtg

SEQ ID NO: 2066 - DNA, 20 bp, Artificial Sequence
  chemically synthesized
aaataagggattggggtgca

SEQ ID NO: 2067 - DNA, 20 bp, Artificial Sequence
  chemically synthesized
agggattggggtgcagagat

SEQ ID NO: 2068 - DNA, 20 bp, Artificial Sequence
  chemically synthesized
ggattggggtgcagagataa

SEQ ID NO: 2069 - DNA, 20 bp, Artificial Sequence
  chemically synthesized
gattggggtgcagagataag

SEQ ID NO: 2070 - DNA, 20 bp, Artificial Sequence
  chemically synthesized
ggggtgcagagataagagga

SEQ ID NO: 2071 - DNA, 20 bp, Artificial Sequence
  chemically synthesized
gggtgcagagataagaggat

SEQ ID NO: 2072 - DNA, 20 bp, Artificial Sequence
  chemically synthesized
ggtgcagagataagaggatg

SEQ ID NO: 2073 - DNA, 20 bp, Artificial Sequence
  chemically synthesized
agagataagaggatggggcg

SEQ ID NO: 2074 - DNA, 20 bp, Artificial Sequence
  chemically synthesized
agaggatggggcgtggaaat

SEQ ID NO: 2075 - DNA, 20 bp, Artificial Sequence
  chemically synthesized
gaggatggggcgtggaaata

SEQ ID NO: 2076 - DNA, 20 bp, Artificial Sequence
  chemically synthesized
aggatggggcgtggaaataa

SEQ ID NO: 2077 - DNA, 20 bp, Artificial Sequence
  chemically synthesized
tggggcgtggaaataaggga

SEQ ID NO: 2078 - DNA, 20 bp, Artificial Sequence
  chemically synthesized
ggggcgtggaaataagggat

SEQ ID NO: 2079 - DNA, 20 bp, Artificial Sequence
  chemically synthesized
gggcgtggaaataagggatg

SEQ ID NO: 2080 - DNA, 20 bp, Artificial Sequence
  chemically synthesized
gaaataagggatggggtgct

SEQ ID NO: 2081 - DNA, 20 bp, Artificial Sequence
  chemically synthesized
aagggatggggtgctgagat

SEQ ID NO: 2082 - DNA, 20 bp, Artificial Sequence
  chemically synthesized
gggatggggtgctgagataa

SEQ ID NO: 2083 - DNA, 20 bp, Artificial Sequence
  chemically synthesized
ggatggggtgctgagataag

SEQ ID NO: 2084 - DNA, 20 bp, Artificial Sequence
  chemically synthesized
ggggtgctgagataagaggt

SEQ ID NO: 2085 - DNA, 20 bp, Artificial Sequence
  chemically synthesized
gggtgctgagataagaggtt

SEQ ID NO: 2086 - DNA, 20 bp, Artificial Sequence
  chemically synthesized
ggtgctgagataagaggttg

SEQ ID NO: 2087 - DNA, 20 bp, Artificial Sequence
  chemically synthesized
tgagataagaggttggggca

SEQ ID NO: 2088 - DNA, 20 bp, Artificial Sequence
  chemically synthesized
agaggttggggcacagaaat

SEQ ID NO: 2089 - DNA, 20 bp, Artificial Sequence
  chemically synthesized
gaggttggggcacagaaata

SEQ ID NO: 2090 - DNA, 20 bp, Artificial Sequence
  chemically synthesized
aggttggggcacagaaataa

SEQ ID NO: 2091 - DNA, 20 bp, Artificial Sequence
  chemically synthesized
ggggcacagaaataagggat

SEQ ID NO: 2092 - DNA, 20 bp, Artificial Sequence
  chemically synthesized
gggcacagaaataagggatt

SEQ ID NO: 2093 - DNA, 20 bp, Artificial Sequence
  chemically synthesized
ggcacagaaataagggattg

SEQ ID NO: 2094 - DNA, 20 bp, Artificial Sequence
  chemically synthesized
gggattggggttcttgcccc

SEQ ID NO: 2095 - DNA, 20 bp, Artificial Sequence
  chemically synthesized
tggggttcttgcccccagaa

SEQ ID NO: 2096 - DNA, 20 bp, Artificial Sequence
  chemically synthesized
ggttcttgcccccagaaaag

SEQ ID NO: 2097 - DNA, 20 bp, Artificial Sequence
  chemically synthesized
ttgcccccagaaaagcagtg

SEQ ID NO: 2098 - DNA, 20 bp, Artificial Sequence
  chemically synthesized
tgcccccagaaaagcagtga

SEQ ID NO: 2099 - DNA, 20 bp, Artificial Sequence
  chemically synthesized
gcccccagaaaagcagtgaa

SEQ ID NO: 2100 - DNA, 20 bp, Artificial Sequence
  chemically synthesized
cccccagaaaagcagtgaag

SEQ ID NO: 2101 - DNA, 20 bp, Artificial Sequence
  chemically synthesized
ccagaaaagcagtgaagggg

SEQ ID NO: 2102 - DNA, 20 bp, Artificial Sequence
  chemically synthesized
agaaaagcagtgaaggggca

SEQ ID NO: 2103 - DNA, 20 bp, Artificial Sequence
  chemically synthesized
gcagtgaaggggcagagaca

SEQ ID NO: 2104 - DNA, 20 bp, Artificial Sequence
  chemically synthesized
agtgaaggggcagagacatg

SEQ ID NO: 2105 - DNA, 20 bp, Artificial Sequence
  chemically synthesized
tgaaggggcagagacatgga

SEQ ID NO: 2106 - DNA, 20 bp, Artificial Sequence
  chemically synthesized
aggggcagagacatggagag

SEQ ID NO: 2107 - DNA, 20 bp, Artificial Sequence
  chemically synthesized
ggggcagagacatggagaga

SEQ ID NO: 2108 - DNA, 20 bp, Artificial Sequence
  chemically synthesized
gggcagagacatggagagaa

SEQ ID NO: 2109 - DNA, 20 bp, Artificial Sequence
  chemically synthesized
ggcagagacatggagagaag

SEQ ID NO: 2110 - DNA, 20 bp, Artificial Sequence
  chemically synthesized
gagacatggagagaaggggt

SEQ ID NO: 2111 - DNA, 20 bp, Artificial Sequence
  chemically synthesized
agacatggagagaaggggtt

SEQ ID NO: 2112 - DNA, 20 bp, Artificial Sequence
  chemically synthesized
gacatggagagaaggggttg

SEQ ID NO: 2113 - DNA, 20 bp, Artificial Sequence
  chemically synthesized
ttggggtacttacccccctc

SEQ ID NO: 2114 - DNA, 20 bp, Artificial Sequence
  chemically synthesized
gtacttacccccctccagaa

SEQ ID NO: 2115 - DNA, 20 bp, Artificial Sequence
  chemically synthesized
cttacccccctccagaaaag

SEQ ID NO: 2116 - DNA, 20 bp, Artificial Sequence
  chemically synthesized
ttacccccctccagaaaagt

SEQ ID NO: 2117 - DNA, 20 bp, Artificial Sequence
  chemically synthesized
gaaaagtgggatttgccgct

SEQ ID NO: 2118 - DNA, 20 bp, Artificial Sequence
  chemically synthesized
aaaagtgggatttgccgcta

SEQ ID NO: 2119 - DNA, 20 bp, Artificial Sequence
  chemically synthesized
aaagtgggatttgccgctaa

SEQ ID NO: 2120 - DNA, 20 bp, Artificial Sequence
  chemically synthesized
gggatttgccgctaagggtg

SEQ ID NO: 2121 - DNA, 20 bp, Artificial Sequence
  chemically synthesized
ggatttgccgctaagggtga

SEQ ID NO: 2122 - DNA, 20 bp, Artificial Sequence
  chemically synthesized
gccgctaagggtgaaggacc

SEQ ID NO: 2123 - DNA, 20 bp, Artificial Sequence
  chemically synthesized
ccgctaagggtgaaggacca

SEQ ID NO: 2124 - DNA, 20 bp, Artificial Sequence
  chemically synthesized
ctaagggtgaaggaccaagg

SEQ ID NO: 2125 - DNA, 20 bp, Artificial Sequence
  chemically synthesized
taagggtgaaggaccaaggc

SEQ ID NO: 2126 - DNA, 20 bp, Artificial Sequence
  chemically synthesized
ccaaggcaggcatccctgcg

SEQ ID NO: 2127 - DNA, 20 bp, Artificial Sequence
  chemically synthesized
ggtctgacacctctgaaaca

SEQ ID NO: 2128 - DNA, 20 bp, Artificial Sequence
  chemically synthesized
ctgaaacatggtttaataat

SEQ ID NO: 2129 - DNA, 20 bp, Artificial Sequence
  chemically synthesized
gaaacatggtttaataatca

SEQ ID NO: 2130 - DNA, 20 bp, Artificial Sequence
  chemically synthesized
aacatggtttaataatcaga

SEQ ID NO: 2131 - DNA, 20 bp, Artificial Sequence
  chemically synthesized
acatggtttaataatcagag

SEQ ID NO: 2132 - DNA, 20 bp, Artificial Sequence
  chemically synthesized
ccctgcaatgattaaacacc

SEQ ID NO: 2133 - DNA, 20 bp, Artificial Sequence
  chemically synthesized
cctgcaatgattaaacacca

SEQ ID NO: 2134 - DNA, 20 bp, Artificial Sequence
  chemically synthesized
ctgcaatgattaaacaccaa

SEQ ID NO: 2135 - DNA, 20 bp, Artificial Sequence
  chemically synthesized
caatgattaaacaccaaggg

SEQ ID NO: 2136 - DNA, 20 bp, Artificial Sequence
  chemically synthesized
aatgattaaacaccaaggga

SEQ ID NO: 2137 - DNA, 20 bp, Artificial Sequence
  chemically synthesized
ccaagggaaggctgccttcc

SEQ ID NO: 2138 - DNA, 20 bp, Artificial Sequence
  chemically synthesized
ctgccttcccagtccgtgac

SEQ ID NO: 2139 - DNA, 20 bp, Artificial Sequence
  chemically synthesized
tcccagtccgtgactggcac

SEQ ID NO: 2140 - DNA, 20 bp, Artificial Sequence
  chemically synthesized
ccagtccgtgactggcaccg

SEQ ID NO: 2141 - DNA, 20 bp, Artificial Sequence
  chemically synthesized
cgtgactggcaccggagttt

SEQ ID NO: 2142 - DNA, 20 bp, Artificial Sequence
  chemically synthesized
gtgactggcaccggagtttt

SEQ ID NO: 2143 - DNA, 20 bp, Artificial Sequence
  chemically synthesized
gcaccggagttttgggtcca

SEQ ID NO: 2144 - DNA, 20 bp, Artificial Sequence
  chemically synthesized
catgtctcctttgtctctac

SEQ ID NO: 2145 - DNA, 20 bp, Artificial Sequence
  chemically synthesized
ttgtctctactggaaaatga

SEQ ID NO: 2146 - DNA, 20 bp, Artificial Sequence
  chemically synthesized
tgtctctactggaaaatgaa

SEQ ID NO: 2147 - DNA, 20 bp, Artificial Sequence
  chemically synthesized
aaatgaaaggaattgaaatt

SEQ ID NO: 2148 - DNA, 20 bp, Artificial Sequence
  chemically synthesized
atgaaaggaattgaaattaa

SEQ ID NO: 2149 - DNA, 20 bp, Artificial Sequence
  chemically synthesized
aaaggaattgaaattaagag

SEQ ID NO: 2150 - DNA, 20 bp, Artificial Sequence
  chemically synthesized
aaggaattgaaattaagaga

SEQ ID NO: 2151 - DNA, 20 bp, Artificial Sequence
  chemically synthesized
aggaattgaaattaagagaa

SEQ ID NO: 2152 - DNA, 20 bp, Artificial Sequence
  chemically synthesized
gaattgaaattaagagaagg

SEQ ID NO: 2153 - DNA, 20 bp, Artificial Sequence
  chemically synthesized
ttaagagaagggagaaattg

SEQ ID NO: 2154 - DNA, 20 bp, Artificial Sequence
  chemically synthesized
agaagggagaaattgaagtg

SEQ ID NO: 2155 - DNA, 20 bp, Artificial Sequence
  chemically synthesized
agaaattgaagtgtggtgcc

SEQ ID NO: 2156 - DNA, 20 bp, Artificial Sequence
  chemically synthesized
aagtgtggtgccaagattga

SEQ ID NO: 2157 - DNA, 20 bp, Artificial Sequence
  chemically synthesized
agtgtggtgccaagattgaa

SEQ ID NO: 2158 - DNA, 20 bp, Artificial Sequence
  chemically synthesized
tgtggtgccaagattgaaag

SEQ ID NO: 2159 - DNA, 20 bp, Artificial Sequence
  chemically synthesized
gtgccaagattgaaaggaga

SEQ ID NO: 2160 - DNA, 20 bp, Artificial Sequence
  chemically synthesized
ccaagattgaaaggagaaag

SEQ ID NO: 2161 - DNA, 20 bp, Artificial Sequence
  chemically synthesized
attgaaaggagaaagaagtt

SEQ ID NO: 2162 - DNA, 20 bp, Artificial Sequence
  chemically synthesized
ttgaaaggagaaagaagttg

SEQ ID NO: 2163 - DNA, 20 bp, Artificial Sequence
  chemically synthesized
tgaaaggagaaagaagttga

SEQ ID NO: 2164 - DNA, 20 bp, Artificial Sequence
  chemically synthesized
aggagaaagaagttgaggga

SEQ ID NO: 2165 - DNA, 20 bp, Artificial Sequence
  chemically synthesized
gaaagaagttgagggatagt

SEQ ID NO: 2166 - DNA, 20 bp, Artificial Sequence
  chemically synthesized
aaagaagttgagggatagtg

SEQ ID NO: 2167 - DNA, 20 bp, Artificial Sequence
  chemically synthesized
aagaagttgagggatagtga

SEQ ID NO: 2168 - DNA, 20 bp, Artificial Sequence
  chemically synthesized
gaagttgagggatagtgagg

SEQ ID NO: 2169 - DNA, 20 bp, Artificial Sequence
  chemically synthesized
aagttgagggatagtgaggg

SEQ ID NO: 2170 - DNA, 20 bp, Artificial Sequence
  chemically synthesized
tgagggatagtgagggaggt

SEQ ID NO: 2171 - DNA, 20 bp, Artificial Sequence
  chemically synthesized
agggatagtgagggaggttg

SEQ ID NO: 2172 - DNA, 20 bp, Artificial Sequence
  chemically synthesized
gatagtgagggaggttggag

SEQ ID NO: 2173 - DNA, 20 bp, Artificial Sequence
  chemically synthesized
gtgagggaggttggagaaga

SEQ ID NO: 2174 - DNA, 20 bp, Artificial Sequence
  chemically synthesized
aggttggagaagacagtaaa

SEQ ID NO: 2175 - DNA, 20 bp, Artificial Sequence
  chemically synthesized
gttggagaagacagtaaaaa

SEQ ID NO: 2176 - DNA, 20 bp, Artificial Sequence
  chemically synthesized
ttggagaagacagtaaaaag

SEQ ID NO: 2177 - DNA, 20 bp, Artificial Sequence
  chemically synthesized
agtaaaaagaggccacttac

SEQ ID NO: 2178 - DNA, 20 bp, Artificial Sequence
  chemically synthesized
ccacttaccggatttgaaat

SEQ ID NO: 2179 - DNA, 20 bp, Artificial Sequence
  chemically synthesized
gaaattggtgaaatgtttct

SEQ ID NO: 2180 - DNA, 20 bp, Artificial Sequence
  chemically synthesized
aaattggtgaaatgtttctt

SEQ ID NO: 2181 - DNA, 20 bp, Artificial Sequence
  chemically synthesized
tggtgaaatgtttcttgggc

SEQ ID NO: 2182 - DNA, 20 bp, Artificial Sequence
  chemically synthesized
gaaatgtttcttgggctggt

SEQ ID NO: 2183 - DNA, 20 bp, Artificial Sequence
  chemically synthesized
tttcttgggctggtcagttt

SEQ ID NO: 2184 - DNA, 20 bp, Artificial Sequence
  chemically synthesized
ttcttgggctggtcagtttg

SEQ ID NO: 2185 - DNA, 20 bp, Artificial Sequence
  chemically synthesized
gctggtcagtttgaggacct

SEQ ID NO: 2186 - DNA, 20 bp, Artificial Sequence
  chemically synthesized
ctggtcagtttgaggacctg

SEQ ID NO: 2187 - DNA, 20 bp, Artificial Sequence
  chemically synthesized
agtttgaggacctgaggtcg

SEQ ID NO: 2188 - DNA, 20 bp, Artificial Sequence
  chemically synthesized
gtttgaggacctgaggtcgt

SEQ ID NO: 2189 - DNA, 20 bp, Artificial Sequence
  chemically synthesized
tgaggacctgaggtcgtagg

SEQ ID NO: 2190 - DNA, 20 bp, Artificial Sequence
  chemically synthesized
tcgtaggtggatctttctca

SEQ ID NO: 2191 - DNA, 20 bp, Artificial Sequence
  chemically synthesized
gtaggtggatctttctcacg

SEQ ID NO: 2192 - DNA, 20 bp, Artificial Sequence
  chemically synthesized
tggatctttctcacggagca

SEQ ID NO: 2193 - DNA, 20 bp, Artificial Sequence
  chemically synthesized
gatctttctcacggagcaaa

SEQ ID NO: 2194 - DNA, 20 bp, Artificial Sequence
  chemically synthesized
ctttctcacggagcaaagag

SEQ ID NO: 2195 - DNA, 20 bp, Artificial Sequence
  chemically synthesized
tttctcacggagcaaagagc

SEQ ID NO: 2196 - DNA, 20 bp, Artificial Sequence
  chemically synthesized
tctcacggagcaaagagcag

SEQ ID NO: 2197 - DNA, 20 bp, Artificial Sequence
  chemically synthesized
ctcacggagcaaagagcagg

SEQ ID NO: 2198 - DNA, 20 bp, Artificial Sequence
  chemically synthesized
cggagcaaagagcaggagga

SEQ ID NO: 2199 - DNA, 20 bp, Artificial Sequence
  chemically synthesized
ggagcaaagagcaggaggac

SEQ ID NO: 2200 - DNA, 20 bp, Artificial Sequence
  chemically synthesized
gagcaaagagcaggaggaca

SEQ ID NO: 2201 - DNA, 20 bp, Artificial Sequence
  chemically synthesized
agcaaagagcaggaggacag

SEQ ID NO: 2202 - DNA, 20 bp, Artificial Sequence
  chemically synthesized
ggacaggggattgatctccc

SEQ ID NO: 2203 - DNA, 20 bp, Artificial Sequence
  chemically synthesized
gacaggggattgatctccca

SEQ ID NO: 2204 - DNA, 20 bp, Artificial Sequence
  chemically synthesized
acaggggattgatctcccaa

SEQ ID NO: 2205 - DNA, 20 bp, Artificial Sequence
  chemically synthesized
aggggattgatctcccaagg

SEQ ID NO: 2206 - DNA, 20 bp, Artificial Sequence
  chemically synthesized
ggggattgatctcccaaggg

SEQ ID NO: 2207 - DNA, 20 bp, Artificial Sequence
  chemically synthesized
caagggaggtcccccaatct

SEQ ID NO: 2208 - DNA, 20 bp, Artificial Sequence
  chemically synthesized
aggtcccccaatctgagtca

SEQ ID NO: 2209 - DNA, 20 bp, Artificial Sequence
  chemically synthesized
atttcatgcgcgtccatatg

SEQ ID NO: 2210 - DNA, 20 bp, Artificial Sequence
  chemically synthesized
ttcatgcgcgtccatatgaa

SEQ ID NO: 2211 - DNA, 20 bp, Artificial Sequence
  chemically synthesized
catatgaagagactaccaaa

SEQ ID NO: 2212 - DNA, 20 bp, Artificial Sequence
  chemically synthesized
atatgaagagactaccaaac

SEQ ID NO: 2213 - DNA, 20 bp, Artificial Sequence
  chemically synthesized
ctaccaaacaggctttgtgt

SEQ ID NO: 2214 - DNA, 20 bp, Artificial Sequence
  chemically synthesized
acaggctttgtgtaagcaac

SEQ ID NO: 2215 - DNA, 20 bp, Artificial Sequence
  chemically synthesized
caggctttgtgtaagcaaca

SEQ ID NO: 2216 - DNA, 20 bp, Artificial Sequence
  chemically synthesized
acaaggctgtttatttcacc

SEQ ID NO: 2217 - DNA, 20 bp, Artificial Sequence
  chemically synthesized
caaggctgtttatttcacct

SEQ ID NO: 2218 - DNA, 20 bp, Artificial Sequence
  chemically synthesized
ctgtttatttcacctgggtg

SEQ ID NO: 2219 - DNA, 20 bp, Artificial Sequence
  chemically synthesized
tgtttatttcacctgggtgc

SEQ ID NO: 2220 - DNA, 20 bp, Artificial Sequence
  chemically synthesized
ttatttcacctgggtgcagg

SEQ ID NO: 2221 - DNA, 20 bp, Artificial Sequence
  chemically synthesized
tatttcacctgggtgcaggc

SEQ ID NO: 2222 - DNA, 20 bp, Artificial Sequence
  chemically synthesized
cacctgggtgcaggcaggct

SEQ ID NO: 2223 - DNA, 20 bp, Artificial Sequence
  chemically synthesized
gcaggcaggctgagtccaaa

SEQ ID NO: 2224 - DNA, 20 bp, Artificial Sequence
  chemically synthesized
aggcaggctgagtccaaaaa

SEQ ID NO: 2225 - DNA, 20 bp, Artificial Sequence
  chemically synthesized
gcaggctgagtccaaaaaga

SEQ ID NO: 2226 - DNA, 20 bp, Artificial Sequence
  chemically synthesized
gctgagtccaaaaagagagt

SEQ ID NO: 2227 - DNA, 20 bp, Artificial Sequence
  chemically synthesized
gtccaaaaagagagtcagca

SEQ ID NO: 2228 - DNA, 20 bp, Artificial Sequence
  chemically synthesized
tccaaaaagagagtcagcaa

SEQ ID NO: 2229 - DNA, 20 bp, Artificial Sequence
  chemically synthesized
ccaaaaagagagtcagcaaa

SEQ ID NO: 2230 - DNA, 20 bp, Artificial Sequence
  chemically synthesized
aaaaagagagtcagcaaagg

SEQ ID NO: 2231 - DNA, 20 bp, Artificial Sequence
  chemically synthesized
agagagtcagcaaagggaga

SEQ ID NO: 2232 - DNA, 20 bp, Artificial Sequence
  chemically synthesized
gagagtcagcaaagggagat

SEQ ID NO: 2233 - DNA, 20 bp, Artificial Sequence
  chemically synthesized
gagtcagcaaagggagatag

SEQ ID NO: 2234 - DNA, 20 bp, Artificial Sequence
  chemically synthesized
tcagcaaagggagataggag

SEQ ID NO: 2235 - DNA, 20 bp, Artificial Sequence
  chemically synthesized
cagcaaagggagataggagt

SEQ ID NO: 2236 - DNA, 20 bp, Artificial Sequence
  chemically synthesized
agcaaagggagataggagtg

SEQ ID NO: 2237 - DNA, 20 bp, Artificial Sequence
  chemically synthesized
taggagtggggctgttttat

SEQ ID NO: 2238 - DNA, 20 bp, Artificial Sequence
  chemically synthesized
tggggctgttttataagatt

SEQ ID NO: 2239 - DNA, 20 bp, Artificial Sequence
  chemically synthesized
ggggctgttttataagattt

SEQ ID NO: 2240 - DNA, 20 bp, Artificial Sequence
  chemically synthesized
gctgttttataagatttggg

SEQ ID NO: 2241 - DNA, 20 bp, Artificial Sequence
  chemically synthesized
ctgttttataagatttgggt

SEQ ID NO: 2242 - DNA, 20 bp, Artificial Sequence
  chemically synthesized
ttataagatttgggtaggta

SEQ ID NO: 2243 - DNA, 20 bp, Artificial Sequence
  chemically synthesized
tataagatttgggtaggtaa

SEQ ID NO: 2244 - DNA, 20 bp, Artificial Sequence
  chemically synthesized
gggtaggtaaaggaaaatta

SEQ ID NO: 2245 - DNA, 20 bp, Artificial Sequence
  chemically synthesized
gtaaaggaaaattacagtca

SEQ ID NO: 2246 - DNA, 20 bp, Artificial Sequence
  chemically synthesized
taaaggaaaattacagtcaa

SEQ ID NO: 2247 - DNA, 20 bp, Artificial Sequence
  chemically synthesized
aaaggaaaattacagtcaaa

SEQ ID NO: 2248 - DNA, 20 bp, Artificial Sequence
  chemically synthesized
aaggaaaattacagtcaaag

SEQ ID NO: 2249 - DNA, 20 bp, Artificial Sequence
  chemically synthesized
aggaaaattacagtcaaagg

SEQ ID NO: 2250 - DNA, 20 bp, Artificial Sequence
  chemically synthesized
ggaaaattacagtcaaaggg

SEQ ID NO: 2251 - DNA, 20 bp, Artificial Sequence
  chemically synthesized
gtcaaaggggggttgttctc

SEQ ID NO: 2252 - DNA, 20 bp, Artificial Sequence
  chemically synthesized
aaaggggggttgttctctgg

SEQ ID NO: 2253 - DNA, 20 bp, Artificial Sequence
  chemically synthesized
aaggggggttgttctctggc

SEQ ID NO: 2254 - DNA, 20 bp, Artificial Sequence
  chemically synthesized
gggggttgttctctggcggg

SEQ ID NO: 2255 - DNA, 20 bp, Artificial Sequence
  chemically synthesized
ggggttgttctctggcgggc

SEQ ID NO: 2256 - DNA, 20 bp, Artificial Sequence
  chemically synthesized
ggttgttctctggcgggcag

SEQ ID NO: 2257 - DNA, 20 bp, Artificial Sequence
  chemically synthesized
tgttctctggcgggcaggag

SEQ ID NO: 2258 - DNA, 20 bp, Artificial Sequence
  chemically synthesized
gttctctggcgggcaggagt

SEQ ID NO: 2259 - DNA, 20 bp, Artificial Sequence
  chemically synthesized
ttctctggcgggcaggagtg

SEQ ID NO: 2260 - DNA, 20 bp, Artificial Sequence
  chemically synthesized
tctctggcgggcaggagtgg

SEQ ID NO: 2261 - DNA, 20 bp, Artificial Sequence
  chemically synthesized
cgggcaggagtgggggtcac

SEQ ID NO: 2262 - DNA, 20 bp, Artificial Sequence
  chemically synthesized
gggcaggagtgggggtcaca

SEQ ID NO: 2263 - DNA, 20 bp, Artificial Sequence
  chemically synthesized
agtgggggtcacaaggtgct

SEQ ID NO: 2264 - DNA, 20 bp, Artificial Sequence
  chemically synthesized
gggggtcacaaggtgctcag

SEQ ID NO: 2265 - DNA, 20 bp, Artificial Sequence
  chemically synthesized
ggggtcacaaggtgctcagt

SEQ ID NO: 2266 - DNA, 20 bp, Artificial Sequence
  chemically synthesized
gggtcacaaggtgctcagta

SEQ ID NO: 2267 - DNA, 20 bp, Artificial Sequence
  chemically synthesized
ggtcacaaggtgctcagtag

SEQ ID NO: 2268 - DNA, 20 bp, Artificial Sequence
  chemically synthesized
tcacaaggtgctcagtaggg

SEQ ID NO: 2269 - DNA, 20 bp, Artificial Sequence
  chemically synthesized
tgctcagtaggggagctttt

SEQ ID NO: 2270 - DNA, 20 bp, Artificial Sequence
  chemically synthesized
cagtaggggagcttttgagc

SEQ ID NO: 2271 - DNA, 20 bp, Artificial Sequence
  chemically synthesized
agtaggggagcttttgagcc

SEQ ID NO: 2272 - DNA, 20 bp, Artificial Sequence
  chemically synthesized
gggagcttttgagccaggat

SEQ ID NO: 2273 - DNA, 20 bp, Artificial Sequence
  chemically synthesized
gcttttgagccaggatgagc

SEQ ID NO: 2274 - DNA, 20 bp, Artificial Sequence
  chemically synthesized
cttttgagccaggatgagcc

SEQ ID NO: 2275 - DNA, 20 bp, Artificial Sequence
  chemically synthesized
tttgagccaggatgagccag

SEQ ID NO: 2276 - DNA, 20 bp, Artificial Sequence
  chemically synthesized
gagccaggatgagccaggag

SEQ ID NO: 2277 - DNA, 20 bp, Artificial Sequence
  chemically synthesized
agccaggatgagccaggaga

SEQ ID NO: 2278 - DNA, 20 bp, Artificial Sequence
  chemically synthesized
gccaggagaaggaatttcac

SEQ ID NO: 2279 - DNA, 20 bp, Artificial Sequence
  chemically synthesized
atttcacaagacaatgtcat

SEQ ID NO: 2280 - DNA, 20 bp, Artificial Sequence
  chemically synthesized
acaagacaatgtcatcagtt

SEQ ID NO: 2281 - DNA, 20 bp, Artificial Sequence
  chemically synthesized
caagacaatgtcatcagtta

SEQ ID NO: 2282 - DNA, 20 bp, Artificial Sequence
  chemically synthesized
gacaatgtcatcagttaagg

SEQ ID NO: 2283 - DNA, 20 bp, Artificial Sequence
  chemically synthesized
acaatgtcatcagttaaggc

SEQ ID NO: 2284 - DNA, 20 bp, Artificial Sequence
  chemically synthesized
gtcatcagttaaggcaggaa

SEQ ID NO: 2285 - DNA, 20 bp, Artificial Sequence
  chemically synthesized
tcatcagttaaggcaggaac

SEQ ID NO: 2286 - DNA, 20 bp, Artificial Sequence
  chemically synthesized
ggccattttcacttcttttg

SEQ ID NO: 2287 - DNA, 20 bp, Artificial Sequence
  chemically synthesized
cattttcacttcttttgtgg

SEQ ID NO: 2288 - DNA, 20 bp, Artificial Sequence
  chemically synthesized
cttttgtggtggaatgtcat

SEQ ID NO: 2289 - DNA, 20 bp, Artificial Sequence
  chemically synthesized
gtggtggaatgtcatcagtt

SEQ ID NO: 2290 - DNA, 20 bp, Artificial Sequence
  chemically synthesized
tggtggaatgtcatcagtta

SEQ ID NO: 2291 - DNA, 20 bp, Artificial Sequence
  chemically synthesized
tggaatgtcatcagttaagg

SEQ ID NO: 2292 - DNA, 20 bp, Artificial Sequence
  chemically synthesized
tcatcagttaaggcagaaac

SEQ ID NO: 2293 - DNA, 20 bp, Artificial Sequence
  chemically synthesized
gccatctgtatgtgtatatg

SEQ ID NO: 2294 - DNA, 20 bp, Artificial Sequence
  chemically synthesized
ccatctgtatgtgtatatgc

SEQ ID NO: 2295 - DNA, 20 bp, Artificial Sequence
  chemically synthesized
gtatgtgtatatgcaggtca

SEQ ID NO: 2296 - DNA, 20 bp, Artificial Sequence
  chemically synthesized
tatgtgtatatgcaggtcac

SEQ ID NO: 2297 - DNA, 20 bp, Artificial Sequence
  chemically synthesized
atgtgtatatgcaggtcaca

SEQ ID NO: 2298 - DNA, 20 bp, Artificial Sequence
  chemically synthesized
tgtgtatatgcaggtcacag

SEQ ID NO: 2299 - DNA, 20 bp, Artificial Sequence
  chemically synthesized
gcaggtcacaggggacatga

SEQ ID NO: 2300 - DNA, 20 bp, Artificial Sequence
  chemically synthesized
tcacaggggacatgatggct

SEQ ID NO: 2301 - DNA, 20 bp, Artificial Sequence
  chemically synthesized
ggggacatgatggcttagct

SEQ ID NO: 2302 - DNA, 20 bp, Artificial Sequence
  chemically synthesized
gggacatgatggcttagctt

SEQ ID NO: 2303 - DNA, 20 bp, Artificial Sequence
  chemically synthesized
atgatggcttagcttgggct

SEQ ID NO: 2304 - DNA, 20 bp, Artificial Sequence
  chemically synthesized
gatggcttagcttgggctca

SEQ ID NO: 2305 - DNA, 20 bp, Artificial Sequence
  chemically synthesized
atggcttagcttgggctcag

SEQ ID NO: 2306 - DNA, 20 bp, Artificial Sequence
  chemically synthesized
gggctcagaggcctgacatt

SEQ ID NO: 2307 - DNA, 20 bp, Artificial Sequence
  chemically synthesized
ggctcagaggcctgacattc

SEQ ID NO: 2308 - DNA, 20 bp, Artificial Sequence
  chemically synthesized
ctcagaggcctgacattcag

SEQ ID NO: 2309 - DNA, 20 bp, Artificial Sequence
  chemically synthesized
atcttcttgttattcatttc

SEQ ID NO: 2310 - DNA, 20 bp, Artificial Sequence
  chemically synthesized
tttctagttttattccactg

SEQ ID NO: 2311 - DNA, 20 bp, Artificial Sequence
  chemically synthesized
tagttttattccactgtggt

SEQ ID NO: 2312 - DNA, 20 bp, Artificial Sequence
  chemically synthesized
atttgtacaaacttaccttg

SEQ ID NO: 2313 - DNA, 20 bp, Artificial Sequence
  chemically synthesized
ttaccttgtggcctaacata

SEQ ID NO: 2314 - DNA, 20 bp, Artificial Sequence
  chemically synthesized
gcctaacatatggccttatt

SEQ ID NO: 2315 - DNA, 20 bp, Artificial Sequence
  chemically synthesized
cctaacatatggccttattt

SEQ ID NO: 2316 - DNA, 20 bp, Artificial Sequence
  chemically synthesized
atgttgtacatgctgcttta

SEQ ID NO: 2317 - DNA, 20 bp, Artificial Sequence
  chemically synthesized
ttaaagaaatgtatcttctt

SEQ ID NO: 2318 - DNA, 20 bp, Artificial Sequence
  chemically synthesized
aagaaatgtatcttcttcag

SEQ ID NO: 2319 - DNA, 20 bp, Artificial Sequence
  chemically synthesized
aatgtatcttcttcagcagt

SEQ ID NO: 2320 - DNA, 20 bp, Artificial Sequence
  chemically synthesized
atgtatcttcttcagcagtt

SEQ ID NO: 2321 - DNA, 20 bp, Artificial Sequence
  chemically synthesized
tgtatcttcttcagcagttg

SEQ ID NO: 2322 - DNA, 20 bp, Artificial Sequence
  chemically synthesized
gtatcttcttcagcagttgg

SEQ ID NO: 2323 - DNA, 20 bp, Artificial Sequence
  chemically synthesized
ttcttcagcagttgggggac

SEQ ID NO: 2324 - DNA, 20 bp, Artificial Sequence
  chemically synthesized
gggacaagttctgttaatgt

SEQ ID NO: 2325 - DNA, 20 bp, Artificial Sequence
  chemically synthesized
caagttctgttaatgtcagt

SEQ ID NO: 2326 - DNA, 20 bp, Artificial Sequence
  chemically synthesized
aagttctgttaatgtcagtt

SEQ ID NO: 2327 - DNA, 20 bp, Artificial Sequence
  chemically synthesized
ttaatgtcagttgggtctat

SEQ ID NO: 2328 - DNA, 20 bp, Artificial Sequence
  chemically synthesized
tcagttgggtctattagata

SEQ ID NO: 2329 - DNA, 20 bp, Artificial Sequence
  chemically synthesized
gttgggtctattagatatag

SEQ ID NO: 2330 - DNA, 20 bp, Artificial Sequence
  chemically synthesized
ttgggtctattagatatagt

SEQ ID NO: 2331 - DNA, 20 bp, Artificial Sequence
  chemically synthesized
gttgttcatttgttgatttt

SEQ ID NO: 2332 - DNA, 20 bp, Artificial Sequence
  chemically synthesized
tcatttgttgatttttagtc

SEQ ID NO: 2333 - DNA, 20 bp, Artificial Sequence
  chemically synthesized
tggccgatctgttcattact

SEQ ID NO: 2334 - DNA, 20 bp, Artificial Sequence
  chemically synthesized
tctgttcattactgagactg

SEQ ID NO: 2335 - DNA, 20 bp, Artificial Sequence
  chemically synthesized
tactgagactgaagtgttta

SEQ ID NO: 2336 - DNA, 20 bp, Artificial Sequence
  chemically synthesized
tccctactattattgtattg

SEQ ID NO: 2337 - DNA, 20 bp, Artificial Sequence
  chemically synthesized
ttgcagtctgtctcgccctt

SEQ ID NO: 2338 - DNA, 20 bp, Artificial Sequence
  chemically synthesized
tgcagtctgtctcgcccttt

SEQ ID NO: 2339 - DNA, 20 bp, Artificial Sequence
  chemically synthesized
taatgttttccttatatact

SEQ ID NO: 2340 - DNA, 20 bp, Artificial Sequence
  chemically synthesized
aatgttttccttatatactt

SEQ ID NO: 2341 - DNA, 20 bp, Artificial Sequence
  chemically synthesized
atacttgggaactttgatgt

SEQ ID NO: 2342 - DNA, 20 bp, Artificial Sequence
  chemically synthesized
ttgacccctttattattata

SEQ ID NO: 2343 - DNA, 20 bp, Artificial Sequence
  chemically synthesized
accctccttatcttttctta

SEQ ID NO: 2344 - DNA, 20 bp, Artificial Sequence
  chemically synthesized
tcttacagtttttaaatttg

SEQ ID NO: 2345 - DNA, 20 bp, Artificial Sequence
  chemically synthesized
tagtctattttatctgattt

SEQ ID NO: 2346 - DNA, 20 bp, Artificial Sequence
  chemically synthesized
acaattactactgctctttc

SEQ ID NO: 2347 - DNA, 20 bp, Artificial Sequence
  chemically synthesized
ctactgctctttctggtttc

SEQ ID NO: 2348 - DNA, 20 bp, Artificial Sequence
  chemically synthesized
tctttctggtttccagttca

SEQ ID NO: 2349 - DNA, 20 bp, Artificial Sequence
  chemically synthesized
ttcatttatgtgtgccttta

SEQ ID NO: 2350 - DNA, 20 bp, Artificial Sequence
  chemically synthesized
tcatttatgtgtgcctttat

SEQ ID NO: 2351 - DNA, 20 bp, Artificial Sequence
  chemically synthesized
tatgtgtgcctttataggtg

SEQ ID NO: 2352 - DNA, 20 bp, Artificial Sequence
  chemically synthesized
gtgtgcctttataggtgaag

SEQ ID NO: 2353 - DNA, 20 bp, Artificial Sequence
  chemically synthesized
tgtgcctttataggtgaagt

SEQ ID NO: 2354 - DNA, 20 bp, Artificial Sequence
  chemically synthesized
taggtgaagtgggtttcttg

SEQ ID NO: 2355 - DNA, 20 bp, Artificial Sequence
  chemically synthesized
ggtttcttgaagatcgcata

SEQ ID NO: 2356 - DNA, 20 bp, Artificial Sequence
  chemically synthesized
tcttgaagatcgcataaagt

SEQ ID NO: 2357 - DNA, 20 bp, Artificial Sequence
  chemically synthesized
accattctattacttttaat

SEQ ID NO: 2358 - DNA, 20 bp, Artificial Sequence
  chemically synthesized
ccattctattacttttaatt

SEQ ID NO: 2359 - DNA, 20 bp, Artificial Sequence
  chemically synthesized
cattctattacttttaattg

SEQ ID NO: 2360 - DNA, 20 bp, Artificial Sequence
  chemically synthesized
ttacttttaattggggaact

SEQ ID NO: 2361 - DNA, 20 bp, Artificial Sequence
  chemically synthesized
gaactgagactatttacact

SEQ ID NO: 2362 - DNA, 20 bp, Artificial Sequence
  chemically synthesized
gagactatttacactcagtg

SEQ ID NO: 2363 - DNA, 20 bp, Artificial Sequence
  chemically synthesized
ttacactcagtgtagttact

SEQ ID NO: 2364 - DNA, 20 bp, Artificial Sequence
  chemically synthesized
actcagtgtagttactaagt

SEQ ID NO: 2365 - DNA, 20 bp, Artificial Sequence
  chemically synthesized
ctcagtgtagttactaagta

SEQ ID NO: 2366 - DNA, 20 bp, Artificial Sequence
  chemically synthesized
tttttttttttgcttatttt

SEQ ID NO: 2367 - DNA, 20 bp, Artificial Sequence
  chemically synthesized
tttgcttatttttggctgta

SEQ ID NO: 2368 - DNA, 20 bp, Artificial Sequence
  chemically synthesized
tgcttatttttggctgtatg

SEQ ID NO: 2369 - DNA, 20 bp, Artificial Sequence
  chemically synthesized
tcttccttttttttccttca

SEQ ID NO: 2370 - DNA, 20 bp, Artificial Sequence
  chemically synthesized
catggttatgtgattatctc

SEQ ID NO: 2371 - DNA, 20 bp, Artificial Sequence
  chemically synthesized
ggttatgtgattatctctgg

SEQ ID NO: 2372 - DNA, 20 bp, Artificial Sequence
  chemically synthesized
aatttgttactttttatttt

SEQ ID NO: 2373 - DNA, 20 bp, Artificial Sequence
  chemically synthesized
tatttttagtaaatctatta

SEQ ID NO: 2374 - DNA, 20 bp, Artificial Sequence
  chemically synthesized
tattatagatttttgtgctg

SEQ ID NO: 2375 - DNA, 20 bp, Artificial Sequence
  chemically synthesized
tttttgtgctgtggttacca

SEQ ID NO: 2376 - DNA, 20 bp, Artificial Sequence
  chemically synthesized
ttttgtgctgtggttaccat

SEQ ID NO: 2377 - DNA, 20 bp, Artificial Sequence
  chemically synthesized
tttgtgctgtggttaccatg

SEQ ID NO: 2378 - DNA, 20 bp, Artificial Sequence
  chemically synthesized
gtggttaccatggggcttac

SEQ ID NO: 2379 - DNA, 20 bp, Artificial Sequence
  chemically synthesized
caagaaacatcttataaata

SEQ ID NO: 2380 - DNA, 20 bp, Artificial Sequence
  chemically synthesized
aaacatcttataaatatagc

SEQ ID NO: 2381 - DNA, 20 bp, Artificial Sequence
  chemically synthesized
aaatatagcaagttatttta

SEQ ID NO: 2382 - DNA, 20 bp, Artificial Sequence
  chemically synthesized
aatatagcaagttattttaa

SEQ ID NO: 2383 - DNA, 20 bp, Artificial Sequence
  chemically synthesized
taaaggatgacgaattatct

SEQ ID NO: 2384 - DNA, 20 bp, Artificial Sequence
  chemically synthesized
attatcttagatcgcaaata

SEQ ID NO: 2385 - DNA, 20 bp, Artificial Sequence
  chemically synthesized
ttatcttagatcgcaaataa

SEQ ID NO: 2386 - DNA, 20 bp, Artificial Sequence
  chemically synthesized
gcaaataaaggaatataaac

SEQ ID NO: 2387 - DNA, 20 bp, Artificial Sequence
  chemically synthesized
caaataaaggaatataaaca

SEQ ID NO: 2388 - DNA, 20 bp, Artificial Sequence
  chemically synthesized
aaataaaggaatataaacaa

SEQ ID NO: 2389 - DNA, 20 bp, Artificial Sequence
  chemically synthesized
aatataaacaagggcaaaaa

SEQ ID NO: 2390 - DNA, 20 bp, Artificial Sequence
  chemically synthesized
atataaacaagggcaaaaac

SEQ ID NO: 2391 - DNA, 20 bp, Artificial Sequence
  chemically synthesized
ttatattacctacatcttaa

SEQ ID NO: 2392 - DNA, 20 bp, Artificial Sequence
  chemically synthesized
tatattacctacatcttaaa

SEQ ID NO: 2393 - DNA, 20 bp, Artificial Sequence
  chemically synthesized
tacatcttaaaaggttgcta

SEQ ID NO: 2394 - DNA, 20 bp, Artificial Sequence
  chemically synthesized
atagctattactgtttttga

SEQ ID NO: 2395 - DNA, 20 bp, Artificial Sequence
  chemically synthesized
tttttgaaagatttgttttt

SEQ ID NO: 2396 - DNA, 20 bp, Artificial Sequence
  chemically synthesized
ttttgaaagatttgtttttt

SEQ ID NO: 2397 - DNA, 20 bp, Artificial Sequence
  chemically synthesized
ttgttttttgggtttcatac

SEQ ID NO: 2398 - DNA, 20 bp, Artificial Sequence
  chemically synthesized
gttttttgggtttcatactg

SEQ ID NO: 2399 - DNA, 20 bp, Artificial Sequence
  chemically synthesized
tttcatactggagttctgtg

SEQ ID NO: 2400 - DNA, 20 bp, Artificial Sequence
  chemically synthesized
ggattgcacaccaaaaaata

SEQ ID NO: 2401 - DNA, 20 bp, Artificial Sequence
  chemically synthesized
cacaccaaaaaatacagtaa

SEQ ID NO: 2402 - DNA, 20 bp, Artificial Sequence
  chemically synthesized
acaccaaaaaatacagtaat

SEQ ID NO: 2403 - DNA, 20 bp, Artificial Sequence
  chemically synthesized
caccaaaaaatacagtaatg

SEQ ID NO: 2404 - DNA, 20 bp, Artificial Sequence
  chemically synthesized
aatacagtaatggggtattc

SEQ ID NO: 2405 - DNA, 20 bp, Artificial Sequence
  chemically synthesized
atacagtaatggggtattct

SEQ ID NO: 2406 - DNA, 20 bp, Artificial Sequence
  chemically synthesized
gtctatgtacttaattttac

SEQ ID NO: 2407 - DNA, 20 bp, Artificial Sequence
  chemically synthesized
tatgtacttaattttaccag

SEQ ID NO: 2408 - DNA, 20 bp, Artificial Sequence
  chemically synthesized
atgtacttaattttaccagt

SEQ ID NO: 2409 - DNA, 20 bp, Artificial Sequence
  chemically synthesized
agtgggtttcatactttgaa

SEQ ID NO: 2410 - DNA, 20 bp, Artificial Sequence
  chemically synthesized
tgttaatgtcttttttcttt

SEQ ID NO: 2411 - DNA, 20 bp, Artificial Sequence
  chemically synthesized
tcagattgcataactccctt

SEQ ID NO: 2412 - DNA, 20 bp, Artificial Sequence
  chemically synthesized
ctccctttagcattttttgc

SEQ ID NO: 2413 - DNA, 20 bp, Artificial Sequence
  chemically synthesized
ctttagcattttttgcaaga

SEQ ID NO: 2414 - DNA, 20 bp, Artificial Sequence
  chemically synthesized
gcattttttgcaagatggtc

SEQ ID NO: 2415 - DNA, 20 bp, Artificial Sequence
  chemically synthesized
tttgcaagatggtctggtgt

SEQ ID NO: 2416 - DNA, 20 bp, Artificial Sequence
  chemically synthesized
tctctcaacttttgtttgtc

SEQ ID NO: 2417 - DNA, 20 bp, Artificial Sequence
  chemically synthesized
ctctcaacttttgtttgtct

SEQ ID NO: 2418 - DNA, 20 bp, Artificial Sequence
  chemically synthesized
caacttttgtttgtctggga

SEQ ID NO: 2419 - DNA, 20 bp, Artificial Sequence
  chemically synthesized
tattgcttatatttgaataa

SEQ ID NO: 2420 - DNA, 20 bp, Artificial Sequence
  chemically synthesized
tataaaatattcttgaatat

SEQ ID NO: 2421 - DNA, 20 bp, Artificial Sequence
  chemically synthesized
atcagttttcttttatccct

SEQ ID NO: 2422 - DNA, 20 bp, Artificial Sequence
  chemically synthesized
aatttcattcgactctctct

SEQ ID NO: 2423 - DNA, 20 bp, Artificial Sequence
  chemically synthesized
tggactgtgtgatttctatt

SEQ ID NO: 2424 - DNA, 20 bp, Artificial Sequence
  chemically synthesized
tattgagatgtttgttgtca

SEQ ID NO: 2425 - DNA, 20 bp, Artificial Sequence
  chemically synthesized
attgagatgtttgttgtcac

SEQ ID NO: 2426 - DNA, 20 bp, Artificial Sequence
  chemically synthesized
atgtttgttgtcacaggatt

SEQ ID NO: 2427 - DNA, 20 bp, Artificial Sequence
  chemically synthesized
gtttgttgtcacaggatttg

SEQ ID NO: 2428 - DNA, 20 bp, Artificial Sequence
  chemically synthesized
tttctcatctcttctgcttt

SEQ ID NO: 2429 - DNA, 20 bp, Artificial Sequence
  chemically synthesized
ttctcatctcttctgctttt

SEQ ID NO: 2430 - DNA, 20 bp, Artificial Sequence
  chemically synthesized
ttgtccttgacctgatgtct

SEQ ID NO: 2431 - DNA, 20 bp, Artificial Sequence
  chemically synthesized
cttgacctgatgtcttggcg

SEQ ID NO: 2432 - DNA, 20 bp, Artificial Sequence
  chemically synthesized
gcgtagtactctactatatc

SEQ ID NO: 2433 - DNA, 20 bp, Artificial Sequence
  chemically synthesized
cgtagtactctactatatct

SEQ ID NO: 2434 - DNA, 20 bp, Artificial Sequence
  chemically synthesized
actatatctaggactacact

SEQ ID NO: 2435 - DNA, 20 bp, Artificial Sequence
  chemically synthesized
gaataatatgtaataaaaca

SEQ ID NO: 2436 - DNA, 20 bp, Artificial Sequence
  chemically synthesized
aatatgtaataaaacatagt

SEQ ID NO: 2437 - DNA, 20 bp, Artificial Sequence
  chemically synthesized
gtaataaaacatagtaagtg

SEQ ID NO: 2438 - DNA, 20 bp, Artificial Sequence
  chemically synthesized
aaaacatagtaagtgaagtg

SEQ ID NO: 2439 - DNA, 20 bp, Artificial Sequence
  chemically synthesized
agtaagtgaagtgaagttgc

SEQ ID NO: 2440 - DNA, 20 bp, Artificial Sequence
  chemically synthesized
agtgaagttgctggcttaaa

SEQ ID NO: 2441 - DNA, 20 bp, Artificial Sequence
  chemically synthesized
aaaaagtatttatttattgt

SEQ ID NO: 2442 - DNA, 20 bp, Artificial Sequence
  chemically synthesized
tatttatttattgtaagcat

SEQ ID NO: 2443 - DNA, 20 bp, Artificial Sequence
  chemically synthesized
aaatttgaccgatgtaatct

SEQ ID NO: 2444 - DNA, 20 bp, Artificial Sequence
  chemically synthesized
accgatgtaatcttagatga

SEQ ID NO: 2445 - DNA, 20 bp, Artificial Sequence
  chemically synthesized
atcttagatgatagttctaa

SEQ ID NO: 2446 - DNA, 20 bp, Artificial Sequence
  chemically synthesized
gatgatagttctaaaagtgt

SEQ ID NO: 2447 - DNA, 20 bp, Artificial Sequence
  chemically synthesized
tagttctaaaagtgttggtt

SEQ ID NO: 2448 - DNA, 20 bp, Artificial Sequence
  chemically synthesized
agttctaaaagtgttggttg

SEQ ID NO: 2449 - DNA, 20 bp, Artificial Sequence
  chemically synthesized
tctaaaagtgttggttgagg

SEQ ID NO: 2450 - DNA, 20 bp, Artificial Sequence
  chemically synthesized
aaaagtgttggttgaggaag

SEQ ID NO: 2451 - DNA, 20 bp, Artificial Sequence
  chemically synthesized
agtgttggttgaggaagtag

SEQ ID NO: 2452 - DNA, 20 bp, Artificial Sequence
  chemically synthesized
tgttggttgaggaagtagaa

SEQ ID NO: 2453 - DNA, 20 bp, Artificial Sequence
  chemically synthesized
ttgaggaagtagaagagaat

SEQ ID NO: 2454 - DNA, 20 bp, Artificial Sequence
  chemically synthesized
gtagaagagaatcagtacct

SEQ ID NO: 2455 - DNA, 20 bp, Artificial Sequence
  chemically synthesized
gaagagaatcagtacctaag

SEQ ID NO: 2456 - DNA, 20 bp, Artificial Sequence
  chemically synthesized
cctaagcagttaaactaatg

SEQ ID NO: 2457 - DNA, 20 bp, Artificial Sequence
  chemically synthesized
ctaagcagttaaactaatgt

SEQ ID NO: 2458 - DNA, 20 bp, Artificial Sequence
  chemically synthesized
agcagttaaactaatgtggg

SEQ ID NO: 2459 - DNA, 20 bp, Artificial Sequence
  chemically synthesized
gcagttaaactaatgtggga

SEQ ID NO: 2460 - DNA, 20 bp, Artificial Sequence
  chemically synthesized
gtgggaaggccccttttata

SEQ ID NO: 2461 - DNA, 20 bp, Artificial Sequence
  chemically synthesized
ccttttataaagatcctctt

SEQ ID NO: 2462 - DNA, 20 bp, Artificial Sequence
  chemically synthesized
tattaatatatgactataat

SEQ ID NO: 2463 - DNA, 20 bp, Artificial Sequence
  chemically synthesized
ttaatatatgactataatta

SEQ ID NO: 2464 - DNA, 20 bp, Artificial Sequence
  chemically synthesized
taatatatgactataattag

SEQ ID NO: 2465 - DNA, 20 bp, Artificial Sequence
  chemically synthesized
atgactataattagaggaaa

SEQ ID NO: 2466 - DNA, 20 bp, Artificial Sequence
  chemically synthesized
gactataattagaggaaaca

SEQ ID NO: 2467 - DNA, 20 bp, Artificial Sequence
  chemically synthesized
actataattagaggaaacag

SEQ ID NO: 2468 - DNA, 20 bp, Artificial Sequence
  chemically synthesized
taattagaggaaacagaggt

SEQ ID NO: 2469 - DNA, 20 bp, Artificial Sequence
  chemically synthesized
ttttgtcctcatgaatctca

SEQ ID NO: 2470 - DNA, 20 bp, Artificial Sequence
  chemically synthesized
tttgtcctcatgaatctcaa

SEQ ID NO: 2471 - DNA, 20 bp, Artificial Sequence
  chemically synthesized
tgtcctcatgaatctcaaag

SEQ ID NO: 2472 - DNA, 20 bp, Artificial Sequence
  chemically synthesized
atgaatctcaaaggagaaaa

SEQ ID NO: 2473 - DNA, 20 bp, Artificial Sequence
  chemically synthesized
tcaaaggagaaaatggttta

SEQ ID NO: 2474 - DNA, 20 bp, Artificial Sequence
  chemically synthesized
aaatggtttacagaattgct

SEQ ID NO: 2475 - DNA, 20 bp, Artificial Sequence
  chemically synthesized
cagaattgcttggtgttctt

SEQ ID NO: 2476 - DNA, 20 bp, Artificial Sequence
  chemically synthesized
ttcttcagattccaatttta

SEQ ID NO: 2477 - DNA, 20 bp, Artificial Sequence
  chemically synthesized
taaagtcaaatctgaatttt

SEQ ID NO: 2478 - DNA, 20 bp, Artificial Sequence
  chemically synthesized
caaatctgaattttaagtta

SEQ ID NO: 2479 - DNA, 20 bp, Artificial Sequence
  chemically synthesized
aaatctgaattttaagttat

SEQ ID NO: 2480 - DNA, 20 bp, Artificial Sequence
  chemically synthesized
ttatgggaccactgataata

SEQ ID NO: 2481 - DNA, 20 bp, Artificial Sequence
  chemically synthesized
tgggaccactgataatatgg

SEQ ID NO: 2482 - DNA, 20 bp, Artificial Sequence
  chemically synthesized
gggaccactgataatatggt

SEQ ID NO: 2483 - DNA, 20 bp, Artificial Sequence
  chemically synthesized
actgataatatggtgggcta

SEQ ID NO: 2484 - DNA, 20 bp, Artificial Sequence
  chemically synthesized
aatatggtgggctaaagaat

SEQ ID NO: 2485 - DNA, 20 bp, Artificial Sequence
  chemically synthesized
atatggtgggctaaagaatc

SEQ ID NO: 2486 - DNA, 20 bp, Artificial Sequence
  chemically synthesized
gggctaaagaatcaggtttt

SEQ ID NO: 2487 - DNA, 20 bp, Artificial Sequence
  chemically synthesized
taaagaatcaggtttttagt

SEQ ID NO: 2488 - DNA, 20 bp, Artificial Sequence
  chemically synthesized
aggtttttagttggattgtc

SEQ ID NO: 2489 - DNA, 20 bp, Artificial Sequence
  chemically synthesized
tagttggattgtctggtttt

SEQ ID NO: 2490 - DNA, 20 bp, Artificial Sequence
  chemically synthesized
cacttattaactctttgact

SEQ ID NO: 2491 - DNA, 20 bp, Artificial Sequence
  chemically synthesized
acttattaactctttgactt

SEQ ID NO: 2492 - DNA, 20 bp, Artificial Sequence
  chemically synthesized
cttattaactctttgacttg

SEQ ID NO: 2493 - DNA, 20 bp, Artificial Sequence
  chemically synthesized
gtttctacatttgtaacatg

SEQ ID NO: 2494 - DNA, 20 bp, Artificial Sequence
  chemically synthesized
ttcttcatatatttgttccg

SEQ ID NO: 2495 - DNA, 20 bp, Artificial Sequence
  chemically synthesized
actaatctatataaatcact

SEQ ID NO: 2496 - DNA, 20 bp, Artificial Sequence
  chemically synthesized
tctatataaatcacttagta

SEQ ID NO: 2497 - DNA, 20 bp, Artificial Sequence
  chemically synthesized
tcacttagtatggtacacta

SEQ ID NO: 2498 - DNA, 20 bp, Artificial Sequence
  chemically synthesized
tggtacactatagctcgtga

SEQ ID NO: 2499 - DNA, 20 bp, Artificial Sequence
  chemically synthesized
gtacactatagctcgtgaca

SEQ ID NO: 2500 - DNA, 20 bp, Artificial Sequence
  chemically synthesized
actttaatttttatgtactt

SEQ ID NO: 2501 - DNA, 20 bp, Artificial Sequence
  chemically synthesized
tatgtacttgagtttaaaat

SEQ ID NO: 2502 - DNA, 20 bp, Artificial Sequence
  chemically synthesized
ttgagtttaaaattagcatt

SEQ ID NO: 2503 - DNA, 20 bp, Artificial Sequence
  chemically synthesized
gagtttaaaattagcattta

SEQ ID NO: 2504 - DNA, 20 bp, Artificial Sequence
  chemically synthesized
gtttaaaattagcatttaga

SEQ ID NO: 2505 - DNA, 20 bp, Artificial Sequence
  chemically synthesized
ttagcatttagagagactgt

SEQ ID NO: 2506 - DNA, 20 bp, Artificial Sequence
  chemically synthesized
tagcatttagagagactgtc

SEQ ID NO: 2507 - DNA, 20 bp, Artificial Sequence
  chemically synthesized
gactgtgtattcacgtattg

SEQ ID NO: 2508 - DNA, 20 bp, Artificial Sequence
  chemically synthesized
gtgtattcacgtattgtagt

SEQ ID NO: 2509 - DNA, 20 bp, Artificial Sequence
  chemically synthesized
tcacgtattgtagtcagatt

SEQ ID NO: 2510 - DNA, 20 bp, Artificial Sequence
  chemically synthesized
tgtagtcagatttggtgaaa

SEQ ID NO: 2511 - DNA, 20 bp, Artificial Sequence
  chemically synthesized
ataaaatataattacttatt

SEQ ID NO: 2512 - DNA, 20 bp, Artificial Sequence
  chemically synthesized
acttattgagcaaattttac

SEQ ID NO: 2513 - DNA, 20 bp, Artificial Sequence
  chemically synthesized
cttattgagcaaattttact

SEQ ID NO: 2514 - DNA, 20 bp, Artificial Sequence
  chemically synthesized
caccatttcatttaatcttc

SEQ ID NO: 2515 - DNA, 20 bp, Artificial Sequence
  chemically synthesized
tttaatcttcaagatcataa

SEQ ID NO: 2516 - DNA, 20 bp, Artificial Sequence
  chemically synthesized
atcttcaagatcataaaagc

SEQ ID NO: 2517 - DNA, 20 bp, Artificial Sequence
  chemically synthesized
atgaataaattatattcaaa

SEQ ID NO: 2518 - DNA, 20 bp, Artificial Sequence
  chemically synthesized
tgaataaattatattcaaac

SEQ ID NO: 2519 - DNA, 20 bp, Artificial Sequence
  chemically synthesized
attcaaacaggtcatactac

SEQ ID NO: 2520 - DNA, 20 bp, Artificial Sequence
  chemically synthesized
aaacaggtcatactactagc

SEQ ID NO: 2521 - DNA, 20 bp, Artificial Sequence
  chemically synthesized
caagatcccacaattactaa

SEQ ID NO: 2522 - DNA, 20 bp, Artificial Sequence
  chemically synthesized
atcccacaattactaatagc

SEQ ID NO: 2523 - DNA, 20 bp, Artificial Sequence
  chemically synthesized
cacaattactaatagcaaga

SEQ ID NO: 2524 - DNA, 20 bp, Artificial Sequence
  chemically synthesized
ttactaatagcaagatagct

SEQ ID NO: 2525 - DNA, 20 bp, Artificial Sequence
  chemically synthesized
agatagctaagatttcaacc

SEQ ID NO: 2526 - DNA, 20 bp, Artificial Sequence
  chemically synthesized
gatagctaagatttcaacct

SEQ ID NO: 2527 - DNA, 20 bp, Artificial Sequence
  chemically synthesized
gatttcaacctaggtacatc

SEQ ID NO: 2528 - DNA, 20 bp, Artificial Sequence
  chemically synthesized
aacctaggtacatctggttc

SEQ ID NO: 2529 - DNA, 20 bp, Artificial Sequence
  chemically synthesized
caagtgtataacatcacact

SEQ ID NO: 2530 - DNA, 20 bp, Artificial Sequence
  chemically synthesized
aagtgtataacatcacactg

SEQ ID NO: 2531 - DNA, 20 bp, Artificial Sequence
  chemically synthesized
ataacatcacactgaggact

SEQ ID NO: 2532 - DNA, 20 bp, Artificial Sequence
  chemically synthesized
cacactgaggacttggctct

SEQ ID NO: 2533 - DNA, 20 bp, Artificial Sequence
  chemically synthesized
acactgaggacttggctctt

SEQ ID NO: 2534 - DNA, 20 bp, Artificial Sequence
  chemically synthesized
gacttggctcttgggtgtac

SEQ ID NO: 2535 - DNA, 20 bp, Artificial Sequence
  chemically synthesized
tccattgtgtgaacttgata

SEQ ID NO: 2536 - DNA, 20 bp, Artificial Sequence
  chemically synthesized
aagttacaaaaattatctct

SEQ ID NO: 2537 - DNA, 20 bp, Artificial Sequence
  chemically synthesized
agttttttcatgtataccat

SEQ ID NO: 2538 - DNA, 20 bp, Artificial Sequence
  chemically synthesized
tttcatgtataccataagaa

SEQ ID NO: 2539 - DNA, 20 bp, Artificial Sequence
  chemically synthesized
ataccataagaatagtaata

SEQ ID NO: 2540 - DNA, 20 bp, Artificial Sequence
  chemically synthesized
taccataagaatagtaatac

SEQ ID NO: 2541 - DNA, 20 bp, Artificial Sequence
  chemically synthesized
atagtaatacaggactgtaa

SEQ ID NO: 2542 - DNA, 20 bp, Artificial Sequence
  chemically synthesized
agtaatacaggactgtaatg

SEQ ID NO: 2543 - DNA, 20 bp, Artificial Sequence
  chemically synthesized
gtaatacaggactgtaatgg

SEQ ID NO: 2544 - DNA, 20 bp, Artificial Sequence
  chemically synthesized
ggttaccaataattattgtt

SEQ ID NO: 2545 - DNA, 20 bp, Artificial Sequence
  chemically synthesized
gttaccaataattattgtta

SEQ ID NO: 2546 - DNA, 20 bp, Artificial Sequence
  chemically synthesized
accaataattattgttaagg

SEQ ID NO: 2547 - DNA, 20 bp, Artificial Sequence
  chemically synthesized
ccaataattattgttaagga

SEQ ID NO: 2548 - DNA, 20 bp, Artificial Sequence
  chemically synthesized
caataattattgttaaggaa

SEQ ID NO: 2549 - DNA, 20 bp, Artificial Sequence
  chemically synthesized
ctaaattactctgaaatttt

SEQ ID NO: 2550 - DNA, 20 bp, Artificial Sequence
  chemically synthesized
cactacattgaacactttca

SEQ ID NO: 2551 - DNA, 20 bp, Artificial Sequence
  chemically synthesized
actacattgaacactttcaa

SEQ ID NO: 2552 - DNA, 20 bp, Artificial Sequence
  chemically synthesized
tcatacattaaaaatttttt

SEQ ID NO: 2553 - DNA, 20 bp, Artificial Sequence
  chemically synthesized
taagtccataaattaatttc

SEQ ID NO: 2554 - DNA, 20 bp, Artificial Sequence
  chemically synthesized
aagtccataaattaatttcg

SEQ ID NO: 2555 - DNA, 20 bp, Artificial Sequence
  chemically synthesized
taaattaatttcgaggaaaa

SEQ ID NO: 2556 - DNA, 20 bp, Artificial Sequence
  chemically synthesized
tatttgaccaaaccttctat

SEQ ID NO: 2557 - DNA, 20 bp, Artificial Sequence
  chemically synthesized
caaaccttctattagttact

SEQ ID NO: 2558 - DNA, 20 bp, Artificial Sequence
  chemically synthesized
ccttctattagttacttggt

SEQ ID NO: 2559 - DNA, 20 bp, Artificial Sequence
  chemically synthesized
tggttggctgataatcactc

SEQ ID NO: 2560 - DNA, 20 bp, Artificial Sequence
  chemically synthesized
gataatcactcaagactgtg

SEQ ID NO: 2561 - DNA, 20 bp, Artificial Sequence
  chemically synthesized
ctcaagactgtgtggtttaa

SEQ ID NO: 2562 - DNA, 20 bp, Artificial Sequence
  chemically synthesized
tcaagactgtgtggtttaat

SEQ ID NO: 2563 - DNA, 20 bp, Artificial Sequence
  chemically synthesized
gtttaataggatattcactg

SEQ ID NO: 2564 - DNA, 20 bp, Artificial Sequence
  chemically synthesized
aggatattcactgtggttca

SEQ ID NO: 2565 - DNA, 20 bp, Artificial Sequence
  chemically synthesized
tggaaattcaaaattatctg

SEQ ID NO: 2566 - DNA, 20 bp, Artificial Sequence
  chemically synthesized
aattatctgaagaaaacaaa

SEQ ID NO: 2567 - DNA, 20 bp, Artificial Sequence
  chemically synthesized
atctgaagaaaacaaaaagt

SEQ ID NO: 2568 - DNA, 20 bp, Artificial Sequence
  chemically synthesized
tctgaagaaaacaaaaagtt

SEQ ID NO: 2569 - DNA, 20 bp, Artificial Sequence
  chemically synthesized
gggctctgcaatccctgtct

SEQ ID NO: 2570 - DNA, 20 bp, Artificial Sequence
  chemically synthesized
ggctctgcaatccctgtctg

SEQ ID NO: 2571 - DNA, 20 bp, Artificial Sequence
  chemically synthesized
gctctgcaatccctgtctga

SEQ ID NO: 2572 - DNA, 20 bp, Artificial Sequence
  chemically synthesized
tccctgtctgagggattttc

SEQ ID NO: 2573 - DNA, 20 bp, Artificial Sequence
  chemically synthesized
gggattttctagaattcttc

SEQ ID NO: 2574 - DNA, 20 bp, Artificial Sequence
  chemically synthesized
ctccctacctttttgtttgt

SEQ ID NO: 2575 - DNA, 20 bp, Artificial Sequence
  chemically synthesized
cctacctttttgtttgtcag

SEQ ID NO: 2576 - DNA, 20 bp, Artificial Sequence
  chemically synthesized
tcagaagcttgtctactacc

SEQ ID NO: 2577 - DNA, 20 bp, Artificial Sequence
  chemically synthesized
ccgagtgattgatgtcacca

SEQ ID NO: 2578 - DNA, 20 bp, Artificial Sequence
  chemically synthesized
gatgtcaccaaagactattg

SEQ ID NO: 2579 - DNA, 20 bp, Artificial Sequence
  chemically synthesized
atgtcaccaaagactattgc

SEQ ID NO: 2580 - DNA, 20 bp, Artificial Sequence
  chemically synthesized
gtcaccaaagactattgcag

SEQ ID NO: 2581 - DNA, 20 bp, Artificial Sequence
  chemically synthesized
accaaagactattgcaggag

SEQ ID NO: 2582 - DNA, 20 bp, Artificial Sequence
  chemically synthesized
ccaaagactattgcaggagt

SEQ ID NO: 2583 - DNA, 20 bp, Artificial Sequence
  chemically synthesized
gccttgctttttctgttttt

SEQ ID NO: 2584 - DNA, 20 bp, Artificial Sequence
  chemically synthesized
ttagttattttcttctaaaa

SEQ ID NO: 2585 - DNA, 20 bp, Artificial Sequence
  chemically synthesized
tcttctaaaacagtattttc

SEQ ID NO: 2586 - DNA, 20 bp, Artificial Sequence
  chemically synthesized
tctaaaacagtattttcaag

SEQ ID NO: 2587 - DNA, 20 bp, Artificial Sequence
  chemically synthesized
acagtattttcaagtagttg

SEQ ID NO: 2588 - DNA, 20 bp, Artificial Sequence
  chemically synthesized
gttgtggttttttttctttc

SEQ ID NO: 2589 - DNA, 20 bp, Artificial Sequence
  chemically synthesized
tgaactcattaaaaataaaa

SEQ ID NO: 2590 - DNA, 20 bp, Artificial Sequence
  chemically synthesized
aaaaataaaatagctttcta

SEQ ID NO: 2591 - DNA, 20 bp, Artificial Sequence
  chemically synthesized
aatagctttctaaagccaaa

SEQ ID NO: 2592 - DNA, 20 bp, Artificial Sequence
  chemically synthesized
ccaaacagtttcctcctgac

SEQ ID NO: 2593 - DNA, 20 bp, Artificial Sequence
  chemically synthesized
gtttcctcctgaccagttaa

SEQ ID NO: 2594 - DNA, 20 bp, Artificial Sequence
  chemically synthesized
taaaagttatctctgcttca

SEQ ID NO: 2595 - DNA, 20 bp, Artificial Sequence
  chemically synthesized
ttcatggtgcatattcaatt

SEQ ID NO: 2596 - DNA, 20 bp, Artificial Sequence
  chemically synthesized
attcaattaagatttaacat

SEQ ID NO: 2597 - DNA, 20 bp, Artificial Sequence
  chemically synthesized
agatttaacattagcacact

SEQ ID NO: 2598 - DNA, 20 bp, Artificial Sequence
  chemically synthesized
acactgagtataattttttt

SEQ ID NO: 2599 - DNA, 20 bp, Artificial Sequence
  chemically synthesized
ttttaagaatctttttatta

SEQ ID NO: 2600 - DNA, 20 bp, Artificial Sequence
  chemically synthesized
cagaaattgtaaactacaca

SEQ ID NO: 2601 - DNA, 20 bp, Artificial Sequence
  chemically synthesized
tgtaaactacacaaagtaaa

SEQ ID NO: 2602 - DNA, 20 bp, Artificial Sequence
  chemically synthesized
agaatattataattaatttc

SEQ ID NO: 2603 - DNA, 20 bp, Artificial Sequence
  chemically synthesized
gaatattataattaatttcc

SEQ ID NO: 2604 - DNA, 20 bp, Artificial Sequence
  chemically synthesized
tttttgttattattatcatt

SEQ ID NO: 2605 - DNA, 20 bp, Artificial Sequence
  chemically synthesized
ttgttattattatcattcag

SEQ ID NO: 2606 - DNA, 20 bp, Artificial Sequence
  chemically synthesized
tgatgtaaaattgatgtacc

SEQ ID NO: 2607 - DNA, 20 bp, Artificial Sequence
  chemically synthesized
acctagaaatgtgcaaatct

SEQ ID NO: 2608 - DNA, 20 bp, Artificial Sequence
  chemically synthesized
acaaaatatttccatctccc

SEQ ID NO: 2609 - DNA, 20 bp, Artificial Sequence
  chemically synthesized
tcttccatctttatatccat

SEQ ID NO: 2610 - DNA, 20 bp, Artificial Sequence
  chemically synthesized
ttccatctttatatccatca

SEQ ID NO: 2611 - DNA, 20 bp, Artificial Sequence
  chemically synthesized
tccatctttatatccatcag

SEQ ID NO: 2612 - DNA, 20 bp, Artificial Sequence
  chemically synthesized
tctttatatccatcagaggt

SEQ ID NO: 2613 - DNA, 20 bp, Artificial Sequence
  chemically synthesized
ttatatccatcagaggtaag

SEQ ID NO: 2614 - DNA, 20 bp, Artificial Sequence
  chemically synthesized
tatatccatcagaggtaagc

SEQ ID NO: 2615 - DNA, 20 bp, Artificial Sequence
  chemically synthesized
atatccatcagaggtaagca

SEQ ID NO: 2616 - DNA, 20 bp, Artificial Sequence
  chemically synthesized
ctgattttttgacattaaat

SEQ ID NO: 2617 - DNA, 20 bp, Artificial Sequence
  chemically synthesized
tcctgattattttccttcac

SEQ ID NO: 2618 - DNA, 20 bp, Artificial Sequence
  chemically synthesized
atcactaattttaatataac

SEQ ID NO: 2619 - DNA, 20 bp, Artificial Sequence
  chemically synthesized
ccagaaacttaaacctcccc

SEQ ID NO: 2620 - DNA, 20 bp, Artificial Sequence
  chemically synthesized
agactctttctacatattcc

SEQ ID NO: 2621 - DNA, 20 bp, Artificial Sequence
  chemically synthesized
gaaccaaatgtcactgaatt

SEQ ID NO: 2622 - DNA, 20 bp, Artificial Sequence
  chemically synthesized
tgtcactgaattgagtattc

SEQ ID NO: 2623 - DNA, 20 bp, Artificial Sequence
  chemically synthesized
gtcactgaattgagtattca

SEQ ID NO: 2624 - DNA, 20 bp, Artificial Sequence
  chemically synthesized
gaattgagtattcaaggatt

SEQ ID NO: 2625 - DNA, 20 bp, Artificial Sequence
  chemically synthesized
attcaaggattcagcacaca

SEQ ID NO: 2626 - DNA, 20 bp, Artificial Sequence
  chemically synthesized
cacacaaagtgtgtcatcac

SEQ ID NO: 2627 - DNA, 20 bp, Artificial Sequence
  chemically synthesized
acacaaagtgtgtcatcacc

SEQ ID NO: 2628 - DNA, 20 bp, Artificial Sequence
  chemically synthesized
agtgtgtcatcaccaggaca

SEQ ID NO: 2629 - DNA, 20 bp, Artificial Sequence
  chemically synthesized
ctcctcccacaattttattt

SEQ ID NO: 2630 - DNA, 20 bp, Artificial Sequence
  chemically synthesized
cctcccacaattttatttca

SEQ ID NO: 2631 - DNA, 20 bp, Artificial Sequence
  chemically synthesized
gtaatgccatttcctattct

SEQ ID NO: 2632 - DNA, 20 bp, Artificial Sequence
  chemically synthesized
taatgccatttcctattctc

SEQ ID NO: 2633 - DNA, 20 bp, Artificial Sequence
  chemically synthesized
aatgccatttcctattctca

SEQ ID NO: 2634 - DNA, 20 bp, Artificial Sequence
  chemically synthesized
tcttcatctacaaaatgtta

SEQ ID NO: 2635 - DNA, 20 bp, Artificial Sequence
  chemically synthesized
aaatgttaaagctcattaac

SEQ ID NO: 2636 - DNA, 20 bp, Artificial Sequence
  chemically synthesized
gctcattaacaagcaataat

SEQ ID NO: 2637 - DNA, 20 bp, Artificial Sequence
  chemically synthesized
taacaagcaataataagcca

SEQ ID NO: 2638 - DNA, 20 bp, Artificial Sequence
  chemically synthesized
tggaatttttcatatttgca

SEQ ID NO: 2639 - DNA, 20 bp, Artificial Sequence
  chemically synthesized
atatttgcaaagctaatatt

SEQ ID NO: 2640 - DNA, 20 bp, Artificial Sequence
  chemically synthesized
tatttgcaaagctaatattc

SEQ ID NO: 2641 - DNA, 20 bp, Artificial Sequence
  chemically synthesized
aagctaatattcaggtaata

SEQ ID NO: 2642 - DNA, 20 bp, Artificial Sequence
  chemically synthesized
caggtaataaagcctgatct

SEQ ID NO: 2643 - DNA, 20 bp, Artificial Sequence
  chemically synthesized
gatctaagtgcctgtgctgt

SEQ ID NO: 2644 - DNA, 20 bp, Artificial Sequence
  chemically synthesized
atctaagtgcctgtgctgtc

SEQ ID NO: 2645 - DNA, 20 bp, Artificial Sequence
  chemically synthesized
tctaagtgcctgtgctgtca

SEQ ID NO: 2646 - DNA, 20 bp, Artificial Sequence
  chemically synthesized
ctgtgctgtcagggtatctt

SEQ ID NO: 2647 - DNA, 20 bp, Artificial Sequence
  chemically synthesized
agggtatcttcagtctccat

SEQ ID NO: 2648 - DNA, 20 bp, Artificial Sequence
  chemically synthesized
ttagaactcacccctcttcc

SEQ ID NO: 2649 - DNA, 20 bp, Artificial Sequence
  chemically synthesized
aactcacccctcttcctgga

SEQ ID NO: 2650 - DNA, 20 bp, Artificial Sequence
  chemically synthesized
cccctcttcctggatagtgt

SEQ ID NO: 2651 - DNA, 20 bp, Artificial Sequence
  chemically synthesized
tttctttgattttgatacta

SEQ ID NO: 2652 - DNA, 20 bp, Artificial Sequence
  chemically synthesized
gattttgatactatagacaa

SEQ ID NO: 2653 - DNA, 20 bp, Artificial Sequence
  chemically synthesized
attttgatactatagacaat

SEQ ID NO: 2654 - DNA, 20 bp, Artificial Sequence
  chemically synthesized
ttttgatactatagacaatg

SEQ ID NO: 2655 - DNA, 20 bp, Artificial Sequence
  chemically synthesized
atagacaatggggttgacca

SEQ ID NO: 2656 - DNA, 20 bp, Artificial Sequence
  chemically synthesized
tagacaatggggttgaccac

SEQ ID NO: 2657 - DNA, 20 bp, Artificial Sequence
  chemically synthesized
gacaatggggttgaccacag

SEQ ID NO: 2658 - DNA, 20 bp, Artificial Sequence
  chemically synthesized
acaatggggttgaccacagg

SEQ ID NO: 2659 - DNA, 20 bp, Artificial Sequence
  chemically synthesized
ggttgaccacaggaggaaaa

SEQ ID NO: 2660 - DNA, 20 bp, Artificial Sequence
  chemically synthesized
ttgaccacaggaggaaaaaa

SEQ ID NO: 2661 - DNA, 20 bp, Artificial Sequence
  chemically synthesized
tgaccacaggaggaaaaaag

SEQ ID NO: 2662 - DNA, 20 bp, Artificial Sequence
  chemically synthesized
cacaggaggaaaaaagaggt

SEQ ID NO: 2663 - DNA, 20 bp, Artificial Sequence
  chemically synthesized
aggaaaaaagaggtaagcat

SEQ ID NO: 2664 - DNA, 20 bp, Artificial Sequence
  chemically synthesized
gaggtaagcattggccgtga

SEQ ID NO: 2665 - DNA, 20 bp, Artificial Sequence
  chemically synthesized
aagcattggccgtgacagtc

SEQ ID NO: 2666 - DNA, 20 bp, Artificial Sequence
  chemically synthesized
ttggccgtgacagtctggaa

SEQ ID NO: 2667 - DNA, 20 bp, Artificial Sequence
  chemically synthesized
gccgtgacagtctggaaaag

SEQ ID NO: 2668 - DNA, 20 bp, Artificial Sequence
  chemically synthesized
cgtgacagtctggaaaagtg

SEQ ID NO: 2669 - DNA, 20 bp, Artificial Sequence
  chemically synthesized
gtgacagtctggaaaagtgg

SEQ ID NO: 2670 - DNA, 20 bp, Artificial Sequence
  chemically synthesized
gtggaggtaaatgccgtcca

SEQ ID NO: 2671 - DNA, 20 bp, Artificial Sequence
  chemically synthesized
gaggtaaatgccgtccaaag

SEQ ID NO: 2672 - DNA, 20 bp, Artificial Sequence
  chemically synthesized
tgccgtccaaagcggtgcat

SEQ ID NO: 2673 - DNA, 20 bp, Artificial Sequence
  chemically synthesized
gccgtccaaagcggtgcatc

SEQ ID NO: 2674 - DNA, 20 bp, Artificial Sequence
  chemically synthesized
ccgtccaaagcggtgcatca

SEQ ID NO: 2675 - DNA, 20 bp, Artificial Sequence
  chemically synthesized
gtccaaagcggtgcatcagg

SEQ ID NO: 2676 - DNA, 20 bp, Artificial Sequence
  chemically synthesized
ccaaagcggtgcatcaggga

SEQ ID NO: 2677 - DNA, 20 bp, Artificial Sequence
  chemically synthesized
caaagcggtgcatcagggag

SEQ ID NO: 2678 - DNA, 20 bp, Artificial Sequence
  chemically synthesized
catcagggagaggctgatca

SEQ ID NO: 2679 - DNA, 20 bp, Artificial Sequence
  chemically synthesized
atcagggagaggctgatcat

SEQ ID NO: 2680 - DNA, 20 bp, Artificial Sequence
  chemically synthesized
agaggctgatcatgggcaca

SEQ ID NO: 2681 - DNA, 20 bp, Artificial Sequence
  chemically synthesized
atcatgggcacatagtacac

SEQ ID NO: 2682 - DNA, 20 bp, Artificial Sequence
  chemically synthesized
gggcacatagtacacaagca

SEQ ID NO: 2683 - DNA, 20 bp, Artificial Sequence
  chemically synthesized
atgtgcgacacacatgtgtt

SEQ ID NO: 2684 - DNA, 20 bp, Artificial Sequence
  chemically synthesized
tgcctgccaccgccctgctc

SEQ ID NO: 2685 - DNA, 20 bp, Artificial Sequence
  chemically synthesized
ctgccaccgccctgctccag

SEQ ID NO: 2686 - DNA, 20 bp, Artificial Sequence
  chemically synthesized
cctgctccagaagctatttc

SEQ ID NO: 2687 - DNA, 20 bp, Artificial Sequence
  chemically synthesized
gctatttccagtactgtatg

SEQ ID NO: 2688 - DNA, 20 bp, Artificial Sequence
  chemically synthesized
tccagtactgtatgaagaat

SEQ ID NO: 2689 - DNA, 20 bp, Artificial Sequence
  chemically synthesized
tgtatgaagaatcagcacat

SEQ ID NO: 2690 - DNA, 20 bp, Artificial Sequence
  chemically synthesized
aagaaaccacaatgaacaat

SEQ ID NO: 2691 - DNA, 20 bp, Artificial Sequence
  chemically synthesized
accacaatgaacaataagtc

SEQ ID NO: 2692 - DNA, 20 bp, Artificial Sequence
  chemically synthesized
ataagtccagtccaaatgtg

SEQ ID NO: 2693 - DNA, 20 bp, Artificial Sequence
  chemically synthesized
taagtccagtccaaatgtga

SEQ ID NO: 2694 - DNA, 20 bp, Artificial Sequence
  chemically synthesized
aatgtgaaggtaatgacaaa

SEQ ID NO: 2695 - DNA, 20 bp, Artificial Sequence
  chemically synthesized
tgtgaaggtaatgacaaata

SEQ ID NO: 2696 - DNA, 20 bp, Artificial Sequence
  chemically synthesized
aaggtaatgacaaatagagc

SEQ ID NO: 2697 - DNA, 20 bp, Artificial Sequence
  chemically synthesized
aggtaatgacaaatagagcc

SEQ ID NO: 2698 - DNA, 20 bp, Artificial Sequence
  chemically synthesized
aaatagagccaggatgctat

SEQ ID NO: 2699 - DNA, 20 bp, Artificial Sequence
  chemically synthesized
aatagagccaggatgctatt

SEQ ID NO: 2700 - DNA, 20 bp, Artificial Sequence
  chemically synthesized
tattgggacgtgtgtctcca

SEQ ID NO: 2701 - DNA, 20 bp, Artificial Sequence
  chemically synthesized
attgggacgtgtgtctccac

SEQ ID NO: 2702 - DNA, 20 bp, Artificial Sequence
  chemically synthesized
ttgggacgtgtgtctccaca

SEQ ID NO: 2703 - DNA, 20 bp, Artificial Sequence
  chemically synthesized
tctccacagggcaatttgat

SEQ ID NO: 2704 - DNA, 20 bp, Artificial Sequence
  chemically synthesized
agggcaatttgatcagatct

SEQ ID NO: 2705 - DNA, 20 bp, Artificial Sequence
  chemically synthesized
gcaatttgatcagatctgag

SEQ ID NO: 2706 - DNA, 20 bp, Artificial Sequence
  chemically synthesized
aatttgatcagatctgagtg

SEQ ID NO: 2707 - DNA, 20 bp, Artificial Sequence
  chemically synthesized
atttgatcagatctgagtgg

SEQ ID NO: 2708 - DNA, 20 bp, Artificial Sequence
  chemically synthesized
cagatctgagtggaggcaat

SEQ ID NO: 2709 - DNA, 20 bp, Artificial Sequence
  chemically synthesized
gatctgagtggaggcaataa

SEQ ID NO: 2710 - DNA, 20 bp, Artificial Sequence
  chemically synthesized
tggaggcaataagagtgtgt

SEQ ID NO: 2711 - DNA, 20 bp, Artificial Sequence
  chemically synthesized
ggaggcaataagagtgtgtg

SEQ ID NO: 2712 - DNA, 20 bp, Artificial Sequence
  chemically synthesized
gaggcaataagagtgtgtga

SEQ ID NO: 2713 - DNA, 20 bp, Artificial Sequence
  chemically synthesized
aagagtgtgtgagggtattg

SEQ ID NO: 2714 - DNA, 20 bp, Artificial Sequence
  chemically synthesized
gtgtgagggtattgtggcca

SEQ ID NO: 2715 - DNA, 20 bp, Artificial Sequence
  chemically synthesized
gagggtattgtggccacaga

SEQ ID NO: 2716 - DNA, 20 bp, Artificial Sequence
  chemically synthesized
agggtattgtggccacagaa

SEQ ID NO: 2717 - DNA, 20 bp, Artificial Sequence
  chemically synthesized
gtattgtggccacagaaagg

SEQ ID NO: 2718 - DNA, 20 bp, Artificial Sequence
  chemically synthesized
ccacagaaaggcagacgcct

SEQ ID NO: 2719 - DNA, 20 bp, Artificial Sequence
  chemically synthesized
cacagaaaggcagacgcctc

SEQ ID NO: 2720 - DNA, 20 bp, Artificial Sequence
  chemically synthesized
cagaaaggcagacgcctcag

SEQ ID NO: 2721 - DNA, 20 bp, Artificial Sequence
  chemically synthesized
aaggcagacgcctcaggaga

SEQ ID NO: 2722 - DNA, 20 bp, Artificial Sequence
  chemically synthesized
ggcagacgcctcaggagaaa

SEQ ID NO: 2723 - DNA, 20 bp, Artificial Sequence
  chemically synthesized
agacgcctcaggagaaagag

SEQ ID NO: 2724 - DNA, 20 bp, Artificial Sequence
  chemically synthesized
cgcctcaggagaaagagcag

SEQ ID NO: 2725 - DNA, 20 bp, Artificial Sequence
  chemically synthesized
gcctcaggagaaagagcagt

SEQ ID NO: 2726 - DNA, 20 bp, Artificial Sequence
  chemically synthesized
ctcaggagaaagagcagtgg

SEQ ID NO: 2727 - DNA, 20 bp, Artificial Sequence
  chemically synthesized
agaaagagcagtgggagcat

SEQ ID NO: 2728 - DNA, 20 bp, Artificial Sequence
  chemically synthesized
gcataagcattacactgcgc

SEQ ID NO: 2729 - DNA, 20 bp, Artificial Sequence
  chemically synthesized
cataagcattacactgcgca

SEQ ID NO: 2730 - DNA, 20 bp, Artificial Sequence
  chemically synthesized
cattacactgcgcaaggcaa

SEQ ID NO: 2731 - DNA, 20 bp, Artificial Sequence
  chemically synthesized
tacactgcgcaaggcaatgg

SEQ ID NO: 2732 - DNA, 20 bp, Artificial Sequence
  chemically synthesized
ggcaatggcggcacccgtcc

SEQ ID NO: 2733 - DNA, 20 bp, Artificial Sequence
  chemically synthesized
cggcacccgtcccagaaatg

SEQ ID NO: 2734 - DNA, 20 bp, Artificial Sequence
  chemically synthesized
ggcacccgtcccagaaatgc

SEQ ID NO: 2735 - DNA, 20 bp, Artificial Sequence
  chemically synthesized
ccagaaatgcaggcaattgt

SEQ ID NO: 2736 - DNA, 20 bp, Artificial Sequence
  chemically synthesized
aatgcaggcaattgtcagaa

SEQ ID NO: 2737 - DNA, 20 bp, Artificial Sequence
  chemically synthesized
caattgtcagaatggttgtg

SEQ ID NO: 2738 - DNA, 20 bp, Artificial Sequence
  chemically synthesized
gtcagaatggttgtgtagcg

SEQ ID NO: 2739 - DNA, 20 bp, Artificial Sequence
  chemically synthesized
agaatggttgtgtagcgcag

SEQ ID NO: 2740 - DNA, 20 bp, Artificial Sequence
  chemically synthesized
gaatggttgtgtagcgcagt

SEQ ID NO: 2741 - DNA, 20 bp, Artificial Sequence
  chemically synthesized
ttgtgtagcgcagtgggctg

SEQ ID NO: 2742 - DNA, 20 bp, Artificial Sequence
  chemically synthesized
gtagcgcagtgggctgtaga

SEQ ID NO: 2743 - DNA, 20 bp, Artificial Sequence
  chemically synthesized
gtgggctgtagatggccaca

SEQ ID NO: 2744 - DNA, 20 bp, Artificial Sequence
  chemically synthesized
ggctgtagatggccacaaag

SEQ ID NO: 2745 - DNA, 20 bp, Artificial Sequence
  chemically synthesized
aagcggtccactgacattgc

SEQ ID NO: 2746 - DNA, 20 bp, Artificial Sequence
  chemically synthesized
cggtccactgacattgccag

SEQ ID NO: 2747 - DNA, 20 bp, Artificial Sequence
  chemically synthesized
ggtccactgacattgccaga

SEQ ID NO: 2748 - DNA, 20 bp, Artificial Sequence
  chemically synthesized
agaaggacacctgactccat

SEQ ID NO: 2749 - DNA, 20 bp, Artificial Sequence
  chemically synthesized
aaggacacctgactccataa

SEQ ID NO: 2750 - DNA, 20 bp, Artificial Sequence
  chemically synthesized
acctgactccataagagtga

SEQ ID NO: 2751 - DNA, 20 bp, Artificial Sequence
  chemically synthesized
ctgactccataagagtgaaa

SEQ ID NO: 2752 - DNA, 20 bp, Artificial Sequence
  chemically synthesized
cataagagtgaaagagtgca

SEQ ID NO: 2753 - DNA, 20 bp, Artificial Sequence
  chemically synthesized
aagagtgcatagaaaacatc

SEQ ID NO: 2754 - DNA, 20 bp, Artificial Sequence
  chemically synthesized
gagtgcatagaaaacatctg

SEQ ID NO: 2755 - DNA, 20 bp, Artificial Sequence
  chemically synthesized
tgcatagaaaacatctggag

SEQ ID NO: 2756 - DNA, 20 bp, Artificial Sequence
  chemically synthesized
gcatagaaaacatctggagc

SEQ ID NO: 2757 - DNA, 20 bp, Artificial Sequence
  chemically synthesized
aactgacatcgttaatgcca

SEQ ID NO: 2758 - DNA, 20 bp, Artificial Sequence
  chemically synthesized
ctgacatcgttaatgccaaa

SEQ ID NO: 2759 - DNA, 20 bp, Artificial Sequence
  chemically synthesized
tgacatcgttaatgccaaag

SEQ ID NO: 2760 - DNA, 20 bp, Artificial Sequence
  chemically synthesized
aaagaggaatatgcttaaca

SEQ ID NO: 2761 - DNA, 20 bp, Artificial Sequence
  chemically synthesized
gaggaatatgcttaacacag

SEQ ID NO: 2762 - DNA, 20 bp, Artificial Sequence
  chemically synthesized
aggaatatgcttaacacagt

SEQ ID NO: 2763 - DNA, 20 bp, Artificial Sequence
  chemically synthesized
tatgcttaacacagtgggca

SEQ ID NO: 2764 - DNA, 20 bp, Artificial Sequence
  chemically synthesized
gcttaacacagtgggcatgg

SEQ ID NO: 2765 - DNA, 20 bp, Artificial Sequence
  chemically synthesized
taacacagtgggcatggtgg

SEQ ID NO: 2766 - DNA, 20 bp, Artificial Sequence
  chemically synthesized
cacagtgggcatggtggaag

SEQ ID NO: 2767 - DNA, 20 bp, Artificial Sequence
  chemically synthesized
cagtgggcatggtggaagca

SEQ ID NO: 2768 - DNA, 20 bp, Artificial Sequence
  chemically synthesized
atggtggaagcagagacacc

SEQ ID NO: 2769 - DNA, 20 bp, Artificial Sequence
  chemically synthesized
cagagacaccaagttcaaca

SEQ ID NO: 2770 - DNA, 20 bp, Artificial Sequence
  chemically synthesized
agagacaccaagttcaacaa

SEQ ID NO: 2771 - DNA, 20 bp, Artificial Sequence
  chemically synthesized
acaccaagttcaacaaaggc

SEQ ID NO: 2772 - DNA, 20 bp, Artificial Sequence
  chemically synthesized
aagttcaacaaaggccggca

SEQ ID NO: 2773 - DNA, 20 bp, Artificial Sequence
  chemically synthesized
tcaacaaaggccggcatggc

SEQ ID NO: 2774 - DNA, 20 bp, Artificial Sequence
  chemically synthesized
aggccggcatggccagaaaa

SEQ ID NO: 2775 - DNA, 20 bp, Artificial Sequence
  chemically synthesized
catggccagaaaatagtaca

SEQ ID NO: 2776 - DNA, 20 bp, Artificial Sequence
  chemically synthesized
atggccagaaaatagtacat

SEQ ID NO: 2777 - DNA, 20 bp, Artificial Sequence
  chemically synthesized
ccagaaaatagtacatgggt

SEQ ID NO: 2778 - DNA, 20 bp, Artificial Sequence
  chemically synthesized
aatagtacatgggttggtgc

SEQ ID NO: 2779 - DNA, 20 bp, Artificial Sequence
  chemically synthesized
atagtacatgggttggtgca

SEQ ID NO: 2780 - DNA, 20 bp, Artificial Sequence
  chemically synthesized
gtacatgggttggtgcaagg

SEQ ID NO: 2781 - DNA, 20 bp, Artificial Sequence
  chemically synthesized
acatgggttggtgcaaggaa

SEQ ID NO: 2782 - DNA, 20 bp, Artificial Sequence
  chemically synthesized
ggtgcaaggaagagtcaatt

SEQ ID NO: 2783 - DNA, 20 bp, Artificial Sequence
  chemically synthesized
gagtcaattcggatgatgtg

SEQ ID NO: 2784 - DNA, 20 bp, Artificial Sequence
  chemically synthesized
tgaagaatgatgccatttcc

SEQ ID NO: 2785 - DNA, 20 bp, Artificial Sequence
  chemically synthesized
gaatgatgccatttcccgga

SEQ ID NO: 2786 - DNA, 20 bp, Artificial Sequence
  chemically synthesized
gccatttcccggaaagatga

SEQ ID NO: 2787 - DNA, 20 bp, Artificial Sequence
  chemically synthesized
ggaaagatgatggtgtatat

SEQ ID NO: 2788 - DNA, 20 bp, Artificial Sequence
  chemically synthesized
gaaagatgatggtgtatatc

SEQ ID NO: 2789 - DNA, 20 bp, Artificial Sequence
  chemically synthesized
agatgatggtgtatatcagg

SEQ ID NO: 2790 - DNA, 20 bp, Artificial Sequence
  chemically synthesized
tgatggtgtatatcaggcag

SEQ ID NO: 2791 - DNA, 20 bp, Artificial Sequence
  chemically synthesized
gatggtgtatatcaggcaga

SEQ ID NO: 2792 - DNA, 20 bp, Artificial Sequence
  chemically synthesized
atggtgtatatcaggcagaa

SEQ ID NO: 2793 - DNA, 20 bp, Artificial Sequence
  chemically synthesized
tggtgtatatcaggcagaag

SEQ ID NO: 2794 - DNA, 20 bp, Artificial Sequence
  chemically synthesized
gtatatcaggcagaagggga

SEQ ID NO: 2795 - DNA, 20 bp, Artificial Sequence
  chemically synthesized
tccacataatgttctgcctc

SEQ ID NO: 2796 - DNA, 20 bp, Artificial Sequence
  chemically synthesized
taatgttctgcctccagtcc

SEQ ID NO: 2797 - DNA, 20 bp, Artificial Sequence
  chemically synthesized
aatgttctgcctccagtccc

SEQ ID NO: 2798 - DNA, 20 bp, Artificial Sequence
  chemically synthesized
tccagtcccgggatgccaac

SEQ ID NO: 2799 - DNA, 20 bp, Artificial Sequence
  chemically synthesized
cagtcccgggatgccaacga

SEQ ID NO: 2800 - DNA, 20 bp, Artificial Sequence
  chemically synthesized
gccaacgagagtgaatgttg

SEQ ID NO: 2801 - DNA, 20 bp, Artificial Sequence
  chemically synthesized
ccaacgagagtgaatgttgt

SEQ ID NO: 2802 - DNA, 20 bp, Artificial Sequence
  chemically synthesized
tgttgtaggtgtgaatgtta

SEQ ID NO: 2803 - DNA, 20 bp, Artificial Sequence
  chemically synthesized
tggaacgtttgaaaacgtca

SEQ ID NO: 2804 - DNA, 20 bp, Artificial Sequence
  chemically synthesized
tcatggtgatacttcctctg

SEQ ID NO: 2805 - DNA, 20 bp, Artificial Sequence
  chemically synthesized
atacttcctctgaagatatt

SEQ ID NO: 2806 - DNA, 20 bp, Artificial Sequence
  chemically synthesized
cttcctctgaagatattgag

SEQ ID NO: 2807 - DNA, 20 bp, Artificial Sequence
  chemically synthesized
tgaagatattgagaagcaca

SEQ ID NO: 2808 - DNA, 20 bp, Artificial Sequence
  chemically synthesized
aagatattgagaagcacatg

SEQ ID NO: 2809 - DNA, 20 bp, Artificial Sequence
  chemically synthesized
attgagaagcacatggagac

SEQ ID NO: 2810 - DNA, 20 bp, Artificial Sequence
  chemically synthesized
acatggagactggaatatat

SEQ ID NO: 2811 - DNA, 20 bp, Artificial Sequence
  chemically synthesized
ggaatatataagtttctact

SEQ ID NO: 2812 - DNA, 20 bp, Artificial Sequence
  chemically synthesized
ctactcagttattgcacatc

SEQ ID NO: 2813 - DNA, 20 bp, Artificial Sequence
  chemically synthesized
gttattgcacatcaagttct

SEQ ID NO: 2814 - DNA, 20 bp, Artificial Sequence
  chemically synthesized
cacatcaagttctgagctaa

SEQ ID NO: 2815 - DNA, 20 bp, Artificial Sequence
  chemically synthesized
ctgagctaacagtcatatct

SEQ ID NO: 2816 - DNA, 20 bp, Artificial Sequence
  chemically synthesized
tcatatctaagacatttcct

SEQ ID NO: 2817 - DNA, 20 bp, Artificial Sequence
  chemically synthesized
ctaagacatttcctcagaaa

SEQ ID NO: 2818 - DNA, 20 bp, Artificial Sequence
  chemically synthesized
taagacatttcctcagaaaa

SEQ ID NO: 2819 - DNA, 20 bp, Artificial Sequence
  chemically synthesized
aagacatttcctcagaaaaa

SEQ ID NO: 2820 - DNA, 20 bp, Artificial Sequence
  chemically synthesized
aaaaaatttatttctgaaac

SEQ ID NO: 2821 - DNA, 20 bp, Artificial Sequence
  chemically synthesized
aaaaatttatttctgaaaca

SEQ ID NO: 2822 - DNA, 20 bp, Artificial Sequence
  chemically synthesized
aaaatttatttctgaaacaa

SEQ ID NO: 2823 - DNA, 20 bp, Artificial Sequence
  chemically synthesized
ttatttctgaaacaagggca

SEQ ID NO: 2824 - DNA, 20 bp, Artificial Sequence
  chemically synthesized
tatttctgaaacaagggcac

SEQ ID NO: 2825 - DNA, 20 bp, Artificial Sequence
  chemically synthesized
tctgaaacaagggcacaggt

SEQ ID NO: 2826 - DNA, 20 bp, Artificial Sequence
  chemically synthesized
acaagggcacaggtaagcca

SEQ ID NO: 2827 - DNA, 20 bp, Artificial Sequence
  chemically synthesized
gggcacaggtaagccacagt

SEQ ID NO: 2828 - DNA, 20 bp, Artificial Sequence
  chemically synthesized
cacaggtaagccacagtgag

SEQ ID NO: 2829 - DNA, 20 bp, Artificial Sequence
  chemically synthesized
aggtaagccacagtgagtgg

SEQ ID NO: 2830 - DNA, 20 bp, Artificial Sequence
  chemically synthesized
gtaagccacagtgagtggaa

SEQ ID NO: 2831 - DNA, 20 bp, Artificial Sequence
  chemically synthesized
tgagtggaagagaaacctaa

SEQ ID NO: 2832 - DNA, 20 bp, Artificial Sequence
  chemically synthesized
gagtggaagagaaacctaat

SEQ ID NO: 2833 - DNA, 20 bp, Artificial Sequence
  chemically synthesized
gagaaacctaatgggtcatg

SEQ ID NO: 2834 - DNA, 20 bp, Artificial Sequence
  chemically synthesized
acctaatgggtcatgcagaa

SEQ ID NO: 2835 - DNA, 20 bp, Artificial Sequence
  chemically synthesized
tgcagaaaagtattccaaca

SEQ ID NO: 2836 - DNA, 20 bp, Artificial Sequence
  chemically synthesized
ttccaacatagcctatatgc

SEQ ID NO: 2837 - DNA, 20 bp, Artificial Sequence
  chemically synthesized
acatagcctatatgccagat

SEQ ID NO: 2838 - DNA, 20 bp, Artificial Sequence
  chemically synthesized
catagcctatatgccagata

SEQ ID NO: 2839 - DNA, 20 bp, Artificial Sequence
  chemically synthesized
tatgccagataaggcattaa

SEQ ID NO: 2840 - DNA, 20 bp, Artificial Sequence
  chemically synthesized
aaggcattaatagaaatctc

SEQ ID NO: 2841 - DNA, 20 bp, Artificial Sequence
  chemically synthesized
cattaatagaaatctcaagt

SEQ ID NO: 2842 - DNA, 20 bp, Artificial Sequence
  chemically synthesized
attaatagaaatctcaagtt

SEQ ID NO: 2843 - DNA, 20 bp, Artificial Sequence
  chemically synthesized
atctcaagttgggtcatcta

SEQ ID NO: 2844 - DNA, 20 bp, Artificial Sequence
  chemically synthesized
tcaagttgggtcatctatgg

SEQ ID NO: 2845 - DNA, 20 bp, Artificial Sequence
  chemically synthesized
tcatctatggcagtgaaaaa

SEQ ID NO: 2846 - DNA, 20 bp, Artificial Sequence
  chemically synthesized
cagtgaaaaacagttaaaat

SEQ ID NO: 2847 - DNA, 20 bp, Artificial Sequence
  chemically synthesized
aaaaacagttaaaataagca

SEQ ID NO: 2848 - DNA, 20 bp, Artificial Sequence
  chemically synthesized
aaacagttaaaataagcata

SEQ ID NO: 2849 - DNA, 20 bp, Artificial Sequence
  chemically synthesized
taaaataagcatagagatga

SEQ ID NO: 2850 - DNA, 20 bp, Artificial Sequence
  chemically synthesized
atagagatgacagattcaca

SEQ ID NO: 2851 - DNA, 20 bp, Artificial Sequence
  chemically synthesized
tcacatggaaattatgactg

SEQ ID NO: 2852 - DNA, 20 bp, Artificial Sequence
  chemically synthesized
ctgaagaaactgctaacttg

SEQ ID NO: 2853 - DNA, 20 bp, Artificial Sequence
  chemically synthesized
gctaacttgtagtgtttata

SEQ ID NO: 2854 - DNA, 20 bp, Artificial Sequence
  chemically synthesized
taacttgtagtgtttataaa

SEQ ID NO: 2855 - DNA, 20 bp, Artificial Sequence
  chemically synthesized
acttgtagtgtttataaaga

SEQ ID NO: 2856 - DNA, 20 bp, Artificial Sequence
  chemically synthesized
tgtagtgtttataaagagag

SEQ ID NO: 2857 - DNA, 20 bp, Artificial Sequence
  chemically synthesized
ttataaagagagtagatgaa

SEQ ID NO: 2858 - DNA, 20 bp, Artificial Sequence
  chemically synthesized
agagagtagatgaatagcta

SEQ ID NO: 2859 - DNA, 20 bp, Artificial Sequence
  chemically synthesized
aaagtaatataacactaata

SEQ ID NO: 2860 - DNA, 20 bp, Artificial Sequence
  chemically synthesized
agtaatataacactaataaa

SEQ ID NO: 2861 - DNA, 20 bp, Artificial Sequence
  chemically synthesized
acactaataaagagtattga

SEQ ID NO: 2862 - DNA, 20 bp, Artificial Sequence
  chemically synthesized
atttaattgacgtgtaatct

SEQ ID NO: 2863 - DNA, 20 bp, Artificial Sequence
  chemically synthesized
tttaattgacgtgtaatctt

SEQ ID NO: 2864 - DNA, 20 bp, Artificial Sequence
  chemically synthesized
gtaatcttgggattatatta

SEQ ID NO: 2865 - DNA, 20 bp, Artificial Sequence
  chemically synthesized
ttaaagttgatttatattgc

SEQ ID NO: 2866 - DNA, 20 bp, Artificial Sequence
  chemically synthesized
atttatattgcaagttatct

SEQ ID NO: 2867 - DNA, 20 bp, Artificial Sequence
  chemically synthesized
attgcaagttatctgagacc

SEQ ID NO: 2868 - DNA, 20 bp, Artificial Sequence
  chemically synthesized
agacccagatatttgctata

SEQ ID NO: 2869 - DNA, 20 bp, Artificial Sequence
  chemically synthesized
atttgctataaagacaataa

SEQ ID NO: 2870 - DNA, 20 bp, Artificial Sequence
  chemically synthesized
aagacaataatagtatttta

SEQ ID NO: 2871 - DNA, 20 bp, Artificial Sequence
  chemically synthesized
atattgtttatcattatatg

SEQ ID NO: 2872 - DNA, 20 bp, Artificial Sequence
  chemically synthesized
ttatcattatatgtggaata

SEQ ID NO: 2873 - DNA, 20 bp, Artificial Sequence
  chemically synthesized
tatagtaaatattaaatgta

SEQ ID NO: 2874 - DNA, 20 bp, Artificial Sequence
  chemically synthesized
tattaaatgtatagaataaa

SEQ ID NO: 2875 - DNA, 20 bp, Artificial Sequence
  chemically synthesized
aaaagaacaatttaatatat

SEQ ID NO: 2876 - DNA, 20 bp, Artificial Sequence
  chemically synthesized
aatttaatatattagaacac

SEQ ID NO: 2877 - DNA, 20 bp, Artificial Sequence
  chemically synthesized
atttaatatattagaacaca

SEQ ID NO: 2878 - DNA, 20 bp, Artificial Sequence
  chemically synthesized
aatatattagaacacaagga

SEQ ID NO: 2879 - DNA, 20 bp, Artificial Sequence
  chemically synthesized
aacacaaggatagtttctcc

SEQ ID NO: 2880 - DNA, 20 bp, Artificial Sequence
  chemically synthesized
ggatagtttctcctagaata

SEQ ID NO: 2881 - DNA, 20 bp, Artificial Sequence
  chemically synthesized
catttttttctttaacttac

SEQ ID NO: 2882 - DNA, 20 bp, Artificial Sequence
  chemically synthesized
ctttctccacctgctatcca

SEQ ID NO: 2883 - DNA, 20 bp, Artificial Sequence
  chemically synthesized
tccacctgctatccatagat

SEQ ID NO: 2884 - DNA, 20 bp, Artificial Sequence
  chemically synthesized
ctgctatccatagattagaa

SEQ ID NO: 2885 - DNA, 20 bp, Artificial Sequence
  chemically synthesized
aaaagctcctctgtattttg

SEQ ID NO: 2886 - DNA, 20 bp, Artificial Sequence
  chemically synthesized
agctcctctgtattttgcag

SEQ ID NO: 2887 - DNA, 20 bp, Artificial Sequence
  chemically synthesized
gctcctctgtattttgcaga

SEQ ID NO: 2888 - DNA, 20 bp, Artificial Sequence
  chemically synthesized
ctcctctgtattttgcagaa

SEQ ID NO: 2889 - DNA, 20 bp, Artificial Sequence
  chemically synthesized
tctgtattttgcagaagggt

SEQ ID NO: 2890 - DNA, 20 bp, Artificial Sequence
  chemically synthesized
cagaagggtcagtcttctgc

SEQ ID NO: 2891 - DNA, 20 bp, Artificial Sequence
  chemically synthesized
ggtcagtcttctgctggaac

SEQ ID NO: 2892 - DNA, 20 bp, Artificial Sequence
  chemically synthesized
gtcagtcttctgctggaacc

SEQ ID NO: 2893 - DNA, 20 bp, Artificial Sequence
  chemically synthesized
gtcttctgctggaaccgggt

SEQ ID NO: 2894 - DNA, 20 bp, Artificial Sequence
  chemically synthesized
tcttctgctggaaccgggtc

SEQ ID NO: 2895 - DNA, 20 bp, Artificial Sequence
  chemically synthesized
cttctgctggaaccgggtca

SEQ ID NO: 2896 - DNA, 20 bp, Artificial Sequence
  chemically synthesized
tctgctggaaccgggtcagg

SEQ ID NO: 2897 - DNA, 20 bp, Artificial Sequence
  chemically synthesized
ctggaaccgggtcagggagc

SEQ ID NO: 2898 - DNA, 20 bp, Artificial Sequence
  chemically synthesized
accgggtcagggagcaagat

SEQ ID NO: 2899 - DNA, 20 bp, Artificial Sequence
  chemically synthesized
gggtcagggagcaagatcag

SEQ ID NO: 2900 - DNA, 20 bp, Artificial Sequence
  chemically synthesized
gggagcaagatcagaagcat

SEQ ID NO: 2901 - DNA, 20 bp, Artificial Sequence
  chemically synthesized
cagaagcatcagtatctcac

SEQ ID NO: 2902 - DNA, 20 bp, Artificial Sequence
  chemically synthesized
atctcacaagtcacatgtga

SEQ ID NO: 2903 - DNA, 20 bp, Artificial Sequence
  chemically synthesized
tcacaagtcacatgtgatgg

SEQ ID NO: 2904 - DNA, 20 bp, Artificial Sequence
  chemically synthesized
cacaagtcacatgtgatggt

SEQ ID NO: 2905 - DNA, 20 bp, Artificial Sequence
  chemically synthesized
acaagtcacatgtgatggtg

SEQ ID NO: 2906 - DNA, 20 bp, Artificial Sequence
  chemically synthesized
gtcacatgtgatggtggggc

SEQ ID NO: 2907 - DNA, 20 bp, Artificial Sequence
  chemically synthesized
tcacatgtgatggtggggct

SEQ ID NO: 2908 - DNA, 20 bp, Artificial Sequence
  chemically synthesized
cacatgtgatggtggggcta

SEQ ID NO: 2909 - DNA, 20 bp, Artificial Sequence
  chemically synthesized
gtgatggtggggctagggta

SEQ ID NO: 2910 - DNA, 20 bp, Artificial Sequence
  chemically synthesized
tgatggtggggctagggtac

SEQ ID NO: 2911 - DNA, 20 bp, Artificial Sequence
  chemically synthesized
gtggggctagggtacaggct

SEQ ID NO: 2912 - DNA, 20 bp, Artificial Sequence
  chemically synthesized
ggggctagggtacaggctta

SEQ ID NO: 2913 - DNA, 20 bp, Artificial Sequence
  chemically synthesized
caggcttagagatatttatc

SEQ ID NO: 2914 - DNA, 20 bp, Artificial Sequence
  chemically synthesized
aggcttagagatatttatct

SEQ ID NO: 2915 - DNA, 20 bp, Artificial Sequence
  chemically synthesized
agagatatttatctgggaac

SEQ ID NO: 2916 - DNA, 20 bp, Artificial Sequence
  chemically synthesized
gaacaagtttattaacacta

SEQ ID NO: 2917 - DNA, 20 bp, Artificial Sequence
  chemically synthesized
actaaagttccacttatctg

SEQ ID NO: 2918 - DNA, 20 bp, Artificial Sequence
  chemically synthesized
aaagttccacttatctgcag

SEQ ID NO: 2919 - DNA, 20 bp, Artificial Sequence
  chemically synthesized
agttccacttatctgcagca

SEQ ID NO: 2920 - DNA, 20 bp, Artificial Sequence
  chemically synthesized
acttatctgcagcagagcct

SEQ ID NO: 2921 - DNA, 20 bp, Artificial Sequence
  chemically synthesized
cttatctgcagcagagcctt

SEQ ID NO: 2922 - DNA, 20 bp, Artificial Sequence
  chemically synthesized
agagccttaggtattaacgt

SEQ ID NO: 2923 - DNA, 20 bp, Artificial Sequence
  chemically synthesized
agccttaggtattaacgttg

SEQ ID NO: 2924 - DNA, 20 bp, Artificial Sequence
  chemically synthesized
gccttaggtattaacgttgg

SEQ ID NO: 2925 - DNA, 20 bp, Artificial Sequence
  chemically synthesized
taggtattaacgttggaggc

SEQ ID NO: 2926 - DNA, 20 bp, Artificial Sequence
  chemically synthesized
ttaacgttggaggccagaaa

SEQ ID NO: 2927 - DNA, 20 bp, Artificial Sequence
  chemically synthesized
tggaggccagaaatggaatt

SEQ ID NO: 2928 - DNA, 20 bp, Artificial Sequence
  chemically synthesized
ggaggccagaaatggaattc

SEQ ID NO: 2929 - DNA, 20 bp, Artificial Sequence
  chemically synthesized
gccagaaatggaattcagga

SEQ ID NO: 2930 - DNA, 20 bp, Artificial Sequence
  chemically synthesized
ccagaaatggaattcaggat

SEQ ID NO: 2931 - DNA, 20 bp, Artificial Sequence
  chemically synthesized
cagaaatggaattcaggatg

SEQ ID NO: 2932 - DNA, 20 bp, Artificial Sequence
  chemically synthesized
atggaattcaggatggggct

SEQ ID NO: 2933 - DNA, 20 bp, Artificial Sequence
  chemically synthesized
tcaggatggggctcagaaat

SEQ ID NO: 2934 - DNA, 20 bp, Artificial Sequence
  chemically synthesized
tcagaaataagaatgtgacc

SEQ ID NO: 2935 - DNA, 20 bp, Artificial Sequence
  chemically synthesized
cagaaataagaatgtgacca

SEQ ID NO: 2936 - DNA, 20 bp, Artificial Sequence
  chemically synthesized
ctgaactcttcttcccgtgt

SEQ ID NO: 2937 - DNA, 20 bp, Artificial Sequence
  chemically synthesized
tgaactcttcttcccgtgtt

SEQ ID NO: 2938 - DNA, 20 bp, Artificial Sequence
  chemically synthesized
ctcttcttcccgtgttgggc

SEQ ID NO: 2939 - DNA, 20 bp, Artificial Sequence
  chemically synthesized
tcttcttcccgtgttgggcc

SEQ ID NO: 2940 - DNA, 20 bp, Artificial Sequence
  chemically synthesized
cttcttcccgtgttgggcca

SEQ ID NO: 2941 - DNA, 20 bp, Artificial Sequence
  chemically synthesized
gttgggccagggctcttcgt

SEQ ID NO: 2942 - DNA, 20 bp, Artificial Sequence
  chemically synthesized
ttgggccagggctcttcgtt

SEQ ID NO: 2943 - DNA, 20 bp, Artificial Sequence
  chemically synthesized
ggctcttcgttaggcataat

SEQ ID NO: 2944 - DNA, 20 bp, Artificial Sequence
  chemically synthesized
tcttcgttaggcataatcag

SEQ ID NO: 2945 - DNA, 20 bp, Artificial Sequence
  chemically synthesized
cttcgttaggcataatcagt

SEQ ID NO: 2946 - DNA, 20 bp, Artificial Sequence
  chemically synthesized
gttaggcataatcagtggga

SEQ ID NO: 2947 - DNA, 20 bp, Artificial Sequence
  chemically synthesized
aaaaatgccctgatttttac

SEQ ID NO: 2948 - DNA, 20 bp, Artificial Sequence
  chemically synthesized
actcctaccatgatcaattt

SEQ ID NO: 2949 - DNA, 20 bp, Artificial Sequence
  chemically synthesized
tgatcaatttcagactacca

SEQ ID NO: 2950 - DNA, 20 bp, Artificial Sequence
  chemically synthesized
atcaatttcagactaccaaa

SEQ ID NO: 2951 - DNA, 20 bp, Artificial Sequence
  chemically synthesized
caaagagatgctattaaatg

SEQ ID NO: 2952 - DNA, 20 bp, Artificial Sequence
  chemically synthesized
aagagatgctattaaatgca

SEQ ID NO: 2953 - DNA, 20 bp, Artificial Sequence
  chemically synthesized
atgctattaaatgcagagct

SEQ ID NO: 2954 - DNA, 20 bp, Artificial Sequence
  chemically synthesized
attaaatgcagagctgagat

SEQ ID NO: 2955 - DNA, 20 bp, Artificial Sequence
  chemically synthesized
agagctgagatgagcataat

SEQ ID NO: 2956 - DNA, 20 bp, Artificial Sequence
  chemically synthesized
tgagcataatcagctttcct

SEQ ID NO: 2957 - DNA, 20 bp, Artificial Sequence
  chemically synthesized
cataatcagctttcctaagc

SEQ ID NO: 2958 - DNA, 20 bp, Artificial Sequence
  chemically synthesized
cagctttcctaagctggtgc

SEQ ID NO: 2959 - DNA, 20 bp, Artificial Sequence
  chemically synthesized
tttcctaagctggtgcaagc

SEQ ID NO: 2960 - DNA, 20 bp, Artificial Sequence
  chemically synthesized
aagccagcacattataccat

SEQ ID NO: 2961 - DNA, 20 bp, Artificial Sequence
  chemically synthesized
agccagcacattataccatt

SEQ ID NO: 2962 - DNA, 20 bp, Artificial Sequence
  chemically synthesized
tataccattaggcataacta

SEQ ID NO: 2963 - DNA, 20 bp, Artificial Sequence
  chemically synthesized
ggcataactatagttgatcc

SEQ ID NO: 2964 - DNA, 20 bp, Artificial Sequence
  chemically synthesized
ctatagttgatcctagacct

SEQ ID NO: 2965 - DNA, 20 bp, Artificial Sequence
  chemically synthesized
ctagacctcagatacttacc

SEQ ID NO: 2966 - DNA, 20 bp, Artificial Sequence
  chemically synthesized
tagacctcagatacttacct

SEQ ID NO: 2967 - DNA, 20 bp, Artificial Sequence
  chemically synthesized
acctcagatacttacctagg

SEQ ID NO: 2968 - DNA, 20 bp, Artificial Sequence
  chemically synthesized
atacttacctaggtggaact

SEQ ID NO: 2969 - DNA, 20 bp, Artificial Sequence
  chemically synthesized
acttacctaggtggaactga

SEQ ID NO: 2970 - DNA, 20 bp, Artificial Sequence
  chemically synthesized
tgttactgtttactttcaac

SEQ ID NO: 2971 - DNA, 20 bp, Artificial Sequence
  chemically synthesized
gttactgtttactttcaact

SEQ ID NO: 2972 - DNA, 20 bp, Artificial Sequence
  chemically synthesized
gtttactttcaactgggctg

SEQ ID NO: 2973 - DNA, 20 bp, Artificial Sequence
  chemically synthesized
tttcaactgggctgtggaca

SEQ ID NO: 2974 - DNA, 20 bp, Artificial Sequence
  chemically synthesized
tacctccctgtatatgtgct

SEQ ID NO: 2975 - DNA, 20 bp, Artificial Sequence
  chemically synthesized
tgtatatgtgcttagttgac

SEQ ID NO: 2976 - DNA, 20 bp, Artificial Sequence
  chemically synthesized
tatatgtgcttagttgactg

SEQ ID NO: 2977 - DNA, 20 bp, Artificial Sequence
  chemically synthesized
atatgtgcttagttgactgg

SEQ ID NO: 2978 - DNA, 20 bp, Artificial Sequence
  chemically synthesized
gcttagttgactggaggaca

SEQ ID NO: 2979 - DNA, 20 bp, Artificial Sequence
  chemically synthesized
ttagttgactggaggacata

SEQ ID NO: 2980 - DNA, 20 bp, Artificial Sequence
  chemically synthesized
ttgactggaggacatagaga

SEQ ID NO: 2981 - DNA, 20 bp, Artificial Sequence
  chemically synthesized
gacatagagacagaatgatt

SEQ ID NO: 2982 - DNA, 20 bp, Artificial Sequence
  chemically synthesized
agaatgattcagtatccctc

SEQ ID NO: 2983 - DNA, 20 bp, Artificial Sequence
  chemically synthesized
atgattcagtatccctcaag

SEQ ID NO: 2984 - DNA, 20 bp, Artificial Sequence
  chemically synthesized
ccctcaagaagcaattaacc

SEQ ID NO: 2985 - DNA, 20 bp, Artificial Sequence
  chemically synthesized
taaccaagaataattattcc

SEQ ID NO: 2986 - DNA, 20 bp, Artificial Sequence
  chemically synthesized
ataattattcccagaaactt

SEQ ID NO: 2987 - DNA, 20 bp, Artificial Sequence
  chemically synthesized
taattattcccagaaacttc

SEQ ID NO: 2988 - DNA, 20 bp, Artificial Sequence
  chemically synthesized
cccagaaacttcgggtgtat

SEQ ID NO: 2989 - DNA, 20 bp, Artificial Sequence
  chemically synthesized
cagaaacttcgggtgtatta

SEQ ID NO: 2990 - DNA, 20 bp, Artificial Sequence
  chemically synthesized
gaaacttcgggtgtattaga

SEQ ID NO: 2991 - DNA, 20 bp, Artificial Sequence
  chemically synthesized
cttcgggtgtattagagaga

SEQ ID NO: 2992 - DNA, 20 bp, Artificial Sequence
  chemically synthesized
ttcgggtgtattagagagaa

SEQ ID NO: 2993 - DNA, 20 bp, Artificial Sequence
  chemically synthesized
tcgggtgtattagagagaaa

SEQ ID NO: 2994 - DNA, 20 bp, Artificial Sequence
  chemically synthesized
cgggtgtattagagagaaag

SEQ ID NO: 2995 - DNA, 20 bp, Artificial Sequence
  chemically synthesized
gggtgtattagagagaaagg

SEQ ID NO: 2996 - DNA, 20 bp, Artificial Sequence
  chemically synthesized
ggtgtattagagagaaaggg

SEQ ID NO: 2997 - DNA, 20 bp, Artificial Sequence
  chemically synthesized
attagagagaaaggggggaa

SEQ ID NO: 2998 - DNA, 20 bp, Artificial Sequence
  chemically synthesized
gaaaggggggaatagttcct

SEQ ID NO: 2999 - DNA, 20 bp, Artificial Sequence
  chemically synthesized
aggggggaatagttcctgag

SEQ ID NO: 3000 - DNA, 20 bp, Artificial Sequence
  chemically synthesized
atagttcctgagaagcatgc

SEQ ID NO: 3001 - DNA, 20 bp, Artificial Sequence
  chemically synthesized
agttcctgagaagcatgctg

SEQ ID NO: 3002 - DNA, 20 bp, Artificial Sequence
  chemically synthesized
ttcctgagaagcatgctgga

SEQ ID NO: 3003 - DNA, 20 bp, Artificial Sequence
  chemically synthesized
cctgagaagcatgctggaga

SEQ ID NO: 3004 - DNA, 20 bp, Artificial Sequence
  chemically synthesized
atgctggagagagtatacat

SEQ ID NO: 3005 - DNA, 20 bp, Artificial Sequence
  chemically synthesized
aaacccaaataaacataaaa

SEQ ID NO: 3006 - DNA, 20 bp, Artificial Sequence
  chemically synthesized
attaattataatttaaatat

SEQ ID NO: 3007 - DNA, 20 bp, Artificial Sequence
  chemically synthesized
ataatttaaatataagacat

SEQ ID NO: 3008 - DNA, 20 bp, Artificial Sequence
  chemically synthesized
tcatttacaaaacttttatg

SEQ ID NO: 3009 - DNA, 20 bp, Artificial Sequence
  chemically synthesized
ttacaaaacttttatgtagt

SEQ ID NO: 3010 - DNA, 20 bp, Artificial Sequence
  chemically synthesized
tacaaaacttttatgtagtc

SEQ ID NO: 3011 - DNA, 20 bp, Artificial Sequence
  chemically synthesized
attatatacttttcattctt

SEQ ID NO: 3012 - DNA, 20 bp, Artificial Sequence
  chemically synthesized
atatacttttcattcttaag

SEQ ID NO: 3013 - DNA, 20 bp, Artificial Sequence
  chemically synthesized
aagaagctattccatataca

SEQ ID NO: 3014 - DNA, 20 bp, Artificial Sequence
  chemically synthesized
tattccatatacaaagtaaa

SEQ ID NO: 3015 - DNA, 20 bp, Artificial Sequence
  chemically synthesized
tccatatacaaagtaaaaag

SEQ ID NO: 3016 - DNA, 20 bp, Artificial Sequence
  chemically synthesized
catatacaaagtaaaaagtg

SEQ ID NO: 3017 - DNA, 20 bp, Artificial Sequence
  chemically synthesized
tatacaaagtaaaaagtgga

SEQ ID NO: 3018 - DNA, 20 bp, Artificial Sequence
  chemically synthesized
aagtaaaaagtggagagatg

SEQ ID NO: 3019 - DNA, 20 bp, Artificial Sequence
  chemically synthesized
gtaaaaagtggagagatgca

SEQ ID NO: 3020 - DNA, 20 bp, Artificial Sequence
  chemically synthesized
aaagtggagagatgcagagt

SEQ ID NO: 3021 - DNA, 20 bp, Artificial Sequence
  chemically synthesized
gagagatgcagagttggatc

SEQ ID NO: 3022 - DNA, 20 bp, Artificial Sequence
  chemically synthesized
gagatgcagagttggatcta

SEQ ID NO: 3023 - DNA, 20 bp, Artificial Sequence
  chemically synthesized
tgcagagttggatctagagc

SEQ ID NO: 3024 - DNA, 20 bp, Artificial Sequence
  chemically synthesized
cagagttggatctagagcta

SEQ ID NO: 3025 - DNA, 20 bp, Artificial Sequence
  chemically synthesized
gttggatctagagctagaga

SEQ ID NO: 3026 - DNA, 20 bp, Artificial Sequence
  chemically synthesized
tagagctagagacggaactg

SEQ ID NO: 3027 - DNA, 20 bp, Artificial Sequence
  chemically synthesized
gctagagacggaactgcaga

SEQ ID NO: 3028 - DNA, 20 bp, Artificial Sequence
  chemically synthesized
ctagagacggaactgcagat

SEQ ID NO: 3029 - DNA, 20 bp, Artificial Sequence
  chemically synthesized
tagagacggaactgcagata

SEQ ID NO: 3030 - DNA, 20 bp, Artificial Sequence
  chemically synthesized
gacggaactgcagataggga

SEQ ID NO: 3031 - DNA, 20 bp, Artificial Sequence
  chemically synthesized
ggaactgcagatagggatag

SEQ ID NO: 3032 - DNA, 20 bp, Artificial Sequence
  chemically synthesized
tgcagatagggatagtggtg

SEQ ID NO: 3033 - DNA, 20 bp, Artificial Sequence
  chemically synthesized
gatagggatagtggtgtaga

SEQ ID NO: 3034 - DNA, 20 bp, Artificial Sequence
  chemically synthesized
tagtggtgtagatagtaata

SEQ ID NO: 3035 - DNA, 20 bp, Artificial Sequence
  chemically synthesized
agtggtgtagatagtaataa

SEQ ID NO: 3036 - DNA, 20 bp, Artificial Sequence
  chemically synthesized
gtggtgtagatagtaataaa

SEQ ID NO: 3037 - DNA, 20 bp, Artificial Sequence
  chemically synthesized
tggtgtagatagtaataaag

SEQ ID NO: 3038 - DNA, 20 bp, Artificial Sequence
  chemically synthesized
ggtgtagatagtaataaagg

SEQ ID NO: 3039 - DNA, 20 bp, Artificial Sequence
  chemically synthesized
tagatagtaataaaggggga

SEQ ID NO: 3040 - DNA, 20 bp, Artificial Sequence
  chemically synthesized
gatagtaataaagggggata

SEQ ID NO: 3041 - DNA, 20 bp, Artificial Sequence
  chemically synthesized
gtaataaagggggatagaga

SEQ ID NO: 3042 - DNA, 20 bp, Artificial Sequence
  chemically synthesized
tagagacagtaatcatgata

SEQ ID NO: 3043 - DNA, 20 bp, Artificial Sequence
  chemically synthesized
gacagtaatcatgataaaga

SEQ ID NO: 3044 - DNA, 20 bp, Artificial Sequence
  chemically synthesized
acagtaatcatgataaagac

SEQ ID NO: 3045 - DNA, 20 bp, Artificial Sequence
  chemically synthesized
atgataaagacaggtaataa

SEQ ID NO: 3046 - DNA, 20 bp, Artificial Sequence
  chemically synthesized
aagacaggtaataatagtgt

SEQ ID NO: 3047 - DNA, 20 bp, Artificial Sequence
  chemically synthesized
gacaggtaataatagtgtta

SEQ ID NO: 3048 - DNA, 20 bp, Artificial Sequence
  chemically synthesized
gattccacctgaaatttgtt

SEQ ID NO: 3049 - DNA, 20 bp, Artificial Sequence
  chemically synthesized
attccacctgaaatttgttt

SEQ ID NO: 3050 - DNA, 20 bp, Artificial Sequence
  chemically synthesized
ttccacctgaaatttgtttg

SEQ ID NO: 3051 - DNA, 20 bp, Artificial Sequence
  chemically synthesized
tccacctgaaatttgtttgg

SEQ ID NO: 3052 - DNA, 20 bp, Artificial Sequence
  chemically synthesized
tgaaatttgtttgggggact

SEQ ID NO: 3053 - DNA, 20 bp, Artificial Sequence
  chemically synthesized
gaaatttgtttgggggactt

SEQ ID NO: 3054 - DNA, 20 bp, Artificial Sequence
  chemically synthesized
gtttgggggacttgggtaat

SEQ ID NO: 3055 - DNA, 20 bp, Artificial Sequence
  chemically synthesized
gggtaattagaattttactt

SEQ ID NO: 3056 - DNA, 20 bp, Artificial Sequence
  chemically synthesized
taaacaatttttctaatacc

SEQ ID NO: 3057 - DNA, 20 bp, Artificial Sequence
  chemically synthesized
atttttctaataccaagtat

SEQ ID NO: 3058 - DNA, 20 bp, Artificial Sequence
  chemically synthesized
ctaataccaagtataagatc

SEQ ID NO: 3059 - DNA, 20 bp, Artificial Sequence
  chemically synthesized
taataccaagtataagatca

SEQ ID NO: 3060 - DNA, 20 bp, Artificial Sequence
  chemically synthesized
aataccaagtataagatcaa

SEQ ID NO: 3061 - DNA, 20 bp, Artificial Sequence
  chemically synthesized
ccaagtataagatcaagggt

SEQ ID NO: 3062 - DNA, 20 bp, Artificial Sequence
  chemically synthesized
aagatcaagggttggtctcc

SEQ ID NO: 3063 - DNA, 20 bp, Artificial Sequence
  chemically synthesized
ggttggtctccaagcatgat

SEQ ID NO: 3064 - DNA, 20 bp, Artificial Sequence
  chemically synthesized
gttggtctccaagcatgatg

SEQ ID NO: 3065 - DNA, 20 bp, Artificial Sequence
  chemically synthesized
ttggtctccaagcatgatga

SEQ ID NO: 3066 - DNA, 20 bp, Artificial Sequence
  chemically synthesized
tttatatttttatataaata

SEQ ID NO: 3067 - DNA, 20 bp, Artificial Sequence
  chemically synthesized
tataaatatggatctaattc

SEQ ID NO: 3068 - DNA, 20 bp, Artificial Sequence
  chemically synthesized
tatacaacttcatattcaat

SEQ ID NO: 3069 - DNA, 20 bp, Artificial Sequence
  chemically synthesized
aacttcatattcaattggtc

SEQ ID NO: 3070 - DNA, 20 bp, Artificial Sequence
  chemically synthesized
aactttgtattctttcaaat

SEQ ID NO: 3071 - DNA, 20 bp, Artificial Sequence
  chemically synthesized
actttgtattctttcaaata

SEQ ID NO: 3072 - DNA, 20 bp, Artificial Sequence
  chemically synthesized
ttctttcaaataaggattaa

SEQ ID NO: 3073 - DNA, 20 bp, Artificial Sequence
  chemically synthesized
ttcaaataaggattaaaagc

SEQ ID NO: 3074 - DNA, 20 bp, Artificial Sequence
  chemically synthesized
taatgacctaaattgaacta

SEQ ID NO: 3075 - DNA, 20 bp, Artificial Sequence
  chemically synthesized
aactaaagccataacaccct

SEQ ID NO: 3076 - DNA, 20 bp, Artificial Sequence
  chemically synthesized
taaagccataacaccctcgg

SEQ ID NO: 3077 - DNA, 20 bp, Artificial Sequence
  chemically synthesized
aaagccataacaccctcgga

SEQ ID NO: 3078 - DNA, 20 bp, Artificial Sequence
  chemically synthesized
gccataacaccctcggaagg

SEQ ID NO: 3079 - DNA, 20 bp, Artificial Sequence
  chemically synthesized
aacaccctcggaaggaagca

SEQ ID NO: 3080 - DNA, 20 bp, Artificial Sequence
  chemically synthesized
acaccctcggaaggaagcat

SEQ ID NO: 3081 - DNA, 20 bp, Artificial Sequence
  chemically synthesized
catgaactttgattttacaa

SEQ ID NO: 3082 - DNA, 20 bp, Artificial Sequence
  chemically synthesized
ttgattttacaatagattct

SEQ ID NO: 3083 - DNA, 20 bp, Artificial Sequence
  chemically synthesized
attcttagatatgacacaaa

SEQ ID NO: 3084 - DNA, 20 bp, Artificial Sequence
  chemically synthesized
agatatgacacaaaaagtat

SEQ ID NO: 3085 - DNA, 20 bp, Artificial Sequence
  chemically synthesized
caaaaaataaatacataaat

SEQ ID NO: 3086 - DNA, 20 bp, Artificial Sequence
  chemically synthesized
taaattggatttcatttaaa

SEQ ID NO: 3087 - DNA, 20 bp, Artificial Sequence
  chemically synthesized
ttcatgcaacaaacgacttt

SEQ ID NO: 3088 - DNA, 20 bp, Artificial Sequence
  chemically synthesized
tgcaacaaacgactttaaga

SEQ ID NO: 3089 - DNA, 20 bp, Artificial Sequence
  chemically synthesized
aacgactttaagaaagtaaa

SEQ ID NO: 3090 - DNA, 20 bp, Artificial Sequence
  chemically synthesized
aaagtaaaaagacaacctat

SEQ ID NO: 3091 - DNA, 20 bp, Artificial Sequence
  chemically synthesized
aaaaagacaacctataagat

SEQ ID NO: 3092 - DNA, 20 bp, Artificial Sequence
  chemically synthesized
aaagacaacctataagatga

SEQ ID NO: 3093 - DNA, 20 bp, Artificial Sequence
  chemically synthesized
ttgcaaattatgtatttcat

SEQ ID NO: 3094 - DNA, 20 bp, Artificial Sequence
  chemically synthesized
tatttcataagtttaatatc

SEQ ID NO: 3095 - DNA, 20 bp, Artificial Sequence
  chemically synthesized
aatatccagaatgtatgaaa

SEQ ID NO: 3096 - DNA, 20 bp, Artificial Sequence
  chemically synthesized
tcctacaactcaaaaacaaa

SEQ ID NO: 3097 - DNA, 20 bp, Artificial Sequence
  chemically synthesized
atttaaaaatatgcaaatga

SEQ ID NO: 3098 - DNA, 20 bp, Artificial Sequence
  chemically synthesized
tttaaaaatatgcaaatgat

SEQ ID NO: 3099 - DNA, 20 bp, Artificial Sequence
  chemically synthesized
aatatgcaaatgatgggaat

SEQ ID NO: 3100 - DNA, 20 bp, Artificial Sequence
  chemically synthesized
tgatgggaatgagtaatttc

SEQ ID NO: 3101 - DNA, 20 bp, Artificial Sequence
  chemically synthesized
gggaatgagtaatttctaga

SEQ ID NO: 3102 - DNA, 20 bp, Artificial Sequence
  chemically synthesized
aatgagtaatttctagaaag

SEQ ID NO: 3103 - DNA, 20 bp, Artificial Sequence
  chemically synthesized
gaagatatacaaatgaacat

SEQ ID NO: 3104 - DNA, 20 bp, Artificial Sequence
  chemically synthesized
atgcaaaccaaaaccacaat

SEQ ID NO: 3105 - DNA, 20 bp, Artificial Sequence
  chemically synthesized
agacactacttcaaacttac

SEQ ID NO: 3106 - DNA, 20 bp, Artificial Sequence
  chemically synthesized
tactagaatgtctatacttt

SEQ ID NO: 3107 - DNA, 20 bp, Artificial Sequence
  chemically synthesized
ctagaatgtctatactttaa

SEQ ID NO: 3108 - DNA, 20 bp, Artificial Sequence
  chemically synthesized
agagaaacaaaacaaatgaa

SEQ ID NO: 3109 - DNA, 20 bp, Artificial Sequence
  chemically synthesized
caaaacaaatgaaaagtaac

SEQ ID NO: 3110 - DNA, 20 bp, Artificial Sequence
  chemically synthesized
aaaagtaacaagtgttgaca

SEQ ID NO: 3111 - DNA, 20 bp, Artificial Sequence
  chemically synthesized
acaagtgttgacaaagatat

SEQ ID NO: 3112 - DNA, 20 bp, Artificial Sequence
  chemically synthesized
tgacaaagatataagaaaat

SEQ ID NO: 3113 - DNA, 20 bp, Artificial Sequence
  chemically synthesized
atattgctgctaaaaatgtt

SEQ ID NO: 3114 - DNA, 20 bp, Artificial Sequence
  chemically synthesized
ttgctgctaaaaatgttaag

SEQ ID NO: 3115 - DNA, 20 bp, Artificial Sequence
  chemically synthesized
gttaagtggtgcaacttctg

SEQ ID NO: 3116 - DNA, 20 bp, Artificial Sequence
  chemically synthesized
ttctgtagaaaatattttga

SEQ ID NO: 3117 - DNA, 20 bp, Artificial Sequence
  chemically synthesized
ttgacagttcttcaaaaact

SEQ ID NO: 3118 - DNA, 20 bp, Artificial Sequence
  chemically synthesized
tgacagttcttcaaaaactt

SEQ ID NO: 3119 - DNA, 20 bp, Artificial Sequence
  chemically synthesized
tgaccccaaaattcctctcc

SEQ ID NO: 3120 - DNA, 20 bp, Artificial Sequence
  chemically synthesized
gaccccaaaattcctctcct

SEQ ID NO: 3121 - DNA, 20 bp, Artificial Sequence
  chemically synthesized
atatattaaaaatatatata

SEQ ID NO: 3122 - DNA, 20 bp, Artificial Sequence
  chemically synthesized
aatatatataaagatttaaa

SEQ ID NO: 3123 - DNA, 20 bp, Artificial Sequence
  chemically synthesized
atatatataaagatttaaac

SEQ ID NO: 3124 - DNA, 20 bp, Artificial Sequence
  chemically synthesized
ttgtactgaaatgttcattg

SEQ ID NO: 3125 - DNA, 20 bp, Artificial Sequence
  chemically synthesized
cattgtagcattattcacaa

SEQ ID NO: 3126 - DNA, 20 bp, Artificial Sequence
  chemically synthesized
gcattattcacaatagccaa

SEQ ID NO: 3127 - DNA, 20 bp, Artificial Sequence
  chemically synthesized
cattattcacaatagccaaa

SEQ ID NO: 3128 - DNA, 20 bp, Artificial Sequence
  chemically synthesized
tattcacaatagccaaaagg

SEQ ID NO: 3129 - DNA, 20 bp, Artificial Sequence
  chemically synthesized
agccaaaaggtggaaacaac

SEQ ID NO: 3130 - DNA, 20 bp, Artificial Sequence
  chemically synthesized
acaaccagaatgtacataaa

SEQ ID NO: 3131 - DNA, 20 bp, Artificial Sequence
  chemically synthesized
aatgtgatatatacacacaa

SEQ ID NO: 3132 - DNA, 20 bp, Artificial Sequence
  chemically synthesized
acacacaatggaatattatg

SEQ ID NO: 3133 - DNA, 20 bp, Artificial Sequence
  chemically synthesized
aatattatgtagcaataaaa

SEQ ID NO: 3134 - DNA, 20 bp, Artificial Sequence
  chemically synthesized
tgtagcaataaaaaagaatg

SEQ ID NO: 3135 - DNA, 20 bp, Artificial Sequence
  chemically synthesized
caataaaaaagaatgaagta

SEQ ID NO: 3136 - DNA, 20 bp, Artificial Sequence
  chemically synthesized
aaaagaatgaagtacagatg

SEQ ID NO: 3137 - DNA, 20 bp, Artificial Sequence
  chemically synthesized
gaatgaagtacagatgcagt

SEQ ID NO: 3138 - DNA, 20 bp, Artificial Sequence
  chemically synthesized
tccttatttaatgtcatgaa

SEQ ID NO: 3139 - DNA, 20 bp, Artificial Sequence
  chemically synthesized
ccttatttaatgtcatgaat

SEQ ID NO: 3140 - DNA, 20 bp, Artificial Sequence
  chemically synthesized
taatgtcatgaataggtttt

SEQ ID NO: 3141 - DNA, 20 bp, Artificial Sequence
  chemically synthesized
catgaataggtttttggaaa

SEQ ID NO: 3142 - DNA, 20 bp, Artificial Sequence
  chemically synthesized
tttttggaaatggcaacttt

SEQ ID NO: 3143 - DNA, 20 bp, Artificial Sequence
  chemically synthesized
ttaagtgaaatgatgtaaaa

SEQ ID NO: 3144 - DNA, 20 bp, Artificial Sequence
  chemically synthesized
atcctcaaataacactgttt

SEQ ID NO: 3145 - DNA, 20 bp, Artificial Sequence
  chemically synthesized
actgttttagccaacactgt

SEQ ID NO: 3146 - DNA, 20 bp, Artificial Sequence
  chemically synthesized
tttagccaacactgttagat

SEQ ID NO: 3147 - DNA, 20 bp, Artificial Sequence
  chemically synthesized
ctgttagatgagaaaaaaaa

SEQ ID NO: 3148 - DNA, 20 bp, Artificial Sequence
  chemically synthesized
ggatatcattatatgtcact

SEQ ID NO: 3149 - DNA, 20 bp, Artificial Sequence
  chemically synthesized
attatatgtcacttggctta

SEQ ID NO: 3150 - DNA, 20 bp, Artificial Sequence
  chemically synthesized
tgtcacttggcttaaagttt

SEQ ID NO: 3151 - DNA, 20 bp, Artificial Sequence
  chemically synthesized
ggcttaaagtttcagtttcc

SEQ ID NO: 3152 - DNA, 20 bp, Artificial Sequence
  chemically synthesized
agtttccaagaatctatgaa

SEQ ID NO: 3153 - DNA, 20 bp, Artificial Sequence
  chemically synthesized
atctatgaatggacaacatt

SEQ ID NO: 3154 - DNA, 20 bp, Artificial Sequence
  chemically synthesized
tgaatggacaacattaagca

SEQ ID NO: 3155 - DNA, 20 bp, Artificial Sequence
  chemically synthesized
acttaccactatacatgtta

SEQ ID NO: 3156 - DNA, 20 bp, Artificial Sequence
  chemically synthesized
ccactatacatgttatggca

SEQ ID NO: 3157 - DNA, 20 bp, Artificial Sequence
  chemically synthesized
tatacatgttatggcatgga

SEQ ID NO: 3158 - DNA, 20 bp, Artificial Sequence
  chemically synthesized
tggactttgaaaccttatgt

SEQ ID NO: 3159 - DNA, 20 bp, Artificial Sequence
  chemically synthesized
ggactttgaaaccttatgtt

SEQ ID NO: 3160 - DNA, 20 bp, Artificial Sequence
  chemically synthesized
aaccttatgttgggtaaaat

SEQ ID NO: 3161 - DNA, 20 bp, Artificial Sequence
  chemically synthesized
ttatgttgggtaaaataagc

SEQ ID NO: 3162 - DNA, 20 bp, Artificial Sequence
  chemically synthesized
tttatatgaattatctaaaa

SEQ ID NO: 3163 - DNA, 20 bp, Artificial Sequence
  chemically synthesized
ttatctaaaatagactgatt

SEQ ID NO: 3164 - DNA, 20 bp, Artificial Sequence
  chemically synthesized
atctaaaatagactgattta

SEQ ID NO: 3165 - DNA, 20 bp, Artificial Sequence
  chemically synthesized
gactgatttagagaaacata

SEQ ID NO: 3166 - DNA, 20 bp, Artificial Sequence
  chemically synthesized
tgatttagagaaacatatag

SEQ ID NO: 3167 - DNA, 20 bp, Artificial Sequence
  chemically synthesized
tagagaaacatatagtagat

SEQ ID NO: 3168 - DNA, 20 bp, Artificial Sequence
  chemically synthesized
gagaaacatatagtagatta

SEQ ID NO: 3169 - DNA, 20 bp, Artificial Sequence
  chemically synthesized
agaaacatatagtagattag

SEQ ID NO: 3170 - DNA, 20 bp, Artificial Sequence
  chemically synthesized
tagtagattagaggttacta

SEQ ID NO: 3171 - DNA, 20 bp, Artificial Sequence
  chemically synthesized
agtagattagaggttactat

SEQ ID NO: 3172 - DNA, 20 bp, Artificial Sequence
  chemically synthesized
attagaggttactatgggac

SEQ ID NO: 3173 - DNA, 20 bp, Artificial Sequence
  chemically synthesized
ttagaggttactatgggact

SEQ ID NO: 3174 - DNA, 20 bp, Artificial Sequence
  chemically synthesized
tagaggttactatgggactg

SEQ ID NO: 3175 - DNA, 20 bp, Artificial Sequence
  chemically synthesized
gaggttactatgggactggg

SEQ ID NO: 3176 - DNA, 20 bp, Artificial Sequence
  chemically synthesized
ctggggagttactgcctaac

SEQ ID NO: 3177 - DNA, 20 bp, Artificial Sequence
  chemically synthesized
gagttactgcctaacaagta

SEQ ID NO: 3178 - DNA, 20 bp, Artificial Sequence
  chemically synthesized
acaagtatagcatttctgct

SEQ ID NO: 3179 - DNA, 20 bp, Artificial Sequence
  chemically synthesized
tttctgcttggatgatgaaa

SEQ ID NO: 3180 - DNA, 20 bp, Artificial Sequence
  chemically synthesized
cttggatgatgaaaaagttt

SEQ ID NO: 3181 - DNA, 20 bp, Artificial Sequence
  chemically synthesized
tgatgaaaaagttttggcat

SEQ ID NO: 3182 - DNA, 20 bp, Artificial Sequence
  chemically synthesized
aaagttttggcatgagatca

SEQ ID NO: 3183 - DNA, 20 bp, Artificial Sequence
  chemically synthesized
ttggcatgagatcatggtga

SEQ ID NO: 3184 - DNA, 20 bp, Artificial Sequence
  chemically synthesized
gcatgagatcatggtgatag

SEQ ID NO: 3185 - DNA, 20 bp, Artificial Sequence
  chemically synthesized
cacataattatacttaaaaa

SEQ ID NO: 3186 - DNA, 20 bp, Artificial Sequence
  chemically synthesized
atacttaaaaatggttaata

SEQ ID NO: 3187 - DNA, 20 bp, Artificial Sequence
  chemically synthesized
ttaaaaatggttaatatggt

SEQ ID NO: 3188 - DNA, 20 bp, Artificial Sequence
  chemically synthesized
gctttattatatatgatata

SEQ ID NO: 3189 - DNA, 20 bp, Artificial Sequence
  chemically synthesized
atgatatacggtattatatg

SEQ ID NO: 3190 - DNA, 20 bp, Artificial Sequence
  chemically synthesized
aaactttatcacaataaaaa

SEQ ID NO: 3191 - DNA, 20 bp, Artificial Sequence
  chemically synthesized
tttatcacaataaaaatgga

SEQ ID NO: 3192 - DNA, 20 bp, Artificial Sequence
  chemically synthesized
aatggaaagaaatttaaaac

SEQ ID NO: 3193 - DNA, 20 bp, Artificial Sequence
  chemically synthesized
agacaaatttttattttgat

SEQ ID NO: 3194 - DNA, 20 bp, Artificial Sequence
  chemically synthesized
gacaaatttttattttgatt

SEQ ID NO: 3195 - DNA, 20 bp, Artificial Sequence
  chemically synthesized
acaaatttttattttgatta

SEQ ID NO: 3196 - DNA, 20 bp, Artificial Sequence
  chemically synthesized
ggttgaattgaatttattat

SEQ ID NO: 3197 - DNA, 20 bp, Artificial Sequence
  chemically synthesized
atttattatgagttgtttct

SEQ ID NO: 3198 - DNA, 20 bp, Artificial Sequence
  chemically synthesized
ttattatgagttgtttctga

SEQ ID NO: 3199 - DNA, 20 bp, Artificial Sequence
  chemically synthesized
aacaattatttcatttattt

SEQ ID NO: 3200 - DNA, 20 bp, Artificial Sequence
  chemically synthesized
acaattatttcatttatttt

SEQ ID NO: 3201 - DNA, 20 bp, Artificial Sequence
  chemically synthesized
atttattttaggcacatata

SEQ ID NO: 3202 - DNA, 20 bp, Artificial Sequence
  chemically synthesized
atacagttctattatcattt

SEQ ID NO: 3203 - DNA, 20 bp, Artificial Sequence
  chemically synthesized
tacagttctattatcatttt

SEQ ID NO: 3204 - DNA, 20 bp, Artificial Sequence
  chemically synthesized
gtttttgttttacgtatttt

SEQ ID NO: 3205 - DNA, 20 bp, Artificial Sequence
  chemically synthesized
tacgtatttttggttttttt

SEQ ID NO: 3206 - DNA, 20 bp, Artificial Sequence
  chemically synthesized
tatttttggtttttttgaga

SEQ ID NO: 3207 - DNA, 20 bp, Artificial Sequence
  chemically synthesized
tttttggtttttttgagatg

SEQ ID NO: 3208 - DNA, 20 bp, Artificial Sequence
  chemically synthesized
tgagatggagtctctctctg

SEQ ID NO: 3209 - DNA, 20 bp, Artificial Sequence
  chemically synthesized
tggagtctctctctgtggtc

SEQ ID NO: 3210 - DNA, 20 bp, Artificial Sequence
  chemically synthesized
ggagtctctctctgtggtcc

SEQ ID NO: 3211 - DNA, 20 bp, Artificial Sequence
  chemically synthesized
tctctctctgtggtccaggc

SEQ ID NO: 3212 - DNA, 20 bp, Artificial Sequence
  chemically synthesized
tctctctgtggtccaggcta

SEQ ID NO: 3213 - DNA, 20 bp, Artificial Sequence
  chemically synthesized
tctgtggtccaggctagagt

SEQ ID NO: 3214 - DNA, 20 bp, Artificial Sequence
  chemically synthesized
ctgtggtccaggctagagtg

SEQ ID NO: 3215 - DNA, 20 bp, Artificial Sequence
  chemically synthesized
agagtgaggtgacgcgatct

SEQ ID NO: 3216 - DNA, 20 bp, Artificial Sequence
  chemically synthesized
ctcactgcaacctccgcctc

SEQ ID NO: 3217 - DNA, 20 bp, Artificial Sequence
  chemically synthesized
ttcaaatcattctcctgcct

SEQ ID NO: 3218 - DNA, 20 bp, Artificial Sequence
  chemically synthesized
tcctgcctcagcctcccatg

SEQ ID NO: 3219 - DNA, 20 bp, Artificial Sequence
  chemically synthesized
gcctcagcctcccatgtagc

SEQ ID NO: 3220 - DNA, 20 bp, Artificial Sequence
  chemically synthesized
cctcagcctcccatgtagct

SEQ ID NO: 3221 - DNA, 20 bp, Artificial Sequence
  chemically synthesized
ctcccatgtagctgggatta

SEQ ID NO: 3222 - DNA, 20 bp, Artificial Sequence
  chemically synthesized
tcccatgtagctgggattac

SEQ ID NO: 3223 - DNA, 20 bp, Artificial Sequence
  chemically synthesized
caggtgtgcgccaccacgtc

SEQ ID NO: 3224 - DNA, 20 bp, Artificial Sequence
  chemically synthesized
ttcccattctattttcctat

SEQ ID NO: 3225 - DNA, 20 bp, Artificial Sequence
  chemically synthesized
tattttcctattggttcttg

SEQ ID NO: 3226 - DNA, 20 bp, Artificial Sequence
  chemically synthesized
tatataactctttttacttt

SEQ ID NO: 3227 - DNA, 20 bp, Artificial Sequence
  chemically synthesized
atataactctttttactttc

SEQ ID NO: 3228 - DNA, 20 bp, Artificial Sequence
  chemically synthesized
aatgatcatatcatatacaa

SEQ ID NO: 3229 - DNA, 20 bp, Artificial Sequence
  chemically synthesized
atcatatcatatacaaaaga

SEQ ID NO: 3230 - DNA, 20 bp, Artificial Sequence
  chemically synthesized
caaaagaaagttaaaaaata

SEQ ID NO: 3231 - DNA, 20 bp, Artificial Sequence
  chemically synthesized
aaaagaaagttaaaaaataa

SEQ ID NO: 3232 - DNA, 20 bp, Artificial Sequence
  chemically synthesized
aaagttaaaaaataaaggca

SEQ ID NO: 3233 - DNA, 20 bp, Artificial Sequence
  chemically synthesized
taaaggcaaagatgtaaata

SEQ ID NO: 3234 - DNA, 20 bp, Artificial Sequence
  chemically synthesized
gtaaataaagaaatacaccc

SEQ ID NO: 3235 - DNA, 20 bp, Artificial Sequence
  chemically synthesized
atacaccccagattacaatt

SEQ ID NO: 3236 - DNA, 20 bp, Artificial Sequence
  chemically synthesized
ttgcttgattgatattaact

SEQ ID NO: 3237 - DNA, 20 bp, Artificial Sequence
  chemically synthesized
attgatattaactaagacct

SEQ ID NO: 3238 - DNA, 20 bp, Artificial Sequence
  chemically synthesized
agacctcagttataaaacaa

SEQ ID NO: 3239 - DNA, 20 bp, Artificial Sequence
  chemically synthesized
agttataaaacaatagtctg

SEQ ID NO: 3240 - DNA, 20 bp, Artificial Sequence
  chemically synthesized
tataaaacaatagtctgtag

SEQ ID NO: 3241 - DNA, 20 bp, Artificial Sequence
  chemically synthesized
acaatagtctgtagtggtac

SEQ ID NO: 3242 - DNA, 20 bp, Artificial Sequence
  chemically synthesized
gtctgtagtggtactggtct

SEQ ID NO: 3243 - DNA, 20 bp, Artificial Sequence
  chemically synthesized
ttctcaccttatcaatcact

SEQ ID NO: 3244 - DNA, 20 bp, Artificial Sequence
  chemically synthesized
ttgtttttgctaattctgtc

SEQ ID NO: 3245 - DNA, 20 bp, Artificial Sequence
  chemically synthesized
ttctgtctagaacaccatat

SEQ ID NO: 3246 - DNA, 20 bp, Artificial Sequence
  chemically synthesized
ctagaacaccatatcagttt

SEQ ID NO: 3247 - DNA, 20 bp, Artificial Sequence
  chemically synthesized
acaccatatcagttttagct

SEQ ID NO: 3248 - DNA, 20 bp, Artificial Sequence
  chemically synthesized
ctccctgctttaaaattgtt

SEQ ID NO: 3249 - DNA, 20 bp, Artificial Sequence
  chemically synthesized
gtttggtttctgcccttttt

SEQ ID NO: 3250 - DNA, 20 bp, Artificial Sequence
  chemically synthesized
ttccctttcccttcctgctg

SEQ ID NO: 3251 - DNA, 20 bp, Artificial Sequence
  chemically synthesized
tccctttcccttcctgctga

SEQ ID NO: 3252 - DNA, 20 bp, Artificial Sequence
  chemically synthesized
ccttcctgctgaaggattac

SEQ ID NO: 3253 - DNA, 20 bp, Artificial Sequence
  chemically synthesized
ctgctgaaggattactggtt

SEQ ID NO: 3254 - DNA, 20 bp, Artificial Sequence
  chemically synthesized
tgctgaaggattactggtta

SEQ ID NO: 3255 - DNA, 20 bp, Artificial Sequence
  chemically synthesized
ctgaaggattactggttaag

SEQ ID NO: 3256 - DNA, 20 bp, Artificial Sequence
  chemically synthesized
aggattactggttaaggaga

SEQ ID NO: 3257 - DNA, 20 bp, Artificial Sequence
  chemically synthesized
attactggttaaggagacag

SEQ ID NO: 3258 - DNA, 20 bp, Artificial Sequence
  chemically synthesized
tgaaaacttcttctcatgtc

SEQ ID NO: 3259 - DNA, 20 bp, Artificial Sequence
  chemically synthesized
gaaaacttcttctcatgtcc

SEQ ID NO: 3260 - DNA, 20 bp, Artificial Sequence
  chemically synthesized
aaaacttcttctcatgtcca

SEQ ID NO: 3261 - DNA, 20 bp, Artificial Sequence
  chemically synthesized
tcttctcatgtccagggcaa

SEQ ID NO: 3262 - DNA, 20 bp, Artificial Sequence
  chemically synthesized
tcatgtccagggcaatggct

SEQ ID NO: 3263 - DNA, 20 bp, Artificial Sequence
  chemically synthesized
tggctcagtaatgttaaatt

SEQ ID NO: 3264 - DNA, 20 bp, Artificial Sequence
  chemically synthesized
ctcagtaatgttaaattcag

SEQ ID NO: 3265 - DNA, 20 bp, Artificial Sequence
  chemically synthesized
tgttaaattcagcagctgca

SEQ ID NO: 3266 - DNA, 20 bp, Artificial Sequence
  chemically synthesized
attcagcagctgcatagcaa

SEQ ID NO: 3267 - DNA, 20 bp, Artificial Sequence
  chemically synthesized
agccatttcctaaatccttt

SEQ ID NO: 3268 - DNA, 20 bp, Artificial Sequence
  chemically synthesized
cctaaatcctttcagaatct

SEQ ID NO: 3269 - DNA, 20 bp, Artificial Sequence
  chemically synthesized
gaatctgagtgctcaactga

SEQ ID NO: 3270 - DNA, 20 bp, Artificial Sequence
  chemically synthesized
tgctcaactgaaagtttatt

SEQ ID NO: 3271 - DNA, 20 bp, Artificial Sequence
  chemically synthesized
ctcaactgaaagtttattta

SEQ ID NO: 3272 - DNA, 20 bp, Artificial Sequence
  chemically synthesized
gacatgtatatgttactgtg

SEQ ID NO: 3273 - DNA, 20 bp, Artificial Sequence
  chemically synthesized
atatattcatatacctattt

SEQ ID NO: 3274 - DNA, 20 bp, Artificial Sequence
  chemically synthesized
atatcatgttgcatgcattt

SEQ ID NO: 3275 - DNA, 20 bp, Artificial Sequence
  chemically synthesized
atgcattttggatgtgaaat

SEQ ID NO: 3276 - DNA, 20 bp, Artificial Sequence
  chemically synthesized
atgtgaaattggcattttct

SEQ ID NO: 3277 - DNA, 20 bp, Artificial Sequence
  chemically synthesized
agctccccactgctaaaatc

SEQ ID NO: 3278 - DNA, 20 bp, Artificial Sequence
  chemically synthesized
tacaaaatcttcctaccttt

SEQ ID NO: 3279 - DNA, 20 bp, Artificial Sequence
  chemically synthesized
ccatcatattattactttta

SEQ ID NO: 3280 - DNA, 20 bp, Artificial Sequence
  chemically synthesized
atcatattattacttttatg

SEQ ID NO: 3281 - DNA, 20 bp, Artificial Sequence
  chemically synthesized
ttatggagaaatgcaacgct

SEQ ID NO: 3282 - DNA, 20 bp, Artificial Sequence
  chemically synthesized
gctgagtgtaaatttcacat

SEQ ID NO: 3283 - DNA, 20 bp, Artificial Sequence
  chemically synthesized
agaatgtccaaaacattgtg

SEQ ID NO: 3284 - DNA, 20 bp, Artificial Sequence
  chemically synthesized
aatgtccaaaacattgtgta

SEQ ID NO: 3285 - DNA, 20 bp, Artificial Sequence
  chemically synthesized
gtccaaaacattgtgtagag

SEQ ID NO: 3286 - DNA, 20 bp, Artificial Sequence
  chemically synthesized
gtagaaaaaaaaactatatg

SEQ ID NO: 3287 - DNA, 20 bp, Artificial Sequence
  chemically synthesized
aaaaactatatgaagtttaa

SEQ ID NO: 3288 - DNA, 20 bp, Artificial Sequence
  chemically synthesized
tgaagtttaacagatgtact

SEQ ID NO: 3289 - DNA, 20 bp, Artificial Sequence
  chemically synthesized
tgagaaatgcaaatattttg

SEQ ID NO: 3290 - DNA, 20 bp, Artificial Sequence
  chemically synthesized
attttgaagacaattcaaaa

SEQ ID NO: 3291 - DNA, 20 bp, Artificial Sequence
  chemically synthesized
caaaatagcacttaaatatt

SEQ ID NO: 3292 - DNA, 20 bp, Artificial Sequence
  chemically synthesized
tagcacttaaatatttagtg

SEQ ID NO: 3293 - DNA, 20 bp, Artificial Sequence
  chemically synthesized
ttaaatatttagtgtagtac

SEQ ID NO: 3294 - DNA, 20 bp, Artificial Sequence
  chemically synthesized
aatatttagtgtagtactag

SEQ ID NO: 3295 - DNA, 20 bp, Artificial Sequence
  chemically synthesized
actagcagaaacaaattaat

SEQ ID NO: 3296 - DNA, 20 bp, Artificial Sequence
  chemically synthesized
aacaaattaattagattttt

SEQ ID NO: 3297 - DNA, 20 bp, Artificial Sequence
  chemically synthesized
gtattctcccttcccaataa

SEQ ID NO: 3298 - DNA, 20 bp, Artificial Sequence
  chemically synthesized
tcccaataatggaaatactg

SEQ ID NO: 3299 - DNA, 20 bp, Artificial Sequence
  chemically synthesized
cccaataatggaaatactgt

SEQ ID NO: 3300 - DNA, 20 bp, Artificial Sequence
  chemically synthesized
aataatggaaatactgtagg

SEQ ID NO: 3301 - DNA, 20 bp, Artificial Sequence
  chemically synthesized
tttctaactttcttattctt

SEQ ID NO: 3302 - DNA, 20 bp, Artificial Sequence
  chemically synthesized
tgtgtgtgtacatatatatg

SEQ ID NO: 3303 - DNA, 20 bp, Artificial Sequence
  chemically synthesized
gtgtgtgtacatatatatga

SEQ ID NO: 3304 - DNA, 20 bp, Artificial Sequence
  chemically synthesized
ggtacatccacatataaatg

SEQ ID NO: 3305 - DNA, 20 bp, Artificial Sequence
  chemically synthesized
catataaatgtagataaatt

SEQ ID NO: 3306 - DNA, 20 bp, Artificial Sequence
  chemically synthesized
gtgtgtgtatatgtaaatct

SEQ ID NO: 3307 - DNA, 20 bp, Artificial Sequence
  chemically synthesized
ataaatttctataaaaatca

SEQ ID NO: 3308 - DNA, 20 bp, Artificial Sequence
  chemically synthesized
ttctataaaaatcacagaaa

SEQ ID NO: 3309 - DNA, 20 bp, Artificial Sequence
  chemically synthesized
taaaaatcacagaaaaagct

SEQ ID NO: 3310 - DNA, 20 bp, Artificial Sequence
  chemically synthesized
tcacagaaaaagctaagcat

SEQ ID NO: 3311 - DNA, 20 bp, Artificial Sequence
  chemically synthesized
gaaaaagctaagcataagcc

SEQ ID NO: 3312 - DNA, 20 bp, Artificial Sequence
  chemically synthesized
gctaagcataagccaagcat

SEQ ID NO: 3313 - DNA, 20 bp, Artificial Sequence
  chemically synthesized
aagcataagccaagcatgag

SEQ ID NO: 3314 - DNA, 20 bp, Artificial Sequence
  chemically synthesized
gccaagcatgagtagatttc

SEQ ID NO: 3315 - DNA, 20 bp, Artificial Sequence
  chemically synthesized
tgagtagatttcaagtgttt

SEQ ID NO: 3316 - DNA, 20 bp, Artificial Sequence
  chemically synthesized
tagatttcaagtgtttaaga

SEQ ID NO: 3317 - DNA, 20 bp, Artificial Sequence
  chemically synthesized
aagtgtttaagatagtacct

SEQ ID NO: 3318 - DNA, 20 bp, Artificial Sequence
  chemically synthesized
atagtacctcagatttctca

SEQ ID NO: 3319 - DNA, 20 bp, Artificial Sequence
  chemically synthesized
gttttttttttgtctttctt

SEQ ID NO: 3320 - DNA, 20 bp, Artificial Sequence
  chemically synthesized
ttttttttttgtctttcttt

SEQ ID NO: 3321 - DNA, 20 bp, Artificial Sequence
  chemically synthesized
gtctttctttaggtgtaaat

SEQ ID NO: 3322 - DNA, 20 bp, Artificial Sequence
  chemically synthesized
tctttctttaggtgtaaata

SEQ ID NO: 3323 - DNA, 20 bp, Artificial Sequence
  chemically synthesized
tcattttttaaacattctca

SEQ ID NO: 3324 - DNA, 20 bp, Artificial Sequence
  chemically synthesized
acattctcatggcattgttc

SEQ ID NO: 3325 - DNA, 20 bp, Artificial Sequence
  chemically synthesized
cattctcatggcattgttct

SEQ ID NO: 3326 - DNA, 20 bp, Artificial Sequence
  chemically synthesized
tggcattgttctaggctttt

SEQ ID NO: 3327 - DNA, 20 bp, Artificial Sequence
  chemically synthesized
cattgttctaggcttttaag

SEQ ID NO: 3328 - DNA, 20 bp, Artificial Sequence
  chemically synthesized
attgttctaggcttttaaga

SEQ ID NO: 3329 - DNA, 20 bp, Artificial Sequence
  chemically synthesized
tgttctaggcttttaagaag

SEQ ID NO: 3330 - DNA, 20 bp, Artificial Sequence
  chemically synthesized
ttctaggcttttaagaagga

SEQ ID NO: 3331 - DNA, 20 bp, Artificial Sequence
  chemically synthesized
taaaaatttgtattgatgtg

SEQ ID NO: 3332 - DNA, 20 bp, Artificial Sequence
  chemically synthesized
aaaaatttgtattgatgtga

SEQ ID NO: 3333 - DNA, 20 bp, Artificial Sequence
  chemically synthesized
aaaatttgtattgatgtgaa

SEQ ID NO: 3334 - DNA, 20 bp, Artificial Sequence
  chemically synthesized
tgtattgatgtgaagggatt

SEQ ID NO: 3335 - DNA, 20 bp, Artificial Sequence
  chemically synthesized
gtattgatgtgaagggatta

SEQ ID NO: 3336 - DNA, 20 bp, Artificial Sequence
  chemically synthesized
gatgtgaagggattaaggta

SEQ ID NO: 3337 - DNA, 20 bp, Artificial Sequence
  chemically synthesized
agggattaaggtatagtctg

SEQ ID NO: 3338 - DNA, 20 bp, Artificial Sequence
  chemically synthesized
atagtctgtagataatatca

SEQ ID NO: 3339 - DNA, 20 bp, Artificial Sequence
  chemically synthesized
tcatagataattacttttgc

SEQ ID NO: 3340 - DNA, 20 bp, Artificial Sequence
  chemically synthesized
catagataattacttttgct

SEQ ID NO: 3341 - DNA, 20 bp, Artificial Sequence
  chemically synthesized
gattacattcttttttattt

SEQ ID NO: 3342 - DNA, 20 bp, Artificial Sequence
  chemically synthesized
tcttttttatttaagtttct

SEQ ID NO: 3343 - DNA, 20 bp, Artificial Sequence
  chemically synthesized
atattctccttaatcttctc

SEQ ID NO: 3344 - DNA, 20 bp, Artificial Sequence
  chemically synthesized
ttaaaaatttatttatcacc

SEQ ID NO: 3345 - DNA, 20 bp, Artificial Sequence
  chemically synthesized
taaaaatttatttatcaccc

SEQ ID NO: 3346 - DNA, 20 bp, Artificial Sequence
  chemically synthesized
atttatttatcacccaggta

SEQ ID NO: 3347 - DNA, 20 bp, Artificial Sequence
  chemically synthesized
tttcaatcattttacttctt

SEQ ID NO: 3348 - DNA, 20 bp, Artificial Sequence
  chemically synthesized
atgatgctccattgatgact

SEQ ID NO: 3349 - DNA, 20 bp, Artificial Sequence
  chemically synthesized
tgatgctccattgatgactt

SEQ ID NO: 3350 - DNA, 20 bp, Artificial Sequence
  chemically synthesized
tgggtctaaaatctccacta

SEQ ID NO: 3351 - DNA, 20 bp, Artificial Sequence
  chemically synthesized
gggtctaaaatctccactat

SEQ ID NO: 3352 - DNA, 20 bp, Artificial Sequence
  chemically synthesized
ggtctaaaatctccactata

SEQ ID NO: 3353 - DNA, 20 bp, Artificial Sequence
  chemically synthesized
gtctaaaatctccactatag

SEQ ID NO: 3354 - DNA, 20 bp, Artificial Sequence
  chemically synthesized
tctaaaatctccactatagg

SEQ ID NO: 3355 - DNA, 20 bp, Artificial Sequence
  chemically synthesized
ctatagggggaaatgtgtat

SEQ ID NO: 3356 - DNA, 20 bp, Artificial Sequence
  chemically synthesized
gtatcagattttacatcatc

SEQ ID NO: 3357 - DNA, 20 bp, Artificial Sequence
  chemically synthesized
tatcagattttacatcatcc

SEQ ID NO: 3358 - DNA, 20 bp, Artificial Sequence
  chemically synthesized
catatttgttaatttaatat

SEQ ID NO: 3359 - DNA, 20 bp, Artificial Sequence
  chemically synthesized
attatgtgtctattccatac

SEQ ID NO: 3360 - DNA, 20 bp, Artificial Sequence
  chemically synthesized
tatgtgtctattccatacaa

SEQ ID NO: 3361 - DNA, 20 bp, Artificial Sequence
  chemically synthesized
ttccatacaagagactttgt

SEQ ID NO: 3362 - DNA, 20 bp, Artificial Sequence
  chemically synthesized
caagagactttgtgagatgt

SEQ ID NO: 3363 - DNA, 20 bp, Artificial Sequence
  chemically synthesized
agactttgtgagatgtcagt

SEQ ID NO: 3364 - DNA, 20 bp, Artificial Sequence
  chemically synthesized
tttgtgagatgtcagtgagt

SEQ ID NO: 3365 - DNA, 20 bp, Artificial Sequence
  chemically synthesized
cagtgagttagaaaatattc

SEQ ID NO: 3366 - DNA, 20 bp, Artificial Sequence
  chemically synthesized
agtgagttagaaaatattct

SEQ ID NO: 3367 - DNA, 20 bp, Artificial Sequence
  chemically synthesized
gtgagttagaaaatattcta

SEQ ID NO: 3368 - DNA, 20 bp, Artificial Sequence
  chemically synthesized
tagggataacattttaactt

SEQ ID NO: 3369 - DNA, 20 bp, Artificial Sequence
  chemically synthesized
taacattttaacttaagtaa

SEQ ID NO: 3370 - DNA, 20 bp, Artificial Sequence
  chemically synthesized
aacattttaacttaagtaac

SEQ ID NO: 3371 - DNA, 20 bp, Artificial Sequence
  chemically synthesized
tgttgacaaaaataatatta

SEQ ID NO: 3372 - DNA, 20 bp, Artificial Sequence
  chemically synthesized
atattatggcttcatgttat

SEQ ID NO: 3373 - DNA, 20 bp, Artificial Sequence
  chemically synthesized
tggcttcatgttattggttc

SEQ ID NO: 3374 - DNA, 20 bp, Artificial Sequence
  chemically synthesized
gttattggttcaagtctctg

SEQ ID NO: 3375 - DNA, 20 bp, Artificial Sequence
  chemically synthesized
tattggttcaagtctctgca

SEQ ID NO: 3376 - DNA, 20 bp, Artificial Sequence
  chemically synthesized
gttcaagtctctgcagagta

SEQ ID NO: 3377 - DNA, 20 bp, Artificial Sequence
  chemically synthesized
caagtctctgcagagtacag

SEQ ID NO: 3378 - DNA, 20 bp, Artificial Sequence
  chemically synthesized
aagtctctgcagagtacagc

SEQ ID NO: 3379 - DNA, 20 bp, Artificial Sequence
  chemically synthesized
gtctctgcagagtacagcgg

SEQ ID NO: 3380 - DNA, 20 bp, Artificial Sequence
  chemically synthesized
agcgggagtgttgtacattt

SEQ ID NO: 3381 - DNA, 20 bp, Artificial Sequence
  chemically synthesized
gggagtgttgtacatttcag

SEQ ID NO: 3382 - DNA, 20 bp, Artificial Sequence
  chemically synthesized
tgtacatttcagcagaattt

SEQ ID NO: 3383 - DNA, 20 bp, Artificial Sequence
  chemically synthesized
aatttcagactgactataaa

SEQ ID NO: 3384 - DNA, 20 bp, Artificial Sequence
  chemically synthesized
cagactgactataaaaagcc

SEQ ID NO: 3385 - DNA, 20 bp, Artificial Sequence
  chemically synthesized
tgactcaaaaccccacttcc

SEQ ID NO: 3386 - DNA, 20 bp, Artificial Sequence
  chemically synthesized
ccccacttcctagctctacg

SEQ ID NO: 3387 - DNA, 20 bp, Artificial Sequence
  chemically synthesized
cccacttcctagctctacgt

SEQ ID NO: 3388 - DNA, 20 bp, Artificial Sequence
  chemically synthesized
ttcctagctctacgtaggaa

SEQ ID NO: 3389 - DNA, 20 bp, Artificial Sequence
  chemically synthesized
ctacgtaggaaaagtcaatc

SEQ ID NO: 3390 - DNA, 20 bp, Artificial Sequence
  chemically synthesized
gattatctttatatattttt

SEQ ID NO: 3391 - DNA, 20 bp, Artificial Sequence
  chemically synthesized
taagttaaaattcatgaaaa

SEQ ID NO: 3392 - DNA, 20 bp, Artificial Sequence
  chemically synthesized
aaatagtatttctgaaaaaa

SEQ ID NO: 3393 - DNA, 20 bp, Artificial Sequence
  chemically synthesized
atagtatttctgaaaaaatg

SEQ ID NO: 3394 - DNA, 20 bp, Artificial Sequence
  chemically synthesized
aaaaatggagaatttcatta

SEQ ID NO: 3395 - DNA, 20 bp, Artificial Sequence
  chemically synthesized
tttcaaaacctttgatcttt

SEQ ID NO: 3396 - DNA, 20 bp, Artificial Sequence
  chemically synthesized
cctttgatctttgagtgcct

SEQ ID NO: 3397 - DNA, 20 bp, Artificial Sequence
  chemically synthesized
agtgccttagcaaaattccg

SEQ ID NO: 3398 - DNA, 20 bp, Artificial Sequence
  chemically synthesized
aaattccgtggacactttga

SEQ ID NO: 3399 - DNA, 20 bp, Artificial Sequence
  chemically synthesized
ttgatagacaccatcatttt

SEQ ID NO: 3400 - DNA, 20 bp, Artificial Sequence
  chemically synthesized
ccatcattttaagtgtgttt

SEQ ID NO: 3401 - DNA, 20 bp, Artificial Sequence
  chemically synthesized
catcattttaagtgtgtttg

SEQ ID NO: 3402 - DNA, 20 bp, Artificial Sequence
  chemically synthesized
agtgtgtttgaggatttcta

SEQ ID NO: 3403 - DNA, 20 bp, Artificial Sequence
  chemically synthesized
atttattctattccctaaaa

SEQ ID NO: 3404 - DNA, 20 bp, Artificial Sequence
  chemically synthesized
aacagactttttaatcttaa

SEQ ID NO: 3405 - DNA, 20 bp, Artificial Sequence
  chemically synthesized
atcttaacagcatacactga

SEQ ID NO: 3406 - DNA, 20 bp, Artificial Sequence
  chemically synthesized
tcttaacagcatacactgat

SEQ ID NO: 3407 - DNA, 20 bp, Artificial Sequence
  chemically synthesized
ttaacagcatacactgatag

SEQ ID NO: 3408 - DNA, 20 bp, Artificial Sequence
  chemically synthesized
aacagcatacactgatagga

SEQ ID NO: 3409 - DNA, 20 bp, Artificial Sequence
  chemically synthesized
catacactgataggagagaa

SEQ ID NO: 3410 - DNA, 20 bp, Artificial Sequence
  chemically synthesized
cactcgatctttaatttgtt

SEQ ID NO: 3411 - DNA, 20 bp, Artificial Sequence
  chemically synthesized
ggtcttcaccccataaatga

SEQ ID NO: 3412 - DNA, 20 bp, Artificial Sequence
  chemically synthesized
gtcttcaccccataaatgat

SEQ ID NO: 3413 - DNA, 20 bp, Artificial Sequence
  chemically synthesized
tcttcaccccataaatgatg

SEQ ID NO: 3414 - DNA, 20 bp, Artificial Sequence
  chemically synthesized
accccataaatgatggggtt

SEQ ID NO: 3415 - DNA, 20 bp, Artificial Sequence
  chemically synthesized
ataaatgatggggtttagca

SEQ ID NO: 3416 - DNA, 20 bp, Artificial Sequence
  chemically synthesized
taaatgatggggtttagcat

SEQ ID NO: 3417 - DNA, 20 bp, Artificial Sequence
  chemically synthesized
aaatgatggggtttagcata

SEQ ID NO: 3418 - DNA, 20 bp, Artificial Sequence
  chemically synthesized
aatgatggggtttagcatag

SEQ ID NO: 3419 - DNA, 20 bp, Artificial Sequence
  chemically synthesized
atgatggggtttagcatagg

SEQ ID NO: 3420 - DNA, 20 bp, Artificial Sequence
  chemically synthesized
gcatagggggcactaacaca

SEQ ID NO: 3421 - DNA, 20 bp, Artificial Sequence
  chemically synthesized
atagggggcactaacacata

SEQ ID NO: 3422 - DNA, 20 bp, Artificial Sequence
  chemically synthesized
aacacatagagactgcccac

SEQ ID NO: 3423 - DNA, 20 bp, Artificial Sequence
  chemically synthesized
acacatagagactgcccact

SEQ ID NO: 3424 - DNA, 20 bp, Artificial Sequence
  chemically synthesized
tgcccactaggatgtgaatg

SEQ ID NO: 3425 - DNA, 20 bp, Artificial Sequence
  chemically synthesized
cactaggatgtgaatgtggt

SEQ ID NO: 3426 - DNA, 20 bp, Artificial Sequence
  chemically synthesized
actaggatgtgaatgtggtg

SEQ ID NO: 3427 - DNA, 20 bp, Artificial Sequence
  chemically synthesized
ctaggatgtgaatgtggtga

SEQ ID NO: 3428 - DNA, 20 bp, Artificial Sequence
  chemically synthesized
gatgtgaatgtggtgaggga

SEQ ID NO: 3429 - DNA, 20 bp, Artificial Sequence
  chemically synthesized
gagggatggttttacctcca

SEQ ID NO: 3430 - DNA, 20 bp, Artificial Sequence
  chemically synthesized
tggttttacctccaaagcga

SEQ ID NO: 3431 - DNA, 20 bp, Artificial Sequence
  chemically synthesized
ggttttacctccaaagcgat

SEQ ID NO: 3432 - DNA, 20 bp, Artificial Sequence
  chemically synthesized
ttacctccaaagcgatgggc

SEQ ID NO: 3433 - DNA, 20 bp, Artificial Sequence
  chemically synthesized
agcgatgggcaagaaatgaa

SEQ ID NO: 3434 - DNA, 20 bp, Artificial Sequence
  chemically synthesized
gcaagaaatgaaaagaatgc

SEQ ID NO: 3435 - DNA, 20 bp, Artificial Sequence
  chemically synthesized
caagaaatgaaaagaatgct

SEQ ID NO: 3436 - DNA, 20 bp, Artificial Sequence
  chemically synthesized
aagaaatgaaaagaatgctg

SEQ ID NO: 3437 - DNA, 20 bp, Artificial Sequence
  chemically synthesized
atgaaaagaatgctggggta

SEQ ID NO: 3438 - DNA, 20 bp, Artificial Sequence
  chemically synthesized
tatagaacataaatatgaca

SEQ ID NO: 3439 - DNA, 20 bp, Artificial Sequence
  chemically synthesized
cataaatatgacacagatat

SEQ ID NO: 3440 - DNA, 20 bp, Artificial Sequence
  chemically synthesized
taaatatgacacagatatga

SEQ ID NO: 3441 - DNA, 20 bp, Artificial Sequence
  chemically synthesized
atatgagagccgcacgtact

SEQ ID NO: 3442 - DNA, 20 bp, Artificial Sequence
  chemically synthesized
tatgagagccgcacgtacta

SEQ ID NO: 3443 - DNA, 20 bp, Artificial Sequence
  chemically synthesized
atgagagccgcacgtactaa

SEQ ID NO: 3444 - DNA, 20 bp, Artificial Sequence
  chemically synthesized
cgtactaagggccttgaacc

SEQ ID NO: 3445 - DNA, 20 bp, Artificial Sequence
  chemically synthesized
actaagggccttgaacctgg

SEQ ID NO: 3446 - DNA, 20 bp, Artificial Sequence
  chemically synthesized
gggccttgaacctggcagcc

SEQ ID NO: 3447 - DNA, 20 bp, Artificial Sequence
  chemically synthesized
ggccttgaacctggcagccc

SEQ ID NO: 3448 - DNA, 20 bp, Artificial Sequence
  chemically synthesized
cttgaacctggcagcccagg

SEQ ID NO: 3449 - DNA, 20 bp, Artificial Sequence
  chemically synthesized
aggaagatatctgaaacact

SEQ ID NO: 3450 - DNA, 20 bp, Artificial Sequence
  chemically synthesized
gatatctgaaacactgagtg

SEQ ID NO: 3451 - DNA, 20 bp, Artificial Sequence
  chemically synthesized
atatctgaaacactgagtga

SEQ ID NO: 3452 - DNA, 20 bp, Artificial Sequence
  chemically synthesized
ctgagtgaaggatcattgtg

SEQ ID NO: 3453 - DNA, 20 bp, Artificial Sequence
  chemically synthesized
tgagtgaaggatcattgtgt

SEQ ID NO: 3454 - DNA, 20 bp, Artificial Sequence
  chemically synthesized
attgtgtaggatataatgat

SEQ ID NO: 3455 - DNA, 20 bp, Artificial Sequence
  chemically synthesized
ataatgataagcactatatc

SEQ ID NO: 3456 - DNA, 20 bp, Artificial Sequence
  chemically synthesized
aagcactatatccagtcctg

SEQ ID NO: 3457 - DNA, 20 bp, Artificial Sequence
  chemically synthesized
gcactatatccagtcctgta

SEQ ID NO: 3458 - DNA, 20 bp, Artificial Sequence
  chemically synthesized
actatatccagtcctgtaga

SEQ ID NO: 3459 - DNA, 20 bp, Artificial Sequence
  chemically synthesized
atatccagtcctgtagagag

SEQ ID NO: 3460 - DNA, 20 bp, Artificial Sequence
  chemically synthesized
tatccagtcctgtagagagt

SEQ ID NO: 3461 - DNA, 20 bp, Artificial Sequence
  chemically synthesized
atccagtcctgtagagagta

SEQ ID NO: 3462 - DNA, 20 bp, Artificial Sequence
  chemically synthesized
tcctgtagagagtagggcca

SEQ ID NO: 3463 - DNA, 20 bp, Artificial Sequence
  chemically synthesized
gtagagagtagggccacagt

SEQ ID NO: 3464 - DNA, 20 bp, Artificial Sequence
  chemically synthesized
tagagagtagggccacagtg

SEQ ID NO: 3465 - DNA, 20 bp, Artificial Sequence
  chemically synthesized
attgacattgatattgccac

SEQ ID NO: 3466 - DNA, 20 bp, Artificial Sequence
  chemically synthesized
gatattgccacaagccaatc

SEQ ID NO: 3467 - DNA, 20 bp, Artificial Sequence
  chemically synthesized
ccaatctggcaatgtgctca

SEQ ID NO: 3468 - DNA, 20 bp, Artificial Sequence
  chemically synthesized
atctggcaatgtgctcacag

SEQ ID NO: 3469 - DNA, 20 bp, Artificial Sequence
  chemically synthesized
tctggcaatgtgctcacagt

SEQ ID NO: 3470 - DNA, 20 bp, Artificial Sequence
  chemically synthesized
aatgtgctcacagtaggaat

SEQ ID NO: 3471 - DNA, 20 bp, Artificial Sequence
  chemically synthesized
atgtgctcacagtaggaatg

SEQ ID NO: 3472 - DNA, 20 bp, Artificial Sequence
  chemically synthesized
atgtttctcccacaatatgt

SEQ ID NO: 3473 - DNA, 20 bp, Artificial Sequence
  chemically synthesized
ttctcccacaatatgtaagt

SEQ ID NO: 3474 - DNA, 20 bp, Artificial Sequence
  chemically synthesized
caatatgtaagtcggtatac

SEQ ID NO: 3475 - DNA, 20 bp, Artificial Sequence
  chemically synthesized
aatatgtaagtcggtatacc

SEQ ID NO: 3476 - DNA, 20 bp, Artificial Sequence
  chemically synthesized
atgtaagtcggtataccagg

SEQ ID NO: 3477 - DNA, 20 bp, Artificial Sequence
  chemically synthesized
cggtataccaggaagatgaa

SEQ ID NO: 3478 - DNA, 20 bp, Artificial Sequence
  chemically synthesized
ataccaggaagatgaacgga

SEQ ID NO: 3479 - DNA, 20 bp, Artificial Sequence
  chemically synthesized
ccaggaagatgaacggacag

SEQ ID NO: 3480 - DNA, 20 bp, Artificial Sequence
  chemically synthesized
tgaacggacagcagatgaaa

SEQ ID NO: 3481 - DNA, 20 bp, Artificial Sequence
  chemically synthesized
gatgaaaaagctcctgacca

SEQ ID NO: 3482 - DNA, 20 bp, Artificial Sequence
  chemically synthesized
tgctatgccaatcttcctga

SEQ ID NO: 3483 - DNA, 20 bp, Artificial Sequence
  chemically synthesized
caatcttcctgacggctgat

SEQ ID NO: 3484 - DNA, 20 bp, Artificial Sequence
  chemically synthesized
aatcttcctgacggctgatg

SEQ ID NO: 3485 - DNA, 20 bp, Artificial Sequence
  chemically synthesized
gacggctgatgaggttaaaa

SEQ ID NO: 3486 - DNA, 20 bp, Artificial Sequence
  chemically synthesized
gaggttaaaatggtgtatct

SEQ ID NO: 3487 - DNA, 20 bp, Artificial Sequence
  chemically synthesized
gttaaaatggtgtatctcag

SEQ ID NO: 3488 - DNA, 20 bp, Artificial Sequence
  chemically synthesized
ttaaaatggtgtatctcagt

SEQ ID NO: 3489 - DNA, 20 bp, Artificial Sequence
  chemically synthesized
tggtgtatctcagtgggtaa

SEQ ID NO: 3490 - DNA, 20 bp, Artificial Sequence
  chemically synthesized
gtatctcagtgggtaacaga

SEQ ID NO: 3491 - DNA, 20 bp, Artificial Sequence
  chemically synthesized
gtgggtaacagatggccaca

SEQ ID NO: 3492 - DNA, 20 bp, Artificial Sequence
  chemically synthesized
ggtaacagatggccacatag

SEQ ID NO: 3493 - DNA, 20 bp, Artificial Sequence
  chemically synthesized
tagcggtcaaatgccattgc

SEQ ID NO: 3494 - DNA, 20 bp, Artificial Sequence
  chemically synthesized
agcggtcaaatgccattgcc

SEQ ID NO: 3495 - DNA, 20 bp, Artificial Sequence
  chemically synthesized
cggtcaaatgccattgccag

SEQ ID NO: 3496 - DNA, 20 bp, Artificial Sequence
  chemically synthesized
aaatgccattgccaggagaa

SEQ ID NO: 3497 - DNA, 20 bp, Artificial Sequence
  chemically synthesized
tgccattgccaggagaatag

SEQ ID NO: 3498 - DNA, 20 bp, Artificial Sequence
  chemically synthesized
gaatagcagattctgccaca

SEQ ID NO: 3499 - DNA, 20 bp, Artificial Sequence
  chemically synthesized
ccacaaagatgaaatgtatg

SEQ ID NO: 3500 - DNA, 20 bp, Artificial Sequence
  chemically synthesized
gaaatgtatgaagaacatct

SEQ ID NO: 3501 - DNA, 20 bp, Artificial Sequence
  chemically synthesized
tctgagacacacaactacca

SEQ ID NO: 3502 - DNA, 20 bp, Artificial Sequence
  chemically synthesized
ctgagacacacaactaccaa

SEQ ID NO: 3503 - DNA, 20 bp, Artificial Sequence
  chemically synthesized
actaccaaaggatatgtcca

SEQ ID NO: 3504 - DNA, 20 bp, Artificial Sequence
  chemically synthesized
taccaaaggatatgtccatg

SEQ ID NO: 3505 - DNA, 20 bp, Artificial Sequence
  chemically synthesized
caaaggatatgtccatggag

SEQ ID NO: 3506 - DNA, 20 bp, Artificial Sequence
  chemically synthesized
atatgtccatggagtggaac

SEQ ID NO: 3507 - DNA, 20 bp, Artificial Sequence
  chemically synthesized
atgtccatggagtggaacca

SEQ ID NO: 3508 - DNA, 20 bp, Artificial Sequence
  chemically synthesized
tgtccatggagtggaaccag

SEQ ID NO: 3509 - DNA, 20 bp, Artificial Sequence
  chemically synthesized
catggagtggaaccagagga

SEQ ID NO: 3510 - DNA, 20 bp, Artificial Sequence
  chemically synthesized
gagtggaaccagaggatagc

SEQ ID NO: 3511 - DNA, 20 bp, Artificial Sequence
  chemically synthesized
ccagaggatagccagcacct

SEQ ID NO: 3512 - DNA, 20 bp, Artificial Sequence
  chemically synthesized
cagaggatagccagcacctt

SEQ ID NO: 3513 - DNA, 20 bp, Artificial Sequence
  chemically synthesized
agaggatagccagcacctta

SEQ ID NO: 3514 - DNA, 20 bp, Artificial Sequence
  chemically synthesized
gaggatagccagcaccttag

SEQ ID NO: 3515 - DNA, 20 bp, Artificial Sequence
  chemically synthesized
agccagcaccttaggggctg

SEQ ID NO: 3516 - DNA, 20 bp, Artificial Sequence
  chemically synthesized
cagcaccttaggggctgcag

SEQ ID NO: 3517 - DNA, 20 bp, Artificial Sequence
  chemically synthesized
caccttaggggctgcagcag

SEQ ID NO: 3518 - DNA, 20 bp, Artificial Sequence
  chemically synthesized
ttaggggctgcagcagtggc

SEQ ID NO: 3519 - DNA, 20 bp, Artificial Sequence
  chemically synthesized
ggggctgcagcagtggcgag

SEQ ID NO: 3520 - DNA, 20 bp, Artificial Sequence
  chemically synthesized
gggctgcagcagtggcgagc

SEQ ID NO: 3521 - DNA, 20 bp, Artificial Sequence
  chemically synthesized
ctgcagcagtggcgagcagg

SEQ ID NO: 3522 - DNA, 20 bp, Artificial Sequence
  chemically synthesized
agcagtggcgagcaggaagt

SEQ ID NO: 3523 - DNA, 20 bp, Artificial Sequence
  chemically synthesized
tggcgagcaggaagtcggct

SEQ ID NO: 3524 - DNA, 20 bp, Artificial Sequence
  chemically synthesized
ggcgagcaggaagtcggctg

SEQ ID NO: 3525 - DNA, 20 bp, Artificial Sequence
  chemically synthesized
agcaggaagtcggctgaggc

SEQ ID NO: 3526 - DNA, 20 bp, Artificial Sequence
  chemically synthesized
gaagtcggctgaggccagca

SEQ ID NO: 3527 - DNA, 20 bp, Artificial Sequence
  chemically synthesized
tcggctgaggccagcatgga

SEQ ID NO: 3528 - DNA, 20 bp, Artificial Sequence
  chemically synthesized
cggctgaggccagcatggat

SEQ ID NO: 3529 - DNA, 20 bp, Artificial Sequence
  chemically synthesized
ctgaggccagcatggatagg

SEQ ID NO: 3530 - DNA, 20 bp, Artificial Sequence
  chemically synthesized
gaggccagcatggataggaa

SEQ ID NO: 3531 - DNA, 20 bp, Artificial Sequence
  chemically synthesized
catggataggaagagataca

SEQ ID NO: 3532 - DNA, 20 bp, Artificial Sequence
  chemically synthesized
atggataggaagagatacat

SEQ ID NO: 3533 - DNA, 20 bp, Artificial Sequence
  chemically synthesized
ggaagagatacatgggctca

SEQ ID NO: 3534 - DNA, 20 bp, Artificial Sequence
  chemically synthesized
aagagatacatgggctcatg

SEQ ID NO: 3535 - DNA, 20 bp, Artificial Sequence
  chemically synthesized
gggctcatggagactgcgct

SEQ ID NO: 3536 - DNA, 20 bp, Artificial Sequence
  chemically synthesized
agactgcgctcagtcatgat

SEQ ID NO: 3537 - DNA, 20 bp, Artificial Sequence
  chemically synthesized
gactgcgctcagtcatgatc

SEQ ID NO: 3538 - DNA, 20 bp, Artificial Sequence
  chemically synthesized
tgcgctcagtcatgatcagg

SEQ ID NO: 3539 - DNA, 20 bp, Artificial Sequence
  chemically synthesized
cagtcatgatcaggaagatc

SEQ ID NO: 3540 - DNA, 20 bp, Artificial Sequence
  chemically synthesized
tcatgatcaggaagatcaag

SEQ ID NO: 3541 - DNA, 20 bp, Artificial Sequence
  chemically synthesized
caagaagatattgcctgcaa

SEQ ID NO: 3542 - DNA, 20 bp, Artificial Sequence
  chemically synthesized
aacagccacaatgtacataa

SEQ ID NO: 3543 - DNA, 20 bp, Artificial Sequence
  chemically synthesized
cacaatgtacataaaagaaa

SEQ ID NO: 3544 - DNA, 20 bp, Artificial Sequence
  chemically synthesized
acaatgtacataaaagaaaa

SEQ ID NO: 3545 - DNA, 20 bp, Artificial Sequence
  chemically synthesized
caatgtacataaaagaaaaa

SEQ ID NO: 3546 - DNA, 20 bp, Artificial Sequence
  chemically synthesized
gtacataaaagaaaaaggga

SEQ ID NO: 3547 - DNA, 20 bp, Artificial Sequence
  chemically synthesized
acataaaagaaaaagggatg

SEQ ID NO: 3548 - DNA, 20 bp, Artificial Sequence
  chemically synthesized
aagaaaaagggatggagatc

SEQ ID NO: 3549 - DNA, 20 bp, Artificial Sequence
  chemically synthesized
agaaaaagggatggagatcc

SEQ ID NO: 3550 - DNA, 20 bp, Artificial Sequence
  chemically synthesized
ggatggagatccaggtatgc

SEQ ID NO: 3551 - DNA, 20 bp, Artificial Sequence
  chemically synthesized
atccaggtatgcaagccttc

SEQ ID NO: 3552 - DNA, 20 bp, Artificial Sequence
  chemically synthesized
gtatgcaagccttccagccc

SEQ ID NO: 3553 - DNA, 20 bp, Artificial Sequence
  chemically synthesized
tatgcaagccttccagccct

SEQ ID NO: 3554 - DNA, 20 bp, Artificial Sequence
  chemically synthesized
tccagccctgggattcccat

SEQ ID NO: 3555 - DNA, 20 bp, Artificial Sequence
  chemically synthesized
ccagccctgggattcccatc

SEQ ID NO: 3556 - DNA, 20 bp, Artificial Sequence
  chemically synthesized
tcaggacataccacacatcc

SEQ ID NO: 3557 - DNA, 20 bp, Artificial Sequence
  chemically synthesized
caggacataccacacatcct

SEQ ID NO: 3558 - DNA, 20 bp, Artificial Sequence
  chemically synthesized
ataccacacatcctgggaat

SEQ ID NO: 3559 - DNA, 20 bp, Artificial Sequence
  chemically synthesized
gggaattagtgtgattgcga

SEQ ID NO: 3560 - DNA, 20 bp, Artificial Sequence
  chemically synthesized
attagtgtgattgcgaaaga

SEQ ID NO: 3561 - DNA, 20 bp, Artificial Sequence
  chemically synthesized
ttagtgtgattgcgaaagaa

SEQ ID NO: 3562 - DNA, 20 bp, Artificial Sequence
  chemically synthesized
agtgtgattgcgaaagaaag

SEQ ID NO: 3563 - DNA, 20 bp, Artificial Sequence
  chemically synthesized
aaagaaaggagccgtatgta

SEQ ID NO: 3564 - DNA, 20 bp, Artificial Sequence
  chemically synthesized
gccgtatgtacagtttattc

SEQ ID NO: 3565 - DNA, 20 bp, Artificial Sequence
  chemically synthesized
ccgtatgtacagtttattcc

SEQ ID NO: 3566 - DNA, 20 bp, Artificial Sequence
  chemically synthesized
tgtacagtttattccaggcc

SEQ ID NO: 3567 - DNA, 20 bp, Artificial Sequence
  chemically synthesized
tattccaggcctagtgccat

SEQ ID NO: 3568 - DNA, 20 bp, Artificial Sequence
  chemically synthesized
aggcctagtgccattagtga

SEQ ID NO: 3569 - DNA, 20 bp, Artificial Sequence
  chemically synthesized
gccattagtgaaagactaca

SEQ ID NO: 3570 - DNA, 20 bp, Artificial Sequence
  chemically synthesized
tagtgaaagactacaaagtt

SEQ ID NO: 3571 - DNA, 20 bp, Artificial Sequence
  chemically synthesized
agtgaaagactacaaagttg

SEQ ID NO: 3572 - DNA, 20 bp, Artificial Sequence
  chemically synthesized
agactacaaagttgaggatt

SEQ ID NO: 3573 - DNA, 20 bp, Artificial Sequence
  chemically synthesized
aggatttagaaacactacct

SEQ ID NO: 3574 - DNA, 20 bp, Artificial Sequence
  chemically synthesized
ggatttagaaacactacctt

SEQ ID NO: 3575 - DNA, 20 bp, Artificial Sequence
  chemically synthesized
aacactaccttaggctgaat

SEQ ID NO: 3576 - DNA, 20 bp, Artificial Sequence
  chemically synthesized
acactaccttaggctgaatg

SEQ ID NO: 3577 - DNA, 20 bp, Artificial Sequence
  chemically synthesized
taggctgaatgaggtctcat

SEQ ID NO: 3578 - DNA, 20 bp, Artificial Sequence
  chemically synthesized
ctttccaatgttttcttctc

SEQ ID NO: 3579 - DNA, 20 bp, Artificial Sequence
  chemically synthesized
tttccaatgttttcttctct

SEQ ID NO: 3580 - DNA, 20 bp, Artificial Sequence
  chemically synthesized
caatgttttcttctctggga

SEQ ID NO: 3581 - DNA, 20 bp, Artificial Sequence
  chemically synthesized
aatgttttcttctctgggaa

SEQ ID NO: 3582 - DNA, 20 bp, Artificial Sequence
  chemically synthesized
tgttttcttctctgggaaag

SEQ ID NO: 3583 - DNA, 20 bp, Artificial Sequence
  chemically synthesized
ttttcttctctgggaaagga

SEQ ID NO: 3584 - DNA, 20 bp, Artificial Sequence
  chemically synthesized
tctgggaaaggagagtaaaa

SEQ ID NO: 3585 - DNA, 20 bp, Artificial Sequence
  chemically synthesized
ctgggaaaggagagtaaaat

SEQ ID NO: 3586 - DNA, 20 bp, Artificial Sequence
  chemically synthesized
aggagagtaaaatgggttaa

SEQ ID NO: 3587 - DNA, 20 bp, Artificial Sequence
  chemically synthesized
ggttaatagaccgaatatat

SEQ ID NO: 3588 - DNA, 20 bp, Artificial Sequence
  chemically synthesized
ttttttgtaccttaaaaaat

SEQ ID NO: 3589 - DNA, 20 bp, Artificial Sequence
  chemically synthesized
tttgtaccttaaaaaattag

SEQ ID NO: 3590 - DNA, 20 bp, Artificial Sequence
  chemically synthesized
cttcacaataacctattgaa

SEQ ID NO: 3591 - DNA, 20 bp, Artificial Sequence
  chemically synthesized
tataaatactattatttcta

SEQ ID NO: 3592 - DNA, 20 bp, Artificial Sequence
  chemically synthesized
acagatgtaaaaaaaaccca

SEQ ID NO: 3593 - DNA, 20 bp, Artificial Sequence
  chemically synthesized
aaaaaaaacccacagacttt

SEQ ID NO: 3594 - DNA, 20 bp, Artificial Sequence
  chemically synthesized
agactttcagcctcttaccc

SEQ ID NO: 3595 - DNA, 20 bp, Artificial Sequence
  chemically synthesized
gactttcagcctcttaccct

SEQ ID NO: 3596 - DNA, 20 bp, Artificial Sequence
  chemically synthesized
cctcttaccctaggccctac

SEQ ID NO: 3597 - DNA, 20 bp, Artificial Sequence
  chemically synthesized
cctaggccctactggattta

SEQ ID NO: 3598 - DNA, 20 bp, Artificial Sequence
  chemically synthesized
ggccctactggatttaaagt

SEQ ID NO: 3599 - DNA, 20 bp, Artificial Sequence
  chemically synthesized
gccctactggatttaaagta

SEQ ID NO: 3600 - DNA, 20 bp, Artificial Sequence
  chemically synthesized
ctactggatttaaagtaagg

SEQ ID NO: 3601 - DNA, 20 bp, Artificial Sequence
  chemically synthesized
tactggatttaaagtaaggc

SEQ ID NO: 3602 - DNA, 20 bp, Artificial Sequence
  chemically synthesized
gtaaggcaggataaatctga

SEQ ID NO: 3603 - DNA, 20 bp, Artificial Sequence
  chemically synthesized
accatccaatgctgcctatc

SEQ ID NO: 3604 - DNA, 20 bp, Artificial Sequence
  chemically synthesized
ccatccaatgctgcctatca

SEQ ID NO: 3605 - DNA, 20 bp, Artificial Sequence
  chemically synthesized
gctgcctatcaaggtaaaac

SEQ ID NO: 3606 - DNA, 20 bp, Artificial Sequence
  chemically synthesized
gtaaaactagatataaaacg

SEQ ID NO: 3607 - DNA, 20 bp, Artificial Sequence
  chemically synthesized
tttttactgatcatatccct

SEQ ID NO: 3608 - DNA, 20 bp, Artificial Sequence
  chemically synthesized
ttttactgatcatatcccta

SEQ ID NO: 3609 - DNA, 20 bp, Artificial Sequence
  chemically synthesized
gatcatatccctaaggaaaa

SEQ ID NO: 3610 - DNA, 20 bp, Artificial Sequence
  chemically synthesized
tcatatccctaaggaaaata

SEQ ID NO: 3611 - DNA, 20 bp, Artificial Sequence
  chemically synthesized
atatccctaaggaaaataga

SEQ ID NO: 3612 - DNA, 20 bp, Artificial Sequence
  chemically synthesized
aaatagagagttatgaaatt

SEQ ID NO: 3613 - DNA, 20 bp, Artificial Sequence
  chemically synthesized
aaatttagttgtgctgctta

SEQ ID NO: 3614 - DNA, 20 bp, Artificial Sequence
  chemically synthesized
agttgtgctgcttacagaaa

SEQ ID NO: 3615 - DNA, 20 bp, Artificial Sequence
  chemically synthesized
gttgtgctgcttacagaaat

SEQ ID NO: 3616 - DNA, 20 bp, Artificial Sequence
  chemically synthesized
tgtgctgcttacagaaatgg

SEQ ID NO: 3617 - DNA, 20 bp, Artificial Sequence
  chemically synthesized
gtgctgcttacagaaatggg

SEQ ID NO: 3618 - DNA, 20 bp, Artificial Sequence
  chemically synthesized
tgctgcttacagaaatggga

SEQ ID NO: 3619 - DNA, 20 bp, Artificial Sequence
  chemically synthesized
tacagaaatgggagggaatt

SEQ ID NO: 3620 - DNA, 20 bp, Artificial Sequence
  chemically synthesized
gggaattaagtctgacaaaa

SEQ ID NO: 3621 - DNA, 20 bp, Artificial Sequence
  chemically synthesized
agtctgacaaaatagatttc

SEQ ID NO: 3622 - DNA, 20 bp, Artificial Sequence
  chemically synthesized
aaaatagatttcaagcaata

SEQ ID NO: 3623 - DNA, 20 bp, Artificial Sequence
  chemically synthesized
atgccttcttccacattgat

SEQ ID NO: 3624 - DNA, 20 bp, Artificial Sequence
  chemically synthesized
attggccttaacttattgtt

SEQ ID NO: 3625 - DNA, 20 bp, Artificial Sequence
  chemically synthesized
cttattgttaagccatatgc

SEQ ID NO: 3626 - DNA, 20 bp, Artificial Sequence
  chemically synthesized
aagccatatgctagccattg

SEQ ID NO: 3627 - DNA, 20 bp, Artificial Sequence
  chemically synthesized
tgctagccattgaagacata

SEQ ID NO: 3628 - DNA, 20 bp, Artificial Sequence
  chemically synthesized
taatctatttctcaaaaata

SEQ ID NO: 3629 - DNA, 20 bp, Artificial Sequence
  chemically synthesized
aatctatttctcaaaaatat

SEQ ID NO: 3630 - DNA, 20 bp, Artificial Sequence
  chemically synthesized
ggataaaacattataaactt

SEQ ID NO: 3631 - DNA, 20 bp, Artificial Sequence
  chemically synthesized
taaactttagatatttgcaa

SEQ ID NO: 3632 - DNA, 20 bp, Artificial Sequence
  chemically synthesized
actttagatatttgcaatgg

SEQ ID NO: 3633 - DNA, 20 bp, Artificial Sequence
  chemically synthesized
tagatatttgcaatggcaga

SEQ ID NO: 3634 - DNA, 20 bp, Artificial Sequence
  chemically synthesized
gatatttgcaatggcagacg

SEQ ID NO: 3635 - DNA, 20 bp, Artificial Sequence
  chemically synthesized
tttgcaatggcagacggagc

SEQ ID NO: 3636 - DNA, 20 bp, Artificial Sequence
  chemically synthesized
ttgcaatggcagacggagct

SEQ ID NO: 3637 - DNA, 20 bp, Artificial Sequence
  chemically synthesized
gggtttttaaatctatatgc

SEQ ID NO: 3638 - DNA, 20 bp, Artificial Sequence
  chemically synthesized
tttaaatctatatgccagcc

SEQ ID NO: 3639 - DNA, 20 bp, Artificial Sequence
  chemically synthesized
atctatatgccagcctggca

SEQ ID NO: 3640 - DNA, 20 bp, Artificial Sequence
  chemically synthesized
tatatgccagcctggcacgg

SEQ ID NO: 3641 - DNA, 20 bp, Artificial Sequence
  chemically synthesized
gtggctcacacctgtaatcc

SEQ ID NO: 3642 - DNA, 20 bp, Artificial Sequence
  chemically synthesized
acctgtaatcccagcacttt

SEQ ID NO: 3643 - DNA, 20 bp, Artificial Sequence
  chemically synthesized
ctgtaatcccagcactttga

SEQ ID NO: 3644 - DNA, 20 bp, Artificial Sequence
  chemically synthesized
tgtaatcccagcactttgag

SEQ ID NO: 3645 - DNA, 20 bp, Artificial Sequence
  chemically synthesized
tcccagcactttgagaggct

SEQ ID NO: 3646 - DNA, 20 bp, Artificial Sequence
  chemically synthesized
cccagcactttgagaggctg

SEQ ID NO: 3647 - DNA, 20 bp, Artificial Sequence
  chemically synthesized
agcactttgagaggctgagg

SEQ ID NO: 3648 - DNA, 20 bp, Artificial Sequence
  chemically synthesized
gcactttgagaggctgaggc

SEQ ID NO: 3649 - DNA, 20 bp, Artificial Sequence
  chemically synthesized
ctttgagaggctgaggcggg

SEQ ID NO: 3650 - DNA, 20 bp, Artificial Sequence
  chemically synthesized
ggctgaggcgggtagatcac

SEQ ID NO: 3651 - DNA, 20 bp, Artificial Sequence
  chemically synthesized
gctgaggcgggtagatcaca

SEQ ID NO: 3652 - DNA, 20 bp, Artificial Sequence
  chemically synthesized
aggcgggtagatcacaaggt

SEQ ID NO: 3653 - DNA, 20 bp, Artificial Sequence
  chemically synthesized
ggcgggtagatcacaaggtc

SEQ ID NO: 3654 - DNA, 20 bp, Artificial Sequence
  chemically synthesized
cgggtagatcacaaggtcag

SEQ ID NO: 3655 - DNA, 20 bp, Artificial Sequence
  chemically synthesized
gatcacaaggtcaggagttc

SEQ ID NO: 3656 - DNA, 20 bp, Artificial Sequence
  chemically synthesized
caaggtcaggagttccagac

SEQ ID NO: 3657 - DNA, 20 bp, Artificial Sequence
  chemically synthesized
tctactaaaaatacaaaaat

SEQ ID NO: 3658 - DNA, 20 bp, Artificial Sequence
  chemically synthesized
ctaaaaatacaaaaattagc

SEQ ID NO: 3659 - DNA, 20 bp, Artificial Sequence
  chemically synthesized
taaaaatacaaaaattagct

SEQ ID NO: 3660 - DNA, 20 bp, Artificial Sequence
  chemically synthesized
atacaaaaattagctgggca

SEQ ID NO: 3661 - DNA, 20 bp, Artificial Sequence
  chemically synthesized
caaaaattagctgggcatag

SEQ ID NO: 3662 - DNA, 20 bp, Artificial Sequence
  chemically synthesized
gtggtgtgcacctttaatcc

SEQ ID NO: 3663 - DNA, 20 bp, Artificial Sequence
  chemically synthesized
acctttaatcccagctactc

SEQ ID NO: 3664 - DNA, 20 bp, Artificial Sequence
  chemically synthesized
ctttaatcccagctactcaa

SEQ ID NO: 3665 - DNA, 20 bp, Artificial Sequence
  chemically synthesized
tttaatcccagctactcaag

SEQ ID NO: 3666 - DNA, 20 bp, Artificial Sequence
  chemically synthesized
tcccagctactcaagaggct

SEQ ID NO: 3667 - DNA, 20 bp, Artificial Sequence
  chemically synthesized
cccagctactcaagaggctg

SEQ ID NO: 3668 - DNA, 20 bp, Artificial Sequence
  chemically synthesized
agctactcaagaggctgagg

SEQ ID NO: 3669 - DNA, 20 bp, Artificial Sequence
  chemically synthesized
gctactcaagaggctgaggc

SEQ ID NO: 3670 - DNA, 20 bp, Artificial Sequence
  chemically synthesized
tactcaagaggctgaggcag

SEQ ID NO: 3671 - DNA, 20 bp, Artificial Sequence
  chemically synthesized
gcaggagaatcgcttgaacc

SEQ ID NO: 3672 - DNA, 20 bp, Artificial Sequence
  chemically synthesized
caggagaatcgcttgaacct

SEQ ID NO: 3673 - DNA, 20 bp, Artificial Sequence
  chemically synthesized
ggagaatcgcttgaacctgg

SEQ ID NO: 3674 - DNA, 20 bp, Artificial Sequence
  chemically synthesized
gagaatcgcttgaacctggg

SEQ ID NO: 3675 - DNA, 20 bp, Artificial Sequence
  chemically synthesized
aatcgcttgaacctgggagg

SEQ ID NO: 3676 - DNA, 20 bp, Artificial Sequence
  chemically synthesized
cgcttgaacctgggaggcag

SEQ ID NO: 3677 - DNA, 20 bp, Artificial Sequence
  chemically synthesized
aacctgggaggcagaagttt

SEQ ID NO: 3678 - DNA, 20 bp, Artificial Sequence
  chemically synthesized
tgggaggcagaagtttcagt

SEQ ID NO: 3679 - DNA, 20 bp, Artificial Sequence
  chemically synthesized
gaggcagaagtttcagtgag

SEQ ID NO: 3680 - DNA, 20 bp, Artificial Sequence
  chemically synthesized
ggcagaagtttcagtgagca

SEQ ID NO: 3681 - DNA, 20 bp, Artificial Sequence
  chemically synthesized
gagatcgcgcaactgcactc

SEQ ID NO: 3682 - DNA, 20 bp, Artificial Sequence
  chemically synthesized
cgcgcaactgcactccagcc

SEQ ID NO: 3683 - DNA, 20 bp, Artificial Sequence
  chemically synthesized
gcgcaactgcactccagcct

SEQ ID NO: 3684 - DNA, 20 bp, Artificial Sequence
  chemically synthesized
ctgcactccagcctaggtga

SEQ ID NO: 3685 - DNA, 20 bp, Artificial Sequence
  chemically synthesized
gcactccagcctaggtgaca

SEQ ID NO: 3686 - DNA, 20 bp, Artificial Sequence
  chemically synthesized
tccagcctaggtgacagagc

SEQ ID NO: 3687 - DNA, 20 bp, Artificial Sequence
  chemically synthesized
agactccctctcaaaaaaaa

SEQ ID NO: 3688 - DNA, 20 bp, Artificial Sequence
  chemically synthesized
aaaaaaaagtatatgcctca

SEQ ID NO: 3689 - DNA, 20 bp, Artificial Sequence
  chemically synthesized
aaaaaaagtatatgcctcat

SEQ ID NO: 3690 - DNA, 20 bp, Artificial Sequence
  chemically synthesized
aaaagtatatgcctcatagg

SEQ ID NO: 3691 - DNA, 20 bp, Artificial Sequence
  chemically synthesized
tatatgcctcataggtggta

SEQ ID NO: 3692 - DNA, 20 bp, Artificial Sequence
  chemically synthesized
tattttgtttctttccactt

SEQ ID NO: 3693 - DNA, 20 bp, Artificial Sequence
  chemically synthesized
ttcagtcactgattgaaaat

SEQ ID NO: 3694 - DNA, 20 bp, Artificial Sequence
  chemically synthesized
atatatgtttattatacttt

SEQ ID NO: 3695 - DNA, 20 bp, Artificial Sequence
  chemically synthesized
gtttattatactttaagttc

SEQ ID NO: 3696 - DNA, 20 bp, Artificial Sequence
  chemically synthesized
tttattatactttaagttct

SEQ ID NO: 3697 - DNA, 20 bp, Artificial Sequence
  chemically synthesized
ttattatactttaagttcta

SEQ ID NO: 3698 - DNA, 20 bp, Artificial Sequence
  chemically synthesized
gggtacatgtgcacaacatg

SEQ ID NO: 3699 - DNA, 20 bp, Artificial Sequence
  chemically synthesized
ggtacatgtgcacaacatgc

SEQ ID NO: 3700 - DNA, 20 bp, Artificial Sequence
  chemically synthesized
tatgtatacatgtgccatgt

SEQ ID NO: 3701 - DNA, 20 bp, Artificial Sequence
  chemically synthesized
cattaactcgtcatttacat

SEQ ID NO: 3702 - DNA, 20 bp, Artificial Sequence
  chemically synthesized
attaactcgtcatttacatt

SEQ ID NO: 3703 - DNA, 20 bp, Artificial Sequence
  chemically synthesized
cctaatgctatccctccccc

SEQ ID NO: 3704 - DNA, 20 bp, Artificial Sequence
  chemically synthesized
ccccggcccccaccccacaa

SEQ ID NO: 3705 - DNA, 20 bp, Artificial Sequence
  chemically synthesized
cccggcccccaccccacaac

SEQ ID NO: 3706 - DNA, 20 bp, Artificial Sequence
  chemically synthesized
ccccaccccacaacaggccc

SEQ ID NO: 3707 - DNA, 20 bp, Artificial Sequence
  chemically synthesized
attgttcaactcccacctat

SEQ ID NO: 3708 - DNA, 20 bp, Artificial Sequence
  chemically synthesized
ttcaactcccacctatgagt

SEQ ID NO: 3709 - DNA, 20 bp, Artificial Sequence
  chemically synthesized
cacctatgagtgagaatatg

SEQ ID NO: 3710 - DNA, 20 bp, Artificial Sequence
  chemically synthesized
gagtgagaatatgtggtgtt

SEQ ID NO: 3711 - DNA, 20 bp, Artificial Sequence
  chemically synthesized
cgtccttgcgatactttgct

SEQ ID NO: 3712 - DNA, 20 bp, Artificial Sequence
  chemically synthesized
cgatactttgctcagaatga

SEQ ID NO: 3713 - DNA, 20 bp, Artificial Sequence
  chemically synthesized
ttgctcagaatgatggtttc

SEQ ID NO: 3714 - DNA, 20 bp, Artificial Sequence
  chemically synthesized
gtttcatccatgtccctaca

SEQ ID NO: 3715 - DNA, 20 bp, Artificial Sequence
  chemically synthesized
tttcatccatgtccctacaa

SEQ ID NO: 3716 - DNA, 20 bp, Artificial Sequence
  chemically synthesized
catgaactcatcatttttta

SEQ ID NO: 3717 - DNA, 20 bp, Artificial Sequence
  chemically synthesized
catcattttttatggctgca

SEQ ID NO: 3718 - DNA, 20 bp, Artificial Sequence
  chemically synthesized
tgtgccacattttcttaatc

SEQ ID NO: 3719 - DNA, 20 bp, Artificial Sequence
  chemically synthesized
ttaatccagtctatcattgt

SEQ ID NO: 3720 - DNA, 20 bp, Artificial Sequence
  chemically synthesized
gtctatcattgttggacatt

SEQ ID NO: 3721 - DNA, 20 bp, Artificial Sequence
  chemically synthesized
tctatcattgttggacattt

SEQ ID NO: 3722 - DNA, 20 bp, Artificial Sequence
  chemically synthesized
tcattgttggacatttgggt

SEQ ID NO: 3723 - DNA, 20 bp, Artificial Sequence
  chemically synthesized
tggacatttgggttggttcc

SEQ ID NO: 3724 - DNA, 20 bp, Artificial Sequence
  chemically synthesized
caagtctttgctattgtgaa

SEQ ID NO: 3725 - DNA, 20 bp, Artificial Sequence
  chemically synthesized
tacgtgtgcatgtgtcttta

SEQ ID NO: 3726 - DNA, 20 bp, Artificial Sequence
  chemically synthesized
gtgtgcatgtgtctttatag

SEQ ID NO: 3727 - DNA, 20 bp, Artificial Sequence
  chemically synthesized
cagcatgatttacattcctt

SEQ ID NO: 3728 - DNA, 20 bp, Artificial Sequence
  chemically synthesized
agcatgatttacattccttt

SEQ ID NO: 3729 - DNA, 20 bp, Artificial Sequence
  chemically synthesized
cattcctttgggtatatacc

SEQ ID NO: 3730 - DNA, 20 bp, Artificial Sequence
  chemically synthesized
tttgggtatatacccagtaa

SEQ ID NO: 3731 - DNA, 20 bp, Artificial Sequence
  chemically synthesized
ttgggtatatacccagtaat

SEQ ID NO: 3732 - DNA, 20 bp, Artificial Sequence
  chemically synthesized
gtatatacccagtaatagga

SEQ ID NO: 3733 - DNA, 20 bp, Artificial Sequence
  chemically synthesized
atacccagtaataggatggc

SEQ ID NO: 3734 - DNA, 20 bp, Artificial Sequence
  chemically synthesized
tacccagtaataggatggct

SEQ ID NO: 3735 - DNA, 20 bp, Artificial Sequence
  chemically synthesized
aataggatggctgggtcaaa

SEQ ID NO: 3736 - DNA, 20 bp, Artificial Sequence
  chemically synthesized
gctgggtcaaatggtatttc

SEQ ID NO: 3737 - DNA, 20 bp, Artificial Sequence
  chemically synthesized
tcaaatggtatttctagttc

SEQ ID NO: 3738 - DNA, 20 bp, Artificial Sequence
  chemically synthesized
atttctagttctagatccct

SEQ ID NO: 3739 - DNA, 20 bp, Artificial Sequence
  chemically synthesized
tttctagttctagatccctg

SEQ ID NO: 3740 - DNA, 20 bp, Artificial Sequence
  chemically synthesized
tgccacactgacttccacaa

SEQ ID NO: 3741 - DNA, 20 bp, Artificial Sequence
  chemically synthesized
gacttccacaatggttgaac

SEQ ID NO: 3742 - DNA, 20 bp, Artificial Sequence
  chemically synthesized
acaatggttgaactagttta

SEQ ID NO: 3743 - DNA, 20 bp, Artificial Sequence
  chemically synthesized
ctagtttatagtcccaccaa

SEQ ID NO: 3744 - DNA, 20 bp, Artificial Sequence
  chemically synthesized
tagtcccaccaacagtgtaa

SEQ ID NO: 3745 - DNA, 20 bp, Artificial Sequence
  chemically synthesized
ctatttctccacatcctctc

SEQ ID NO: 3746 - DNA, 20 bp, Artificial Sequence
  chemically synthesized
cacatcctctccagcacctg

SEQ ID NO: 3747 - DNA, 20 bp, Artificial Sequence
  chemically synthesized
ttaatgatcaccattctaac

SEQ ID NO: 3748 - DNA, 20 bp, Artificial Sequence
  chemically synthesized
atcaccattctaactggtgt

SEQ ID NO: 3749 - DNA, 20 bp, Artificial Sequence
  chemically synthesized
tgtgagatgatatctcattg

SEQ ID NO: 3750 - DNA, 20 bp, Artificial Sequence
  chemically synthesized
tttgatttgcatttctctga

SEQ ID NO: 3751 - DNA, 20 bp, Artificial Sequence
  chemically synthesized
atttgcatttctctgatggc

SEQ ID NO: 3752 - DNA, 20 bp, Artificial Sequence
  chemically synthesized
ctctgatggccagtgatgat

SEQ ID NO: 3753 - DNA, 20 bp, Artificial Sequence
  chemically synthesized
gcattttttcatgtgttttt

SEQ ID NO: 3754 - DNA, 20 bp, Artificial Sequence
  chemically synthesized
ctgcataaatgtcttctttt

SEQ ID NO: 3755 - DNA, 20 bp, Artificial Sequence
  chemically synthesized
cataaatgtcttcttttgag

SEQ ID NO: 3756 - DNA, 20 bp, Artificial Sequence
  chemically synthesized
ccttcacccccttgttgatg

SEQ ID NO: 3757 - DNA, 20 bp, Artificial Sequence
  chemically synthesized
tttttcttgtaaatttgttt

SEQ ID NO: 3758 - DNA, 20 bp, Artificial Sequence
  chemically synthesized
aaatttgtttgagttcattg

SEQ ID NO: 3759 - DNA, 20 bp, Artificial Sequence
  chemically synthesized
tttgagttcattgtagattc

SEQ ID NO: 3760 - DNA, 20 bp, Artificial Sequence
  chemically synthesized
tcattgtagattctggatat

SEQ ID NO: 3761 - DNA, 20 bp, Artificial Sequence
  chemically synthesized
tctggatattagccctttgt

SEQ ID NO: 3762 - DNA, 20 bp, Artificial Sequence
  chemically synthesized
atattagccctttgtcagat

SEQ ID NO: 3763 - DNA, 20 bp, Artificial Sequence
  chemically synthesized
ttagccctttgtcagatgag

SEQ ID NO: 3764 - DNA, 20 bp, Artificial Sequence
  chemically synthesized
aaaaattttctcccattgtg

SEQ ID NO: 3765 - DNA, 20 bp, Artificial Sequence
  chemically synthesized
aaaattttctcccattgtgt

SEQ ID NO: 3766 - DNA, 20 bp, Artificial Sequence
  chemically synthesized
aggttgcctgttcactctga

SEQ ID NO: 3767 - DNA, 20 bp, Artificial Sequence
  chemically synthesized
ttgcctgttcactctgatgg

SEQ ID NO: 3768 - DNA, 20 bp, Artificial Sequence
  chemically synthesized
tggtagtttcttttgctgtg

SEQ ID NO: 3769 - DNA, 20 bp, Artificial Sequence
  chemically synthesized
tagtttcttttgctgtgcag

SEQ ID NO: 3770 - DNA, 20 bp, Artificial Sequence
  chemically synthesized
tttgctgtgcagaagctctt

SEQ ID NO: 3771 - DNA, 20 bp, Artificial Sequence
  chemically synthesized
cagaagctctttagtttaat

SEQ ID NO: 3772 - DNA, 20 bp, Artificial Sequence
  chemically synthesized
tcttttgttgccattgcttt

SEQ ID NO: 3773 - DNA, 20 bp, Artificial Sequence
  chemically synthesized
tgccattgcttttggtgttt

SEQ ID NO: 3774 - DNA, 20 bp, Artificial Sequence
  chemically synthesized
cttttggtgttttagacatg

SEQ ID NO: 3775 - DNA, 20 bp, Artificial Sequence
  chemically synthesized
gcccatgcctatgtcctgaa

SEQ ID NO: 3776 - DNA, 20 bp, Artificial Sequence
  chemically synthesized
atgtcctgaatggtattgct

SEQ ID NO: 3777 - DNA, 20 bp, Artificial Sequence
  chemically synthesized
tgtcctgaatggtattgctt

SEQ ID NO: 3778 - DNA, 20 bp, Artificial Sequence
  chemically synthesized
tattgcttaggttttcttct

SEQ ID NO: 3779 - DNA, 20 bp, Artificial Sequence
  chemically synthesized
attgcttaggttttcttcta

SEQ ID NO: 3780 - DNA, 20 bp, Artificial Sequence
  chemically synthesized
gttttcttctaaggttttta

SEQ ID NO: 3781 - DNA, 20 bp, Artificial Sequence
  chemically synthesized
ttctaaggtttttatggttt

SEQ ID NO: 3782 - DNA, 20 bp, Artificial Sequence
  chemically synthesized
tctaaggtttttatggtttt

SEQ ID NO: 3783 - DNA, 20 bp, Artificial Sequence
  chemically synthesized
tggttttaggtctaacatgt

SEQ ID NO: 3784 - DNA, 20 bp, Artificial Sequence
  chemically synthesized
tcttgaaataatttttgtat

SEQ ID NO: 3785 - DNA, 20 bp, Artificial Sequence
  chemically synthesized
cttgaaataatttttgtata

SEQ ID NO: 3786 - DNA, 20 bp, Artificial Sequence
  chemically synthesized
ataatttttgtataaggtgt

SEQ ID NO: 3787 - DNA, 20 bp, Artificial Sequence
  chemically synthesized
taatttttgtataaggtgta

SEQ ID NO: 3788 - DNA, 20 bp, Artificial Sequence
  chemically synthesized
tttttgtataaggtgtaagg

SEQ ID NO: 3789 - DNA, 20 bp, Artificial Sequence
  chemically synthesized
ttttgtataaggtgtaagga

SEQ ID NO: 3790 - DNA, 20 bp, Artificial Sequence
  chemically synthesized
tttgtataaggtgtaaggaa

SEQ ID NO: 3791 - DNA, 20 bp, Artificial Sequence
  chemically synthesized
taaggtgtaaggaagggatc

SEQ ID NO: 3792 - DNA, 20 bp, Artificial Sequence
  chemically synthesized
gtaaggaagggatccagttt

SEQ ID NO: 3793 - DNA, 20 bp, Artificial Sequence
  chemically synthesized
cagtttcagctttctacata

SEQ ID NO: 3794 - DNA, 20 bp, Artificial Sequence
  chemically synthesized
ttcagctttctacatatggc

SEQ ID NO: 3795 - DNA, 20 bp, Artificial Sequence
  chemically synthesized
gctttctacatatggctagc

SEQ ID NO: 3796 - DNA, 20 bp, Artificial Sequence
  chemically synthesized
atatggctagccagttttcc

SEQ ID NO: 3797 - DNA, 20 bp, Artificial Sequence
  chemically synthesized
tcccagcatcatttattaaa

SEQ ID NO: 3798 - DNA, 20 bp, Artificial Sequence
  chemically synthesized
cccagcatcatttattaaat

SEQ ID NO: 3799 - DNA, 20 bp, Artificial Sequence
  chemically synthesized
ccagcatcatttattaaata

SEQ ID NO: 3800 - DNA, 20 bp, Artificial Sequence
  chemically synthesized
tccccattgcttgtttttgt

SEQ ID NO: 3801 - DNA, 20 bp, Artificial Sequence
  chemically synthesized
ccccattgcttgtttttgtc

SEQ ID NO: 3802 - DNA, 20 bp, Artificial Sequence
  chemically synthesized
tgtttttgtcaggtttgtca

SEQ ID NO: 3803 - DNA, 20 bp, Artificial Sequence
  chemically synthesized
ttgtcaggtttgtcaaagat

SEQ ID NO: 3804 - DNA, 20 bp, Artificial Sequence
  chemically synthesized
caggtttgtcaaagatcaga

SEQ ID NO: 3805 - DNA, 20 bp, Artificial Sequence
  chemically synthesized
tgtcaaagatcagatagttg

SEQ ID NO: 3806 - DNA, 20 bp, Artificial Sequence
  chemically synthesized
atcagatagttgtggatgtg

SEQ ID NO: 3807 - DNA, 20 bp, Artificial Sequence
  chemically synthesized
ggatgtgtggtattatttct

SEQ ID NO: 3808 - DNA, 20 bp, Artificial Sequence
  chemically synthesized
atgtgtggtattatttctga

SEQ ID NO: 3809 - DNA, 20 bp, Artificial Sequence
  chemically synthesized
agagctctgttctgctccat

SEQ ID NO: 3810 - DNA, 20 bp, Artificial Sequence
  chemically synthesized
attggtctacatctctgttt

SEQ ID NO: 3811 - DNA, 20 bp, Artificial Sequence
  chemically synthesized
ctacatctctgttttggtac

SEQ ID NO: 3812 - DNA, 20 bp, Artificial Sequence
  chemically synthesized
gtaccagtaccatgttgttt

SEQ ID NO: 3813 - DNA, 20 bp, Artificial Sequence
  chemically synthesized
gttttggttactgtaccttg

SEQ ID NO: 3814 - DNA, 20 bp, Artificial Sequence
  chemically synthesized
ggttactgtaccttgtagta

SEQ ID NO: 3815 - DNA, 20 bp, Artificial Sequence
  chemically synthesized
gtaccttgtagtatagtttg

SEQ ID NO: 3816 - DNA, 20 bp, Artificial Sequence
  chemically synthesized
cttgtagtatagtttgaagt

SEQ ID NO: 3817 - DNA, 20 bp, Artificial Sequence
  chemically synthesized
ttgtagtatagtttgaagtc

SEQ ID NO: 3818 - DNA, 20 bp, Artificial Sequence
  chemically synthesized
tagtatagtttgaagtcagg

SEQ ID NO: 3819 - DNA, 20 bp, Artificial Sequence
  chemically synthesized
gtcaggtagcatgatgcctc

SEQ ID NO: 3820 - DNA, 20 bp, Artificial Sequence
  chemically synthesized
tgcctctagctttgttcttt

SEQ ID NO: 3821 - DNA, 20 bp, Artificial Sequence
  chemically synthesized
ctagctttgttcttttggct

SEQ ID NO: 3822 - DNA, 20 bp, Artificial Sequence
  chemically synthesized
tagctttgttcttttggctt

SEQ ID NO: 3823 - DNA, 20 bp, Artificial Sequence
  chemically synthesized
ttaggattgacttgtcaatg

SEQ ID NO: 3824 - DNA, 20 bp, Artificial Sequence
  chemically synthesized
taggattgacttgtcaatgc

SEQ ID NO: 3825 - DNA, 20 bp, Artificial Sequence
  chemically synthesized
tgtcaatgcgggctcttttt

SEQ ID NO: 3826 - DNA, 20 bp, Artificial Sequence
  chemically synthesized
ttggttccatatgaacttta

SEQ ID NO: 3827 - DNA, 20 bp, Artificial Sequence
  chemically synthesized
gttccatatgaactttaaag

SEQ ID NO: 3828 - DNA, 20 bp, Artificial Sequence
  chemically synthesized
tagttttttccaattctgtg

SEQ ID NO: 3829 - DNA, 20 bp, Artificial Sequence
  chemically synthesized
tttttccaattctgtgaaga

SEQ ID NO: 3830 - DNA, 20 bp, Artificial Sequence
  chemically synthesized
aattctgtgaagaaagtcat

SEQ ID NO: 3831 - DNA, 20 bp, Artificial Sequence
  chemically synthesized
tctgtgaagaaagtcattgg

SEQ ID NO: 3832 - DNA, 20 bp, Artificial Sequence
  chemically synthesized
gaaagtcattggtagcttga

SEQ ID NO: 3833 - DNA, 20 bp, Artificial Sequence
  chemically synthesized
aaagtcattggtagcttgat

SEQ ID NO: 3834 - DNA, 20 bp, Artificial Sequence
  chemically synthesized
aagtcattggtagcttgatg

SEQ ID NO: 3835 - DNA, 20 bp, Artificial Sequence
  chemically synthesized
cattggtagcttgatgggga

SEQ ID NO: 3836 - DNA, 20 bp, Artificial Sequence
  chemically synthesized
attgaatctataaattacct

SEQ ID NO: 3837 - DNA, 20 bp, Artificial Sequence
  chemically synthesized
ttgaatctataaattacctt

SEQ ID NO: 3838 - DNA, 20 bp, Artificial Sequence
  chemically synthesized
aatctataaattaccttggg

SEQ ID NO: 3839 - DNA, 20 bp, Artificial Sequence
  chemically synthesized
tataaattaccttgggcagt

SEQ ID NO: 3840 - DNA, 20 bp, Artificial Sequence
  chemically synthesized
ataaattaccttgggcagta

SEQ ID NO: 3841 - DNA, 20 bp, Artificial Sequence
  chemically synthesized
tattgattcttcctatccat

SEQ ID NO: 3842 - DNA, 20 bp, Artificial Sequence
  chemically synthesized
attcttcctatccatgagca

SEQ ID NO: 3843 - DNA, 20 bp, Artificial Sequence
  chemically synthesized
gtatcctcttttatttcgtt

SEQ ID NO: 3844 - DNA, 20 bp, Artificial Sequence
  chemically synthesized
tcctcttttatttcgttgag

SEQ ID NO: 3845 - DNA, 20 bp, Artificial Sequence
  chemically synthesized
gtgttttgttgttctccttg

SEQ ID NO: 3846 - DNA, 20 bp, Artificial Sequence
  chemically synthesized
gttttgttgttctccttgaa

SEQ ID NO: 3847 - DNA, 20 bp, Artificial Sequence
  chemically synthesized
ttttgttgttctccttgaag

SEQ ID NO: 3848 - DNA, 20 bp, Artificial Sequence
  chemically synthesized
aggtccttcacatcccttgt

SEQ ID NO: 3849 - DNA, 20 bp, Artificial Sequence
  chemically synthesized
ccttcacatcccttgtaagt

SEQ ID NO: 3850 - DNA, 20 bp, Artificial Sequence
  chemically synthesized
tcccttgtaagttggattcc

SEQ ID NO: 3851 - DNA, 20 bp, Artificial Sequence
  chemically synthesized
cccttgtaagttggattcct

SEQ ID NO: 3852 - DNA, 20 bp, Artificial Sequence
  chemically synthesized
ctaggtattttattctcttt

SEQ ID NO: 3853 - DNA, 20 bp, Artificial Sequence
  chemically synthesized
taggtattttattctctttg

SEQ ID NO: 3854 - DNA, 20 bp, Artificial Sequence
  chemically synthesized
ctctttgaggcaattgtgaa

SEQ ID NO: 3855 - DNA, 20 bp, Artificial Sequence
  chemically synthesized
tctttgaggcaattgtgaat

SEQ ID NO: 3856 - DNA, 20 bp, Artificial Sequence
  chemically synthesized
tttgaggcaattgtgaatgg

SEQ ID NO: 3857 - DNA, 20 bp, Artificial Sequence
  chemically synthesized
atgggagttcactcatgatt

SEQ ID NO: 3858 - DNA, 20 bp, Artificial Sequence
  chemically synthesized
gctctctgtttgtctgttat

SEQ ID NO: 3859 - DNA, 20 bp, Artificial Sequence
  chemically synthesized
gtttgtctgttattggtgta

SEQ ID NO: 3860 - DNA, 20 bp, Artificial Sequence
  chemically synthesized
tttgtctgttattggtgtat

SEQ ID NO: 3861 - DNA, 20 bp, Artificial Sequence
  chemically synthesized
gcacattgattttgtatgct

SEQ ID NO: 3862 - DNA, 20 bp, Artificial Sequence
  chemically synthesized
tgtatgctgagacttttctg

SEQ ID NO: 3863 - DNA, 20 bp, Artificial Sequence
  chemically synthesized
acttttctgaagttgcttat

SEQ ID NO: 3864 - DNA, 20 bp, Artificial Sequence
  chemically synthesized
ctgaagttgcttatcagctt

SEQ ID NO: 3865 - DNA, 20 bp, Artificial Sequence
  chemically synthesized
tgaagttgcttatcagctta

SEQ ID NO: 3866 - DNA, 20 bp, Artificial Sequence
  chemically synthesized
aagttgcttatcagcttaag

SEQ ID NO: 3867 - DNA, 20 bp, Artificial Sequence
  chemically synthesized
ttatcagcttaaggagattt

SEQ ID NO: 3868 - DNA, 20 bp, Artificial Sequence
  chemically synthesized
tatcagcttaaggagatttt

SEQ ID NO: 3869 - DNA, 20 bp, Artificial Sequence
  chemically synthesized
gcttaaggagattttgggct

SEQ ID NO: 3870 - DNA, 20 bp, Artificial Sequence
  chemically synthesized
gagattttgggctgagacga

SEQ ID NO: 3871 - DNA, 20 bp, Artificial Sequence
  chemically synthesized
agattttgggctgagacgat

SEQ ID NO: 3872 - DNA, 20 bp, Artificial Sequence
  chemically synthesized
gattttgggctgagacgatg

SEQ ID NO: 3873 - DNA, 20 bp, Artificial Sequence
  chemically synthesized
gctgagacgatggggttttc

SEQ ID NO: 3874 - DNA, 20 bp, Artificial Sequence
  chemically synthesized
acaatcacgtcatctgcaaa

SEQ ID NO: 3875 - DNA, 20 bp, Artificial Sequence
  chemically synthesized
caatcacgtcatctgcaaac

SEQ ID NO: 3876 - DNA, 20 bp, Artificial Sequence
  chemically synthesized
aatcacgtcatctgcaaaca

SEQ ID NO: 3877 - DNA, 20 bp, Artificial Sequence
  chemically synthesized
tttctcttgcctgattgccc

SEQ ID NO: 3878 - DNA, 20 bp, Artificial Sequence
  chemically synthesized
tcttgcctgattgccctggc

SEQ ID NO: 3879 - DNA, 20 bp, Artificial Sequence
  chemically synthesized
acttccaacactatgttgaa

SEQ ID NO: 3880 - DNA, 20 bp, Artificial Sequence
  chemically synthesized
cttccaacactatgttgaat

SEQ ID NO: 3881 - DNA, 20 bp, Artificial Sequence
  chemically synthesized
tccaacactatgttgaatag

SEQ ID NO: 3882 - DNA, 20 bp, Artificial Sequence
  chemically synthesized
aacactatgttgaataggag

SEQ ID NO: 3883 - DNA, 20 bp, Artificial Sequence
  chemically synthesized
ctatgttgaataggagtggt

SEQ ID NO: 3884 - DNA, 20 bp, Artificial Sequence
  chemically synthesized
atgttgaataggagtggtga

SEQ ID NO: 3885 - DNA, 20 bp, Artificial Sequence
  chemically synthesized
gttgaataggagtggtgaga

SEQ ID NO: 3886 - DNA, 20 bp, Artificial Sequence
  chemically synthesized
ttgaataggagtggtgagag

SEQ ID NO: 3887 - DNA, 20 bp, Artificial Sequence
  chemically synthesized
tgaataggagtggtgagaga

SEQ ID NO: 3888 - DNA, 20 bp, Artificial Sequence
  chemically synthesized
agggcatccctgtcttgtgc

SEQ ID NO: 3889 - DNA, 20 bp, Artificial Sequence
  chemically synthesized
ctgtcttgtgccagttttca

SEQ ID NO: 3890 - DNA, 20 bp, Artificial Sequence
  chemically synthesized
tgtcttgtgccagttttcaa

SEQ ID NO: 3891 - DNA, 20 bp, Artificial Sequence
  chemically synthesized
gtcttgtgccagttttcaaa

SEQ ID NO: 3892 - DNA, 20 bp, Artificial Sequence
  chemically synthesized
gttttcaaagggaatgcttc

SEQ ID NO: 3893 - DNA, 20 bp, Artificial Sequence
  chemically synthesized
gcttccagtttttgtccatt

SEQ ID NO: 3894 - DNA, 20 bp, Artificial Sequence
  chemically synthesized
ttgtccattcagtatgatat

SEQ ID NO: 3895 - DNA, 20 bp, Artificial Sequence
  chemically synthesized
attcagtatgatattggctg

SEQ ID NO: 3896 - DNA, 20 bp, Artificial Sequence
  chemically synthesized
ttcagtatgatattggctgt

SEQ ID NO: 3897 - DNA, 20 bp, Artificial Sequence
  chemically synthesized
tattggctgtgggtttgtca

SEQ ID NO: 3898 - DNA, 20 bp, Artificial Sequence
  chemically synthesized
ggctgtgggtttgtcataga

SEQ ID NO: 3899 - DNA, 20 bp, Artificial Sequence
  chemically synthesized
tagatagctcttattatttt

SEQ ID NO: 3900 - DNA, 20 bp, Artificial Sequence
  chemically synthesized
ccatcgatacctaatttatt

SEQ ID NO: 3901 - DNA, 20 bp, Artificial Sequence
  chemically synthesized
atcgatacctaatttattga

SEQ ID NO: 3902 - DNA, 20 bp, Artificial Sequence
  chemically synthesized
cctaatttattgagagtttt

SEQ ID NO: 3903 - DNA, 20 bp, Artificial Sequence
  chemically synthesized
tattgagagtttttagtatg

SEQ ID NO: 3904 - DNA, 20 bp, Artificial Sequence
  chemically synthesized
agcattgttgaattttgtca

SEQ ID NO: 3905 - DNA, 20 bp, Artificial Sequence
  chemically synthesized
gcattgttgaattttgtcaa

SEQ ID NO: 3906 - DNA, 20 bp, Artificial Sequence
  chemically synthesized
aggccttttctgcatctatt

SEQ ID NO: 3907 - DNA, 20 bp, Artificial Sequence
  chemically synthesized
catctattgagataatcatg

SEQ ID NO: 3908 - DNA, 20 bp, Artificial Sequence
  chemically synthesized
aatcatgtggtttgtgtctt

SEQ ID NO: 3909 - DNA, 20 bp, Artificial Sequence
  chemically synthesized
ctttggttctgtttatatgc

SEQ ID NO: 3910 - DNA, 20 bp, Artificial Sequence
  chemically synthesized
ttgatttgcatatgttgaac

SEQ ID NO: 3911 - DNA, 20 bp, Artificial Sequence
  chemically synthesized
gttgaaccagccctgcatcc

SEQ ID NO: 3912 - DNA, 20 bp, Artificial Sequence
  chemically synthesized
ttgaaccagccctgcatccc

SEQ ID NO: 3913 - DNA, 20 bp, Artificial Sequence
  chemically synthesized
tgaaccagccctgcatccca

SEQ ID NO: 3914 - DNA, 20 bp, Artificial Sequence
  chemically synthesized
agccctgcatcccagggatg

SEQ ID NO: 3915 - DNA, 20 bp, Artificial Sequence
  chemically synthesized
ggatgaagcccacttgatca

SEQ ID NO: 3916 - DNA, 20 bp, Artificial Sequence
  chemically synthesized
tgaagcccacttgatcatgg

SEQ ID NO: 3917 - DNA, 20 bp, Artificial Sequence
  chemically synthesized
cccacttgatcatggtggat

SEQ ID NO: 3918 - DNA, 20 bp, Artificial Sequence
  chemically synthesized
taagctttttgatgtgctcc

SEQ ID NO: 3919 - DNA, 20 bp, Artificial Sequence
  chemically synthesized
ttttgatgtgctcctggatt

SEQ ID NO: 3920 - DNA, 20 bp, Artificial Sequence
  chemically synthesized
tgctcctggatttggtttgc

SEQ ID NO: 3921 - DNA, 20 bp, Artificial Sequence
  chemically synthesized
tggtttgccagtattttact

SEQ ID NO: 3922 - DNA, 20 bp, Artificial Sequence
  chemically synthesized
ggtttgccagtattttactg

SEQ ID NO: 3923 - DNA, 20 bp, Artificial Sequence
  chemically synthesized
atttttgcatcgatgttcat

SEQ ID NO: 3924 - DNA, 20 bp, Artificial Sequence
  chemically synthesized
tttttgcatcgatgttcatc

SEQ ID NO: 3925 - DNA, 20 bp, Artificial Sequence
  chemically synthesized
ttttgcatcgatgttcatca

SEQ ID NO: 3926 - DNA, 20 bp, Artificial Sequence
  chemically synthesized
tcgatgttcatcagggatat

SEQ ID NO: 3927 - DNA, 20 bp, Artificial Sequence
  chemically synthesized
tttttttgttgtgtgtctgc

SEQ ID NO: 3928 - DNA, 20 bp, Artificial Sequence
  chemically synthesized
ttttttgttgtgtgtctgct

SEQ ID NO: 3929 - DNA, 20 bp, Artificial Sequence
  chemically synthesized
gttgtgtgtctgctaggctt

SEQ ID NO: 3930 - DNA, 20 bp, Artificial Sequence
  chemically synthesized
gtctgctaggctttggtatc

SEQ ID NO: 3931 - DNA, 20 bp, Artificial Sequence
  chemically synthesized
ctttggtatcaagatgatgc

SEQ ID NO: 3932 - DNA, 20 bp, Artificial Sequence
  chemically synthesized
tgatgctggcctcataaaat

SEQ ID NO: 3933 - DNA, 20 bp, Artificial Sequence
  chemically synthesized
gctggcctcataaaatgagt

SEQ ID NO: 3934 - DNA, 20 bp, Artificial Sequence
  chemically synthesized
ctggcctcataaaatgagtt

SEQ ID NO: 3935 - DNA, 20 bp, Artificial Sequence
  chemically synthesized
tggcctcataaaatgagtta

SEQ ID NO: 3936 - DNA, 20 bp, Artificial Sequence
  chemically synthesized
gcctcataaaatgagttagg

SEQ ID NO: 3937 - DNA, 20 bp, Artificial Sequence
  chemically synthesized
cctcataaaatgagttaggg

SEQ ID NO: 3938 - DNA, 20 bp, Artificial Sequence
  chemically synthesized
ttccctctttttctattgat

SEQ ID NO: 3939 - DNA, 20 bp, Artificial Sequence
  chemically synthesized
tctttttctattgattggaa

SEQ ID NO: 3940 - DNA, 20 bp, Artificial Sequence
  chemically synthesized
tctattgattggaatagttt

SEQ ID NO: 3941 - DNA, 20 bp, Artificial Sequence
  chemically synthesized
attgattggaatagtttcag

SEQ ID NO: 3942 - DNA, 20 bp, Artificial Sequence
  chemically synthesized
ttgattggaatagtttcaga

SEQ ID NO: 3943 - DNA, 20 bp, Artificial Sequence
  chemically synthesized
tggaatagtttcagaaggaa

SEQ ID NO: 3944 - DNA, 20 bp, Artificial Sequence
  chemically synthesized
agtttcagaaggaatggtac

SEQ ID NO: 3945 - DNA, 20 bp, Artificial Sequence
  chemically synthesized
ccagctcctccttgtacctc

SEQ ID NO: 3946 - DNA, 20 bp, Artificial Sequence
  chemically synthesized
gctcctccttgtacctctgg

SEQ ID NO: 3947 - DNA, 20 bp, Artificial Sequence
  chemically synthesized
cttgtacctctggtagaatt

SEQ ID NO: 3948 - DNA, 20 bp, Artificial Sequence
  chemically synthesized
aattcggctgtgaatccatc

SEQ ID NO: 3949 - DNA, 20 bp, Artificial Sequence
  chemically synthesized
gctgtgaatccatctggtcc

SEQ ID NO: 3950 - DNA, 20 bp, Artificial Sequence
  chemically synthesized
atctggtcctggactttttt

SEQ ID NO: 3951 - DNA, 20 bp, Artificial Sequence
  chemically synthesized
ggtcctggactttttttggt

SEQ ID NO: 3952 - DNA, 20 bp, Artificial Sequence
  chemically synthesized
ctggactttttttggttggt

SEQ ID NO: 3953 - DNA, 20 bp, Artificial Sequence
  chemically synthesized
ttttggttggtaagcttcat

SEQ ID NO: 3954 - DNA, 20 bp, Artificial Sequence
  chemically synthesized
gttggtaagcttcataagtg

SEQ ID NO: 3955 - DNA, 20 bp, Artificial Sequence
  chemically synthesized
ttggtaagcttcataagtga

SEQ ID NO: 3956 - DNA, 20 bp, Artificial Sequence
  chemically synthesized
ggtaagcttcataagtgaag

SEQ ID NO: 3957 - DNA, 20 bp, Artificial Sequence
  chemically synthesized
aggagaaataaaatacttta

SEQ ID NO: 3958 - DNA, 20 bp, Artificial Sequence
  chemically synthesized
aaataaaatactttacagac

SEQ ID NO: 3959 - DNA, 20 bp, Artificial Sequence
  chemically synthesized
attgctgattttgtcaccac

SEQ ID NO: 3960 - DNA, 20 bp, Artificial Sequence
  chemically synthesized
ttgctgattttgtcaccacc

SEQ ID NO: 3961 - DNA, 20 bp, Artificial Sequence
  chemically synthesized
caccaccaggcctgccctaa

SEQ ID NO: 3962 - DNA, 20 bp, Artificial Sequence
  chemically synthesized
ccaccaggcctgccctaaaa

SEQ ID NO: 3963 - DNA, 20 bp, Artificial Sequence
  chemically synthesized
ctgccctaaaagagctcctg

SEQ ID NO: 3964 - DNA, 20 bp, Artificial Sequence
  chemically synthesized
tgccctaaaagagctcctga

SEQ ID NO: 3965 - DNA, 20 bp, Artificial Sequence
  chemically synthesized
cctaaaagagctcctgaagg

SEQ ID NO: 3966 - DNA, 20 bp, Artificial Sequence
  chemically synthesized
aaaagagctcctgaaggaag

SEQ ID NO: 3967 - DNA, 20 bp, Artificial Sequence
  chemically synthesized
cctgaaggaagcagtaaaca

SEQ ID NO: 3968 - DNA, 20 bp, Artificial Sequence
  chemically synthesized
aaggaagcagtaaacatgga

SEQ ID NO: 3969 - DNA, 20 bp, Artificial Sequence
  chemically synthesized
taaacatggaaagaaacaac

SEQ ID NO: 3970 - DNA, 20 bp, Artificial Sequence
  chemically synthesized
tggaaagaaacaaccagtac

SEQ ID NO: 3971 - DNA, 20 bp, Artificial Sequence
  chemically synthesized
caaaaacatgccaaattgta

SEQ ID NO: 3972 - DNA, 20 bp, Artificial Sequence
  chemically synthesized
gccaaattgtaaagaccatc

SEQ ID NO: 3973 - DNA, 20 bp, Artificial Sequence
  chemically synthesized
ccaaattgtaaagaccatca

SEQ ID NO: 3974 - DNA, 20 bp, Artificial Sequence
  chemically synthesized
attgtaaagaccatcaaggc

SEQ ID NO: 3975 - DNA, 20 bp, Artificial Sequence
  chemically synthesized
ttgtaaagaccatcaaggct

SEQ ID NO: 3976 - DNA, 20 bp, Artificial Sequence
  chemically synthesized
tgtaaagaccatcaaggcta

SEQ ID NO: 3977 - DNA, 20 bp, Artificial Sequence
  chemically synthesized
taaagaccatcaaggctagg

SEQ ID NO: 3978 - DNA, 20 bp, Artificial Sequence
  chemically synthesized
tagggagaaactgcatcaac

SEQ ID NO: 3979 - DNA, 20 bp, Artificial Sequence
  chemically synthesized
gagaaactgcatcaactagc

SEQ ID NO: 3980 - DNA, 20 bp, Artificial Sequence
  chemically synthesized
caactagcaagcaaaataac

SEQ ID NO: 3981 - DNA, 20 bp, Artificial Sequence
  chemically synthesized
accagctaacatcataatga

SEQ ID NO: 3982 - DNA, 20 bp, Artificial Sequence
  chemically synthesized
ccagctaacatcataatgac

SEQ ID NO: 3983 - DNA, 20 bp, Artificial Sequence
  chemically synthesized
tattaaccttaaatgtaaat

SEQ ID NO: 3984 - DNA, 20 bp, Artificial Sequence
  chemically synthesized
gagctaaatgctccaattaa

SEQ ID NO: 3985 - DNA, 20 bp, Artificial Sequence
  chemically synthesized
aatgctccaattaaaagaca

SEQ ID NO: 3986 - DNA, 20 bp, Artificial Sequence
  chemically synthesized
tccaattaaaagacacagac

SEQ ID NO: 3987 - DNA, 20 bp, Artificial Sequence
  chemically synthesized
aaagacacagactggcaaat

SEQ ID NO: 3988 - DNA, 20 bp, Artificial Sequence
  chemically synthesized
acagactggcaaattggata

SEQ ID NO: 3989 - DNA, 20 bp, Artificial Sequence
  chemically synthesized
agactggcaaattggataaa

SEQ ID NO: 3990 - DNA, 20 bp, Artificial Sequence
  chemically synthesized
ggcaaattggataaagagtc

SEQ ID NO: 3991 - DNA, 20 bp, Artificial Sequence
  chemically synthesized
gataaagagtcaagacctat

SEQ ID NO: 3992 - DNA, 20 bp, Artificial Sequence
  chemically synthesized
acctatcagtgtgctgtatt

SEQ ID NO: 3993 - DNA, 20 bp, Artificial Sequence
  chemically synthesized
cctatcagtgtgctgtattc

SEQ ID NO: 3994 - DNA, 20 bp, Artificial Sequence
  chemically synthesized
ttcaggaaaccaatctcatg

SEQ ID NO: 3995 - DNA, 20 bp, Artificial Sequence
  chemically synthesized
caggaaaccaatctcatgtg

SEQ ID NO: 3996 - DNA, 20 bp, Artificial Sequence
  chemically synthesized
ggaaaccaatctcatgtgga

SEQ ID NO: 3997 - DNA, 20 bp, Artificial Sequence
  chemically synthesized
ctcatgtggagagacacaca

SEQ ID NO: 3998 - DNA, 20 bp, Artificial Sequence
  chemically synthesized
tcatgtggagagacacacat

SEQ ID NO: 3999 - DNA, 20 bp, Artificial Sequence
  chemically synthesized
acacacataggctcaaaata

SEQ ID NO: 4000 - DNA, 20 bp, Artificial Sequence
  chemically synthesized
cacacataggctcaaaataa

SEQ ID NO: 4001 - DNA, 20 bp, Artificial Sequence
  chemically synthesized
acacataggctcaaaataaa

SEQ ID NO: 4002 - DNA, 20 bp, Artificial Sequence
  chemically synthesized
ataggctcaaaataaaggga

SEQ ID NO: 4003 - DNA, 20 bp, Artificial Sequence
  chemically synthesized
aggctcaaaataaagggatg

SEQ ID NO: 4004 - DNA, 20 bp, Artificial Sequence
  chemically synthesized
ggctcaaaataaagggatgg

SEQ ID NO: 4005 - DNA, 20 bp, Artificial Sequence
  chemically synthesized
tcaaaataaagggatggagg

SEQ ID NO: 4006 - DNA, 20 bp, Artificial Sequence
  chemically synthesized
gggatggaggaagatctacc

SEQ ID NO: 4007 - DNA, 20 bp, Artificial Sequence
  chemically synthesized
aggaagatctaccaagcaaa

SEQ ID NO: 4008 - DNA, 20 bp, Artificial Sequence
  chemically synthesized
agcaaatggaaaacaaaaaa

SEQ ID NO: 4009 - DNA, 20 bp, Artificial Sequence
  chemically synthesized
gcaaatggaaaacaaaaaaa

SEQ ID NO: 4010 - DNA, 20 bp, Artificial Sequence
  chemically synthesized
aatggaaaacaaaaaaaagg

SEQ ID NO: 4011 - DNA, 20 bp, Artificial Sequence
  chemically synthesized
atggaaaacaaaaaaaaggc

SEQ ID NO: 4012 - DNA, 20 bp, Artificial Sequence
  chemically synthesized
tggaaaacaaaaaaaaggca

SEQ ID NO: 4013 - DNA, 20 bp, Artificial Sequence
  chemically synthesized
aaaggcagggtttgcaatct

SEQ ID NO: 4014 - DNA, 20 bp, Artificial Sequence
  chemically synthesized
aatcttagtctctgataaaa

SEQ ID NO: 4015 - DNA, 20 bp, Artificial Sequence
  chemically synthesized
aaacagactttaaaccaaca

SEQ ID NO: 4016 - DNA, 20 bp, Artificial Sequence
  chemically synthesized
tttaaaccaacaaagatcaa

SEQ ID NO: 4017 - DNA, 20 bp, Artificial Sequence
  chemically synthesized
taaaccaacaaagatcaaaa

SEQ ID NO: 4018 - DNA, 20 bp, Artificial Sequence
  chemically synthesized
aacaaagatcaaaagagaca

SEQ ID NO: 4019 - DNA, 20 bp, Artificial Sequence
  chemically synthesized
aaagatcaaaagagacaaag

SEQ ID NO: 4020 - DNA, 20 bp, Artificial Sequence
  chemically synthesized
aagatcaaaagagacaaaga

SEQ ID NO: 4021 - DNA, 20 bp, Artificial Sequence
  chemically synthesized
caaagaaggccattacatac

SEQ ID NO: 4022 - DNA, 20 bp, Artificial Sequence
  chemically synthesized
aaggccattacatactggta

SEQ ID NO: 4023 - DNA, 20 bp, Artificial Sequence
  chemically synthesized
aggccattacatactggtaa

SEQ ID NO: 4024 - DNA, 20 bp, Artificial Sequence
  chemically synthesized
ggccattacatactggtaaa

SEQ ID NO: 4025 - DNA, 20 bp, Artificial Sequence
  chemically synthesized
ggtaaagggatcaattcaac

SEQ ID NO: 4026 - DNA, 20 bp, Artificial Sequence
  chemically synthesized
aaagggatcaattcaacaag

SEQ ID NO: 4027 - DNA, 20 bp, Artificial Sequence
  chemically synthesized
agggatcaattcaacaagaa

SEQ ID NO: 4028 - DNA, 20 bp, Artificial Sequence
  chemically synthesized
aaatatatatgcacccaata

SEQ ID NO: 4029 - DNA, 20 bp, Artificial Sequence
  chemically synthesized
tatatatgcacccaatacag

SEQ ID NO: 4030 - DNA, 20 bp, Artificial Sequence
  chemically synthesized
gcacccaatacagcagcacc

SEQ ID NO: 4031 - DNA, 20 bp, Artificial Sequence
  chemically synthesized
cagcagcacccagattcata

SEQ ID NO: 4032 - DNA, 20 bp, Artificial Sequence
  chemically synthesized
agcacccagattcataaagc

SEQ ID NO: 4033 - DNA, 20 bp, Artificial Sequence
  chemically synthesized
agattcataaagcaagtcct

SEQ ID NO: 4034 - DNA, 20 bp, Artificial Sequence
  chemically synthesized
attcataaagcaagtcctta

SEQ ID NO: 4035 - DNA, 20 bp, Artificial Sequence
  chemically synthesized
caagtccttagagacctaca

SEQ ID NO: 4036 - DNA, 20 bp, Artificial Sequence
  chemically synthesized
agtccttagagacctacaaa

SEQ ID NO: 4037 - DNA, 20 bp, Artificial Sequence
  chemically synthesized
tagagacctacaaagagact

SEQ ID NO: 4038 - DNA, 20 bp, Artificial Sequence
  chemically synthesized
agactcccacacaataataa

SEQ ID NO: 4039 - DNA, 20 bp, Artificial Sequence
  chemically synthesized
gactcccacacaataataat

SEQ ID NO: 4040 - DNA, 20 bp, Artificial Sequence
  chemically synthesized
ctcccacacaataataatgg

SEQ ID NO: 4041 - DNA, 20 bp, Artificial Sequence
  chemically synthesized
taacaccccactgtcaacat

SEQ ID NO: 4042 - DNA, 20 bp, Artificial Sequence
  chemically synthesized
accccactgtcaacattaga

SEQ ID NO: 4043 - DNA, 20 bp, Artificial Sequence
  chemically synthesized
tcaacattagacagatcaac

SEQ ID NO: 4044 - DNA, 20 bp, Artificial Sequence
  chemically synthesized
cattagacagatcaacgaga

SEQ ID NO: 4045 - DNA, 20 bp, Artificial Sequence
  chemically synthesized
agacagatcaacgagacaga

SEQ ID NO: 4046 - DNA, 20 bp, Artificial Sequence
  chemically synthesized
caacgagacagaaagttaac

SEQ ID NO: 4047 - DNA, 20 bp, Artificial Sequence
  chemically synthesized
aacgagacagaaagttaaca

SEQ ID NO: 4048 - DNA, 20 bp, Artificial Sequence
  chemically synthesized
agaaagttaacaaggatatc

SEQ ID NO: 4049 - DNA, 20 bp, Artificial Sequence
  chemically synthesized
gaaagttaacaaggatatcc

SEQ ID NO: 4050 - DNA, 20 bp, Artificial Sequence
  chemically synthesized
ggatatccaggaattgaatt

SEQ ID NO: 4051 - DNA, 20 bp, Artificial Sequence
  chemically synthesized
attgaattcagctctgcacc

SEQ ID NO: 4052 - DNA, 20 bp, Artificial Sequence
  chemically synthesized
gaattcagctctgcaccaag

SEQ ID NO: 4053 - DNA, 20 bp, Artificial Sequence
  chemically synthesized
tctgcaccaagcagacctaa

SEQ ID NO: 4054 - DNA, 20 bp, Artificial Sequence
  chemically synthesized
gcagacctaatagacatcta

SEQ ID NO: 4055 - DNA, 20 bp, Artificial Sequence
  chemically synthesized
aactctccatcccaaatcaa

SEQ ID NO: 4056 - DNA, 20 bp, Artificial Sequence
  chemically synthesized
aatagaatatacattcttct

SEQ ID NO: 4057 - DNA, 20 bp, Artificial Sequence
  chemically synthesized
gcaccacaccacacctattc

SEQ ID NO: 4058 - DNA, 20 bp, Artificial Sequence
  chemically synthesized
acctattccagttgaccaca

SEQ ID NO: 4059 - DNA, 20 bp, Artificial Sequence
  chemically synthesized
attccagttgaccacatagt

SEQ ID NO: 4060 - DNA, 20 bp, Artificial Sequence
  chemically synthesized
ccagttgaccacatagttgg

SEQ ID NO: 4061 - DNA, 20 bp, Artificial Sequence
  chemically synthesized
tgaccacatagttggaagtg

SEQ ID NO: 4062 - DNA, 20 bp, Artificial Sequence
  chemically synthesized
gttggaagtgaagcactcct

SEQ ID NO: 4063 - DNA, 20 bp, Artificial Sequence
  chemically synthesized
gcactcctcagcaaacgtaa

SEQ ID NO: 4064 - DNA, 20 bp, Artificial Sequence
  chemically synthesized
cctcagcaaacgtaaaagaa

SEQ ID NO: 4065 - DNA, 20 bp, Artificial Sequence
  chemically synthesized
aacaataacaaactgtctct

SEQ ID NO: 4066 - DNA, 20 bp, Artificial Sequence
  chemically synthesized
acaaactgtctctcagacca

SEQ ID NO: 4067 - DNA, 20 bp, Artificial Sequence
  chemically synthesized
agaccacagtgcaatcaaac

SEQ ID NO: 4068 - DNA, 20 bp, Artificial Sequence
  chemically synthesized
agtgcaatcaaactagaact

SEQ ID NO: 4069 - DNA, 20 bp, Artificial Sequence
  chemically synthesized
gtgcaatcaaactagaactc

SEQ ID NO: 4070 - DNA, 20 bp, Artificial Sequence
  chemically synthesized
tcaaactagaactcaggatt

SEQ ID NO: 4071 - DNA, 20 bp, Artificial Sequence
  chemically synthesized
ctcaaaaccactcaactaca

SEQ ID NO: 4072 - DNA, 20 bp, Artificial Sequence
  chemically synthesized
tcaactacatggaaactgaa

SEQ ID NO: 4073 - DNA, 20 bp, Artificial Sequence
  chemically synthesized
gcctgctcctgaatgactac

SEQ ID NO: 4074 - DNA, 20 bp, Artificial Sequence
  chemically synthesized
cctgctcctgaatgactact

SEQ ID NO: 4075 - DNA, 20 bp, Artificial Sequence
  chemically synthesized
actgggtacataacaaaatg

SEQ ID NO: 4076 - DNA, 20 bp, Artificial Sequence
  chemically synthesized
ctgggtacataacaaaatga

SEQ ID NO: 4077 - DNA, 20 bp, Artificial Sequence
  chemically synthesized
ggtacataacaaaatgaagg

SEQ ID NO: 4078 - DNA, 20 bp, Artificial Sequence
  chemically synthesized
acaaaatgaaggcagaaata

SEQ ID NO: 4079 - DNA, 20 bp, Artificial Sequence
  chemically synthesized
agatgttctttgaaaccaac

SEQ ID NO: 4080 - DNA, 20 bp, Artificial Sequence
  chemically synthesized
ctttgaaaccaacgagaata

SEQ ID NO: 4081 - DNA, 20 bp, Artificial Sequence
  chemically synthesized
agaataaagatacaacaaaa

SEQ ID NO: 4082 - DNA, 20 bp, Artificial Sequence
  chemically synthesized
atacaacaaaacagaatctc

SEQ ID NO: 4083 - DNA, 20 bp, Artificial Sequence
  chemically synthesized
tacaacaaaacagaatctct

SEQ ID NO: 4084 - DNA, 20 bp, Artificial Sequence
  chemically synthesized
gaatctctgggacacattta

SEQ ID NO: 4085 - DNA, 20 bp, Artificial Sequence
  chemically synthesized
tctctgggacacatttaaag

SEQ ID NO: 4086 - DNA, 20 bp, Artificial Sequence
  chemically synthesized
gacacatttaaagcagtgtg

SEQ ID NO: 4087 - DNA, 20 bp, Artificial Sequence
  chemically synthesized
cacatttaaagcagtgtgta

SEQ ID NO: 4088 - DNA, 20 bp, Artificial Sequence
  chemically synthesized
acatttaaagcagtgtgtag

SEQ ID NO: 4089 - DNA, 20 bp, Artificial Sequence
  chemically synthesized
catttaaagcagtgtgtaga

SEQ ID NO: 4090 - DNA, 20 bp, Artificial Sequence
  chemically synthesized
agtgtgtagagggaaattta

SEQ ID NO: 4091 - DNA, 20 bp, Artificial Sequence
  chemically synthesized
atagcactaaatgcccacaa

SEQ ID NO: 4092 - DNA, 20 bp, Artificial Sequence
  chemically synthesized
cactaaatgcccacaaaaga

SEQ ID NO: 4093 - DNA, 20 bp, Artificial Sequence
  chemically synthesized
taaatgcccacaaaagaaag

SEQ ID NO: 4094 - DNA, 20 bp, Artificial Sequence
  chemically synthesized
aaatgcccacaaaagaaagc

SEQ ID NO: 4095 - DNA, 20 bp, Artificial Sequence
  chemically synthesized
gcccacaaaagaaagcagga

SEQ ID NO: 4096 - DNA, 20 bp, Artificial Sequence
  chemically synthesized
caccctaacatcacaattaa

SEQ ID NO: 4097 - DNA, 20 bp, Artificial Sequence
  chemically synthesized
aacatcacaattaaaagaac

SEQ ID NO: 4098 - DNA, 20 bp, Artificial Sequence
  chemically synthesized
catcacaattaaaagaacta

SEQ ID NO: 4099 - DNA, 20 bp, Artificial Sequence
  chemically synthesized
cacaattaaaagaactagag

SEQ ID NO: 4100 - DNA, 20 bp, Artificial Sequence
  chemically synthesized
attaaaagaactagagaagc

SEQ ID NO: 4101 - DNA, 20 bp, Artificial Sequence
  chemically synthesized
taaaagaactagagaagcaa

SEQ ID NO: 4102 - DNA, 20 bp, Artificial Sequence
  chemically synthesized
gcaagagcaaacactttcaa

SEQ ID NO: 4103 - DNA, 20 bp, Artificial Sequence
  chemically synthesized
gagcaaacactttcaaaagc

SEQ ID NO: 4104 - DNA, 20 bp, Artificial Sequence
  chemically synthesized
caaacactttcaaaagctag

SEQ ID NO: 4105 - DNA, 20 bp, Artificial Sequence
  chemically synthesized
acactttcaaaagctagcgg

SEQ ID NO: 4106 - DNA, 20 bp, Artificial Sequence
  chemically synthesized
cactttcaaaagctagcgga

SEQ ID NO: 4107 - DNA, 20 bp, Artificial Sequence
  chemically synthesized
ttcaaaagctagcggaaggc

SEQ ID NO: 4108 - DNA, 20 bp, Artificial Sequence
  chemically synthesized
gctagcggaaggcaagaaat

SEQ ID NO: 4109 - DNA, 20 bp, Artificial Sequence
  chemically synthesized
gcggaaggcaagaaataagt

SEQ ID NO: 4110 - DNA, 20 bp, Artificial Sequence
  chemically synthesized
aggcaagaaataagtaagat

SEQ ID NO: 4111 - DNA, 20 bp, Artificial Sequence
  chemically synthesized
gcaagaaataagtaagatca

SEQ ID NO: 4112 - DNA, 20 bp, Artificial Sequence
  chemically synthesized
agaaataagtaagatcagag

SEQ ID NO: 4113 - DNA, 20 bp, Artificial Sequence
  chemically synthesized
aataagtaagatcagagcag

SEQ ID NO: 4114 - DNA, 20 bp, Artificial Sequence
  chemically synthesized
gtaagatcagagcagaagtg

SEQ ID NO: 4115 - DNA, 20 bp, Artificial Sequence
  chemically synthesized
taagatcagagcagaagtga

SEQ ID NO: 4116 - DNA, 20 bp, Artificial Sequence
  chemically synthesized
agatcagagcagaagtgaag

SEQ ID NO: 4117 - DNA, 20 bp, Artificial Sequence
  chemically synthesized
gagcagaagtgaaggagatt

SEQ ID NO: 4118 - DNA, 20 bp, Artificial Sequence
  chemically synthesized
cttaaaaaaatcaatgaatc

SEQ ID NO: 4119 - DNA, 20 bp, Artificial Sequence
  chemically synthesized
ttaaaaaaatcaatgaatcc

SEQ ID NO: 4120 - DNA, 20 bp, Artificial Sequence
  chemically synthesized
aaaaaaatcaatgaatccag

SEQ ID NO: 4121 - DNA, 20 bp, Artificial Sequence
  chemically synthesized
aaatcaatgaatccaggagc

SEQ ID NO: 4122 - DNA, 20 bp, Artificial Sequence
  chemically synthesized
ccaggagctggttttttgaa

SEQ ID NO: 4123 - DNA, 20 bp, Artificial Sequence
  chemically synthesized
gaaaagatcaacaaaattga

SEQ ID NO: 4124 - DNA, 20 bp, Artificial Sequence
  chemically synthesized
caacaaaattgatagactgc

SEQ ID NO: 4125 - DNA, 20 bp, Artificial Sequence
  chemically synthesized
aaaattgatagactgctagc

SEQ ID NO: 4126 - DNA, 20 bp, Artificial Sequence
  chemically synthesized
gactgctagcaagactaata

SEQ ID NO: 4127 - DNA, 20 bp, Artificial Sequence
  chemically synthesized
tgctagcaagactaataaag

SEQ ID NO: 4128 - DNA, 20 bp, Artificial Sequence
  chemically synthesized
gcaagactaataaagaagaa

SEQ ID NO: 4129 - DNA, 20 bp, Artificial Sequence
  chemically synthesized
aagactaataaagaagaaaa

SEQ ID NO: 4130 - DNA, 20 bp, Artificial Sequence
  chemically synthesized
gactaataaagaagaaaaga

SEQ ID NO: 4131 - DNA, 20 bp, Artificial Sequence
  chemically synthesized
taataaagaagaaaagagag

SEQ ID NO: 4132 - DNA, 20 bp, Artificial Sequence
  chemically synthesized
gaaaagagagaagactcaaa

SEQ ID NO: 4133 - DNA, 20 bp, Artificial Sequence
  chemically synthesized
aagactcaaatagatgcaat

SEQ ID NO: 4134 - DNA, 20 bp, Artificial Sequence
  chemically synthesized
agatgcaataagaaatgata

SEQ ID NO: 4135 - DNA, 20 bp, Artificial Sequence
  chemically synthesized
gatgcaataagaaatgataa

SEQ ID NO: 4136 - DNA, 20 bp, Artificial Sequence
  chemically synthesized
atgcaataagaaatgataaa

SEQ ID NO: 4137 - DNA, 20 bp, Artificial Sequence
  chemically synthesized
tgcaataagaaatgataaag

SEQ ID NO: 4138 - DNA, 20 bp, Artificial Sequence
  chemically synthesized
ggatatcaccaccaatccca

SEQ ID NO: 4139 - DNA, 20 bp, Artificial Sequence
  chemically synthesized
acagacatacaaactaccat

SEQ ID NO: 4140 - DNA, 20 bp, Artificial Sequence
  chemically synthesized
agacatacaaactaccatca

SEQ ID NO: 4141 - DNA, 20 bp, Artificial Sequence
  chemically synthesized
acacctctacgcaaataaac

SEQ ID NO: 4142 - DNA, 20 bp, Artificial Sequence
  chemically synthesized
cgcaaataaactagaaaatc

SEQ ID NO: 4143 - DNA, 20 bp, Artificial Sequence
  chemically synthesized
aaataaactagaaaatctag

SEQ ID NO: 4144 - DNA, 20 bp, Artificial Sequence
  chemically synthesized
actagaaaatctagtagaaa

SEQ ID NO: 4145 - DNA, 20 bp, Artificial Sequence
  chemically synthesized
ctcgacacatacaccctccc

SEQ ID NO: 4146 - DNA, 20 bp, Artificial Sequence
  chemically synthesized
acaccctcccaagactaaac

SEQ ID NO: 4147 - DNA, 20 bp, Artificial Sequence
  chemically synthesized
caccctcccaagactaaacc

SEQ ID NO: 4148 - DNA, 20 bp, Artificial Sequence
  chemically synthesized
accctcccaagactaaacca

SEQ ID NO: 4149 - DNA, 20 bp, Artificial Sequence
  chemically synthesized
cctcccaagactaaaccagg

SEQ ID NO: 4150 - DNA, 20 bp, Artificial Sequence
  chemically synthesized
ggagaaattgaatctcttaa

SEQ ID NO: 4151 - DNA, 20 bp, Artificial Sequence
  chemically synthesized
atctcttaatagacaaataa

SEQ ID NO: 4152 - DNA, 20 bp, Artificial Sequence
  chemically synthesized
tctcttaatagacaaataat

SEQ ID NO: 4153 - DNA, 20 bp, Artificial Sequence
  chemically synthesized
aaataataggctctgaaatt

SEQ ID NO: 4154 - DNA, 20 bp, Artificial Sequence
  chemically synthesized
gaaattgagacaataattaa

SEQ ID NO: 4155 - DNA, 20 bp, Artificial Sequence
  chemically synthesized
agtttacacattgtatatct

SEQ ID NO: 4156 - DNA, 20 bp, Artificial Sequence
  chemically synthesized
tgtatatctaagtaccacca

SEQ ID NO: 4157 - DNA, 20 bp, Artificial Sequence
  chemically synthesized
atatctaagtaccaccacag

SEQ ID NO: 4158 - DNA, 20 bp, Artificial Sequence
  chemically synthesized
ctaagtaccaccacagcagc

SEQ ID NO: 4159 - DNA, 20 bp, Artificial Sequence
  chemically synthesized
aatgttttcacattataaaa

SEQ ID NO: 4160 - DNA, 20 bp, Artificial Sequence
  chemically synthesized
atgttttcacattataaaac

SEQ ID NO: 4161 - DNA, 20 bp, Artificial Sequence
  chemically synthesized
gttttcacattataaaacag

SEQ ID NO: 4162 - DNA, 20 bp, Artificial Sequence
  chemically synthesized
tacttgttattactaattac

SEQ ID NO: 4163 - DNA, 20 bp, Artificial Sequence
  chemically synthesized
attactagttctaaaaaatg

SEQ ID NO: 4164 - DNA, 20 bp, Artificial Sequence
  chemically synthesized
ctagttctaaaaaatgtgga

SEQ ID NO: 4165 - DNA, 20 bp, Artificial Sequence
  chemically synthesized
gttctaaaaaatgtggatag

SEQ ID NO: 4166 - DNA, 20 bp, Artificial Sequence
  chemically synthesized
taaaaaatgtggatagaagc

SEQ ID NO: 4167 - DNA, 20 bp, Artificial Sequence
  chemically synthesized
atagaagcaagtttaatatt

SEQ ID NO: 4168 - DNA, 20 bp, Artificial Sequence
  chemically synthesized
gaagcaagtttaatattgag

SEQ ID NO: 4169 - DNA, 20 bp, Artificial Sequence
  chemically synthesized
tttaatattgagtggaaaat

SEQ ID NO: 4170 - DNA, 20 bp, Artificial Sequence
  chemically synthesized
tattgagtggaaaataagat

SEQ ID NO: 4171 - DNA, 20 bp, Artificial Sequence
  chemically synthesized
attgagtggaaaataagatt

SEQ ID NO: 4172 - DNA, 20 bp, Artificial Sequence
  chemically synthesized
tgagtggaaaataagattag

SEQ ID NO: 4173 - DNA, 20 bp, Artificial Sequence
  chemically synthesized
aagattaggagatgcaacac

SEQ ID NO: 4174 - DNA, 20 bp, Artificial Sequence
  chemically synthesized
agattaggagatgcaacacc

SEQ ID NO: 4175 - DNA, 20 bp, Artificial Sequence
  chemically synthesized
gattaggagatgcaacacca

SEQ ID NO: 4176 - DNA, 20 bp, Artificial Sequence
  chemically synthesized
taggagatgcaacaccaggg

SEQ ID NO: 4177 - DNA, 20 bp, Artificial Sequence
  chemically synthesized
aggagatgcaacaccagggt

SEQ ID NO: 4178 - DNA, 20 bp, Artificial Sequence
  chemically synthesized
accagggtaggtgacatata

SEQ ID NO: 4179 - DNA, 20 bp, Artificial Sequence
  chemically synthesized
cagggtaggtgacatataca

SEQ ID NO: 4180 - DNA, 20 bp, Artificial Sequence
  chemically synthesized
gtaggtgacatatacagaga

SEQ ID NO: 4181 - DNA, 20 bp, Artificial Sequence
  chemically synthesized
tgacatatacagagatagat

SEQ ID NO: 4182 - DNA, 20 bp, Artificial Sequence
  chemically synthesized
atatacagagatagattaga

SEQ ID NO: 4183 - DNA, 20 bp, Artificial Sequence
  chemically synthesized
tatacagagatagattagat

SEQ ID NO: 4184 - DNA, 20 bp, Artificial Sequence
  chemically synthesized
acagagatagattagatagg

SEQ ID NO: 4185 - DNA, 20 bp, Artificial Sequence
  chemically synthesized
agatagattagataggtaga

SEQ ID NO: 4186 - DNA, 20 bp, Artificial Sequence
  chemically synthesized
agattagataggtagatagc

SEQ ID NO: 4187 - DNA, 20 bp, Artificial Sequence
  chemically synthesized
tagataggtagatagctagc

SEQ ID NO: 4188 - DNA, 20 bp, Artificial Sequence
  chemically synthesized
taggtagatagctagctagc

SEQ ID NO: 4189 - DNA, 20 bp, Artificial Sequence
  chemically synthesized
tagatagctagctagctagc

SEQ ID NO: 4190 - DNA, 20 bp, Artificial Sequence
  chemically synthesized
tagctagctagctagctagc

SEQ ID NO: 4191 - DNA, 20 bp, Artificial Sequence
  chemically synthesized
tagctagctagctagctagc

SEQ ID NO: 4192 - DNA, 20 bp, Artificial Sequence
  chemically synthesized
tagctagctagctagctagc

SEQ ID NO: 4193 - DNA, 20 bp, Artificial Sequence
  chemically synthesized
tagctagctagctagctaga

SEQ ID NO: 4194 - DNA, 20 bp, Artificial Sequence
  chemically synthesized
tagctagctagctagaaaga

SEQ ID NO: 4195 - DNA, 20 bp, Artificial Sequence
  chemically synthesized
tagctagctagaaagataga

SEQ ID NO: 4196 - DNA, 20 bp, Artificial Sequence
  chemically synthesized
tagctagaaagatagataga

SEQ ID NO: 4197 - DNA, 20 bp, Artificial Sequence
  chemically synthesized
tagaaagatagatagataga

SEQ ID NO: 4198 - DNA, 20 bp, Artificial Sequence
  chemically synthesized
aagatagatagatagataga

SEQ ID NO: 4199 - DNA, 20 bp, Artificial Sequence
  chemically synthesized
tagatagatagatagataga

SEQ ID NO: 4200 - DNA, 20 bp, Artificial Sequence
  chemically synthesized
tagatagatagatagataga

SEQ ID NO: 4201 - DNA, 20 bp, Artificial Sequence
  chemically synthesized
tagatagatagatagataga

SEQ ID NO: 4202 - DNA, 20 bp, Artificial Sequence
  chemically synthesized
tagatagatagatagataga

SEQ ID NO: 4203 - DNA, 20 bp, Artificial Sequence
  chemically synthesized
tagatagatagatagataga

SEQ ID NO: 4204 - DNA, 20 bp, Artificial Sequence
  chemically synthesized
tagatagatagatagataga

SEQ ID NO: 4205 - DNA, 20 bp, Artificial Sequence
  chemically synthesized
tagatagatagatagataga

SEQ ID NO: 4206 - DNA, 20 bp, Artificial Sequence
  chemically synthesized
tagatagatagatagatgca

SEQ ID NO: 4207 - DNA, 20 bp, Artificial Sequence
  chemically synthesized
agatagatagatagatgcat

SEQ ID NO: 4208 - DNA, 20 bp, Artificial Sequence
  chemically synthesized
tagatgcatgggtataaaca

SEQ ID NO: 4209 - DNA, 20 bp, Artificial Sequence
  chemically synthesized
agataataatatgtgaatga

SEQ ID NO: 4210 - DNA, 20 bp, Artificial Sequence
  chemically synthesized
gataataatatgtgaatgac

SEQ ID NO: 4211 - DNA, 20 bp, Artificial Sequence
  chemically synthesized
aataatatgtgaatgacagg

SEQ ID NO: 4212 - DNA, 20 bp, Artificial Sequence
  chemically synthesized
aggtggcttctatactctct

SEQ ID NO: 4213 - DNA, 20 bp, Artificial Sequence
  chemically synthesized
ctctctaagttccctttctc

SEQ ID NO: 4214 - DNA, 20 bp, Artificial Sequence
  chemically synthesized
aagttccctttctcaagtaa

SEQ ID NO: 4215 - DNA, 20 bp, Artificial Sequence
  chemically synthesized
tccctttctcaagtaaaagc

SEQ ID NO: 4216 - DNA, 20 bp, Artificial Sequence
  chemically synthesized
tctcaagtaaaagctggcta

SEQ ID NO: 4217 - DNA, 20 bp, Artificial Sequence
  chemically synthesized
ggctaaagttcttgtttttt

SEQ ID NO: 4218 - DNA, 20 bp, Artificial Sequence
  chemically synthesized
gctaaagttcttgttttttg

SEQ ID NO: 4219 - DNA, 20 bp, Artificial Sequence
  chemically synthesized
aaagttcttgttttttgagg

SEQ ID NO: 4220 - DNA, 20 bp, Artificial Sequence
  chemically synthesized
tcttgttttttgaggtggca

SEQ ID NO: 4221 - DNA, 20 bp, Artificial Sequence
  chemically synthesized
cttgttttttgaggtggcac

SEQ ID NO: 4222 - DNA, 20 bp, Artificial Sequence
  chemically synthesized
ttgttttttgaggtggcaca

SEQ ID NO: 4223 - DNA, 20 bp, Artificial Sequence
  chemically synthesized
tgttttttgaggtggcacag

SEQ ID NO: 4224 - DNA, 20 bp, Artificial Sequence
  chemically synthesized
ttgaggtggcacaggggctt

SEQ ID NO: 4225 - DNA, 20 bp, Artificial Sequence
  chemically synthesized
cccatctcttgattccatta

SEQ ID NO: 4226 - DNA, 20 bp, Artificial Sequence
  chemically synthesized
tcaatatactgatcattgta

SEQ ID NO: 4227 - DNA, 20 bp, Artificial Sequence
  chemically synthesized
atactgatcattgtatagca

SEQ ID NO: 4228 - DNA, 20 bp, Artificial Sequence
  chemically synthesized
cctttacttttgtttttgct

SEQ ID NO: 4229 - DNA, 20 bp, Artificial Sequence
  chemically synthesized
ttgctaagtgctaaatattc

SEQ ID NO: 4230 - DNA, 20 bp, Artificial Sequence
  chemically synthesized
tggtctcaaattttatatga

SEQ ID NO: 4231 - DNA, 20 bp, Artificial Sequence
  chemically synthesized
ttttatatgatggaaatgtt

SEQ ID NO: 4232 - DNA, 20 bp, Artificial Sequence
  chemically synthesized
tttatatgatggaaatgttt

SEQ ID NO: 4233 - DNA, 20 bp, Artificial Sequence
  chemically synthesized
atgtttgggtcccatttttt

SEQ ID NO: 4234 - DNA, 20 bp, Artificial Sequence
  chemically synthesized
gggtcccattttttgagtta

SEQ ID NO: 4235 - DNA, 20 bp, Artificial Sequence
  chemically synthesized
ccattttttgagttacagtt

SEQ ID NO: 4236 - DNA, 20 bp, Artificial Sequence
  chemically synthesized
tagaatttaaaatacccaca

SEQ ID NO: 4237 - DNA, 20 bp, Artificial Sequence
  chemically synthesized
tttaaaatacccacacagct

SEQ ID NO: 4238 - DNA, 20 bp, Artificial Sequence
  chemically synthesized
gagcaatttacccttgcttt

SEQ ID NO: 4239 - DNA, 20 bp, Artificial Sequence
  chemically synthesized
aatttacccttgctttaagt

SEQ ID NO: 4240 - DNA, 20 bp, Artificial Sequence
  chemically synthesized
cccttgctttaagttggaat

SEQ ID NO: 4241 - DNA, 20 bp, Artificial Sequence
  chemically synthesized
ccttgctttaagttggaatg

SEQ ID NO: 4242 - DNA, 20 bp, Artificial Sequence
  chemically synthesized
tgaggttctttaaaaatatt

SEQ ID NO: 4243 - DNA, 20 bp, Artificial Sequence
  chemically synthesized
aaatattaagataaaatttg

SEQ ID NO: 4244 - DNA, 20 bp, Artificial Sequence
  chemically synthesized
tttgaagttatttaactctg

SEQ ID NO: 4245 - DNA, 20 bp, Artificial Sequence
  chemically synthesized
taatatatatctcacattgt

SEQ ID NO: 4246 - DNA, 20 bp, Artificial Sequence
  chemically synthesized
tcacattgttagaatatttt

SEQ ID NO: 4247 - DNA, 20 bp, Artificial Sequence
  chemically synthesized
taagtaaactgttgatgttt

SEQ ID NO: 4248 - DNA, 20 bp, Artificial Sequence
  chemically synthesized
agtaaactgttgatgtttca

SEQ ID NO: 4249 - DNA, 20 bp, Artificial Sequence
  chemically synthesized
aactgttgatgtttcagaga

SEQ ID NO: 4250 - DNA, 20 bp, Artificial Sequence
  chemically synthesized
actgttgatgtttcagagaa

SEQ ID NO: 4251 - DNA, 20 bp, Artificial Sequence
  chemically synthesized
ttgatgtttcagagaaagga

SEQ ID NO: 4252 - DNA, 20 bp, Artificial Sequence
  chemically synthesized
gaaaggaaagaataattttg

SEQ ID NO: 4253 - DNA, 20 bp, Artificial Sequence
  chemically synthesized
attttgaagcattcctgaca

SEQ ID NO: 4254 - DNA, 20 bp, Artificial Sequence
  chemically synthesized
aagcattcctgacacagttc

SEQ ID NO: 4255 - DNA, 20 bp, Artificial Sequence
  chemically synthesized
agcattcctgacacagttct

SEQ ID NO: 4256 - DNA, 20 bp, Artificial Sequence
  chemically synthesized
ttcctgacacagttctaggc

SEQ ID NO: 4257 - DNA, 20 bp, Artificial Sequence
  chemically synthesized
cctgacacagttctaggcca

SEQ ID NO: 4258 - DNA, 20 bp, Artificial Sequence
  chemically synthesized
taggccagagccatgcatgt

SEQ ID NO: 4259 - DNA, 20 bp, Artificial Sequence
  chemically synthesized
cagagccatgcatgtgagtg

SEQ ID NO: 4260 - DNA, 20 bp, Artificial Sequence
  chemically synthesized
ccatgcatgtgagtgaagcg

SEQ ID NO: 4261 - DNA, 20 bp, Artificial Sequence
  chemically synthesized
atgtgagtgaagcgtagtta

SEQ ID NO: 4262 - DNA, 20 bp, Artificial Sequence
  chemically synthesized
tgagtgaagcgtagttatag

SEQ ID NO: 4263 - DNA, 20 bp, Artificial Sequence
  chemically synthesized
tgaagcgtagttatagaagt

SEQ ID NO: 4264 - DNA, 20 bp, Artificial Sequence
  chemically synthesized
gaagcgtagttatagaagtg

SEQ ID NO: 4265 - DNA, 20 bp, Artificial Sequence
  chemically synthesized
aagcgtagttatagaagtga

SEQ ID NO: 4266 - DNA, 20 bp, Artificial Sequence
  chemically synthesized
agttatagaagtgagggtta

SEQ ID NO: 4267 - DNA, 20 bp, Artificial Sequence
  chemically synthesized
gaagtgagggttacagtgac

SEQ ID NO: 4268 - DNA, 20 bp, Artificial Sequence
  chemically synthesized
aagtgagggttacagtgact

SEQ ID NO: 4269 - DNA, 20 bp, Artificial Sequence
  chemically synthesized
agtgagggttacagtgactg

SEQ ID NO: 4270 - DNA, 20 bp, Artificial Sequence
  chemically synthesized
tacagtgactggggcttcat

SEQ ID NO: 4271 - DNA, 20 bp, Artificial Sequence
  chemically synthesized
acagtgactggggcttcatc

SEQ ID NO: 4272 - DNA, 20 bp, Artificial Sequence
  chemically synthesized
ctggggcttcatcaggacat

SEQ ID NO: 4273 - DNA, 20 bp, Artificial Sequence
  chemically synthesized
tggggcttcatcaggacatt

SEQ ID NO: 4274 - DNA, 20 bp, Artificial Sequence
  chemically synthesized
ggggcttcatcaggacatta

SEQ ID NO: 4275 - DNA, 20 bp, Artificial Sequence
  chemically synthesized
cttcatcaggacattaggga

SEQ ID NO: 4276 - DNA, 20 bp, Artificial Sequence
  chemically synthesized
ttcatcaggacattagggat

SEQ ID NO: 4277 - DNA, 20 bp, Artificial Sequence
  chemically synthesized
catcaggacattagggatgg

SEQ ID NO: 4278 - DNA, 20 bp, Artificial Sequence
  chemically synthesized
tcaggacattagggatggga

SEQ ID NO: 4279 - DNA, 20 bp, Artificial Sequence
  chemically synthesized
ggacattagggatgggagag

SEQ ID NO: 4280 - DNA, 20 bp, Artificial Sequence
  chemically synthesized
gggatgggagagaagaatct

SEQ ID NO: 4281 - DNA, 20 bp, Artificial Sequence
  chemically synthesized
atctaagtgaaaaaaaaata

SEQ ID NO: 4282 - DNA, 20 bp, Artificial Sequence
  chemically synthesized
tctaagtgaaaaaaaaatac

SEQ ID NO: 4283 - DNA, 20 bp, Artificial Sequence
  chemically synthesized
gaaaaaaaaatacaggaatg

SEQ ID NO: 4284 - DNA, 20 bp, Artificial Sequence
  chemically synthesized
aaaaatacaggaatgaagat

SEQ ID NO: 4285 - DNA, 20 bp, Artificial Sequence
  chemically synthesized
aaaatacaggaatgaagata

SEQ ID NO: 4286 - DNA, 20 bp, Artificial Sequence
  chemically synthesized
aaatacaggaatgaagataa

SEQ ID NO: 4287 - DNA, 20 bp, Artificial Sequence
  chemically synthesized
aatacaggaatgaagataag

SEQ ID NO: 4288 - DNA, 20 bp, Artificial Sequence
  chemically synthesized
atacaggaatgaagataagg

SEQ ID NO: 4289 - DNA, 20 bp, Artificial Sequence
  chemically synthesized
aggaatgaagataaggggga

SEQ ID NO: 4290 - DNA, 20 bp, Artificial Sequence
  chemically synthesized
aagataagggggaaagaaaa

SEQ ID NO: 4291 - DNA, 20 bp, Artificial Sequence
  chemically synthesized
gggaaagaaaacagattttc

SEQ ID NO: 4292 - DNA, 20 bp, Artificial Sequence
  chemically synthesized
tctggcctttaaattttttc

SEQ ID NO: 4293 - DNA, 20 bp, Artificial Sequence
  chemically synthesized
gtgatcttttgtgataccta

SEQ ID NO: 4294 - DNA, 20 bp, Artificial Sequence
  chemically synthesized
atatgtgatgacccaaatta

SEQ ID NO: 4295 - DNA, 20 bp, Artificial Sequence
  chemically synthesized
tatgtgatgacccaaattat

SEQ ID NO: 4296 - DNA, 20 bp, Artificial Sequence
  chemically synthesized
gatgacccaaattataggcc

SEQ ID NO: 4297 - DNA, 20 bp, Artificial Sequence
  chemically synthesized
atgacccaaattataggcct

SEQ ID NO: 4298 - DNA, 20 bp, Artificial Sequence
  chemically synthesized
ttataggcctgggttccttg

SEQ ID NO: 4299 - DNA, 20 bp, Artificial Sequence
  chemically synthesized
ggttccttgtagcattattc

SEQ ID NO: 4300 - DNA, 20 bp, Artificial Sequence
  chemically synthesized
gttccttgtagcattattct

SEQ ID NO: 4301 - DNA, 20 bp, Artificial Sequence
  chemically synthesized
ttattctaggatatttctga

SEQ ID NO: 4302 - DNA, 20 bp, Artificial Sequence
  chemically synthesized
ctgaatcatgaatgtatcca

SEQ ID NO: 4303 - DNA, 20 bp, Artificial Sequence
  chemically synthesized
gaatcatgaatgtatccacg

SEQ ID NO: 4304 - DNA, 20 bp, Artificial Sequence
  chemically synthesized
atgaatgtatccacggagca

SEQ ID NO: 4305 - DNA, 20 bp, Artificial Sequence
  chemically synthesized
atgtatccacggagcaaaga

SEQ ID NO: 4306 - DNA, 20 bp, Artificial Sequence
  chemically synthesized
tccacggagcaaagatagtg

SEQ ID NO: 4307 - DNA, 20 bp, Artificial Sequence
  chemically synthesized
gcaaagatagtgtggtgtaa

SEQ ID NO: 4308 - DNA, 20 bp, Artificial Sequence
  chemically synthesized
atagtgtggtgtaatagaaa

SEQ ID NO: 4309 - DNA, 20 bp, Artificial Sequence
  chemically synthesized
gtggtgtaatagaaacagta

SEQ ID NO: 4310 - DNA, 20 bp, Artificial Sequence
  chemically synthesized
aatagaaacagtatagctct

SEQ ID NO: 4311 - DNA, 20 bp, Artificial Sequence
  chemically synthesized
atagaaacagtatagctcta

SEQ ID NO: 4312 - DNA, 20 bp, Artificial Sequence
  chemically synthesized
tatagctctaaggacatata

SEQ ID NO: 4313 - DNA, 20 bp, Artificial Sequence
  chemically synthesized
atatagttgtatttaaatac

SEQ ID NO: 4314 - DNA, 20 bp, Artificial Sequence
  chemically synthesized
ttattctgactctatgaccc

SEQ ID NO: 4315 - DNA, 20 bp, Artificial Sequence
  chemically synthesized
acgtcatttaatttaaactt

SEQ ID NO: 4316 - DNA, 20 bp, Artificial Sequence
  chemically synthesized
cttgtaaaatacctaacaat

SEQ ID NO: 4317 - DNA, 20 bp, Artificial Sequence
  chemically synthesized
taagcataaatttaaaatgt

SEQ ID NO: 4318 - DNA, 20 bp, Artificial Sequence
  chemically synthesized
taaaatgtgagtcttttctg

SEQ ID NO: 4319 - DNA, 20 bp, Artificial Sequence
  chemically synthesized
atgtgagtcttttctgaagt

SEQ ID NO: 4320 - DNA, 20 bp, Artificial Sequence
  chemically synthesized
cttttctgaagtcagtgtct

SEQ ID NO: 4321 - DNA, 20 bp, Artificial Sequence
  chemically synthesized
ttttctgaagtcagtgtctt

SEQ ID NO: 4322 - DNA, 20 bp, Artificial Sequence
  chemically synthesized
tctgaagtcagtgtcttagg

SEQ ID NO: 4323 - DNA, 20 bp, Artificial Sequence
  chemically synthesized
ctgaagtcagtgtcttagga

SEQ ID NO: 4324 - DNA, 20 bp, Artificial Sequence
  chemically synthesized
aagtcagtgtcttaggaagg

SEQ ID NO: 4325 - DNA, 20 bp, Artificial Sequence
  chemically synthesized
tcttaggaaggtagctacat

SEQ ID NO: 4326 - DNA, 20 bp, Artificial Sequence
  chemically synthesized
ttatatctctatcccaacaa

SEQ ID NO: 4327 - DNA, 20 bp, Artificial Sequence
  chemically synthesized
atcccaacaatagatgacat

SEQ ID NO: 4328 - DNA, 20 bp, Artificial Sequence
  chemically synthesized
tcccaacaatagatgacatc

SEQ ID NO: 4329 - DNA, 20 bp, Artificial Sequence
  chemically synthesized
tcaggacactaacaaaattg

SEQ ID NO: 4330 - DNA, 20 bp, Artificial Sequence
  chemically synthesized
ctaacaaaattgtagcaatt

SEQ ID NO: 4331 - DNA, 20 bp, Artificial Sequence
  chemically synthesized
agaccaaaattattgtcaac

SEQ ID NO: 4332 - DNA, 20 bp, Artificial Sequence
  chemically synthesized
aaattattgtcaactggaat

SEQ ID NO: 4333 - DNA, 20 bp, Artificial Sequence
  chemically synthesized
actggaataagtttaacttt

SEQ ID NO: 4334 - DNA, 20 bp, Artificial Sequence
  chemically synthesized
ctggaataagtttaactttc

SEQ ID NO: 4335 - DNA, 20 bp, Artificial Sequence
  chemically synthesized
aagtttaactttcaggactt

SEQ ID NO: 4336 - DNA, 20 bp, Artificial Sequence
  chemically synthesized
agtttaactttcaggacttc

SEQ ID NO: 4337 - DNA, 20 bp, Artificial Sequence
  chemically synthesized
ggcttattatccatcaaact

SEQ ID NO: 4338 - DNA, 20 bp, Artificial Sequence
  chemically synthesized
aaactgagattgaattgatt

SEQ ID NO: 4339 - DNA, 20 bp, Artificial Sequence
  chemically synthesized
actgagattgaattgattta

SEQ ID NO: 4340 - DNA, 20 bp, Artificial Sequence
  chemically synthesized
tttagagtatccataaatac

SEQ ID NO: 4341 - DNA, 20 bp, Artificial Sequence
  chemically synthesized
ttagagtatccataaatact

SEQ ID NO: 4342 - DNA, 20 bp, Artificial Sequence
  chemically synthesized
ttttaataaatttcttatac

SEQ ID NO: 4343 - DNA, 20 bp, Artificial Sequence
  chemically synthesized
tttaataaatttcttatact

SEQ ID NO: 4344 - DNA, 20 bp, Artificial Sequence
  chemically synthesized
aatttcttatactgggcaca

SEQ ID NO: 4345 - DNA, 20 bp, Artificial Sequence
  chemically synthesized
actgggcacatggtatcaat

SEQ ID NO: 4346 - DNA, 20 bp, Artificial Sequence
  chemically synthesized
tatctgtcatttacttttat

SEQ ID NO: 4347 - DNA, 20 bp, Artificial Sequence
  chemically synthesized
atctgtcatttacttttata

SEQ ID NO: 4348 - DNA, 20 bp, Artificial Sequence
  chemically synthesized
ttacttttataaggtgcaaa

SEQ ID NO: 4349 - DNA, 20 bp, Artificial Sequence
  chemically synthesized
tttataaggtgcaaatagtt

SEQ ID NO: 4350 - DNA, 20 bp, Artificial Sequence
  chemically synthesized
aaggtgcaaatagttcagca

SEQ ID NO: 4351 - DNA, 20 bp, Artificial Sequence
  chemically synthesized
caaatagttcagcatggtga

SEQ ID NO: 4352 - DNA, 20 bp, Artificial Sequence
  chemically synthesized
cagacacatgaattttgaaa

SEQ ID NO: 4353 - DNA, 20 bp, Artificial Sequence
  chemically synthesized
gacacatgaattttgaaatg

SEQ ID NO: 4354 - DNA, 20 bp, Artificial Sequence
  chemically synthesized
ttttatttttgccccatcac

SEQ ID NO: 4355 - DNA, 20 bp, Artificial Sequence
  chemically synthesized
agtataatatctttgttaca

SEQ ID NO: 4356 - DNA, 20 bp, Artificial Sequence
  chemically synthesized
gtataatatctttgttacat

SEQ ID NO: 4357 - DNA, 20 bp, Artificial Sequence
  chemically synthesized
tataatatctttgttacata

SEQ ID NO: 4358 - DNA, 20 bp, Artificial Sequence
  chemically synthesized
aatatctttgttacataggg

SEQ ID NO: 4359 - DNA, 20 bp, Artificial Sequence
  chemically synthesized
tatctttgttacatagggaa

SEQ ID NO: 4360 - DNA, 20 bp, Artificial Sequence
  chemically synthesized
tctttgttacatagggaaga

SEQ ID NO: 4361 - DNA, 20 bp, Artificial Sequence
  chemically synthesized
gggaagagagttaaaaattt

SEQ ID NO: 4362 - DNA, 20 bp, Artificial Sequence
  chemically synthesized
gaagagagttaaaaattttg

SEQ ID NO: 4363 - DNA, 20 bp, Artificial Sequence
  chemically synthesized
agttaaaaattttggagtgc

SEQ ID NO: 4364 - DNA, 20 bp, Artificial Sequence
  chemically synthesized
ccagcttcttaatctgtgcc

SEQ ID NO: 4365 - DNA, 20 bp, Artificial Sequence
  chemically synthesized
tgcctagactattacctgat

SEQ ID NO: 4366 - DNA, 20 bp, Artificial Sequence
  chemically synthesized
gactattacctgatgagtaa

SEQ ID NO: 4367 - DNA, 20 bp, Artificial Sequence
  chemically synthesized
gagtaatagtcaataaacta

SEQ ID NO: 4368 - DNA, 20 bp, Artificial Sequence
  chemically synthesized
tactaaaattttttattact

SEQ ID NO: 4369 - DNA, 20 bp, Artificial Sequence
  chemically synthesized
ctgagccttgttttaactac

SEQ ID NO: 4370 - DNA, 20 bp, Artificial Sequence
  chemically synthesized
acattcaaatctgcatatca

SEQ ID NO: 4371 - DNA, 20 bp, Artificial Sequence
  chemically synthesized
atctgcatatcaaagaaaat

SEQ ID NO: 4372 - DNA, 20 bp, Artificial Sequence
  chemically synthesized
gcattatttaaacatattct

SEQ ID NO: 4373 - DNA, 20 bp, Artificial Sequence
  chemically synthesized
attatttaaacatattctaa

SEQ ID NO: 4374 - DNA, 20 bp, Artificial Sequence
  chemically synthesized
gaaaatgacttacttaatac

SEQ ID NO: 4375 - DNA, 20 bp, Artificial Sequence
  chemically synthesized
ctacaattgcaaatcaactc

SEQ ID NO: 4376 - DNA, 20 bp, Artificial Sequence
  chemically synthesized
ttgcaaatcaactccagcta

SEQ ID NO: 4377 - DNA, 20 bp, Artificial Sequence
  chemically synthesized
aatcaactccagctaaagcc

SEQ ID NO: 4378 - DNA, 20 bp, Artificial Sequence
  chemically synthesized
actccagctaaagccaagtc

SEQ ID NO: 4379 - DNA, 20 bp, Artificial Sequence
  chemically synthesized
aagccaagtctagtattcca

SEQ ID NO: 4380 - DNA, 20 bp, Artificial Sequence
  chemically synthesized
agccaagtctagtattccat

SEQ ID NO: 4381 - DNA, 20 bp, Artificial Sequence
  chemically synthesized
tattccatgggtcaaaaatc

SEQ ID NO: 4382 - DNA, 20 bp, Artificial Sequence
  chemically synthesized
attccatgggtcaaaaatca

SEQ ID NO: 4383 - DNA, 20 bp, Artificial Sequence
  chemically synthesized
tcaaaaatcaaggaaaatgt

SEQ ID NO: 4384 - DNA, 20 bp, Artificial Sequence
  chemically synthesized
aaggaaaatgttagatgatt

SEQ ID NO: 4385 - DNA, 20 bp, Artificial Sequence
  chemically synthesized
atgttagatgattaagttat

SEQ ID NO: 4386 - DNA, 20 bp, Artificial Sequence
  chemically synthesized
ttagatgattaagttatcgg

SEQ ID NO: 4387 - DNA, 20 bp, Artificial Sequence
  chemically synthesized
gattaagttatcggaagaat

SEQ ID NO: 4388 - DNA, 20 bp, Artificial Sequence
  chemically synthesized
ggaagaatgagctgcttctg

SEQ ID NO: 4389 - DNA, 20 bp, Artificial Sequence
  chemically synthesized
tttcttgccttttttttttc

SEQ ID NO: 4390 - DNA, 20 bp, Artificial Sequence
  chemically synthesized
tttctggtgttattttctac

SEQ ID NO: 4391 - DNA, 20 bp, Artificial Sequence
  chemically synthesized
attttctacaagttttcatt

SEQ ID NO: 4392 - DNA, 20 bp, Artificial Sequence
  chemically synthesized
agttttcattgagcataact

SEQ ID NO: 4393 - DNA, 20 bp, Artificial Sequence
  chemically synthesized
gtttacttacttgcattttc

SEQ ID NO: 4394 - DNA, 20 bp, Artificial Sequence
  chemically synthesized
ttgcattttctagaatcctg

SEQ ID NO: 4395 - DNA, 20 bp, Artificial Sequence
  chemically synthesized
tctagaatcctgaagatatt

SEQ ID NO: 4396 - DNA, 20 bp, Artificial Sequence
  chemically synthesized
agaatcctgaagatatttag

SEQ ID NO: 4397 - DNA, 20 bp, Artificial Sequence
  chemically synthesized
gaatcctgaagatatttagc

SEQ ID NO: 4398 - DNA, 20 bp, Artificial Sequence
  chemically synthesized
ctgaagatatttagcaggtt

SEQ ID NO: 4399 - DNA, 20 bp, Artificial Sequence
  chemically synthesized
gaagatatttagcaggttga

SEQ ID NO: 4400 - DNA, 20 bp, Artificial Sequence
  chemically synthesized
aagatatttagcaggttgag

SEQ ID NO: 4401 - DNA, 20 bp, Artificial Sequence
  chemically synthesized
gatatttagcaggttgagag

SEQ ID NO: 4402 - DNA, 20 bp, Artificial Sequence
  chemically synthesized
gaggagacaaaataaatgca

SEQ ID NO: 4403 - DNA, 20 bp, Artificial Sequence
  chemically synthesized
ggagacaaaataaatgcaaa

SEQ ID NO: 4404 - DNA, 20 bp, Artificial Sequence
  chemically synthesized
caaaataaatgcaaagagat

SEQ ID NO: 4405 - DNA, 20 bp, Artificial Sequence
  chemically synthesized
aaaataaatgcaaagagatt

SEQ ID NO: 4406 - DNA, 20 bp, Artificial Sequence
  chemically synthesized
tgcaaagagattaggaaatc

SEQ ID NO: 4407 - DNA, 20 bp, Artificial Sequence
  chemically synthesized
aactatttatacttctttta

SEQ ID NO: 4408 - DNA, 20 bp, Artificial Sequence
  chemically synthesized
acttcttttaaagcatgtct

SEQ ID NO: 4409 - DNA, 20 bp, Artificial Sequence
  chemically synthesized
cttcttttaaagcatgtctt

SEQ ID NO: 4410 - DNA, 20 bp, Artificial Sequence
  chemically synthesized
ttaaagcatgtcttgggccc

SEQ ID NO: 4411 - DNA, 20 bp, Artificial Sequence
  chemically synthesized
taaagcatgtcttgggccca

SEQ ID NO: 4412 - DNA, 20 bp, Artificial Sequence
  chemically synthesized
tgtcttgggcccaaggtttt

SEQ ID NO: 4413 - DNA, 20 bp, Artificial Sequence
  chemically synthesized
gggcccaaggttttcagctt

SEQ ID NO: 4414 - DNA, 20 bp, Artificial Sequence
  chemically synthesized
gcccaaggttttcagcttaa

SEQ ID NO: 4415 - DNA, 20 bp, Artificial Sequence
  chemically synthesized
cccaaggttttcagcttaag

SEQ ID NO: 4416 - DNA, 20 bp, Artificial Sequence
  chemically synthesized
gacgaattttactcctccca

SEQ ID NO: 4417 - DNA, 20 bp, Artificial Sequence
  chemically synthesized
gaattttactcctcccatgg

SEQ ID NO: 4418 - DNA, 20 bp, Artificial Sequence
  chemically synthesized
aattttactcctcccatgga

SEQ ID NO: 4419 - DNA, 20 bp, Artificial Sequence
  chemically synthesized
ttttactcctcccatggaag

SEQ ID NO: 4420 - DNA, 20 bp, Artificial Sequence
  chemically synthesized
tcccatggaaggagatgaca

SEQ ID NO: 4421 - DNA, 20 bp, Artificial Sequence
  chemically synthesized
ccatggaaggagatgacaca

SEQ ID NO: 4422 - DNA, 20 bp, Artificial Sequence
  chemically synthesized
agatgacacagagctgcttc

SEQ ID NO: 4423 - DNA, 20 bp, Artificial Sequence
  chemically synthesized
acagagctgcttctggtaca

SEQ ID NO: 4424 - DNA, 20 bp, Artificial Sequence
  chemically synthesized
tgcttctggtacatagtcca

SEQ ID NO: 4425 - DNA, 20 bp, Artificial Sequence
  chemically synthesized
gcttctggtacatagtccac

SEQ ID NO: 4426 - DNA, 20 bp, Artificial Sequence
  chemically synthesized
cttctggtacatagtccaca

SEQ ID NO: 4427 - DNA, 20 bp, Artificial Sequence
  chemically synthesized
tctggtacatagtccacagg

SEQ ID NO: 4428 - DNA, 20 bp, Artificial Sequence
  chemically synthesized
atttgtgcattttttttctt

SEQ ID NO: 4429 - DNA, 20 bp, Artificial Sequence
  chemically synthesized
gccaccactctctgacacct

SEQ ID NO: 4430 - DNA, 20 bp, Artificial Sequence
  chemically synthesized
aatacatacatctacatgtc

SEQ ID NO: 4431 - DNA, 20 bp, Artificial Sequence
  chemically synthesized
atacatacatctacatgtcc

SEQ ID NO: 4432 - DNA, 20 bp, Artificial Sequence
  chemically synthesized
tgtcatatattgtttccaat

SEQ ID NO: 4433 - DNA, 20 bp, Artificial Sequence
  chemically synthesized
tattgtttccaatgagccat

SEQ ID NO: 4434 - DNA, 20 bp, Artificial Sequence
  chemically synthesized
caatgagccattggcaaata

SEQ ID NO: 4435 - DNA, 20 bp, Artificial Sequence
  chemically synthesized
aatgagccattggcaaatat

SEQ ID NO: 4436 - DNA, 20 bp, Artificial Sequence
  chemically synthesized
attggcaaatataggttgca

SEQ ID NO: 4437 - DNA, 20 bp, Artificial Sequence
  chemically synthesized
ttggcaaatataggttgcaa

SEQ ID NO: 4438 - DNA, 20 bp, Artificial Sequence
  chemically synthesized
ggcaaatataggttgcaaag

SEQ ID NO: 4439 - DNA, 20 bp, Artificial Sequence
  chemically synthesized
taggttgcaaaggagacatg

SEQ ID NO: 4440 - DNA, 20 bp, Artificial Sequence
  chemically synthesized
aggttgcaaaggagacatgt

SEQ ID NO: 4441 - DNA, 20 bp, Artificial Sequence
  chemically synthesized
gttgcaaaggagacatgtgg

SEQ ID NO: 4442 - DNA, 20 bp, Artificial Sequence
  chemically synthesized
gcaaaggagacatgtgggag

SEQ ID NO: 4443 - DNA, 20 bp, Artificial Sequence
  chemically synthesized
caaaggagacatgtgggaga

SEQ ID NO: 4444 - DNA, 20 bp, Artificial Sequence
  chemically synthesized
gagaaggactttacacatct

SEQ ID NO: 4445 - DNA, 20 bp, Artificial Sequence
  chemically synthesized
aggactttacacatcttaga

SEQ ID NO: 4446 - DNA, 20 bp, Artificial Sequence
  chemically synthesized
acatcttagatggcacctaa

SEQ ID NO: 4447 - DNA, 20 bp, Artificial Sequence
  chemically synthesized
tttatttccctttaattttt

SEQ ID NO: 4448 - DNA, 20 bp, Artificial Sequence
  chemically synthesized
ttatttccctttaattttta

SEQ ID NO: 4449 - DNA, 20 bp, Artificial Sequence
  chemically synthesized
ttgctttccctgctttttct

SEQ ID NO: 4450 - DNA, 20 bp, Artificial Sequence
  chemically synthesized
cctgctttttcttggtcaca

SEQ ID NO: 4451 - DNA, 20 bp, Artificial Sequence
  chemically synthesized
tttcttggtcacatggtaaa

SEQ ID NO: 4452 - DNA, 20 bp, Artificial Sequence
  chemically synthesized
ttcttggtcacatggtaaat

SEQ ID NO: 4453 - DNA, 20 bp, Artificial Sequence
  chemically synthesized
tggtcacatggtaaatgggt

SEQ ID NO: 4454 - DNA, 20 bp, Artificial Sequence
  chemically synthesized
ggtaaatgggtcagaatctg

SEQ ID NO: 4455 - DNA, 20 bp, Artificial Sequence
  chemically synthesized
gtaaatgggtcagaatctga

SEQ ID NO: 4456 - DNA, 20 bp, Artificial Sequence
  chemically synthesized
taaatgggtcagaatctgaa

SEQ ID NO: 4457 - DNA, 20 bp, Artificial Sequence
  chemically synthesized
gggtcagaatctgaagggcc

SEQ ID NO: 4458 - DNA, 20 bp, Artificial Sequence
  chemically synthesized
gaagggccaagaaattatat

SEQ ID NO: 4459 - DNA, 20 bp, Artificial Sequence
  chemically synthesized
agaaattatattagctactg

SEQ ID NO: 4460 - DNA, 20 bp, Artificial Sequence
  chemically synthesized
gtagatatcccattctcttg

SEQ ID NO: 4461 - DNA, 20 bp, Artificial Sequence
  chemically synthesized
tagatatcccattctcttga

SEQ ID NO: 4462 - DNA, 20 bp, Artificial Sequence
  chemically synthesized
ctcttgaaggatactttaat

SEQ ID NO: 4463 - DNA, 20 bp, Artificial Sequence
  chemically synthesized
tcttgaaggatactttaatg

SEQ ID NO: 4464 - DNA, 20 bp, Artificial Sequence
  chemically synthesized
ggatactttaatgaggaata

SEQ ID NO: 4465 - DNA, 20 bp, Artificial Sequence
  chemically synthesized
tttaatgaggaatacagatg

SEQ ID NO: 4466 - DNA, 20 bp, Artificial Sequence
  chemically synthesized
ggaatacagatgaagataaa

SEQ ID NO: 4467 - DNA, 20 bp, Artificial Sequence
  chemically synthesized
tacagatgaagataaaaaga

SEQ ID NO: 4468 - DNA, 20 bp, Artificial Sequence
  chemically synthesized
aacaaataccatgatattca

SEQ ID NO: 4469 - DNA, 20 bp, Artificial Sequence
  chemically synthesized
atattcatggaattaaaaac

SEQ ID NO: 4470 - DNA, 20 bp, Artificial Sequence
  chemically synthesized
aaaactggcttcacactgat

SEQ ID NO: 4471 - DNA, 20 bp, Artificial Sequence
  chemically synthesized
ctggcttcacactgataagc

SEQ ID NO: 4472 - DNA, 20 bp, Artificial Sequence
  chemically synthesized
acactgataagccagattta

SEQ ID NO: 4473 - DNA, 20 bp, Artificial Sequence
  chemically synthesized
actgataagccagatttatg

SEQ ID NO: 4474 - DNA, 20 bp, Artificial Sequence
  chemically synthesized
tgataagccagatttatgga

SEQ ID NO: 4475 - DNA, 20 bp, Artificial Sequence
  chemically synthesized
ataagccagatttatggaga

SEQ ID NO: 4476 - DNA, 20 bp, Artificial Sequence
  chemically synthesized
agatgtttccttattctctc

SEQ ID NO: 4477 - DNA, 20 bp, Artificial Sequence
  chemically synthesized
tgtttccttattctctcaag

SEQ ID NO: 4478 - DNA, 20 bp, Artificial Sequence
  chemically synthesized
tttccttattctctcaagtg

SEQ ID NO: 4479 - DNA, 20 bp, Artificial Sequence
  chemically synthesized
tgattttctgatatttttca

SEQ ID NO: 4480 - DNA, 20 bp, Artificial Sequence
  chemically synthesized
gatatttttcaaagaatccc

SEQ ID NO: 4481 - DNA, 20 bp, Artificial Sequence
  chemically synthesized
atttttcaaagaatccctag

SEQ ID NO: 4482 - DNA, 20 bp, Artificial Sequence
  chemically synthesized
ctagaagcttttttcaccta

SEQ ID NO: 4483 - DNA, 20 bp, Artificial Sequence
  chemically synthesized
gaagcttttttcacctatag

SEQ ID NO: 4484 - DNA, 20 bp, Artificial Sequence
  chemically synthesized
tcacctatagtagtaaaact

SEQ ID NO: 4485 - DNA, 20 bp, Artificial Sequence
  chemically synthesized
taaaacttagtaaaaaaaaa

SEQ ID NO: 4486 - DNA, 20 bp, Artificial Sequence
  chemically synthesized
ataaatatgatgtttgacat

SEQ ID NO: 4487 - DNA, 20 bp, Artificial Sequence
  chemically synthesized
tgacatcagctgaccctgac

SEQ ID NO: 4488 - DNA, 20 bp, Artificial Sequence
  chemically synthesized
cctgactggatgatcttgat

SEQ ID NO: 4489 - DNA, 20 bp, Artificial Sequence
  chemically synthesized
ggatgatcttgattggatgc

SEQ ID NO: 4490 - DNA, 20 bp, Artificial Sequence
  chemically synthesized
gatgatcttgattggatgct

SEQ ID NO: 4491 - DNA, 20 bp, Artificial Sequence
  chemically synthesized
atcttgattggatgctaggc

SEQ ID NO: 4492 - DNA, 20 bp, Artificial Sequence
  chemically synthesized
ttggatgctaggcaagtgcc

SEQ ID NO: 4493 - DNA, 20 bp, Artificial Sequence
  chemically synthesized
tggatgctaggcaagtgccc

SEQ ID NO: 4494 - DNA, 20 bp, Artificial Sequence
  chemically synthesized
aagtgcccaggtcctccaat

SEQ ID NO: 4495 - DNA, 20 bp, Artificial Sequence
  chemically synthesized
aggtcctccaatcagtcatc

SEQ ID NO: 4496 - DNA, 20 bp, Artificial Sequence
  chemically synthesized
ggtcctccaatcagtcatct

SEQ ID NO: 4497 - DNA, 20 bp, Artificial Sequence
  chemically synthesized
aatcagtcatctaggcatct

SEQ ID NO: 4498 - DNA, 20 bp, Artificial Sequence
  chemically synthesized
ctaggcatcttagttctcac

SEQ ID NO: 4499 - DNA, 20 bp, Artificial Sequence
  chemically synthesized
catcttagttctcactggct

SEQ ID NO: 4500 - DNA, 20 bp, Artificial Sequence
  chemically synthesized
tcttagttctcactggctaa

SEQ ID NO: 4501 - DNA, 20 bp, Artificial Sequence
  chemically synthesized
ttagttctcactggctaaga

SEQ ID NO: 4502 - DNA, 20 bp, Artificial Sequence
  chemically synthesized
tagttctcactggctaagag

SEQ ID NO: 4503 - DNA, 20 bp, Artificial Sequence
  chemically synthesized
gaggtcatattttattacgt

SEQ ID NO: 4504 - DNA, 20 bp, Artificial Sequence
  chemically synthesized
atattttattacgtaagtgt

SEQ ID NO: 4505 - DNA, 20 bp, Artificial Sequence
  chemically synthesized
acgtaagtgtgagtgctata

SEQ ID NO: 4506 - DNA, 20 bp, Artificial Sequence
  chemically synthesized
taagtgtgagtgctatatgg

SEQ ID NO: 4507 - DNA, 20 bp, Artificial Sequence
  chemically synthesized
aagtgtgagtgctatatggt

SEQ ID NO: 4508 - DNA, 20 bp, Artificial Sequence
  chemically synthesized
gtgtgagtgctatatggtgg

SEQ ID NO: 4509 - DNA, 20 bp, Artificial Sequence
  chemically synthesized
tgctatatggtgggagatat

SEQ ID NO: 4510 - DNA, 20 bp, Artificial Sequence
  chemically synthesized
agaattatcacatgcatttc

SEQ ID NO: 4511 - DNA, 20 bp, Artificial Sequence
  chemically synthesized
tttcaagtgctttccattca

SEQ ID NO: 4512 - DNA, 20 bp, Artificial Sequence
  chemically synthesized
ttcaagtgctttccattcaa

SEQ ID NO: 4513 - DNA, 20 bp, Artificial Sequence
  chemically synthesized
attcaaaggtcttgaaacca

SEQ ID NO: 4514 - DNA, 20 bp, Artificial Sequence
  chemically synthesized
aaaggtcttgaaaccatagt

SEQ ID NO: 4515 - DNA, 20 bp, Artificial Sequence
  chemically synthesized
aaggtcttgaaaccatagtg

SEQ ID NO: 4516 - DNA, 20 bp, Artificial Sequence
  chemically synthesized
aggtcttgaaaccatagtga

SEQ ID NO: 4517 - DNA, 20 bp, Artificial Sequence
  chemically synthesized
aaaccatagtgagggtaaat

SEQ ID NO: 4518 - DNA, 20 bp, Artificial Sequence
  chemically synthesized
catagtgagggtaaattgga

SEQ ID NO: 4519 - DNA, 20 bp, Artificial Sequence
  chemically synthesized
atggcttcaccttgcttttt

SEQ ID NO: 4520 - DNA, 20 bp, Artificial Sequence
  chemically synthesized
ccttgcttttttagacatta

SEQ ID NO: 4521 - DNA, 20 bp, Artificial Sequence
  chemically synthesized
gcttttttagacattaaaga

SEQ ID NO: 4522 - DNA, 20 bp, Artificial Sequence
  chemically synthesized
cttttttagacattaaagaa

SEQ ID NO: 4523 - DNA, 20 bp, Artificial Sequence
  chemically synthesized
tttagacattaaagaaagga

SEQ ID NO: 4524 - DNA, 20 bp, Artificial Sequence
  chemically synthesized
cttatcttcccacctatcct

SEQ ID NO: 4525 - DNA, 20 bp, Artificial Sequence
  chemically synthesized
cttcccacctatccttggaa

SEQ ID NO: 4526 - DNA, 20 bp, Artificial Sequence
  chemically synthesized
tatccttggaaaagaaatta

SEQ ID NO: 4527 - DNA, 20 bp, Artificial Sequence
  chemically synthesized
atccttggaaaagaaattaa

SEQ ID NO: 4528 - DNA, 20 bp, Artificial Sequence
  chemically synthesized
aaaagaaattaaaggaatca

SEQ ID NO: 4529 - DNA, 20 bp, Artificial Sequence
  chemically synthesized
aaagaaattaaaggaatcaa

SEQ ID NO: 4530 - DNA, 20 bp, Artificial Sequence
  chemically synthesized
aaaggaatcaaaggatatta

SEQ ID NO: 4531 - DNA, 20 bp, Artificial Sequence
  chemically synthesized
atcaaaggatattatagaaa

SEQ ID NO: 4532 - DNA, 20 bp, Artificial Sequence
  chemically synthesized
caaaggatattatagaaaaa

SEQ ID NO: 4533 - DNA, 20 bp, Artificial Sequence
  chemically synthesized
ggatattatagaaaaagaga

SEQ ID NO: 4534 - DNA, 20 bp, Artificial Sequence
  chemically synthesized
atattatagaaaaagagatg

SEQ ID NO: 4535 - DNA, 20 bp, Artificial Sequence
  chemically synthesized
tatagaaaaagagatggaga

SEQ ID NO: 4536 - DNA, 20 bp, Artificial Sequence
  chemically synthesized
atagaaaaagagatggagaa

SEQ ID NO: 4537 - DNA, 20 bp, Artificial Sequence
  chemically synthesized
aaaagagatggagaaaggac

SEQ ID NO: 4538 - DNA, 20 bp, Artificial Sequence
  chemically synthesized
aaagagatggagaaaggaca

SEQ ID NO: 4539 - DNA, 20 bp, Artificial Sequence
  chemically synthesized
agagatggagaaaggacaag

SEQ ID NO: 4540 - DNA, 20 bp, Artificial Sequence
  chemically synthesized
gagaaaggacaaggagaatt

SEQ ID NO: 4541 - DNA, 20 bp, Artificial Sequence
  chemically synthesized
agaaaggacaaggagaattt

SEQ ID NO: 4542 - DNA, 20 bp, Artificial Sequence
  chemically synthesized
gaaaggacaaggagaattta

SEQ ID NO: 4543 - DNA, 20 bp, Artificial Sequence
  chemically synthesized
aaaggacaaggagaatttag

SEQ ID NO: 4544 - DNA, 20 bp, Artificial Sequence
  chemically synthesized
aaggagaatttaggggacaa

SEQ ID NO: 4545 - DNA, 20 bp, Artificial Sequence
  chemically synthesized
gtctgcatctgactacctga

SEQ ID NO: 4546 - DNA, 20 bp, Artificial Sequence
  chemically synthesized
atctgactacctgatagtga

SEQ ID NO: 4547 - DNA, 20 bp, Artificial Sequence
  chemically synthesized
tctgactacctgatagtgac

SEQ ID NO: 4548 - DNA, 20 bp, Artificial Sequence
  chemically synthesized
gactacctgatagtgacagg

SEQ ID NO: 4549 - DNA, 20 bp, Artificial Sequence
  chemically synthesized
tgatagtgacaggaagaaca

SEQ ID NO: 4550 - DNA, 20 bp, Artificial Sequence
  chemically synthesized
gtgacaggaagaacaaagaa

SEQ ID NO: 4551 - DNA, 20 bp, Artificial Sequence
  chemically synthesized
aagaacaaagaatagaatcc

SEQ ID NO: 4552 - DNA, 20 bp, Artificial Sequence
  chemically synthesized
gaacaaagaatagaatccaa

SEQ ID NO: 4553 - DNA, 20 bp, Artificial Sequence
  chemically synthesized
aacaaagaatagaatccaag

SEQ ID NO: 4554 - DNA, 20 bp, Artificial Sequence
  chemically synthesized
tattataatgtttttaaatc

SEQ ID NO: 4555 - DNA, 20 bp, Artificial Sequence
  chemically synthesized
attataatgtttttaaatct

SEQ ID NO: 4556 - DNA, 20 bp, Artificial Sequence
  chemically synthesized
ttataatgtttttaaatctg

SEQ ID NO: 4557 - DNA, 20 bp, Artificial Sequence
  chemically synthesized
tctggggactctaaaacttg

SEQ ID NO: 4558 - DNA, 20 bp, Artificial Sequence
  chemically synthesized
aacttgaagaattttttttt

SEQ ID NO: 4559 - DNA, 20 bp, Artificial Sequence
  chemically synthesized
tttttttgagcaaatgtttt

SEQ ID NO: 4560 - DNA, 20 bp, Artificial Sequence
  chemically synthesized
ttctgataaatataatatgc

SEQ ID NO: 4561 - DNA, 20 bp, Artificial Sequence
  chemically synthesized
ctgataaatataatatgcaa

SEQ ID NO: 4562 - DNA, 20 bp, Artificial Sequence
  chemically synthesized
tgataaatataatatgcaag

SEQ ID NO: 4563 - DNA, 20 bp, Artificial Sequence
  chemically synthesized
gataaatataatatgcaaga

SEQ ID NO: 4564 - DNA, 20 bp, Artificial Sequence
  chemically synthesized
aaatataatatgcaagaggg

SEQ ID NO: 4565 - DNA, 20 bp, Artificial Sequence
  chemically synthesized
gagggcagtgatccaaacta

SEQ ID NO: 4566 - DNA, 20 bp, Artificial Sequence
  chemically synthesized
aactacggctgctgtgatac

SEQ ID NO: 4567 - DNA, 20 bp, Artificial Sequence
  chemically synthesized
actactttaaaacacacctt

SEQ ID NO: 4568 - DNA, 20 bp, Artificial Sequence
  chemically synthesized
accttcagcaatattctatg

SEQ ID NO: 4569 - DNA, 20 bp, Artificial Sequence
  chemically synthesized
attctatgcagatgaaataa

SEQ ID NO: 4570 - DNA, 20 bp, Artificial Sequence
  chemically synthesized
tatgtttaatttaatatgtt

SEQ ID NO: 4571 - DNA, 20 bp, Artificial Sequence
  chemically synthesized
taatatgtttagttttctta

SEQ ID NO: 4572 - DNA, 20 bp, Artificial Sequence
  chemically synthesized
tatgtttagttttcttatag

SEQ ID NO: 4573 - DNA, 20 bp, Artificial Sequence
  chemically synthesized
agttttcttatagaagtcta

SEQ ID NO: 4574 - DNA, 20 bp, Artificial Sequence
  chemically synthesized
tatagaagtctacagtcttt

SEQ ID NO: 4575 - DNA, 20 bp, Artificial Sequence
  chemically synthesized
agtctttgagccacatgctt

SEQ ID NO: 4576 - DNA, 20 bp, Artificial Sequence
  chemically synthesized
tatataatattattgacatc

SEQ ID NO: 4577 - DNA, 20 bp, Artificial Sequence
  chemically synthesized
acatcaagtaacaatatcat

SEQ ID NO: 4578 - DNA, 20 bp, Artificial Sequence
  chemically synthesized
taacaatatcattggaatct

SEQ ID NO: 4579 - DNA, 20 bp, Artificial Sequence
  chemically synthesized
atatgattatctaatatacc

SEQ ID NO: 4580 - DNA, 20 bp, Artificial Sequence
  chemically synthesized
aatatacctagatatttttg

SEQ ID NO: 4581 - DNA, 20 bp, Artificial Sequence
  chemically synthesized
atatacctagatatttttgc

SEQ ID NO: 4582 - DNA, 20 bp, Artificial Sequence
  chemically synthesized
tatacctagatatttttgca

SEQ ID NO: 4583 - DNA, 20 bp, Artificial Sequence
  chemically synthesized
tatttttgcagggaacatgt

SEQ ID NO: 4584 - DNA, 20 bp, Artificial Sequence
  chemically synthesized
gggaacatgtaagtattatg

SEQ ID NO: 4585 - DNA, 20 bp, Artificial Sequence
  chemically synthesized
agtattatgtagaataaata

SEQ ID NO: 4586 - DNA, 20 bp, Artificial Sequence
  chemically synthesized
gattataaaaattctcacat

SEQ ID NO: 4587 - DNA, 20 bp, Artificial Sequence
  chemically synthesized
attctcacataagttcatgt

SEQ ID NO: 4588 - DNA, 20 bp, Artificial Sequence
  chemically synthesized
gtcagaaattgccatcactt

SEQ ID NO: 4589 - DNA, 20 bp, Artificial Sequence
  chemically synthesized
cagaaattgccatcacttta

SEQ ID NO: 4590 - DNA, 20 bp, Artificial Sequence
  chemically synthesized
aaattgccatcactttagag

SEQ ID NO: 4591 - DNA, 20 bp, Artificial Sequence
  chemically synthesized
agagcagattgtgctgttaa

SEQ ID NO: 4592 - DNA, 20 bp, Artificial Sequence
  chemically synthesized
gattgtgctgttaaaagact

SEQ ID NO: 4593 - DNA, 20 bp, Artificial Sequence
  chemically synthesized
actcagtttttaaatttcta

SEQ ID NO: 4594 - DNA, 20 bp, Artificial Sequence
  chemically synthesized
tttaaatttctatggatttc

SEQ ID NO: 4595 - DNA, 20 bp, Artificial Sequence
  chemically synthesized
ttaaatttctatggatttca

SEQ ID NO: 4596 - DNA, 20 bp, Artificial Sequence
  chemically synthesized
ttctatggatttcaaggaaa

SEQ ID NO: 4597 - DNA, 20 bp, Artificial Sequence
  chemically synthesized
aggaaatggataaatgattg

SEQ ID NO: 4598 - DNA, 20 bp, Artificial Sequence
  chemically synthesized
tgtggccctgttaaccaaaa

SEQ ID NO: 4599 - DNA, 20 bp, Artificial Sequence
  chemically synthesized
ggccctgttaaccaaaatag

SEQ ID NO: 4600 - DNA, 20 bp, Artificial Sequence
  chemically synthesized
aaccaaaatagcagtaaaaa

SEQ ID NO: 4601 - DNA, 20 bp, Artificial Sequence
  chemically synthesized
aatagcagtaaaaatggctt

SEQ ID NO: 4602 - DNA, 20 bp, Artificial Sequence
  chemically synthesized
aatggctttggctactgatt

SEQ ID NO: 4603 - DNA, 20 bp, Artificial Sequence
  chemically synthesized
tgatttagtatctgtaaatt

SEQ ID NO: 4604 - DNA, 20 bp, Artificial Sequence
  chemically synthesized
gatttagtatctgtaaatta

SEQ ID NO: 4605 - DNA, 20 bp, Artificial Sequence
  chemically synthesized
tatctgtaaattaaggatgt

SEQ ID NO: 4606 - DNA, 20 bp, Artificial Sequence
  chemically synthesized
ttaaggatgttggattgctt

SEQ ID NO: 4607 - DNA, 20 bp, Artificial Sequence
  chemically synthesized
tgttggattgcttgagattt

SEQ ID NO: 4608 - DNA, 20 bp, Artificial Sequence
  chemically synthesized
ctaactctgcttcaatatgt

SEQ ID NO: 4609 - DNA, 20 bp, Artificial Sequence
  chemically synthesized
tatgtaagatacttctaatt

SEQ ID NO: 4610 - DNA, 20 bp, Artificial Sequence
  chemically synthesized
aagatacttctaattgagtc

SEQ ID NO: 4611 - DNA, 20 bp, Artificial Sequence
  chemically synthesized
gagtctagataattgttcta

SEQ ID NO: 4612 - DNA, 20 bp, Artificial Sequence
  chemically synthesized
agtctagataattgttctat

SEQ ID NO: 4613 - DNA, 20 bp, Artificial Sequence
  chemically synthesized
taattgttctataggtaaat

SEQ ID NO: 4614 - DNA, 20 bp, Artificial Sequence
  chemically synthesized
ctataggtaaattagtgtcc

SEQ ID NO: 4615 - DNA, 20 bp, Artificial Sequence
  chemically synthesized
taaattagtgtcctggatgc

SEQ ID NO: 4616 - DNA, 20 bp, Artificial Sequence
  chemically synthesized
tgtcctggatgctagtgctt

SEQ ID NO: 4617 - DNA, 20 bp, Artificial Sequence
  chemically synthesized
gcttcagccaaaaaatgaaa

SEQ ID NO: 4618 - DNA, 20 bp, Artificial Sequence
  chemically synthesized
aaaaagatacaattaaatga

SEQ ID NO: 4619 - DNA, 20 bp, Artificial Sequence
  chemically synthesized
tgaaagcctttatcttacta

SEQ ID NO: 4620 - DNA, 20 bp, Artificial Sequence
  chemically synthesized
gaaagcctttatcttactat

SEQ ID NO: 4621 - DNA, 20 bp, Artificial Sequence
  chemically synthesized
tttatcttactatgggactt

SEQ ID NO: 4622 - DNA, 20 bp, Artificial Sequence
  chemically synthesized
atcttactatgggacttgag

SEQ ID NO: 4623 - DNA, 20 bp, Artificial Sequence
  chemically synthesized
cttactatgggacttgagtg

SEQ ID NO: 4624 - DNA, 20 bp, Artificial Sequence
  chemically synthesized
ttactatgggacttgagtgg

SEQ ID NO: 4625 - DNA, 20 bp, Artificial Sequence
  chemically synthesized
gacttgagtggaggaaatcc

SEQ ID NO: 4626 - DNA, 20 bp, Artificial Sequence
  chemically synthesized
gagtggaggaaatccaagaa

SEQ ID NO: 4627 - DNA, 20 bp, Artificial Sequence
  chemically synthesized
gaaatccaagaaaagaattc

SEQ ID NO: 4628 - DNA, 20 bp, Artificial Sequence
  chemically synthesized
agatgatcctttcttcgaac

SEQ ID NO: 4629 - DNA, 20 bp, Artificial Sequence
  chemically synthesized
ctttcttcgaacaagtaatt

SEQ ID NO: 4630 - DNA, 20 bp, Artificial Sequence
  chemically synthesized
aacaagtaatttggcataat

SEQ ID NO: 4631 - DNA, 20 bp, Artificial Sequence
  chemically synthesized
atttggcataattggacacc

SEQ ID NO: 4632 - DNA, 20 bp, Artificial Sequence
  chemically synthesized
cctggtttcttctcatttgt

SEQ ID NO: 4633 - DNA, 20 bp, Artificial Sequence
  chemically synthesized
gtttcttctcatttgtaagt

SEQ ID NO: 4634 - DNA, 20 bp, Artificial Sequence
  chemically synthesized
ttctcatttgtaagttagta

SEQ ID NO: 4635 - DNA, 20 bp, Artificial Sequence
  chemically synthesized
catttgtaagttagtaaagc

SEQ ID NO: 4636 - DNA, 20 bp, Artificial Sequence
  chemically synthesized
atttgtaagttagtaaagct

SEQ ID NO: 4637 - DNA, 20 bp, Artificial Sequence
  chemically synthesized
ttgtaagttagtaaagctgg

SEQ ID NO: 4638 - DNA, 20 bp, Artificial Sequence
  chemically synthesized
aagttagtaaagctgggagt

SEQ ID NO: 4639 - DNA, 20 bp, Artificial Sequence
  chemically synthesized
gtaaagctgggagttggtgc

SEQ ID NO: 4640 - DNA, 20 bp, Artificial Sequence
  chemically synthesized
gctgggagttggtgctagta

SEQ ID NO: 4641 - DNA, 20 bp, Artificial Sequence
  chemically synthesized
ggagttggtgctagtaaagc

SEQ ID NO: 4642 - DNA, 20 bp, Artificial Sequence
  chemically synthesized
gagttggtgctagtaaagct

SEQ ID NO: 4643 - DNA, 20 bp, Artificial Sequence
  chemically synthesized
gttggtgctagtaaagctgg

SEQ ID NO: 4644 - DNA, 20 bp, Artificial Sequence
  chemically synthesized
gtgctagtaaagctgggagt

SEQ ID NO: 4645 - DNA, 20 bp, Artificial Sequence
  chemically synthesized
gtaaagctgggagttggtgc

SEQ ID NO: 4646 - DNA, 20 bp, Artificial Sequence
  chemically synthesized
gctgggagttggtgccagaa

SEQ ID NO: 4647 - DNA, 20 bp, Artificial Sequence
  chemically synthesized
tgggagttggtgccagaaaa

SEQ ID NO: 4648 - DNA, 20 bp, Artificial Sequence
  chemically synthesized
gttggtgccagaaaagagaa

SEQ ID NO: 4649 - DNA, 20 bp, Artificial Sequence
  chemically synthesized
atttatttcttccttgtttg

SEQ ID NO: 4650 - DNA, 20 bp, Artificial Sequence
  chemically synthesized
tttatttcttccttgtttgt

SEQ ID NO: 4651 - DNA, 20 bp, Artificial Sequence
  chemically synthesized
tcttccttgtttgtaggctg

SEQ ID NO: 4652 - DNA, 20 bp, Artificial Sequence
  chemically synthesized
ttccttgtttgtaggctgta

SEQ ID NO: 4653 - DNA, 20 bp, Artificial Sequence
  chemically synthesized
ttgtttgtaggctgtagagc

SEQ ID NO: 4654 - DNA, 20 bp, Artificial Sequence
  chemically synthesized
gagcaagcttgtccaacctg

SEQ ID NO: 4655 - DNA, 20 bp, Artificial Sequence
  chemically synthesized
cttgtccaacctgtggcccg

SEQ ID NO: 4656 - DNA, 20 bp, Artificial Sequence
  chemically synthesized
ttgtccaacctgtggcccgt

SEQ ID NO: 4657 - DNA, 20 bp, Artificial Sequence
  chemically synthesized
ccgtgggctgcatgcatccc

SEQ ID NO: 4658 - DNA, 20 bp, Artificial Sequence
  chemically synthesized
gggctgcatgcatcccaaga

SEQ ID NO: 4659 - DNA, 20 bp, Artificial Sequence
  chemically synthesized
caactttcttaaaacattat

SEQ ID NO: 4660 - DNA, 20 bp, Artificial Sequence
  chemically synthesized
taaaacattatgagatttta

SEQ ID NO: 4661 - DNA, 20 bp, Artificial Sequence
  chemically synthesized
aaaacattatgagattttat

SEQ ID NO: 4662 - DNA, 20 bp, Artificial Sequence
  chemically synthesized
ttgtgatttttttttttttt

SEQ ID NO: 4663 - DNA, 20 bp, Artificial Sequence
  chemically synthesized
tttttttttttttggctcat

SEQ ID NO: 4664 - DNA, 20 bp, Artificial Sequence
  chemically synthesized
tttggctcatgagctgtcat

SEQ ID NO: 4665 - DNA, 20 bp, Artificial Sequence
  chemically synthesized
tcatgagctgtcattagtgt

SEQ ID NO: 4666 - DNA, 20 bp, Artificial Sequence
  chemically synthesized
gtgttagtatattttatgtg

SEQ ID NO: 4667 - DNA, 20 bp, Artificial Sequence
  chemically synthesized
agtatattttatgtgtggcc

SEQ ID NO: 4668 - DNA, 20 bp, Artificial Sequence
  chemically synthesized
gtatattttatgtgtggccc

SEQ ID NO: 4669 - DNA, 20 bp, Artificial Sequence
  chemically synthesized
tatattttatgtgtggccca

SEQ ID NO: 4670 - DNA, 20 bp, Artificial Sequence
  chemically synthesized
attttatgtgtggcccaggg

SEQ ID NO: 4671 - DNA, 20 bp, Artificial Sequence
  chemically synthesized
gtgtggcccagggaagccaa

SEQ ID NO: 4672 - DNA, 20 bp, Artificial Sequence
  chemically synthesized
gcccagggaagccaaaagat

SEQ ID NO: 4673 - DNA, 20 bp, Artificial Sequence
  chemically synthesized
aagattggacatccctgctg

SEQ ID NO: 4674 - DNA, 20 bp, Artificial Sequence
  chemically synthesized
gattggacatccctgctgta

SEQ ID NO: 4675 - DNA, 20 bp, Artificial Sequence
  chemically synthesized
atccctgctgtagagtttct

SEQ ID NO: 4676 - DNA, 20 bp, Artificial Sequence
  chemically synthesized
cctgctgtagagtttctcag

SEQ ID NO: 4677 - DNA, 20 bp, Artificial Sequence
  chemically synthesized
ctgtagagtttctcagtggt

SEQ ID NO: 4678 - DNA, 20 bp, Artificial Sequence
  chemically synthesized
gtggttggaatcaatatttg

SEQ ID NO: 4679 - DNA, 20 bp, Artificial Sequence
  chemically synthesized
ggttggaatcaatatttgca

SEQ ID NO: 4680 - DNA, 20 bp, Artificial Sequence
  chemically synthesized
tcaatatttgcagagtcttg

SEQ ID NO: 4681 - DNA, 20 bp, Artificial Sequence
  chemically synthesized
agagtcttgtagctttttca

SEQ ID NO: 4682 - DNA, 20 bp, Artificial Sequence
  chemically synthesized
atttttcccctgccacattg

SEQ ID NO: 4683 - DNA, 20 bp, Artificial Sequence
  chemically synthesized
tcccctgccacattgaagaa

SEQ ID NO: 4684 - DNA, 20 bp, Artificial Sequence
  chemically synthesized
gccacattgaagaatagctt

SEQ ID NO: 4685 - DNA, 20 bp, Artificial Sequence
  chemically synthesized
ttgaagaatagcttgagcaa

SEQ ID NO: 4686 - DNA, 20 bp, Artificial Sequence
  chemically synthesized
gcaatagccactcttctttc

SEQ ID NO: 4687 - DNA, 20 bp, Artificial Sequence
  chemically synthesized
caatagccactcttctttcc

SEQ ID NO: 4688 - DNA, 20 bp, Artificial Sequence
  chemically synthesized
tagccactcttctttccagg

SEQ ID NO: 4689 - DNA, 20 bp, Artificial Sequence
  chemically synthesized
gccactcttctttccaggtg

SEQ ID NO: 4690 - DNA, 20 bp, Artificial Sequence
  chemically synthesized
gtggagtttgtgaattactt

SEQ ID NO: 4691 - DNA, 20 bp, Artificial Sequence
  chemically synthesized
ggagtttgtgaattacttta

SEQ ID NO: 4692 - DNA, 20 bp, Artificial Sequence
  chemically synthesized
ctttagagatgatctttatc

SEQ ID NO: 4693 - DNA, 20 bp, Artificial Sequence
  chemically synthesized
tttagagatgatctttatct

SEQ ID NO: 4694 - DNA, 20 bp, Artificial Sequence
  chemically synthesized
agagatgatctttatctggg

SEQ ID NO: 4695 - DNA, 20 bp, Artificial Sequence
  chemically synthesized
taatatattatctcttcgtt

SEQ ID NO: 4696 - DNA, 20 bp, Artificial Sequence
  chemically synthesized
tctcttcgtttagctaacgt

SEQ ID NO: 4697 - DNA, 20 bp, Artificial Sequence
  chemically synthesized
ctcttcgtttagctaacgta

SEQ ID NO: 4698 - DNA, 20 bp, Artificial Sequence
  chemically synthesized
tttagctaacgtaaggttat

SEQ ID NO: 4699 - DNA, 20 bp, Artificial Sequence
  chemically synthesized
gttattagatacttttcttt

SEQ ID NO: 4700 - DNA, 20 bp, Artificial Sequence
  chemically synthesized
ttattagatacttttcttta

SEQ ID NO: 4701 - DNA, 20 bp, Artificial Sequence
  chemically synthesized
ttagatacttttctttaagg

SEQ ID NO: 4702 - DNA, 20 bp, Artificial Sequence
  chemically synthesized
tagatacttttctttaagga

SEQ ID NO: 4703 - DNA, 20 bp, Artificial Sequence
  chemically synthesized
ttctttaaggaaggatacac

SEQ ID NO: 4704 - DNA, 20 bp, Artificial Sequence
  chemically synthesized
tctttaaggaaggatacacc

SEQ ID NO: 4705 - DNA, 20 bp, Artificial Sequence
  chemically synthesized
acaccaggacctgccttaat

SEQ ID NO: 4706 - DNA, 20 bp, Artificial Sequence
  chemically synthesized
caccaggacctgccttaata

SEQ ID NO: 4707 - DNA, 20 bp, Artificial Sequence
  chemically synthesized
atcataatatgtgtgtcgtg

SEQ ID NO: 4708 - DNA, 20 bp, Artificial Sequence
  chemically synthesized
cataatatgtgtgtcgtgca

SEQ ID NO: 4709 - DNA, 20 bp, Artificial Sequence
  chemically synthesized
cgtgcagagataaacttgta

SEQ ID NO: 4710 - DNA, 20 bp, Artificial Sequence
  chemically synthesized
gcagagataaacttgtatag

SEQ ID NO: 4711 - DNA, 20 bp, Artificial Sequence
  chemically synthesized
caatacgactgcttgtatta

SEQ ID NO: 4712 - DNA, 20 bp, Artificial Sequence
  chemically synthesized
ctgcttgtattaaagaaaca

SEQ ID NO: 4713 - DNA, 20 bp, Artificial Sequence
  chemically synthesized
gttgaattgtgtttaatcac

SEQ ID NO: 4714 - DNA, 20 bp, Artificial Sequence
  chemically synthesized
tgaattgtgtttaatcacaa

SEQ ID NO: 4715 - DNA, 20 bp, Artificial Sequence
  chemically synthesized
agagtaatgcatgcctgata

SEQ ID NO: 4716 - DNA, 20 bp, Artificial Sequence
  chemically synthesized
aatgcatgcctgatatggtt

SEQ ID NO: 4717 - DNA, 20 bp, Artificial Sequence
  chemically synthesized
ctccaccctaatctcatgtt

SEQ ID NO: 4718 - DNA, 20 bp, Artificial Sequence
  chemically synthesized
tcatgttcagctgtaatccc

SEQ ID NO: 4719 - DNA, 20 bp, Artificial Sequence
  chemically synthesized
agctgtaatccccagtgttg

SEQ ID NO: 4720 - DNA, 20 bp, Artificial Sequence
  chemically synthesized
gtaatccccagtgttgaaga

SEQ ID NO: 4721 - DNA, 20 bp, Artificial Sequence
  chemically synthesized
taatccccagtgttgaagat

SEQ ID NO: 4722 - DNA, 20 bp, Artificial Sequence
  chemically synthesized
aatccccagtgttgaagatg

SEQ ID NO: 4723 - DNA, 20 bp, Artificial Sequence
  chemically synthesized
ccagtgttgaagatggggcc

SEQ ID NO: 4724 - DNA, 20 bp, Artificial Sequence
  chemically synthesized
gtgttgaagatggggcctgg

SEQ ID NO: 4725 - DNA, 20 bp, Artificial Sequence
  chemically synthesized
tgttgaagatggggcctggt

SEQ ID NO: 4726 - DNA, 20 bp, Artificial Sequence
  chemically synthesized
tgaagatggggcctggtggg

SEQ ID NO: 4727 - DNA, 20 bp, Artificial Sequence
  chemically synthesized
ggggcctggtgggaagtgat

SEQ ID NO: 4728 - DNA, 20 bp, Artificial Sequence
  chemically synthesized
ggtgggaagtgattggatca

SEQ ID NO: 4729 - DNA, 20 bp, Artificial Sequence
  chemically synthesized
gtgggaagtgattggatcat

SEQ ID NO: 4730 - DNA, 20 bp, Artificial Sequence
  chemically synthesized
gggaagtgattggatcatag

SEQ ID NO: 4731 - DNA, 20 bp, Artificial Sequence
  chemically synthesized
aagtgattggatcataggag

SEQ ID NO: 4732 - DNA, 20 bp, Artificial Sequence
  chemically synthesized
gtgattggatcataggagca

SEQ ID NO: 4733 - DNA, 20 bp, Artificial Sequence
  chemically synthesized
aggagcagagttatcataaa

SEQ ID NO: 4734 - DNA, 20 bp, Artificial Sequence
  chemically synthesized
tatcataaatagcttaatat

SEQ ID NO: 4735 - DNA, 20 bp, Artificial Sequence
  chemically synthesized
agcttaatatcagtcccttt

SEQ ID NO: 4736 - DNA, 20 bp, Artificial Sequence
  chemically synthesized
tcagtcccttttggtacgta

SEQ ID NO: 4737 - DNA, 20 bp, Artificial Sequence
  chemically synthesized
gtcccttttggtacgtatag

SEQ ID NO: 4738 - DNA, 20 bp, Artificial Sequence
  chemically synthesized
tcccttttggtacgtatagt

SEQ ID NO: 4739 - DNA, 20 bp, Artificial Sequence
  chemically synthesized
ttttggtacgtatagtgggt

SEQ ID NO: 4740 - DNA, 20 bp, Artificial Sequence
  chemically synthesized
tatagtgggtgagttctcat

SEQ ID NO: 4741 - DNA, 20 bp, Artificial Sequence
  chemically synthesized
gggtgagttctcatgagata

SEQ ID NO: 4742 - DNA, 20 bp, Artificial Sequence
  chemically synthesized
cctgcctcttcttcctgctc

SEQ ID NO: 4743 - DNA, 20 bp, Artificial Sequence
  chemically synthesized
cttcctgctccagccatgtg

SEQ ID NO: 4744 - DNA, 20 bp, Artificial Sequence
  chemically synthesized
tttctctctgccatgattat

SEQ ID NO: 4745 - DNA, 20 bp, Artificial Sequence
  chemically synthesized
taagtttcctgaaacctccc

SEQ ID NO: 4746 - DNA, 20 bp, Artificial Sequence
  chemically synthesized
gtttcctgaaacctccctag

SEQ ID NO: 4747 - DNA, 20 bp, Artificial Sequence
  chemically synthesized
ctgaaacctccctagaagct

SEQ ID NO: 4748 - DNA, 20 bp, Artificial Sequence
  chemically synthesized
aaacctccctagaagctgag

SEQ ID NO: 4749 - DNA, 20 bp, Artificial Sequence
  chemically synthesized
acgttgccatgcttcctgta

SEQ ID NO: 4750 - DNA, 20 bp, Artificial Sequence
  chemically synthesized
catgcttcctgtacagcctt

SEQ ID NO: 4751 - DNA, 20 bp, Artificial Sequence
  chemically synthesized
tgtacagcctttagaactgt

SEQ ID NO: 4752 - DNA, 20 bp, Artificial Sequence
  chemically synthesized
tctgttcttcaccatttacc

SEQ ID NO: 4753 - DNA, 20 bp, Artificial Sequence
  chemically synthesized
cttcaccatttacccagtct

SEQ ID NO: 4754 - DNA, 20 bp, Artificial Sequence
  chemically synthesized
ttcaccatttacccagtctc

SEQ ID NO: 4755 - DNA, 20 bp, Artificial Sequence
  chemically synthesized
cagtctcaggtatttcctta

SEQ ID NO: 4756 - DNA, 20 bp, Artificial Sequence
  chemically synthesized
ctcaggtatttccttatagc

SEQ ID NO: 4757 - DNA, 20 bp, Artificial Sequence
  chemically synthesized
gtatttccttatagcaagat

SEQ ID NO: 4758 - DNA, 20 bp, Artificial Sequence
  chemically synthesized
tccttatagcaagatgagaa

SEQ ID NO: 4759 - DNA, 20 bp, Artificial Sequence
  chemically synthesized
atagcaagatgagaatggac

SEQ ID NO: 4760 - DNA, 20 bp, Artificial Sequence
  chemically synthesized
aagatgagaatggaccagta

SEQ ID NO: 4761 - DNA, 20 bp, Artificial Sequence
  chemically synthesized
aatggaccagtacagaaaat

SEQ ID NO: 4762 - DNA, 20 bp, Artificial Sequence
  chemically synthesized
gtacagaaaattggtaccaa

SEQ ID NO: 4763 - DNA, 20 bp, Artificial Sequence
  chemically synthesized
cagaaaattggtaccaaaag

SEQ ID NO: 4764 - DNA, 20 bp, Artificial Sequence
  chemically synthesized
agaaaattggtaccaaaagt

SEQ ID NO: 4765 - DNA, 20 bp, Artificial Sequence
  chemically synthesized
gaaaattggtaccaaaagtg

SEQ ID NO: 4766 - DNA, 20 bp, Artificial Sequence
  chemically synthesized
aaaagtggggtactgctata

SEQ ID NO: 4767 - DNA, 20 bp, Artificial Sequence
  chemically synthesized
tataaagatacatgaaaatg

SEQ ID NO: 4768 - DNA, 20 bp, Artificial Sequence
  chemically synthesized
aaagatacatgaaaatgtgg

SEQ ID NO: 4769 - DNA, 20 bp, Artificial Sequence
  chemically synthesized
tgaaaatgtggaagcaactt

SEQ ID NO: 4770 - DNA, 20 bp, Artificial Sequence
  chemically synthesized
tgtggaagcaactttggcat

SEQ ID NO: 4771 - DNA, 20 bp, Artificial Sequence
  chemically synthesized
gcaactttggcattggataa

SEQ ID NO: 4772 - DNA, 20 bp, Artificial Sequence
  chemically synthesized
caactttggcattggataac

SEQ ID NO: 4773 - DNA, 20 bp, Artificial Sequence
  chemically synthesized
ctttggcattggataacagg

SEQ ID NO: 4774 - DNA, 20 bp, Artificial Sequence
  chemically synthesized
tggcattggataacaggcag

SEQ ID NO: 4775 - DNA, 20 bp, Artificial Sequence
  chemically synthesized
attggataacaggcagaagt

SEQ ID NO: 4776 - DNA, 20 bp, Artificial Sequence
  chemically synthesized
ggataacaggcagaagttgg

SEQ ID NO: 4777 - DNA, 20 bp, Artificial Sequence
  chemically synthesized
ataacaggcagaagttggaa

SEQ ID NO: 4778 - DNA, 20 bp, Artificial Sequence
  chemically synthesized
aggcagaagttggaagagtg

SEQ ID NO: 4779 - DNA, 20 bp, Artificial Sequence
  chemically synthesized
agaagttggaagagtgtgga

SEQ ID NO: 4780 - DNA, 20 bp, Artificial Sequence
  chemically synthesized
ttggaagagtgtggacggct

SEQ ID NO: 4781 - DNA, 20 bp, Artificial Sequence
  chemically synthesized
gaagagtgtggacggctcag

SEQ ID NO: 4782 - DNA, 20 bp, Artificial Sequence
  chemically synthesized
gagtgtggacggctcagaag

SEQ ID NO: 4783 - DNA, 20 bp, Artificial Sequence
  chemically synthesized
gtggacggctcagaagaaga

SEQ ID NO: 4784 - DNA, 20 bp, Artificial Sequence
  chemically synthesized
tggacggctcagaagaagac

SEQ ID NO: 4785 - DNA, 20 bp, Artificial Sequence
  chemically synthesized
ggacggctcagaagaagaca

SEQ ID NO: 4786 - DNA, 20 bp, Artificial Sequence
  chemically synthesized
acggctcagaagaagacagg

SEQ ID NO: 4787 - DNA, 20 bp, Artificial Sequence
  chemically synthesized
tcagaagaagacagggagat

SEQ ID NO: 4788 - DNA, 20 bp, Artificial Sequence
  chemically synthesized
cagaagaagacagggagatg

SEQ ID NO: 4789 - DNA, 20 bp, Artificial Sequence
  chemically synthesized
agaagaagacagggagatga

SEQ ID NO: 4790 - DNA, 20 bp, Artificial Sequence
  chemically synthesized
aagaagacagggagatgagg

SEQ ID NO: 4791 - DNA, 20 bp, Artificial Sequence
  chemically synthesized
cagggagatgagggagaatt

SEQ ID NO: 4792 - DNA, 20 bp, Artificial Sequence
  chemically synthesized
agggagaatttggaactttc

SEQ ID NO: 4793 - DNA, 20 bp, Artificial Sequence
  chemically synthesized
ggagaatttggaactttcta

SEQ ID NO: 4794 - DNA, 20 bp, Artificial Sequence
  chemically synthesized
tggaactttctagagacttg

SEQ ID NO: 4795 - DNA, 20 bp, Artificial Sequence
  chemically synthesized
ctttctagagacttgtggaa

SEQ ID NO: 4796 - DNA, 20 bp, Artificial Sequence
  chemically synthesized
ggttgtgaccaaaattctga

SEQ ID NO: 4797 - DNA, 20 bp, Artificial Sequence
  chemically synthesized
ccaaaattctgatagtgata

SEQ ID NO: 4798 - DNA, 20 bp, Artificial Sequence
  chemically synthesized
tgatagtgatatggacaatg

SEQ ID NO: 4799 - DNA, 20 bp, Artificial Sequence
  chemically synthesized
gtgatatggacaatgaagtc

SEQ ID NO: 4800 - DNA, 20 bp, Artificial Sequence
  chemically synthesized
tgatatggacaatgaagtcc

SEQ ID NO: 4801 - DNA, 20 bp, Artificial Sequence
  chemically synthesized
tggacaatgaagtccaggct

SEQ ID NO: 4802 - DNA, 20 bp, Artificial Sequence
  chemically synthesized
ggacaatgaagtccaggctg

SEQ ID NO: 4803 - DNA, 20 bp, Artificial Sequence
  chemically synthesized
caatgaagtccaggctgagg

SEQ ID NO: 4804 - DNA, 20 bp, Artificial Sequence
  chemically synthesized
agtccaggctgaggtggtct

SEQ ID NO: 4805 - DNA, 20 bp, Artificial Sequence
  chemically synthesized
caggctgaggtggtctcaga

SEQ ID NO: 4806 - DNA, 20 bp, Artificial Sequence
  chemically synthesized
tcagatggaaatgaatttat

SEQ ID NO: 4807 - DNA, 20 bp, Artificial Sequence
  chemically synthesized
gaaatgaatttattggaaac

SEQ ID NO: 4808 - DNA, 20 bp, Artificial Sequence
  chemically synthesized
aatgaatttattggaaactg

SEQ ID NO: 4809 - DNA, 20 bp, Artificial Sequence
  chemically synthesized
atttattggaaactggagca

SEQ ID NO: 4810 - DNA, 20 bp, Artificial Sequence
  chemically synthesized
tttattggaaactggagcaa

SEQ ID NO: 4811 - DNA, 20 bp, Artificial Sequence
  chemically synthesized
aggtcacttttgttatacat

SEQ ID NO: 4812 - DNA, 20 bp, Artificial Sequence
  chemically synthesized
acttttgttatacattagca

SEQ ID NO: 4813 - DNA, 20 bp, Artificial Sequence
  chemically synthesized
ttttgttatacattagcaaa

SEQ ID NO: 4814 - DNA, 20 bp, Artificial Sequence
  chemically synthesized
tttgttatacattagcaaag

SEQ ID NO: 4815 - DNA, 20 bp, Artificial Sequence
  chemically synthesized
actgcactgtgcctctacct

SEQ ID NO: 4816 - DNA, 20 bp, Artificial Sequence
  chemically synthesized
tgcactgtgcctctacctta

SEQ ID NO: 4817 - DNA, 20 bp, Artificial Sequence
  chemically synthesized
cctctaccttagagaatctg

SEQ ID NO: 4818 - DNA, 20 bp, Artificial Sequence
  chemically synthesized
agagaatctgtggaaattcg

SEQ ID NO: 4819 - DNA, 20 bp, Artificial Sequence
  chemically synthesized
cgaagttgataatattattt

SEQ ID NO: 4820 - DNA, 20 bp, Artificial Sequence
  chemically synthesized
atattatttaagttatgtga

SEQ ID NO: 4821 - DNA, 20 bp, Artificial Sequence
  chemically synthesized
ttatttaagttatgtgacag

SEQ ID NO: 4822 - DNA, 20 bp, Artificial Sequence
  chemically synthesized
gttatgtgacagaagtttct

SEQ ID NO: 4823 - DNA, 20 bp, Artificial Sequence
  chemically synthesized
atgtgacagaagtttctaag

SEQ ID NO: 4824 - DNA, 20 bp, Artificial Sequence
  chemically synthesized
gacagaagtttctaagcagc

SEQ ID NO: 4825 - DNA, 20 bp, Artificial Sequence
  chemically synthesized
acagaagtttctaagcagca

SEQ ID NO: 4826 - DNA, 20 bp, Artificial Sequence
  chemically synthesized
ttctaagcagcaaggtgttc

SEQ ID NO: 4827 - DNA, 20 bp, Artificial Sequence
  chemically synthesized
aaggtgttcaagatgtgtcc

SEQ ID NO: 4828 - DNA, 20 bp, Artificial Sequence
  chemically synthesized
caacctatgctcatatgtgt

SEQ ID NO: 4829 - DNA, 20 bp, Artificial Sequence
  chemically synthesized
tatgctcatatgtgtgagca

SEQ ID NO: 4830 - DNA, 20 bp, Artificial Sequence
  chemically synthesized
gcaaagaaataacataaaat

SEQ ID NO: 4831 - DNA, 20 bp, Artificial Sequence
  chemically synthesized
aaatcagaacttatatttaa

SEQ ID NO: 4832 - DNA, 20 bp, Artificial Sequence
  chemically synthesized
aatcagaacttatatttaaa

SEQ ID NO: 4833 - DNA, 20 bp, Artificial Sequence
  chemically synthesized
atcagaacttatatttaaaa

SEQ ID NO: 4834 - DNA, 20 bp, Artificial Sequence
  chemically synthesized
agaacttatatttaaaaggg

SEQ ID NO: 4835 - DNA, 20 bp, Artificial Sequence
  chemically synthesized
acttatatttaaaagggaag

SEQ ID NO: 4836 - DNA, 20 bp, Artificial Sequence
  chemically synthesized
ttatatttaaaagggaagca

SEQ ID NO: 4837 - DNA, 20 bp, Artificial Sequence
  chemically synthesized
aaaagggaagcagagcataa

SEQ ID NO: 4838 - DNA, 20 bp, Artificial Sequence
  chemically synthesized
ggaagcagagcataaaagtt

SEQ ID NO: 4839 - DNA, 20 bp, Artificial Sequence
  chemically synthesized
agtttggaaaattatctgct

SEQ ID NO: 4840 - DNA, 20 bp, Artificial Sequence
  chemically synthesized
aaattatctgctcggccatg

SEQ ID NO: 4841 - DNA, 20 bp, Artificial Sequence
  chemically synthesized
ttatctgctcggccatgtgg

SEQ ID NO: 4842 - DNA, 20 bp, Artificial Sequence
  chemically synthesized
ctcggccatgtggtagaaaa

SEQ ID NO: 4843 - DNA, 20 bp, Artificial Sequence
  chemically synthesized
ggccatgtggtagaaaacag

SEQ ID NO: 4844 - DNA, 20 bp, Artificial Sequence
  chemically synthesized
aaaacagaagctcattttca

SEQ ID NO: 4845 - DNA, 20 bp, Artificial Sequence
  chemically synthesized
aaacagaagctcattttcaa

SEQ ID NO: 4846 - DNA, 20 bp, Artificial Sequence
  chemically synthesized
acagaagctcattttcaaag

SEQ ID NO: 4847 - DNA, 20 bp, Artificial Sequence
  chemically synthesized
cattttcaaaggagcaattc

SEQ ID NO: 4848 - DNA, 20 bp, Artificial Sequence
  chemically synthesized
tttcaaaggagcaattcaag

SEQ ID NO: 4849 - DNA, 20 bp, Artificial Sequence
  chemically synthesized
ttcaaaggagcaattcaagc

SEQ ID NO: 4850 - DNA, 20 bp, Artificial Sequence
  chemically synthesized
ggagcaattcaagcaggctg

SEQ ID NO: 4851 - DNA, 20 bp, Artificial Sequence
  chemically synthesized
tgtagaaatttgcataaatg

SEQ ID NO: 4852 - DNA, 20 bp, Artificial Sequence
  chemically synthesized
tagaaatttgcataaatgaa

SEQ ID NO: 4853 - DNA, 20 bp, Artificial Sequence
  chemically synthesized
agaaatttgcataaatgaag

SEQ ID NO: 4854 - DNA, 20 bp, Artificial Sequence
  chemically synthesized
aaatttgcataaatgaagag

SEQ ID NO: 4855 - DNA, 20 bp, Artificial Sequence
  chemically synthesized
tgcataaatgaagaggagcc

SEQ ID NO: 4856 - DNA, 20 bp, Artificial Sequence
  chemically synthesized
gaagaggagccgagttctaa

SEQ ID NO: 4857 - DNA, 20 bp, Artificial Sequence
  chemically synthesized
gagttctaatagccaaaata

SEQ ID NO: 4858 - DNA, 20 bp, Artificial Sequence
  chemically synthesized
agttctaatagccaaaataa

SEQ ID NO: 4859 - DNA, 20 bp, Artificial Sequence
  chemically synthesized
gttctaatagccaaaataaa

SEQ ID NO: 4860 - DNA, 20 bp, Artificial Sequence
  chemically synthesized
ttctaatagccaaaataaag

SEQ ID NO: 4861 - DNA, 20 bp, Artificial Sequence
  chemically synthesized
ctaatagccaaaataaaggg

SEQ ID NO: 4862 - DNA, 20 bp, Artificial Sequence
  chemically synthesized
ataaaggggagaatgcctca

SEQ ID NO: 4863 - DNA, 20 bp, Artificial Sequence
  chemically synthesized
agaatgcctcaaagacattt

SEQ ID NO: 4864 - DNA, 20 bp, Artificial Sequence
  chemically synthesized
aatgcctcaaagacatttca

SEQ ID NO: 4865 - DNA, 20 bp, Artificial Sequence
  chemically synthesized
agacatttcagagacccttg

SEQ ID NO: 4866 - DNA, 20 bp, Artificial Sequence
  chemically synthesized
catttcagagacccttgtag

SEQ ID NO: 4867 - DNA, 20 bp, Artificial Sequence
  chemically synthesized
tgtagcagcccctcacatca

SEQ ID NO: 4868 - DNA, 20 bp, Artificial Sequence
  chemically synthesized
gtagcagcccctcacatcac

SEQ ID NO: 4869 - DNA, 20 bp, Artificial Sequence
  chemically synthesized
agcccctcacatcacaggcc

SEQ ID NO: 4870 - DNA, 20 bp, Artificial Sequence
  chemically synthesized
ccctcacatcacaggcctgg

SEQ ID NO: 4871 - DNA, 20 bp, Artificial Sequence
  chemically synthesized
acatcacaggcctggtggcc

SEQ ID NO: 4872 - DNA, 20 bp, Artificial Sequence
  chemically synthesized
catcacaggcctggtggcct

SEQ ID NO: 4873 - DNA, 20 bp, Artificial Sequence
  chemically synthesized
tcacaggcctggtggcctag

SEQ ID NO: 4874 - DNA, 20 bp, Artificial Sequence
  chemically synthesized
aggagtactgaatgattttg

SEQ ID NO: 4875 - DNA, 20 bp, Artificial Sequence
  chemically synthesized
ggagtactgaatgattttgt

SEQ ID NO: 4876 - DNA, 20 bp, Artificial Sequence
  chemically synthesized
tactgaatgattttgtgggt

SEQ ID NO: 4877 - DNA, 20 bp, Artificial Sequence
  chemically synthesized
atgattttgtgggtgagatt

SEQ ID NO: 4878 - DNA, 20 bp, Artificial Sequence
  chemically synthesized
tgattttgtgggtgagattc

SEQ ID NO: 4879 - DNA, 20 bp, Artificial Sequence
  chemically synthesized
attcaggaccctgctgcctt

SEQ ID NO: 4880 - DNA, 20 bp, Artificial Sequence
  chemically synthesized
caggaccctgctgccttgag

SEQ ID NO: 4881 - DNA, 20 bp, Artificial Sequence
  chemically synthesized
cctgctgccttgagcagctt

SEQ ID NO: 4882 - DNA, 20 bp, Artificial Sequence
  chemically synthesized
ctgctgccttgagcagcttc

SEQ ID NO: 4883 - DNA, 20 bp, Artificial Sequence
  chemically synthesized
ggacactgttccttgcatcc

SEQ ID NO: 4884 - DNA, 20 bp, Artificial Sequence
  chemically synthesized
tccttgcatcctggctgctc

SEQ ID NO: 4885 - DNA, 20 bp, Artificial Sequence
  chemically synthesized
catcctggctgctccagcac

SEQ ID NO: 4886 - DNA, 20 bp, Artificial Sequence
  chemically synthesized
ggctgctccagcaccagctg

SEQ ID NO: 4887 - DNA, 20 bp, Artificial Sequence
  chemically synthesized
ccagcaccagctgtggctca

SEQ ID NO: 4888 - DNA, 20 bp, Artificial Sequence
  chemically synthesized
cagcaccagctgtggctcaa

SEQ ID NO: 4889 - DNA, 20 bp, Artificial Sequence
  chemically synthesized
agcaccagctgtggctcaaa

SEQ ID NO: 4890 - DNA, 20 bp, Artificial Sequence
  chemically synthesized
gcaccagctgtggctcaaag

SEQ ID NO: 4891 - DNA, 20 bp, Artificial Sequence
  chemically synthesized
gctgtggctcaaaggggccc

SEQ ID NO: 4892 - DNA, 20 bp, Artificial Sequence
  chemically synthesized
ggctcaaaggggcccaagaa

SEQ ID NO: 4893 - DNA, 20 bp, Artificial Sequence
  chemically synthesized
aaaggggcccaagaacagct

SEQ ID NO: 4894 - DNA, 20 bp, Artificial Sequence
  chemically synthesized
aaggggcccaagaacagcta

SEQ ID NO: 4895 - DNA, 20 bp, Artificial Sequence
  chemically synthesized
aacagctaaggccactgctt

SEQ ID NO: 4896 - DNA, 20 bp, Artificial Sequence
  chemically synthesized
cagctaaggccactgcttca

SEQ ID NO: 4897 - DNA, 20 bp, Artificial Sequence
  chemically synthesized
agctaaggccactgcttcag

SEQ ID NO: 4898 - DNA, 20 bp, Artificial Sequence
  chemically synthesized
gctaaggccactgcttcaga

SEQ ID NO: 4899 - DNA, 20 bp, Artificial Sequence
  chemically synthesized
gccactgcttcagagggtgc

SEQ ID NO: 4900 - DNA, 20 bp, Artificial Sequence
  chemically synthesized
cttcagagggtgcaagacat

SEQ ID NO: 4901 - DNA, 20 bp, Artificial Sequence
  chemically synthesized
agggtgcaagacataagcct

SEQ ID NO: 4902 - DNA, 20 bp, Artificial Sequence
  chemically synthesized
ggtgcaagacataagccttg

SEQ ID NO: 4903 - DNA, 20 bp, Artificial Sequence
  chemically synthesized
gtgcaagacataagccttgg

SEQ ID NO: 4904 - DNA, 20 bp, Artificial Sequence
  chemically synthesized
aagccttggaggcttccaca

SEQ ID NO: 4905 - DNA, 20 bp, Artificial Sequence
  chemically synthesized
cttccacatggtgataaatc

SEQ ID NO: 4906 - DNA, 20 bp, Artificial Sequence
  chemically synthesized
ttccacatggtgataaatct

SEQ ID NO: 4907 - DNA, 20 bp, Artificial Sequence
  chemically synthesized
ccacatggtgataaatctgg

SEQ ID NO: 4908 - DNA, 20 bp, Artificial Sequence
  chemically synthesized
gataaatctgggagtgtgca

SEQ ID NO: 4909 - DNA, 20 bp, Artificial Sequence
  chemically synthesized
ataaatctgggagtgtgcaa

SEQ ID NO: 4910 - DNA, 20 bp, Artificial Sequence
  chemically synthesized
gggagtgtgcaaaggtcaaa

SEQ ID NO: 4911 - DNA, 20 bp, Artificial Sequence
  chemically synthesized
tgtgcaaaggtcaaaaagtt

SEQ ID NO: 4912 - DNA, 20 bp, Artificial Sequence
  chemically synthesized
gtgcaaaggtcaaaaagttg

SEQ ID NO: 4913 - DNA, 20 bp, Artificial Sequence
  chemically synthesized
gtcaaaaagttgaggcttgt

SEQ ID NO: 4914 - DNA, 20 bp, Artificial Sequence
  chemically synthesized
gaggcttgtaagcctccacc

SEQ ID NO: 4915 - DNA, 20 bp, Artificial Sequence
  chemically synthesized
gtaagcctccacctagattt

SEQ ID NO: 4916 - DNA, 20 bp, Artificial Sequence
  chemically synthesized
aagcctccacctagatttca

SEQ ID NO: 4917 - DNA, 20 bp, Artificial Sequence
  chemically synthesized
agcctccacctagatttcag

SEQ ID NO: 4918 - DNA, 20 bp, Artificial Sequence
  chemically synthesized
cctagatttcagaggatgtg

SEQ ID NO: 4919 - DNA, 20 bp, Artificial Sequence
  chemically synthesized
atttcagaggatgtgtagaa

SEQ ID NO: 4920 - DNA, 20 bp, Artificial Sequence
  chemically synthesized
gaggatgtgtagaaaagcct

SEQ ID NO: 4921 - DNA, 20 bp, Artificial Sequence
  chemically synthesized
tgtagaaaagcctgagtgtt

SEQ ID NO: 4922 - DNA, 20 bp, Artificial Sequence
  chemically synthesized
gtagaaaagcctgagtgttc

SEQ ID NO: 4923 - DNA, 20 bp, Artificial Sequence
  chemically synthesized
gaaaagcctgagtgttcagg

SEQ ID NO: 4924 - DNA, 20 bp, Artificial Sequence
  chemically synthesized
aagcctgagtgttcaggcag

SEQ ID NO: 4925 - DNA, 20 bp, Artificial Sequence
  chemically synthesized
gttcaggcagaagcctcctg

SEQ ID NO: 4926 - DNA, 20 bp, Artificial Sequence
  chemically synthesized
ttcaggcagaagcctcctgc

SEQ ID NO: 4927 - DNA, 20 bp, Artificial Sequence
  chemically synthesized
tcaggcagaagcctcctgca

SEQ ID NO: 4928 - DNA, 20 bp, Artificial Sequence
  chemically synthesized
caggcagaagcctcctgcag

SEQ ID NO: 4929 - DNA, 20 bp, Artificial Sequence
  chemically synthesized
gcagaagcctcctgcagggg

SEQ ID NO: 4930 - DNA, 20 bp, Artificial Sequence
  chemically synthesized
gcaggggcagaaccctcatg

SEQ ID NO: 4931 - DNA, 20 bp, Artificial Sequence
  chemically synthesized
ccctcatgaagaacctctaa

SEQ ID NO: 4932 - DNA, 20 bp, Artificial Sequence
  chemically synthesized
cctcatgaagaacctctaat

SEQ ID NO: 4933 - DNA, 20 bp, Artificial Sequence
  chemically synthesized
ctcatgaagaacctctaata

SEQ ID NO: 4934 - DNA, 20 bp, Artificial Sequence
  chemically synthesized
gaacctctaatagggcaatg

SEQ ID NO: 4935 - DNA, 20 bp, Artificial Sequence
  chemically synthesized
acctctaatagggcaatgtg

SEQ ID NO: 4936 - DNA, 20 bp, Artificial Sequence
  chemically synthesized
cctctaatagggcaatgtgg

SEQ ID NO: 4937 - DNA, 20 bp, Artificial Sequence
  chemically synthesized
gcaatgtggaggaaaaatat

SEQ ID NO: 4938 - DNA, 20 bp, Artificial Sequence
  chemically synthesized
caatgtggaggaaaaatatg

SEQ ID NO: 4939 - DNA, 20 bp, Artificial Sequence
  chemically synthesized
gtggaggaaaaatatgaggt

SEQ ID NO: 4940 - DNA, 20 bp, Artificial Sequence
  chemically synthesized
atgaggttggaaccccctca

SEQ ID NO: 4941 - DNA, 20 bp, Artificial Sequence
  chemically synthesized
gaggttggaaccccctcaca

SEQ ID NO: 4942 - DNA, 20 bp, Artificial Sequence
  chemically synthesized
ccccctcacagagtctccac

SEQ ID NO: 4943 - DNA, 20 bp, Artificial Sequence
  chemically synthesized
cccctcacagagtctccact

SEQ ID NO: 4944 - DNA, 20 bp, Artificial Sequence
  chemically synthesized
ccctcacagagtctccactg

SEQ ID NO: 4945 - DNA, 20 bp, Artificial Sequence
  chemically synthesized
gtctccactggggcactgcc

SEQ ID NO: 4946 - DNA, 20 bp, Artificial Sequence
  chemically synthesized
tccactggggcactgcctag

SEQ ID NO: 4947 - DNA, 20 bp, Artificial Sequence
  chemically synthesized
cactggggcactgcctagca

SEQ ID NO: 4948 - DNA, 20 bp, Artificial Sequence
  chemically synthesized
gcactgcctagcagagctat

SEQ ID NO: 4949 - DNA, 20 bp, Artificial Sequence
  chemically synthesized
gcctagcagagctatgagaa

SEQ ID NO: 4950 - DNA, 20 bp, Artificial Sequence
  chemically synthesized
cctagcagagctatgagaaa

SEQ ID NO: 4951 - DNA, 20 bp, Artificial Sequence
  chemically synthesized
ctagcagagctatgagaaaa

SEQ ID NO: 4952 - DNA, 20 bp, Artificial Sequence
  chemically synthesized
agaaaagggccaccgtcctc

SEQ ID NO: 4953 - DNA, 20 bp, Artificial Sequence
  chemically synthesized
ggccaccgtcctccagaccc

SEQ ID NO: 4954 - DNA, 20 bp, Artificial Sequence
  chemically synthesized
ccgtcctccagaccccagaa

SEQ ID NO: 4955 - DNA, 20 bp, Artificial Sequence
  chemically synthesized
tcctccagaccccagaatgg

SEQ ID NO: 4956 - DNA, 20 bp, Artificial Sequence
  chemically synthesized
cagaatggtagatccactga

SEQ ID NO: 4957 - DNA, 20 bp, Artificial Sequence
  chemically synthesized
gacagtttgcaccgtgcacc

SEQ ID NO: 4958 - DNA, 20 bp, Artificial Sequence
  chemically synthesized
tttgcaccgtgcacctagaa

SEQ ID NO: 4959 - DNA, 20 bp, Artificial Sequence
  chemically synthesized
aacactcaatacaatctctt

SEQ ID NO: 4960 - DNA, 20 bp, Artificial Sequence
  chemically synthesized
cactcaatacaatctcttaa

SEQ ID NO: 4961 - DNA, 20 bp, Artificial Sequence
  chemically synthesized
tcaatacaatctcttaagag

SEQ ID NO: 4962 - DNA, 20 bp, Artificial Sequence
  chemically synthesized
atacaatctcttaagagcag

SEQ ID NO: 4963 - DNA, 20 bp, Artificial Sequence
  chemically synthesized
caatctcttaagagcagcag

SEQ ID NO: 4964 - DNA, 20 bp, Artificial Sequence
  chemically synthesized
aatctcttaagagcagcagc

SEQ ID NO: 4965 - DNA, 20 bp, Artificial Sequence
  chemically synthesized
atctcttaagagcagcagca

SEQ ID NO: 4966 - DNA, 20 bp, Artificial Sequence
  chemically synthesized
tctcttaagagcagcagcag

SEQ ID NO: 4967 - DNA, 20 bp, Artificial Sequence
  chemically synthesized
agcaggggctaaactgtgca

SEQ ID NO: 4968 - DNA, 20 bp, Artificial Sequence
  chemically synthesized
ggctaaactgtgcaaagcaa

SEQ ID NO: 4969 - DNA, 20 bp, Artificial Sequence
  chemically synthesized
gctaaactgtgcaaagcaat

SEQ ID NO: 4970 - DNA, 20 bp, Artificial Sequence
  chemically synthesized
ctaaactgtgcaaagcaata

SEQ ID NO: 4971 - DNA, 20 bp, Artificial Sequence
  chemically synthesized
taaactgtgcaaagcaatag

SEQ ID NO: 4972 - DNA, 20 bp, Artificial Sequence
  chemically synthesized
actgtgcaaagcaatagggg

SEQ ID NO: 4973 - DNA, 20 bp, Artificial Sequence
  chemically synthesized
caataggggtggaactgccc

SEQ ID NO: 4974 - DNA, 20 bp, Artificial Sequence
  chemically synthesized
aataggggtggaactgccca

SEQ ID NO: 4975 - DNA, 20 bp, Artificial Sequence
  chemically synthesized
ggtggaactgcccaaggcct

SEQ ID NO: 4976 - DNA, 20 bp, Artificial Sequence
  chemically synthesized
gtggaactgcccaaggcctt

SEQ ID NO: 4977 - DNA, 20 bp, Artificial Sequence
  chemically synthesized
ggaactgcccaaggccttgg

SEQ ID NO: 4978 - DNA, 20 bp, Artificial Sequence
  chemically synthesized
tgggagcccacctcttgcat

SEQ ID NO: 4979 - DNA, 20 bp, Artificial Sequence
  chemically synthesized
catcagtgtgtccctgatat

SEQ ID NO: 4980 - DNA, 20 bp, Artificial Sequence
  chemically synthesized
tgtgtccctgatatgagaca

SEQ ID NO: 4981 - DNA, 20 bp, Artificial Sequence
  chemically synthesized
gtgtccctgatatgagacat

SEQ ID NO: 4982 - DNA, 20 bp, Artificial Sequence
  chemically synthesized
tgtccctgatatgagacatg

SEQ ID NO: 4983 - DNA, 20 bp, Artificial Sequence
  chemically synthesized
tgatatgagacatggggtca

SEQ ID NO: 4984 - DNA, 20 bp, Artificial Sequence
  chemically synthesized
gatatgagacatggggtcaa

SEQ ID NO: 4985 - DNA, 20 bp, Artificial Sequence
  chemically synthesized
tatgagacatggggtcaaag

SEQ ID NO: 4986 - DNA, 20 bp, Artificial Sequence
  chemically synthesized
ggggtcaaaggagattattt

SEQ ID NO: 4987 - DNA, 20 bp, Artificial Sequence
  chemically synthesized
ggtcaaaggagattattttg

SEQ ID NO: 4988 - DNA, 20 bp, Artificial Sequence
  chemically synthesized
ggagattattttggagtgtt

SEQ ID NO: 4989 - DNA, 20 bp, Artificial Sequence
  chemically synthesized
gagattattttggagtgtta

SEQ ID NO: 4990 - DNA, 20 bp, Artificial Sequence
  chemically synthesized
gtccgttttaaactgctatg

SEQ ID NO: 4991 - DNA, 20 bp, Artificial Sequence
  chemically synthesized
actgctatgaagaaataccc

SEQ ID NO: 4992 - DNA, 20 bp, Artificial Sequence
  chemically synthesized
tatgaagaaatacccgagac

SEQ ID NO: 4993 - DNA, 20 bp, Artificial Sequence
  chemically synthesized
atgaagaaatacccgagact

SEQ ID NO: 4994 - DNA, 20 bp, Artificial Sequence
  chemically synthesized
ccgagactgggtaatttata

SEQ ID NO: 4995 - DNA, 20 bp, Artificial Sequence
  chemically synthesized
ctgggtaatttataaagaaa

SEQ ID NO: 4996 - DNA, 20 bp, Artificial Sequence
  chemically synthesized
gggtaatttataaagaaaaa

SEQ ID NO: 4997 - DNA, 20 bp, Artificial Sequence
  chemically synthesized
ataaagaaaaagagatttaa

SEQ ID NO: 4998 - DNA, 20 bp, Artificial Sequence
  chemically synthesized
aaagagatttaatggactca

SEQ ID NO: 4999 - DNA, 20 bp, Artificial Sequence
  chemically synthesized
gactcatagatccacattgc

SEQ ID NO: 5000 - DNA, 20 bp, Artificial Sequence
  chemically synthesized
actcatagatccacattgct

SEQ ID NO: 5001 - DNA, 20 bp, Artificial Sequence
  chemically synthesized
ctcatagatccacattgctg

SEQ ID NO: 5002 - DNA, 20 bp, Artificial Sequence
  chemically synthesized
catagatccacattgctggg

SEQ ID NO: 5003 - DNA, 20 bp, Artificial Sequence
  chemically synthesized
atagatccacattgctgggg

SEQ ID NO: 5004 - DNA, 20 bp, Artificial Sequence
  chemically synthesized
ctggggaggccttacaatca

SEQ ID NO: 5005 - DNA, 20 bp, Artificial Sequence
  chemically synthesized
gggaggccttacaatcatgg

SEQ ID NO: 5006 - DNA, 20 bp, Artificial Sequence
  chemically synthesized
aggccttacaatcatggtgg

SEQ ID NO: 5007 - DNA, 20 bp, Artificial Sequence
  chemically synthesized
ggccttacaatcatggtgga

SEQ ID NO: 5008 - DNA, 20 bp, Artificial Sequence
  chemically synthesized
tacaatcatggtggaaggtg

SEQ ID NO: 5009 - DNA, 20 bp, Artificial Sequence
  chemically synthesized
acaatcatggtggaaggtga

SEQ ID NO: 5010 - DNA, 20 bp, Artificial Sequence
  chemically synthesized
aatcatggtggaaggtgaag

SEQ ID NO: 5011 - DNA, 20 bp, Artificial Sequence
  chemically synthesized
atcatggtggaaggtgaagg

SEQ ID NO: 5012 - DNA, 20 bp, Artificial Sequence
  chemically synthesized
catggtggaaggtgaaggag

SEQ ID NO: 5013 - DNA, 20 bp, Artificial Sequence
  chemically synthesized
tggaaggtgaaggaggagca

SEQ ID NO: 5014 - DNA, 20 bp, Artificial Sequence
  chemically synthesized
gagcaaagtcacatctgaca

SEQ ID NO: 5015 - DNA, 20 bp, Artificial Sequence
  chemically synthesized
caaagtcacatctgacatgg

SEQ ID NO: 5016 - DNA, 20 bp, Artificial Sequence
  chemically synthesized
agtcacatctgacatggtgg

SEQ ID NO: 5017 - DNA, 20 bp, Artificial Sequence
  chemically synthesized
gtcacatctgacatggtggc

SEQ ID NO: 5018 - DNA, 20 bp, Artificial Sequence
  chemically synthesized
catctgacatggtggcaggc

SEQ ID NO: 5019 - DNA, 20 bp, Artificial Sequence
  chemically synthesized
tctgacatggtggcaggcaa

SEQ ID NO: 5020 - DNA, 20 bp, Artificial Sequence
  chemically synthesized
tgacatggtggcaggcaaga

SEQ ID NO: 5021 - DNA, 20 bp, Artificial Sequence
  chemically synthesized
gcaggcaagagagcatgtgc

SEQ ID NO: 5022 - DNA, 20 bp, Artificial Sequence
  chemically synthesized
caggcaagagagcatgtgca

SEQ ID NO: 5023 - DNA, 20 bp, Artificial Sequence
  chemically synthesized
aggcaagagagcatgtgcaa

SEQ ID NO: 5024 - DNA, 20 bp, Artificial Sequence
  chemically synthesized
aatgccctttataaaaccat

SEQ ID NO: 5025 - DNA, 20 bp, Artificial Sequence
  chemically synthesized
ataaaaccatcagatcttgt

SEQ ID NO: 5026 - DNA, 20 bp, Artificial Sequence
  chemically synthesized
tgagacttactcactatcat

SEQ ID NO: 5027 - DNA, 20 bp, Artificial Sequence
  chemically synthesized
cttactcactatcatgagaa

SEQ ID NO: 5028 - DNA, 20 bp, Artificial Sequence
  chemically synthesized
cccatgattcaattacatcc

SEQ ID NO: 5029 - DNA, 20 bp, Artificial Sequence
  chemically synthesized
ccagtgtgttccttccatga

SEQ ID NO: 5030 - DNA, 20 bp, Artificial Sequence
  chemically synthesized
cagtgtgttccttccatgac

SEQ ID NO: 5031 - DNA, 20 bp, Artificial Sequence
  chemically synthesized
tgtgttccttccatgacagg

SEQ ID NO: 5032 - DNA, 20 bp, Artificial Sequence
  chemically synthesized
gtgttccttccatgacaggc

SEQ ID NO: 5033 - DNA, 20 bp, Artificial Sequence
  chemically synthesized
tgttccttccatgacaggca

SEQ ID NO: 5034 - DNA, 20 bp, Artificial Sequence
  chemically synthesized
tccatgacaggcagggatta

SEQ ID NO: 5035 - DNA, 20 bp, Artificial Sequence
  chemically synthesized
ccatgacaggcagggattat

SEQ ID NO: 5036 - DNA, 20 bp, Artificial Sequence
  chemically synthesized
gattatgggacctactattc

SEQ ID NO: 5037 - DNA, 20 bp, Artificial Sequence
  chemically synthesized
tatgggacctactattcaag

SEQ ID NO: 5038 - DNA, 20 bp, Artificial Sequence
  chemically synthesized
ctactattcaagaagaaatt

SEQ ID NO: 5039 - DNA, 20 bp, Artificial Sequence
  chemically synthesized
tactattcaagaagaaattt

SEQ ID NO: 5040 - DNA, 20 bp, Artificial Sequence
  chemically synthesized
tattcaagaagaaatttggg

SEQ ID NO: 5041 - DNA, 20 bp, Artificial Sequence
  chemically synthesized
attcaagaagaaatttgggt

SEQ ID NO: 5042 - DNA, 20 bp, Artificial Sequence
  chemically synthesized
gaaaactgccaaaccatatc

SEQ ID NO: 5043 - DNA, 20 bp, Artificial Sequence
  chemically synthesized
aaaactgccaaaccatatca

SEQ ID NO: 5044 - DNA, 20 bp, Artificial Sequence
  chemically synthesized
aggtgtaatgactgccctgc

SEQ ID NO: 5045 - DNA, 20 bp, Artificial Sequence
  chemically synthesized
ggtgtaatgactgccctgct

SEQ ID NO: 5046 - DNA, 20 bp, Artificial Sequence
  chemically synthesized
tgctgggttttctactcgtg

SEQ ID NO: 5047 - DNA, 20 bp, Artificial Sequence
  chemically synthesized
gctgggttttctactcgtgt

SEQ ID NO: 5048 - DNA, 20 bp, Artificial Sequence
  chemically synthesized
ttctactcgtgtgggatctt

SEQ ID NO: 5049 - DNA, 20 bp, Artificial Sequence
  chemically synthesized
gatctttagcccctttcttt

SEQ ID NO: 5050 - DNA, 20 bp, Artificial Sequence
  chemically synthesized
tttggtgcatttctctcttt

SEQ ID NO: 5051 - DNA, 20 bp, Artificial Sequence
  chemically synthesized
tgcatttctctcttttggaa

SEQ ID NO: 5052 - DNA, 20 bp, Artificial Sequence
  chemically synthesized
gcatttctctcttttggaat

SEQ ID NO: 5053 - DNA, 20 bp, Artificial Sequence
  chemically synthesized
tgggaatttgtacccaatgc

SEQ ID NO: 5054 - DNA, 20 bp, Artificial Sequence
  chemically synthesized
ccagtacctccattatgtct

SEQ ID NO: 5055 - DNA, 20 bp, Artificial Sequence
  chemically synthesized
gtacctccattatgtcttgg

SEQ ID NO: 5056 - DNA, 20 bp, Artificial Sequence
  chemically synthesized
ctaacttgtttttgatttta

SEQ ID NO: 5057 - DNA, 20 bp, Artificial Sequence
  chemically synthesized
taacttgtttttgattttac

SEQ ID NO: 5058 - DNA, 20 bp, Artificial Sequence
  chemically synthesized
tttttgattttacaggctca

SEQ ID NO: 5059 - DNA, 20 bp, Artificial Sequence
  chemically synthesized
ttttgattttacaggctcat

SEQ ID NO: 5060 - DNA, 20 bp, Artificial Sequence
  chemically synthesized
ttttacaggctcataggttg

SEQ ID NO: 5061 - DNA, 20 bp, Artificial Sequence
  chemically synthesized
tttacaggctcataggttga

SEQ ID NO: 5062 - DNA, 20 bp, Artificial Sequence
  chemically synthesized
ttacaggctcataggttgaa

SEQ ID NO: 5063 - DNA, 20 bp, Artificial Sequence
  chemically synthesized
tgaagggacttgccttgtct

SEQ ID NO: 5064 - DNA, 20 bp, Artificial Sequence
  chemically synthesized
ggacttgccttgtcttggat

SEQ ID NO: 5065 - DNA, 20 bp, Artificial Sequence
  chemically synthesized
ccttgtcttggataagactt

SEQ ID NO: 5066 - DNA, 20 bp, Artificial Sequence
  chemically synthesized
ttggataagactttggactt

SEQ ID NO: 5067 - DNA, 20 bp, Artificial Sequence
  chemically synthesized
actttggactttggactttt

SEQ ID NO: 5068 - DNA, 20 bp, Artificial Sequence
  chemically synthesized
ttggacttttgagttaatgc

SEQ ID NO: 5069 - DNA, 20 bp, Artificial Sequence
  chemically synthesized
ttttgagttaatgctggaat

SEQ ID NO: 5070 - DNA, 20 bp, Artificial Sequence
  chemically synthesized
agttaatgctggaatgagtt

SEQ ID NO: 5071 - DNA, 20 bp, Artificial Sequence
  chemically synthesized
tggaatgagttaagactttg

SEQ ID NO: 5072 - DNA, 20 bp, Artificial Sequence
  chemically synthesized
ggaatgagttaagactttgt

SEQ ID NO: 5073 - DNA, 20 bp, Artificial Sequence
  chemically synthesized
ttaagactttgtaggactgt

SEQ ID NO: 5074 - DNA, 20 bp, Artificial Sequence
  chemically synthesized
taagactttgtaggactgtt

SEQ ID NO: 5075 - DNA, 20 bp, Artificial Sequence
  chemically synthesized
gactttgtaggactgttggg

SEQ ID NO: 5076 - DNA, 20 bp, Artificial Sequence
  chemically synthesized
atgattgtattttgtgatgt

SEQ ID NO: 5077 - DNA, 20 bp, Artificial Sequence
  chemically synthesized
attgtattttgtgatgtgag

SEQ ID NO: 5078 - DNA, 20 bp, Artificial Sequence
  chemically synthesized
ttgtgatgtgagaagaacat

SEQ ID NO: 5079 - DNA, 20 bp, Artificial Sequence
  chemically synthesized
tgtgagaagaacatgagatt

SEQ ID NO: 5080 - DNA, 20 bp, Artificial Sequence
  chemically synthesized
gagaagaacatgagatttgg

SEQ ID NO: 5081 - DNA, 20 bp, Artificial Sequence
  chemically synthesized
agaagaacatgagatttgga

SEQ ID NO: 5082 - DNA, 20 bp, Artificial Sequence
  chemically synthesized
gaagaacatgagatttggaa

SEQ ID NO: 5083 - DNA, 20 bp, Artificial Sequence
  chemically synthesized
aagaacatgagatttggaag

SEQ ID NO: 5084 - DNA, 20 bp, Artificial Sequence
  chemically synthesized
acatgagatttggaaggggc

SEQ ID NO: 5085 - DNA, 20 bp, Artificial Sequence
  chemically synthesized
atgagatttggaaggggcca

SEQ ID NO: 5086 - DNA, 20 bp, Artificial Sequence
  chemically synthesized
tgagatttggaaggggccag

SEQ ID NO: 5087 - DNA, 20 bp, Artificial Sequence
  chemically synthesized
gatttggaaggggccagagg

SEQ ID NO: 5088 - DNA, 20 bp, Artificial Sequence
  chemically synthesized
ttggaaggggccagaggtgg

SEQ ID NO: 5089 - DNA, 20 bp, Artificial Sequence
  chemically synthesized
tggaaggggccagaggtgga

SEQ ID NO: 5090 - DNA, 20 bp, Artificial Sequence
  chemically synthesized
gggccagaggtggaaggata

SEQ ID NO: 5091 - DNA, 20 bp, Artificial Sequence
  chemically synthesized
agaggtggaaggatatggtt

SEQ ID NO: 5092 - DNA, 20 bp, Artificial Sequence
  chemically synthesized
tcatgttaaattataatcac

SEQ ID NO: 5093 - DNA, 20 bp, Artificial Sequence
  chemically synthesized
taaattataatcaccagcgt

SEQ ID NO: 5094 - DNA, 20 bp, Artificial Sequence
  chemically synthesized
aattataatcaccagcgttg

SEQ ID NO: 5095 - DNA, 20 bp, Artificial Sequence
  chemically synthesized
attataatcaccagcgttgg

SEQ ID NO: 5096 - DNA, 20 bp, Artificial Sequence
  chemically synthesized
ataatcaccagcgttggagg

SEQ ID NO: 5097 - DNA, 20 bp, Artificial Sequence
  chemically synthesized
taatcaccagcgttggaggt

SEQ ID NO: 5098 - DNA, 20 bp, Artificial Sequence
  chemically synthesized
aatcaccagcgttggaggtg

SEQ ID NO: 5099 - DNA, 20 bp, Artificial Sequence
  chemically synthesized
gcgttggaggtggggccttg

SEQ ID NO: 5100 - DNA, 20 bp, Artificial Sequence
  chemically synthesized
cgttggaggtggggccttgt

SEQ ID NO: 5101 - DNA, 20 bp, Artificial Sequence
  chemically synthesized
ttggaggtggggccttgtgg

SEQ ID NO: 5102 - DNA, 20 bp, Artificial Sequence
  chemically synthesized
tggaggtggggccttgtggg

SEQ ID NO: 5103 - DNA, 20 bp, Artificial Sequence
  chemically synthesized
tgtgggaggtaattcaatca

SEQ ID NO: 5104 - DNA, 20 bp, Artificial Sequence
  chemically synthesized
gggaggtaattcaatcatgg

SEQ ID NO: 5105 - DNA, 20 bp, Artificial Sequence
  chemically synthesized
aggtaattcaatcatggtgg

SEQ ID NO: 5106 - DNA, 20 bp, Artificial Sequence
  chemically synthesized
gtaattcaatcatggtggca

SEQ ID NO: 5107 - DNA, 20 bp, Artificial Sequence
  chemically synthesized
catggtggcagagttctcat

SEQ ID NO: 5108 - DNA, 20 bp, Artificial Sequence
  chemically synthesized
cagagttctcatcagcgatt

SEQ ID NO: 5109 - DNA, 20 bp, Artificial Sequence
  chemically synthesized
cgatttagtaccatccccct

SEQ ID NO: 5110 - DNA, 20 bp, Artificial Sequence
  chemically synthesized
ccatcccccttggtactgta

SEQ ID NO: 5111 - DNA, 20 bp, Artificial Sequence
  chemically synthesized
cccccttggtactgtatagt

SEQ ID NO: 5112 - DNA, 20 bp, Artificial Sequence
  chemically synthesized
gtactgtatagtgagttctc

SEQ ID NO: 5113 - DNA, 20 bp, Artificial Sequence
  chemically synthesized
actgtatagtgagttctcaa

SEQ ID NO: 5114 - DNA, 20 bp, Artificial Sequence
  chemically synthesized
ctgtatagtgagttctcaag

SEQ ID NO: 5115 - DNA, 20 bp, Artificial Sequence
  chemically synthesized
atagtgagttctcaagaggc

SEQ ID NO: 5116 - DNA, 20 bp, Artificial Sequence
  chemically synthesized
tcaagaggctggttgtttga

SEQ ID NO: 5117 - DNA, 20 bp, Artificial Sequence
  chemically synthesized
gctggttgtttgaaagtgtg

SEQ ID NO: 5118 - DNA, 20 bp, Artificial Sequence
  chemically synthesized
taccctgcttctccctgtcc

SEQ ID NO: 5119 - DNA, 20 bp, Artificial Sequence
  chemically synthesized
ctccctgtcctggccatgtg

SEQ ID NO: 5120 - DNA, 20 bp, Artificial Sequence
  chemically synthesized
ttgtcttctgccatgattgt

SEQ ID NO: 5121 - DNA, 20 bp, Artificial Sequence
  chemically synthesized
gccatgattgtaagtttctt

SEQ ID NO: 5122 - DNA, 20 bp, Artificial Sequence
  chemically synthesized
ccatgattgtaagtttcttg

SEQ ID NO: 5123 - DNA, 20 bp, Artificial Sequence
  chemically synthesized
taagtttcttgaggtctccc

SEQ ID NO: 5124 - DNA, 20 bp, Artificial Sequence
  chemically synthesized
gtttcttgaggtctccctag

SEQ ID NO: 5125 - DNA, 20 bp, Artificial Sequence
  chemically synthesized
ttgaggtctccctagaagct

SEQ ID NO: 5126 - DNA, 20 bp, Artificial Sequence
  chemically synthesized
aggtctccctagaagctgag

SEQ ID NO: 5127 - DNA, 20 bp, Artificial Sequence
  chemically synthesized
atgctgccatgcttcttgta

SEQ ID NO: 5128 - DNA, 20 bp, Artificial Sequence
  chemically synthesized
catgcttcttgtacagcctg

SEQ ID NO: 5129 - DNA, 20 bp, Artificial Sequence
  chemically synthesized
tgtacagcctgaagaacttt

SEQ ID NO: 5130 - DNA, 20 bp, Artificial Sequence
  chemically synthesized
tctgttctttataaattacc

SEQ ID NO: 5131 - DNA, 20 bp, Artificial Sequence
  chemically synthesized
ctttataaattacccagtct

SEQ ID NO: 5132 - DNA, 20 bp, Artificial Sequence
  chemically synthesized
tttataaattacccagtctc

SEQ ID NO: 5133 - DNA, 20 bp, Artificial Sequence
  chemically synthesized
cagtctcaggtattttttta

SEQ ID NO: 5134 - DNA, 20 bp, Artificial Sequence
  chemically synthesized
tctcaggtatttttttacag

SEQ ID NO: 5135 - DNA, 20 bp, Artificial Sequence
  chemically synthesized
ctttgatactcaatgtgatc

SEQ ID NO: 5136 - DNA, 20 bp, Artificial Sequence
  chemically synthesized
tactcaatgtgatcaagatt

SEQ ID NO: 5137 - DNA, 20 bp, Artificial Sequence
  chemically synthesized
actcaatgtgatcaagattt

SEQ ID NO: 5138 - DNA, 20 bp, Artificial Sequence
  chemically synthesized
tcaatgtgatcaagatttgg

SEQ ID NO: 5139 - DNA, 20 bp, Artificial Sequence
  chemically synthesized
ctcctctttactcatgtcca

SEQ ID NO: 5140 - DNA, 20 bp, Artificial Sequence
  chemically synthesized
gtgacatgaaacctgtatct

SEQ ID NO: 5141 - DNA, 20 bp, Artificial Sequence
  chemically synthesized
atctaagtgtgttatctcca

SEQ ID NO: 5142 - DNA, 20 bp, Artificial Sequence
  chemically synthesized
tctaagtgtgttatctccat

SEQ ID NO: 5143 - DNA, 20 bp, Artificial Sequence
  chemically synthesized
aagtgtgttatctccatggg

SEQ ID NO: 5144 - DNA, 20 bp, Artificial Sequence
  chemically synthesized
atctatttcattctatgcaa

SEQ ID NO: 5145 - DNA, 20 bp, Artificial Sequence
  chemically synthesized
tgcaatagctgtctgaaact

SEQ ID NO: 5146 - DNA, 20 bp, Artificial Sequence
  chemically synthesized
agctgtctgaaactaagtca

SEQ ID NO: 5147 - DNA, 20 bp, Artificial Sequence
  chemically synthesized
ttgaatatctatatttgttt

SEQ ID NO: 5148 - DNA, 20 bp, Artificial Sequence
  chemically synthesized
tgaatatctatatttgtttg

SEQ ID NO: 5149 - DNA, 20 bp, Artificial Sequence
  chemically synthesized
tttgtttgaggaataataat

SEQ ID NO: 5150 - DNA, 20 bp, Artificial Sequence
  chemically synthesized
ttgaggaataataatcagaa

SEQ ID NO: 5151 - DNA, 20 bp, Artificial Sequence
  chemically synthesized
aggaataataatcagaacag

SEQ ID NO: 5152 - DNA, 20 bp, Artificial Sequence
  chemically synthesized
ggaataataatcagaacaga

SEQ ID NO: 5153 - DNA, 20 bp, Artificial Sequence
  chemically synthesized
atcagaacagaaggatatga

SEQ ID NO: 5154 - DNA, 20 bp, Artificial Sequence
  chemically synthesized
cagaaggatatgaaagacta

SEQ ID NO: 5155 - DNA, 20 bp, Artificial Sequence
  chemically synthesized
agaaggatatgaaagactat

SEQ ID NO: 5156 - DNA, 20 bp, Artificial Sequence
  chemically synthesized
gatatgaaagactataggaa

SEQ ID NO: 5157 - DNA, 20 bp, Artificial Sequence
  chemically synthesized
atgaaagactataggaatgg

SEQ ID NO: 5158 - DNA, 20 bp, Artificial Sequence
  chemically synthesized
taggaatggaagtttctcaa

SEQ ID NO: 5159 - DNA, 20 bp, Artificial Sequence
  chemically synthesized
aatggaagtttctcaacagc

SEQ ID NO: 5160 - DNA, 20 bp, Artificial Sequence
  chemically synthesized
ttctcaacagcaagataaaa

SEQ ID NO: 5161 - DNA, 20 bp, Artificial Sequence
  chemically synthesized
tctcaacagcaagataaaat

SEQ ID NO: 5162 - DNA, 20 bp, Artificial Sequence
  chemically synthesized
agcaagataaaataggttaa

SEQ ID NO: 5163 - DNA, 20 bp, Artificial Sequence
  chemically synthesized
caagataaaataggttaatg

SEQ ID NO: 5164 - DNA, 20 bp, Artificial Sequence
  chemically synthesized
taggttaatggagtaatatg

SEQ ID NO: 5165 - DNA, 20 bp, Artificial Sequence
  chemically synthesized
ggttaatggagtaatatgta

SEQ ID NO: 5166 - DNA, 20 bp, Artificial Sequence
  chemically synthesized
gagaatgatgactataatta

SEQ ID NO: 5167 - DNA, 20 bp, Artificial Sequence
  chemically synthesized
ataattaaagaaaatgaatt

SEQ ID NO: 5168 - DNA, 20 bp, Artificial Sequence
  chemically synthesized
aattaagcaatatacaatta

SEQ ID NO: 5169 - DNA, 20 bp, Artificial Sequence
  chemically synthesized
aagctctttatgtcttttca

SEQ ID NO: 5170 - DNA, 20 bp, Artificial Sequence
  chemically synthesized
tatgtcttttcacagcttga

SEQ ID NO: 5171 - DNA, 20 bp, Artificial Sequence
  chemically synthesized
ctgaataatattctatccta

SEQ ID NO: 5172 - DNA, 20 bp, Artificial Sequence
  chemically synthesized
tctatcctatggatgttcca

SEQ ID NO: 5173 - DNA, 20 bp, Artificial Sequence
  chemically synthesized
cacagtttatccattcatct

SEQ ID NO: 5174 - DNA, 20 bp, Artificial Sequence
  chemically synthesized
tcttggttactttcaacttt

SEQ ID NO: 5175 - DNA, 20 bp, Artificial Sequence
  chemically synthesized
tttcaacttttggcaattat

SEQ ID NO: 5176 - DNA, 20 bp, Artificial Sequence
  chemically synthesized
acttttggcaattatgagta

SEQ ID NO: 5177 - DNA, 20 bp, Artificial Sequence
  chemically synthesized
agtaaagttcctataaacct

SEQ ID NO: 5178 - DNA, 20 bp, Artificial Sequence
  chemically synthesized
aagttcctataaaccttggt

SEQ ID NO: 5179 - DNA, 20 bp, Artificial Sequence
  chemically synthesized
ggttagttcatgtctgtgtg

SEQ ID NO: 5180 - DNA, 20 bp, Artificial Sequence
  chemically synthesized
acataaatttttgactcatt

SEQ ID NO: 5181 - DNA, 20 bp, Artificial Sequence
  chemically synthesized
cataaatttttgactcattt

SEQ ID NO: 5182 - DNA, 20 bp, Artificial Sequence
  chemically synthesized
gactcatttgggtaaataca

SEQ ID NO: 5183 - DNA, 20 bp, Artificial Sequence
  chemically synthesized
actcatttgggtaaatacat

SEQ ID NO: 5184 - DNA, 20 bp, Artificial Sequence
  chemically synthesized
tcatttgggtaaatacatag

SEQ ID NO: 5185 - DNA, 20 bp, Artificial Sequence
  chemically synthesized
atacataggagtgtgattgt

SEQ ID NO: 5186 - DNA, 20 bp, Artificial Sequence
  chemically synthesized
tacataggagtgtgattgtt

SEQ ID NO: 5187 - DNA, 20 bp, Artificial Sequence
  chemically synthesized
tgattgttgggtcacatgaa

SEQ ID NO: 5188 - DNA, 20 bp, Artificial Sequence
  chemically synthesized
gttgggtcacatgaaaagac

SEQ ID NO: 5189 - DNA, 20 bp, Artificial Sequence
  chemically synthesized
catgaaaagactagttttgt

SEQ ID NO: 5190 - DNA, 20 bp, Artificial Sequence
  chemically synthesized
ctgtaaactgtcttccaatt

SEQ ID NO: 5191 - DNA, 20 bp, Artificial Sequence
  chemically synthesized
gcactatttctcatccctac

SEQ ID NO: 5192 - DNA, 20 bp, Artificial Sequence
  chemically synthesized
ttctcatccctacaagcaat

SEQ ID NO: 5193 - DNA, 20 bp, Artificial Sequence
  chemically synthesized
catccctacaagcaataagt

SEQ ID NO: 5194 - DNA, 20 bp, Artificial Sequence
  chemically synthesized
tccctacaagcaataagtga

SEQ ID NO: 5195 - DNA, 20 bp, Artificial Sequence
  chemically synthesized
ctgttgctccacttcgttgc

SEQ ID NO: 5196 - DNA, 20 bp, Artificial Sequence
  chemically synthesized
tccacttcgttgccagtgtt

SEQ ID NO: 5197 - DNA, 20 bp, Artificial Sequence
  chemically synthesized
acttcgttgccagtgtttgg

SEQ ID NO: 5198 - DNA, 20 bp, Artificial Sequence
  chemically synthesized
tgccagtgtttggtggatgt

SEQ ID NO: 5199 - DNA, 20 bp, Artificial Sequence
  chemically synthesized
tttggtggatgtcagtattt

SEQ ID NO: 5200 - DNA, 20 bp, Artificial Sequence
  chemically synthesized
gatgtcagtattttggaatt

SEQ ID NO: 5201 - DNA, 20 bp, Artificial Sequence
  chemically synthesized
ttggccttctaatatgtgtg

SEQ ID NO: 5202 - DNA, 20 bp, Artificial Sequence
  chemically synthesized
gccttctaatatgtgtgtag

SEQ ID NO: 5203 - DNA, 20 bp, Artificial Sequence
  chemically synthesized
tctaatatgtgtgtagtggt

SEQ ID NO: 5204 - DNA, 20 bp, Artificial Sequence
  chemically synthesized
tatcttcttgttttaatgtg

SEQ ID NO: 5205 - DNA, 20 bp, Artificial Sequence
  chemically synthesized
tcttaatgacatgtgttact

SEQ ID NO: 5206 - DNA, 20 bp, Artificial Sequence
  chemically synthesized
tgcaatctatatatcttctt

SEQ ID NO: 5207 - DNA, 20 bp, Artificial Sequence
  chemically synthesized
tctatatatcttctttggta

SEQ ID NO: 5208 - DNA, 20 bp, Artificial Sequence
  chemically synthesized
tctttggtaaagtgtctgtt

SEQ ID NO: 5209 - DNA, 20 bp, Artificial Sequence
  chemically synthesized
tcttttgcccactttgcaat

SEQ ID NO: 5210 - DNA, 20 bp, Artificial Sequence
  chemically synthesized
ggattgtttgttttttattg

SEQ ID NO: 5211 - DNA, 20 bp, Artificial Sequence
  chemically synthesized
tttttattgtagaattttaa

SEQ ID NO: 5212 - DNA, 20 bp, Artificial Sequence
  chemically synthesized
tctttgtataatatgtatac

SEQ ID NO: 5213 - DNA, 20 bp, Artificial Sequence
  chemically synthesized
tatgtatacaagtcctttat

SEQ ID NO: 5214 - DNA, 20 bp, Artificial Sequence
  chemically synthesized
ttttgcaaatatgttctctg

SEQ ID NO: 5215 - DNA, 20 bp, Artificial Sequence
  chemically synthesized
tattttattttattttgttc

SEQ ID NO: 5216 - DNA, 20 bp, Artificial Sequence
  chemically synthesized
attttattttattttgttct

SEQ ID NO: 5217 - DNA, 20 bp, Artificial Sequence
  chemically synthesized
attttgttctgggtattttg

SEQ ID NO: 5218 - DNA, 20 bp, Artificial Sequence
  chemically synthesized
aactgctgtgttcttttgtt

SEQ ID NO: 5219 - DNA, 20 bp, Artificial Sequence
  chemically synthesized
aattgtcttgtattgatctc

SEQ ID NO: 5220 - DNA, 20 bp, Artificial Sequence
  chemically synthesized
gtcttgtattgatctctagt

SEQ ID NO: 5221 - DNA, 20 bp, Artificial Sequence
  chemically synthesized
tttcactctctcctgaactc

SEQ ID NO: 5222 - DNA, 20 bp, Artificial Sequence
  chemically synthesized
ctctctcctgaactccagtt

SEQ ID NO: 5223 - DNA, 20 bp, Artificial Sequence
  chemically synthesized
ctgaactccagttaagattt

SEQ ID NO: 5224 - DNA, 20 bp, Artificial Sequence
  chemically synthesized
gaactccagttaagattttg

SEQ ID NO: 5225 - DNA, 20 bp, Artificial Sequence
  chemically synthesized
ctacttcctgtcccccttat

SEQ ID NO: 5226 - DNA, 20 bp, Artificial Sequence
  chemically synthesized
tactattctgttcaaatatc

SEQ ID NO: 5227 - DNA, 20 bp, Artificial Sequence
  chemically synthesized
actattctgttcaaatatca

SEQ ID NO: 5228 - DNA, 20 bp, Artificial Sequence
  chemically synthesized
aaatatcaaggatctaaaat

SEQ ID NO: 5229 - DNA, 20 bp, Artificial Sequence
  chemically synthesized
tatcaaggatctaaaatgag

SEQ ID NO: 5230 - DNA, 20 bp, Artificial Sequence
  chemically synthesized
aaatgagtggttatttaatt

SEQ ID NO: 5231 - DNA, 20 bp, Artificial Sequence
  chemically synthesized
ttatgcacctcttttattat

SEQ ID NO: 5232 - DNA, 20 bp, Artificial Sequence
  chemically synthesized
ttttattttctgccctgaat

SEQ ID NO: 5233 - DNA, 20 bp, Artificial Sequence
  chemically synthesized
gaataagctgtgctccaaat

SEQ ID NO: 5234 - DNA, 20 bp, Artificial Sequence
  chemically synthesized
ttctttattaaaattgattc

SEQ ID NO: 5235 - DNA, 20 bp, Artificial Sequence
  chemically synthesized
tctttattaaaattgattct

SEQ ID NO: 5236 - DNA, 20 bp, Artificial Sequence
  chemically synthesized
taggtatgtaatttttgtgt

SEQ ID NO: 5237 - DNA, 20 bp, Artificial Sequence
  chemically synthesized
gtatgtaatttttgtgttgg

SEQ ID NO: 5238 - DNA, 20 bp, Artificial Sequence
  chemically synthesized
tttgtccatccttctgtgtc

SEQ ID NO: 5239 - DNA, 20 bp, Artificial Sequence
  chemically synthesized
catccttctgtgtccggaat

SEQ ID NO: 5240 - DNA, 20 bp, Artificial Sequence
  chemically synthesized
ccttctgtgtccggaattgg

SEQ ID NO: 5241 - DNA, 20 bp, Artificial Sequence
  chemically synthesized
cttctgtgtccggaattggt

SEQ ID NO: 5242 - DNA, 20 bp, Artificial Sequence
  chemically synthesized
gtccggaattggtgggttct

SEQ ID NO: 5243 - DNA, 20 bp, Artificial Sequence
  chemically synthesized
ttcttggtctcgctgactta

SEQ ID NO: 5244 - DNA, 20 bp, Artificial Sequence
  chemically synthesized
tctcgctgacttaaagaatg

SEQ ID NO: 5245 - DNA, 20 bp, Artificial Sequence
  chemically synthesized
aatgaagccgcgaaccctcg

SEQ ID NO: 5246 - DNA, 20 bp, Artificial Sequence
  chemically synthesized
aagccgcgaaccctcgtggt

SEQ ID NO: 5247 - DNA, 20 bp, Artificial Sequence
  chemically synthesized
ggtgagtgttacaattctta

SEQ ID NO: 5248 - DNA, 20 bp, Artificial Sequence
  chemically synthesized
agtgttacaattcttaaaga

SEQ ID NO: 5249 - DNA, 20 bp, Artificial Sequence
  chemically synthesized
tcttaaagatggtgtgttca

SEQ ID NO: 5250 - DNA, 20 bp, Artificial Sequence
  chemically synthesized
cttaaagatggtgtgttcaa

SEQ ID NO: 5251 - DNA, 20 bp, Artificial Sequence
  chemically synthesized
aagatggtgtgttcaaagga

SEQ ID NO: 5252 - DNA, 20 bp, Artificial Sequence
  chemically synthesized
ttcaaaggatggtgtgtcca

SEQ ID NO: 5253 - DNA, 20 bp, Artificial Sequence
  chemically synthesized
gtgtccaaagtttgttactt

SEQ ID NO: 5254 - DNA, 20 bp, Artificial Sequence
  chemically synthesized
tttgttacttcagatgtgtc

SEQ ID NO: 5255 - DNA, 20 bp, Artificial Sequence
  chemically synthesized
tgttacttcagatgtgtcca

SEQ ID NO: 5256 - DNA, 20 bp, Artificial Sequence
  chemically synthesized
tgtccagagtttcttccttc

SEQ ID NO: 5257 - DNA, 20 bp, Artificial Sequence
  chemically synthesized
tcttccttctggtgtgttca

SEQ ID NO: 5258 - DNA, 20 bp, Artificial Sequence
  chemically synthesized
tggtgtgttcacggtcttgc

SEQ ID NO: 5259 - DNA, 20 bp, Artificial Sequence
  chemically synthesized
gttcacggtcttgctggctc

SEQ ID NO: 5260 - DNA, 20 bp, Artificial Sequence
  chemically synthesized
ttcacggtcttgctggctcc

SEQ ID NO: 5261 - DNA, 20 bp, Artificial Sequence
  chemically synthesized
cacggtcttgctggctccag

SEQ ID NO: 5262 - DNA, 20 bp, Artificial Sequence
  chemically synthesized
tcttgctggctccaggagtg

SEQ ID NO: 5263 - DNA, 20 bp, Artificial Sequence
  chemically synthesized
tggctccaggagtgaagctg

SEQ ID NO: 5264 - DNA, 20 bp, Artificial Sequence
  chemically synthesized
agtgaagctgcagaccccca

SEQ ID NO: 5265 - DNA, 20 bp, Artificial Sequence
  chemically synthesized
gtgaagctgcagacccccac

SEQ ID NO: 5266 - DNA, 20 bp, Artificial Sequence
  chemically synthesized
tgaagctgcagacccccacg

SEQ ID NO: 5267 - DNA, 20 bp, Artificial Sequence
  chemically synthesized
aagctgcagacccccacggg

SEQ ID NO: 5268 - DNA, 20 bp, Artificial Sequence
  chemically synthesized
gacccccacggggagtgtta

SEQ ID NO: 5269 - DNA, 20 bp, Artificial Sequence
  chemically synthesized
ggggagtgttacagctctta

SEQ ID NO: 5270 - DNA, 20 bp, Artificial Sequence
  chemically synthesized
gggagtgttacagctcttaa

SEQ ID NO: 5271 - DNA, 20 bp, Artificial Sequence
  chemically synthesized
agtgttacagctcttaaagg

SEQ ID NO: 5272 - DNA, 20 bp, Artificial Sequence
  chemically synthesized
tgttacagctcttaaaggcg

SEQ ID NO: 5273 - DNA, 20 bp, Artificial Sequence
  chemically synthesized
gctcttaaaggcggagcgta

SEQ ID NO: 5274 - DNA, 20 bp, Artificial Sequence
  chemically synthesized
tcttaaaggcggagcgtatg

SEQ ID NO: 5275 - DNA, 20 bp, Artificial Sequence
  chemically synthesized
gttgctcattcctcctgtct

SEQ ID NO: 5276 - DNA, 20 bp, Artificial Sequence
  chemically synthesized
ttgctcattcctcctgtctt

SEQ ID NO: 5277 - DNA, 20 bp, Artificial Sequence
  chemically synthesized
gggttgttcatcccccatgc

SEQ ID NO: 5278 - DNA, 20 bp, Artificial Sequence
  chemically synthesized
ggttgttcatcccccatgct

SEQ ID NO: 5279 - DNA, 20 bp, Artificial Sequence
  chemically synthesized
catcccccatgctgggttcg

SEQ ID NO: 5280 - DNA, 20 bp, Artificial Sequence
  chemically synthesized
tgctgggttcgtggtcttgc

SEQ ID NO: 5281 - DNA, 20 bp, Artificial Sequence
  chemically synthesized
gttcgtggtcttgctggctt

SEQ ID NO: 5282 - DNA, 20 bp, Artificial Sequence
  chemically synthesized
cgtggtcttgctggcttcag

SEQ ID NO: 5283 - DNA, 20 bp, Artificial Sequence
  chemically synthesized
tcttgctggcttcagaagtg

SEQ ID NO: 5284 - DNA, 20 bp, Artificial Sequence
  chemically synthesized
tggcttcagaagtgaagccg

SEQ ID NO: 5285 - DNA, 20 bp, Artificial Sequence
  chemically synthesized
agtgaagccgcagaccttcg

SEQ ID NO: 5286 - DNA, 20 bp, Artificial Sequence
  chemically synthesized
aagccgcagaccttcgcagt

SEQ ID NO: 5287 - DNA, 20 bp, Artificial Sequence
  chemically synthesized
gaccttcgcagtgagtgtta

SEQ ID NO: 5288 - DNA, 20 bp, Artificial Sequence
  chemically synthesized
agtgagtgttacagctcata

SEQ ID NO: 5289 - DNA, 20 bp, Artificial Sequence
  chemically synthesized
gtgagtgttacagctcataa

SEQ ID NO: 5290 - DNA, 20 bp, Artificial Sequence
  chemically synthesized
agtgttacagctcataaagg

SEQ ID NO: 5291 - DNA, 20 bp, Artificial Sequence
  chemically synthesized
tacagctcataaaggcagcg

SEQ ID NO: 5292 - DNA, 20 bp, Artificial Sequence
  chemically synthesized
ataaaggcagcgcggatcca

SEQ ID NO: 5293 - DNA, 20 bp, Artificial Sequence
  chemically synthesized
aaaggcagcgcggatccaaa

SEQ ID NO: 5294 - DNA, 20 bp, Artificial Sequence
  chemically synthesized
gcagcgcggatccaaagagt

SEQ ID NO: 5295 - DNA, 20 bp, Artificial Sequence
  chemically synthesized
gcgcggatccaaagagtgag

SEQ ID NO: 5296 - DNA, 20 bp, Artificial Sequence
  chemically synthesized
cggatccaaagagtgagcag

SEQ ID NO: 5297 - DNA, 20 bp, Artificial Sequence
  chemically synthesized
tccaaagagtgagcagcagt

SEQ ID NO: 5298 - DNA, 20 bp, Artificial Sequence
  chemically synthesized
cagcagtaagatttattgtg

SEQ ID NO: 5299 - DNA, 20 bp, Artificial Sequence
  chemically synthesized
agatttattgtgaagaataa

SEQ ID NO: 5300 - DNA, 20 bp, Artificial Sequence
  chemically synthesized
ttgtgaagaataaaagaaca

SEQ ID NO: 5301 - DNA, 20 bp, Artificial Sequence
  chemically synthesized
ataaaagaacaaagcttcca

SEQ ID NO: 5302 - DNA, 20 bp, Artificial Sequence
  chemically synthesized
agaacaaagcttccacagca

SEQ ID NO: 5303 - DNA, 20 bp, Artificial Sequence
  chemically synthesized
acaaagcttccacagcatgg

SEQ ID NO: 5304 - DNA, 20 bp, Artificial Sequence
  chemically synthesized
caaagcttccacagcatggt

SEQ ID NO: 5305 - DNA, 20 bp, Artificial Sequence
  chemically synthesized
aaagcttccacagcatggta

SEQ ID NO: 5306 - DNA, 20 bp, Artificial Sequence
  chemically synthesized
cacagcatggtagggaaccc

SEQ ID NO: 5307 - DNA, 20 bp, Artificial Sequence
  chemically synthesized
gcatggtagggaacccaagt

SEQ ID NO: 5308 - DNA, 20 bp, Artificial Sequence
  chemically synthesized
ggaacccaagtcagttgtca

SEQ ID NO: 5309 - DNA, 20 bp, Artificial Sequence
  chemically synthesized
cccaagtcagttgtcacagc

SEQ ID NO: 5310 - DNA, 20 bp, Artificial Sequence
  chemically synthesized
tcagttgtcacagctggctc

SEQ ID NO: 5311 - DNA, 20 bp, Artificial Sequence
  chemically synthesized
gttgtcacagctggctccgg

SEQ ID NO: 5312 - DNA, 20 bp, Artificial Sequence
  chemically synthesized
cccacccacatcctgctgat

SEQ ID NO: 5313 - DNA, 20 bp, Artificial Sequence
  chemically synthesized
ctgctgattggtccatttta

SEQ ID NO: 5314 - DNA, 20 bp, Artificial Sequence
  chemically synthesized
gctgattggtccattttaca

SEQ ID NO: 5315 - DNA, 20 bp, Artificial Sequence
  chemically synthesized
tgattggtccattttacaga

SEQ ID NO: 5316 - DNA, 20 bp, Artificial Sequence
  chemically synthesized
ccattttacagagagctgat

SEQ ID NO: 5317 - DNA, 20 bp, Artificial Sequence
  chemically synthesized
gagctgattggcccatttta

SEQ ID NO: 5318 - DNA, 20 bp, Artificial Sequence
  chemically synthesized
gctgattggcccattttaca

SEQ ID NO: 5319 - DNA, 20 bp, Artificial Sequence
  chemically synthesized
tgattggcccattttacaga

SEQ ID NO: 5320 - DNA, 20 bp, Artificial Sequence
  chemically synthesized
tggcccattttacagagagc

SEQ ID NO: 5321 - DNA, 20 bp, Artificial Sequence
  chemically synthesized
ccattttacagagagctggt

SEQ ID NO: 5322 - DNA, 20 bp, Artificial Sequence
  chemically synthesized
gagagctggttggtccgttt

SEQ ID NO: 5323 - DNA, 20 bp, Artificial Sequence
  chemically synthesized
agctggttggtccgttttgg

SEQ ID NO: 5324 - DNA, 20 bp, Artificial Sequence
  chemically synthesized
ctggttggtccgttttggca

SEQ ID NO: 5325 - DNA, 20 bp, Artificial Sequence
  chemically synthesized
cgttttggcagagtgctgat

SEQ ID NO: 5326 - DNA, 20 bp, Artificial Sequence
  chemically synthesized
ttggtgcatttacaaacctt

SEQ ID NO: 5327 - DNA, 20 bp, Artificial Sequence
  chemically synthesized
tgcatttacaaaccttgagc

SEQ ID NO: 5328 - DNA, 20 bp, Artificial Sequence
  chemically synthesized
tacaaaccttgagctagaca

SEQ ID NO: 5329 - DNA, 20 bp, Artificial Sequence
  chemically synthesized
caaaccttgagctagacaca

SEQ ID NO: 5330 - DNA, 20 bp, Artificial Sequence
  chemically synthesized
gctagacacagagtgctgat

SEQ ID NO: 5331 - DNA, 20 bp, Artificial Sequence
  chemically synthesized
ttagtgcatttacaatcctt

SEQ ID NO: 5332 - DNA, 20 bp, Artificial Sequence
  chemically synthesized
tgcatttacaatcctttagc

SEQ ID NO: 5333 - DNA, 20 bp, Artificial Sequence
  chemically synthesized
aatcctttagctagacacaa

SEQ ID NO: 5334 - DNA, 20 bp, Artificial Sequence
  chemically synthesized
gctagacacaaaagttctcc

SEQ ID NO: 5335 - DNA, 20 bp, Artificial Sequence
  chemically synthesized
aaagttctccaagtccccac

SEQ ID NO: 5336 - DNA, 20 bp, Artificial Sequence
  chemically synthesized
tctccaagtccccactagat

SEQ ID NO: 5337 - DNA, 20 bp, Artificial Sequence
  chemically synthesized
caagtccccactagattagc

SEQ ID NO: 5338 - DNA, 20 bp, Artificial Sequence
  chemically synthesized
cccactagattagctagaca

SEQ ID NO: 5339 - DNA, 20 bp, Artificial Sequence
  chemically synthesized
cactagattagctagacaca

SEQ ID NO: 5340 - DNA, 20 bp, Artificial Sequence
  chemically synthesized
gctagacacagagcactgat

SEQ ID NO: 5341 - DNA, 20 bp, Artificial Sequence
  chemically synthesized
ttggtgcatttacaaacctt

SEQ ID NO: 5342 - DNA, 20 bp, Artificial Sequence
  chemically synthesized
tgcatttacaaaccttgagt

SEQ ID NO: 5343 - DNA, 20 bp, Artificial Sequence
  chemically synthesized
tacaaaccttgagttagaca

SEQ ID NO: 5344 - DNA, 20 bp, Artificial Sequence
  chemically synthesized
gttagacacagattgctgat

SEQ ID NO: 5345 - DNA, 20 bp, Artificial Sequence
  chemically synthesized
ttggtgcatttacaaacctt

SEQ ID NO: 5346 - DNA, 20 bp, Artificial Sequence
  chemically synthesized
tgcatttacaaacctttagc

SEQ ID NO: 5347 - DNA, 20 bp, Artificial Sequence
  chemically synthesized
aaacctttagctagacatga

SEQ ID NO: 5348 - DNA, 20 bp, Artificial Sequence
  chemically synthesized
agctagacatgaaagttctc

SEQ ID NO: 5349 - DNA, 20 bp, Artificial Sequence
  chemically synthesized
ttctccagttccatatttca

SEQ ID NO: 5350 - DNA, 20 bp, Artificial Sequence
  chemically synthesized
ccagttccatatttcatggt

SEQ ID NO: 5351 - DNA, 20 bp, Artificial Sequence
  chemically synthesized
cagttccatatttcatggtg

SEQ ID NO: 5352 - DNA, 20 bp, Artificial Sequence
  chemically synthesized
atatttcatggtgaggaaca

SEQ ID NO: 5353 - DNA, 20 bp, Artificial Sequence
  chemically synthesized
atggtgaggaacaaagaata

SEQ ID NO: 5354 - DNA, 20 bp, Artificial Sequence
  chemically synthesized
gtgaggaacaaagaatatag

SEQ ID NO: 5355 - DNA, 20 bp, Artificial Sequence
  chemically synthesized
tgaggaacaaagaatatagt

SEQ ID NO: 5356 - DNA, 20 bp, Artificial Sequence
  chemically synthesized
gaggaacaaagaatatagtg

SEQ ID NO: 5357 - DNA, 20 bp, Artificial Sequence
  chemically synthesized
ttgttcctcaccatgaaata

SEQ ID NO: 5358 - DNA, 20 bp, Artificial Sequence
  chemically synthesized
ctcaccatgaaatatggaac

SEQ ID NO: 5359 - DNA, 20 bp, Artificial Sequence
  chemically synthesized
caccatgaaatatggaactg

SEQ ID NO: 5360 - DNA, 20 bp, Artificial Sequence
  chemically synthesized
aactggagaactttcatgtc

SEQ ID NO: 5361 - DNA, 20 bp, Artificial Sequence
  chemically synthesized
agaactttcatgtctagcta

SEQ ID NO: 5362 - DNA, 20 bp, Artificial Sequence
  chemically synthesized
gaactttcatgtctagctaa

SEQ ID NO: 5363 - DNA, 20 bp, Artificial Sequence
  chemically synthesized
tttgtaaatgcaatttattg

SEQ ID NO: 5364 - DNA, 20 bp, Artificial Sequence
  chemically synthesized
tattgcggcactattcacaa

SEQ ID NO: 5365 - DNA, 20 bp, Artificial Sequence
  chemically synthesized
cggcactattcacaatagca

SEQ ID NO: 5366 - DNA, 20 bp, Artificial Sequence
  chemically synthesized
tattcacaatagcaaagact

SEQ ID NO: 5367 - DNA, 20 bp, Artificial Sequence
  chemically synthesized
acccaaatgtccaacaatga

SEQ ID NO: 5368 - DNA, 20 bp, Artificial Sequence
  chemically synthesized
aatgtccaacaatgatagac

SEQ ID NO: 5369 - DNA, 20 bp, Artificial Sequence
  chemically synthesized
caacaatgatagactggatt

SEQ ID NO: 5370 - DNA, 20 bp, Artificial Sequence
  chemically synthesized
tagactggattaagaaaatg

SEQ ID NO: 5371 - DNA, 20 bp, Artificial Sequence
  chemically synthesized
aatgtggcacatacacacca

SEQ ID NO: 5372 - DNA, 20 bp, Artificial Sequence
  chemically synthesized
acacaccatggaatactatg

SEQ ID NO: 5373 - DNA, 20 bp, Artificial Sequence
  chemically synthesized
aatactatgcagccataaaa

SEQ ID NO: 5374 - DNA, 20 bp, Artificial Sequence
  chemically synthesized
atactatgcagccataaaaa

SEQ ID NO: 5375 - DNA, 20 bp, Artificial Sequence
  chemically synthesized
atgcagccataaaaaaggat

SEQ ID NO: 5376 - DNA, 20 bp, Artificial Sequence
  chemically synthesized
ggatgagttcatgtcctttg

SEQ ID NO: 5377 - DNA, 20 bp, Artificial Sequence
  chemically synthesized
gatgagttcatgtcctttgt

SEQ ID NO: 5378 - DNA, 20 bp, Artificial Sequence
  chemically synthesized
atgagttcatgtcctttgta

SEQ ID NO: 5379 - DNA, 20 bp, Artificial Sequence
  chemically synthesized
tcatgtcctttgtagggaca

SEQ ID NO: 5380 - DNA, 20 bp, Artificial Sequence
  chemically synthesized
tgtagggacatggatgaaat

SEQ ID NO: 5381 - DNA, 20 bp, Artificial Sequence
  chemically synthesized
aaattggaaatcatcattct

SEQ ID NO: 5382 - DNA, 20 bp, Artificial Sequence
  chemically synthesized
cattctcagtaaactatcgc

SEQ ID NO: 5383 - DNA, 20 bp, Artificial Sequence
  chemically synthesized
attctcagtaaactatcgca

SEQ ID NO: 5384 - DNA, 20 bp, Artificial Sequence
  chemically synthesized
acactgcatgttctcactca

SEQ ID NO: 5385 - DNA, 20 bp, Artificial Sequence
  chemically synthesized
cactgcatgttctcactcat

SEQ ID NO: 5386 - DNA, 20 bp, Artificial Sequence
  chemically synthesized
tgcatgttctcactcatagg

SEQ ID NO: 5387 - DNA, 20 bp, Artificial Sequence
  chemically synthesized
gcatgttctcactcataggt

SEQ ID NO: 5388 - DNA, 20 bp, Artificial Sequence
  chemically synthesized
ataggtgggaattgaacaat

SEQ ID NO: 5389 - DNA, 20 bp, Artificial Sequence
  chemically synthesized
aattgaacaatgagaacaca

SEQ ID NO: 5390 - DNA, 20 bp, Artificial Sequence
  chemically synthesized
acaatgagaacacatggaca

SEQ ID NO: 5391 - DNA, 20 bp, Artificial Sequence
  chemically synthesized
caatgagaacacatggacac

SEQ ID NO: 5392 - DNA, 20 bp, Artificial Sequence
  chemically synthesized
tgagaacacatggacacagg

SEQ ID NO: 5393 - DNA, 20 bp, Artificial Sequence
  chemically synthesized
gagaacacatggacacagga

SEQ ID NO: 5394 - DNA, 20 bp, Artificial Sequence
  chemically synthesized
agaacacatggacacaggaa

SEQ ID NO: 5395 - DNA, 20 bp, Artificial Sequence
  chemically synthesized
gaacacatggacacaggaag

SEQ ID NO: 5396 - DNA, 20 bp, Artificial Sequence
  chemically synthesized
ggaaggggaacatcacactc

SEQ ID NO: 5397 - DNA, 20 bp, Artificial Sequence
  chemically synthesized
gaaggggaacatcacactct

SEQ ID NO: 5398 - DNA, 20 bp, Artificial Sequence
  chemically synthesized
aaggggaacatcacactctg

SEQ ID NO: 5399 - DNA, 20 bp, Artificial Sequence
  chemically synthesized
tcacactctggggactgttg

SEQ ID NO: 5400 - DNA, 20 bp, Artificial Sequence
  chemically synthesized
cacactctggggactgttgt

SEQ ID NO: 5401 - DNA, 20 bp, Artificial Sequence
  chemically synthesized
acactctggggactgttgtg

SEQ ID NO: 5402 - DNA, 20 bp, Artificial Sequence
  chemically synthesized
ctctggggactgttgtgggg

SEQ ID NO: 5403 - DNA, 20 bp, Artificial Sequence
  chemically synthesized
tctggggactgttgtggggt

SEQ ID NO: 5404 - DNA, 20 bp, Artificial Sequence
  chemically synthesized
ctggggactgttgtggggtg

SEQ ID NO: 5405 - DNA, 20 bp, Artificial Sequence
  chemically synthesized
tggggactgttgtggggtgg

SEQ ID NO: 5406 - DNA, 20 bp, Artificial Sequence
  chemically synthesized
ggggactgttgtggggtggg

SEQ ID NO: 5407 - DNA, 20 bp, Artificial Sequence
  chemically synthesized
ggactgttgtggggtggggg

SEQ ID NO: 5408 - DNA, 20 bp, Artificial Sequence
  chemically synthesized
gactgttgtggggtgggggg

SEQ ID NO: 5409 - DNA, 20 bp, Artificial Sequence
  chemically synthesized
actgttgtggggtgggggga

SEQ ID NO: 5410 - DNA, 20 bp, Artificial Sequence
  chemically synthesized
tgttgtggggtggggggagg

SEQ ID NO: 5411 - DNA, 20 bp, Artificial Sequence
  chemically synthesized
gttgtggggtggggggaggg

SEQ ID NO: 5412 - DNA, 20 bp, Artificial Sequence
  chemically synthesized
tgtggggtggggggagggag

SEQ ID NO: 5413 - DNA, 20 bp, Artificial Sequence
  chemically synthesized
gtggggtggggggagggagg

SEQ ID NO: 5414 - DNA, 20 bp, Artificial Sequence
  chemically synthesized
tggggtggggggagggagga

SEQ ID NO: 5415 - DNA, 20 bp, Artificial Sequence
  chemically synthesized
gtggggggagggaggaggga

SEQ ID NO: 5416 - DNA, 20 bp, Artificial Sequence
  chemically synthesized
ggagggaggagggatagcat

SEQ ID NO: 5417 - DNA, 20 bp, Artificial Sequence
  chemically synthesized
gagggaggagggatagcatt

SEQ ID NO: 5418 - DNA, 20 bp, Artificial Sequence
  chemically synthesized
gggaggagggatagcattag

SEQ ID NO: 5419 - DNA, 20 bp, Artificial Sequence
  chemically synthesized
tatacctaatgctaaatgat

SEQ ID NO: 5420 - DNA, 20 bp, Artificial Sequence
  chemically synthesized
aatgctaaatgatgagttaa

SEQ ID NO: 5421 - DNA, 20 bp, Artificial Sequence
  chemically synthesized
atgctaaatgatgagttaat

SEQ ID NO: 5422 - DNA, 20 bp, Artificial Sequence
  chemically synthesized
aaatgatgagttaatgggtg

SEQ ID NO: 5423 - DNA, 20 bp, Artificial Sequence
  chemically synthesized
agttaatgggtgaagcacac

SEQ ID NO: 5424 - DNA, 20 bp, Artificial Sequence
  chemically synthesized
atgggtgaagcacaccagca

SEQ ID NO: 5425 - DNA, 20 bp, Artificial Sequence
  chemically synthesized
cacatgtaccctaaaactta

SEQ ID NO: 5426 - DNA, 20 bp, Artificial Sequence
  chemically synthesized
taaaataaaataattttaaa

SEQ ID NO: 5427 - DNA, 20 bp, Artificial Sequence
  chemically synthesized
aaataaaataattttaaaaa

SEQ ID NO: 5428 - DNA, 20 bp, Artificial Sequence
  chemically synthesized
aaataattttaaaaagagta

SEQ ID NO: 5429 - DNA, 20 bp, Artificial Sequence
  chemically synthesized
taattttaaaaagagtatag

SEQ ID NO: 5430 - DNA, 20 bp, Artificial Sequence
  chemically synthesized
aattttaaaaagagtatagt

SEQ ID NO: 5431 - DNA, 20 bp, Artificial Sequence
  chemically synthesized
attttaaaaagagtatagtg

SEQ ID NO: 5432 - DNA, 20 bp, Artificial Sequence
  chemically synthesized
agtggggatttctatgaaca

SEQ ID NO: 5433 - DNA, 20 bp, Artificial Sequence
  chemically synthesized
ttctatgaacacggtacaat

SEQ ID NO: 5434 - DNA, 20 bp, Artificial Sequence
  chemically synthesized
acacggtacaattagttatc

SEQ ID NO: 5435 - DNA, 20 bp, Artificial Sequence
  chemically synthesized
ggtacaattagttatctggc

SEQ ID NO: 5436 - DNA, 20 bp, Artificial Sequence
  chemically synthesized
ttatctggccagttactttg

SEQ ID NO: 5437 - DNA, 20 bp, Artificial Sequence
  chemically synthesized
tatctggccagttactttga

SEQ ID NO: 5438 - DNA, 20 bp, Artificial Sequence
  chemically synthesized
cagttactttgaaggctgat

SEQ ID NO: 5439 - DNA, 20 bp, Artificial Sequence
  chemically synthesized
tactttgaaggctgatcaga

SEQ ID NO: 5440 - DNA, 20 bp, Artificial Sequence
  chemically synthesized
tttgaaggctgatcagaaag

SEQ ID NO: 5441 - DNA, 20 bp, Artificial Sequence
  chemically synthesized
aggctgatcagaaagaagcc

SEQ ID NO: 5442 - DNA, 20 bp, Artificial Sequence
  chemically synthesized
agaaagaagcctagctaatc

SEQ ID NO: 5443 - DNA, 20 bp, Artificial Sequence
  chemically synthesized
agaagcctagctaatccagt

SEQ ID NO: 5444 - DNA, 20 bp, Artificial Sequence
  chemically synthesized
actcaaatgccaatatctat

SEQ ID NO: 5445 - DNA, 20 bp, Artificial Sequence
  chemically synthesized
atctattagtcctttctctt

SEQ ID NO: 5446 - DNA, 20 bp, Artificial Sequence
  chemically synthesized
attagtcctttctcttgaga

SEQ ID NO: 5447 - DNA, 20 bp, Artificial Sequence
  chemically synthesized
ctgtttcatatattacacct

SEQ ID NO: 5448 - DNA, 20 bp, Artificial Sequence
  chemically synthesized
catatattacaccttagtcc

SEQ ID NO: 5449 - DNA, 20 bp, Artificial Sequence
  chemically synthesized
atcctttgcactgaatttcc

SEQ ID NO: 5450 - DNA, 20 bp, Artificial Sequence
  chemically synthesized
gcactgaatttcccagtgtc

SEQ ID NO: 5451 - DNA, 20 bp, Artificial Sequence
  chemically synthesized
tgtctggatcatcattgatt

SEQ ID NO: 5452 - DNA, 20 bp, Artificial Sequence
  chemically synthesized
catcattgatttggttacta

SEQ ID NO: 5453 - DNA, 20 bp, Artificial Sequence
  chemically synthesized
acagacactaatcattttgc

SEQ ID NO: 5454 - DNA, 20 bp, Artificial Sequence
  chemically synthesized
taatcattttgccagaacta

SEQ ID NO: 5455 - DNA, 20 bp, Artificial Sequence
  chemically synthesized
atcattttgccagaactaaa

SEQ ID NO: 5456 - DNA, 20 bp, Artificial Sequence
  chemically synthesized
tgccagaactaaagagaaat

SEQ ID NO: 5457 - DNA, 20 bp, Artificial Sequence
  chemically synthesized
actaaagagaaatgagtacc

SEQ ID NO: 5458 - DNA, 20 bp, Artificial Sequence
  chemically synthesized
atgagtacctggctatcttt

SEQ ID NO: 5459 - DNA, 20 bp, Artificial Sequence
  chemically synthesized
tgagtacctggctatctttt

SEQ ID NO: 5460 - DNA, 20 bp, Artificial Sequence
  chemically synthesized
atcttttaggcaaccttaaa

SEQ ID NO: 5461 - DNA, 20 bp, Artificial Sequence
  chemically synthesized
tcttttaggcaaccttaaac

SEQ ID NO: 5462 - DNA, 20 bp, Artificial Sequence
  chemically synthesized
ttcaccttttctaccatttt

SEQ ID NO: 5463 - DNA, 20 bp, Artificial Sequence
  chemically synthesized
acccctcacgaatgctttat

SEQ ID NO: 5464 - DNA, 20 bp, Artificial Sequence
  chemically synthesized
aagtaatttctgtgtttttc

SEQ ID NO: 5465 - DNA, 20 bp, Artificial Sequence
  chemically synthesized
tttccagaaaatgctctttg

SEQ ID NO: 5466 - DNA, 20 bp, Artificial Sequence
  chemically synthesized
cagataacgttttttctcat

SEQ ID NO: 5467 - DNA, 20 bp, Artificial Sequence
  chemically synthesized
ctcattggtatccttttctg

SEQ ID NO: 5468 - DNA, 20 bp, Artificial Sequence
  chemically synthesized
tatccttttctgtagacata

SEQ ID NO: 5469 - DNA, 20 bp, Artificial Sequence
  chemically synthesized
ttctgtagacatatagattt

SEQ ID NO: 5470 - DNA, 20 bp, Artificial Sequence
  chemically synthesized
atattgtgctattttcttca

SEQ ID NO: 5471 - DNA, 20 bp, Artificial Sequence
  chemically synthesized
agtgtctctgtgtacatcta

SEQ ID NO: 5472 - DNA, 20 bp, Artificial Sequence
  chemically synthesized
tctgtgtacatctatagctt

SEQ ID NO: 5473 - DNA, 20 bp, Artificial Sequence
  chemically synthesized
gtgtacatctatagctttag

SEQ ID NO: 5474 - DNA, 20 bp, Artificial Sequence
  chemically synthesized
catctatagctttagtggat

SEQ ID NO: 5475 - DNA, 20 bp, Artificial Sequence
  chemically synthesized
tctatagctttagtggatta

SEQ ID NO: 5476 - DNA, 20 bp, Artificial Sequence
  chemically synthesized
tagctttagtggattagaga

SEQ ID NO: 5477 - DNA, 20 bp, Artificial Sequence
  chemically synthesized
ctttagtggattagagaaag

SEQ ID NO: 5478 - DNA, 20 bp, Artificial Sequence
  chemically synthesized
tagtggattagagaaagtag

SEQ ID NO: 5479 - DNA, 20 bp, Artificial Sequence
  chemically synthesized
agcagaaatgaacacatatt

SEQ ID NO: 5480 - DNA, 20 bp, Artificial Sequence
  chemically synthesized
tgaacacatattcagtctgc

SEQ ID NO: 5481 - DNA, 20 bp, Artificial Sequence
  chemically synthesized
gaacacatattcagtctgcc

SEQ ID NO: 5482 - DNA, 20 bp, Artificial Sequence
  chemically synthesized
taaatttatattttattatt

SEQ ID NO: 5483 - DNA, 20 bp, Artificial Sequence
  chemically synthesized
ttatattttattattcagta

SEQ ID NO: 5484 - DNA, 20 bp, Artificial Sequence
  chemically synthesized
acagaaaaatacataaataa

SEQ ID NO: 5485 - DNA, 20 bp, Artificial Sequence
  chemically synthesized
aaaatacataaataaaagta

SEQ ID NO: 5486 - DNA, 20 bp, Artificial Sequence
  chemically synthesized
ttgttaaattgacacaaaat

SEQ ID NO: 5487 - DNA, 20 bp, Artificial Sequence
  chemically synthesized
aattgacacaaaattagcaa

SEQ ID NO: 5488 - DNA, 20 bp, Artificial Sequence
  chemically synthesized
aaaagcttttaacaaacact

SEQ ID NO: 5489 - DNA, 20 bp, Artificial Sequence
  chemically synthesized
ttttaacaaacactcagacc

SEQ ID NO: 5490 - DNA, 20 bp, Artificial Sequence
  chemically synthesized
aacaaacactcagaccaaga

SEQ ID NO: 5491 - DNA, 20 bp, Artificial Sequence
  chemically synthesized
caaacactcagaccaagaaa

SEQ ID NO: 5492 - DNA, 20 bp, Artificial Sequence
  chemically synthesized
accaagaaagagaacattac

SEQ ID NO: 5493 - DNA, 20 bp, Artificial Sequence
  chemically synthesized
gaacattaccagcatctcaa

SEQ ID NO: 5494 - DNA, 20 bp, Artificial Sequence
  chemically synthesized
ctaaacaccgattgattcct

SEQ ID NO: 5495 - DNA, 20 bp, Artificial Sequence
  chemically synthesized
accgattgattcctcagttc

SEQ ID NO: 5496 - DNA, 20 bp, Artificial Sequence
  chemically synthesized
cagttctggctgcaacctga

SEQ ID NO: 5497 - DNA, 20 bp, Artificial Sequence
  chemically synthesized
attttctatgtgccattaca

SEQ ID NO: 5498 - DNA, 20 bp, Artificial Sequence
  chemically synthesized
atgtgccattacatggtgcc

SEQ ID NO: 5499 - DNA, 20 bp, Artificial Sequence
  chemically synthesized
attacatggtgccaagactg

SEQ ID NO: 5500 - DNA, 20 bp, Artificial Sequence
  chemically synthesized
ttacatggtgccaagactgc

SEQ ID NO: 5501 - DNA, 20 bp, Artificial Sequence
  chemically synthesized
tacatggtgccaagactgca

SEQ ID NO: 5502 - DNA, 20 bp, Artificial Sequence
  chemically synthesized
acatggtgccaagactgcag

SEQ ID NO: 5503 - DNA, 20 bp, Artificial Sequence
  chemically synthesized
tggtgccaagactgcagggg

SEQ ID NO: 5504 - DNA, 20 bp, Artificial Sequence
  chemically synthesized
ggcagaaaccacacttttac

SEQ ID NO: 5505 - DNA, 20 bp, Artificial Sequence
  chemically synthesized
aaaccacacttttactggaa

SEQ ID NO: 5506 - DNA, 20 bp, Artificial Sequence
  chemically synthesized
cacttttactggaaaagctt

SEQ ID NO: 5507 - DNA, 20 bp, Artificial Sequence
  chemically synthesized
acttttactggaaaagcttt

SEQ ID NO: 5508 - DNA, 20 bp, Artificial Sequence
  chemically synthesized
taggacatcgactcctactg

SEQ ID NO: 5509 - DNA, 20 bp, Artificial Sequence
  chemically synthesized
aggacatcgactcctactgc

SEQ ID NO: 5510 - DNA, 20 bp, Artificial Sequence
  chemically synthesized
ggacatcgactcctactgca

SEQ ID NO: 5511 - DNA, 20 bp, Artificial Sequence
  chemically synthesized
gacatcgactcctactgcag

SEQ ID NO: 5512 - DNA, 20 bp, Artificial Sequence
  chemically synthesized
tcctactgcaggggtgttct

SEQ ID NO: 5513 - DNA, 20 bp, Artificial Sequence
  chemically synthesized
actgcaggggtgttcttggc

SEQ ID NO: 5514 - DNA, 20 bp, Artificial Sequence
  chemically synthesized
ctgcaggggtgttcttggct

SEQ ID NO: 5515 - DNA, 20 bp, Artificial Sequence
  chemically synthesized
aggggtgttcttggctaggt

SEQ ID NO: 5516 - DNA, 20 bp, Artificial Sequence
  chemically synthesized
ctaggttggcattaattttt

SEQ ID NO: 5517 - DNA, 20 bp, Artificial Sequence
  chemically synthesized
attaatttttaagtttctgc

SEQ ID NO: 5518 - DNA, 20 bp, Artificial Sequence
  chemically synthesized
taatttttaagtttctgcaa

SEQ ID NO: 5519 - DNA, 20 bp, Artificial Sequence
  chemically synthesized
aagtttctgcaagagacttc

SEQ ID NO: 5520 - DNA, 20 bp, Artificial Sequence
  chemically synthesized
agtttctgcaagagacttct

SEQ ID NO: 5521 - DNA, 20 bp, Artificial Sequence
  chemically synthesized
gcaagagacttctgggaaaa

SEQ ID NO: 5522 - DNA, 20 bp, Artificial Sequence
  chemically synthesized
ctatttttatttccttcatc

SEQ ID NO: 5523 - DNA, 20 bp, Artificial Sequence
  chemically synthesized
atttttatttccttcatctg

SEQ ID NO: 5524 - DNA, 20 bp, Artificial Sequence
  chemically synthesized
tttttatttccttcatctgg

SEQ ID NO: 5525 - DNA, 20 bp, Artificial Sequence
  chemically synthesized
gaggcctctattcactactc

SEQ ID NO: 5526 - DNA, 20 bp, Artificial Sequence
  chemically synthesized
ctctagcaattatcttctgc

SEQ ID NO: 5527 - DNA, 20 bp, Artificial Sequence
  chemically synthesized
caattatcttctgcaagtaa

SEQ ID NO: 5528 - DNA, 20 bp, Artificial Sequence
  chemically synthesized
agtaatggtaacaaatatcc

SEQ ID NO: 5529 - DNA, 20 bp, Artificial Sequence
  chemically synthesized
gtaatggtaacaaatatcct

SEQ ID NO: 5530 - DNA, 20 bp, Artificial Sequence
  chemically synthesized
taatggtaacaaatatccta

SEQ ID NO: 5531 - DNA, 20 bp, Artificial Sequence
  chemically synthesized
gtaacaaatatcctagggaa

SEQ ID NO: 5532 - DNA, 20 bp, Artificial Sequence
  chemically synthesized
aacaaatatcctagggaatg

SEQ ID NO: 5533 - DNA, 20 bp, Artificial Sequence
  chemically synthesized
gggaatggagacacaacctc

SEQ ID NO: 5534 - DNA, 20 bp, Artificial Sequence
  chemically synthesized
aatggagacacaacctcaag

SEQ ID NO: 5535 - DNA, 20 bp, Artificial Sequence
  chemically synthesized
cctcaagtagaacatctctt

SEQ ID NO: 5536 - DNA, 20 bp, Artificial Sequence
  chemically synthesized
tttaacaatacgattttgat

SEQ ID NO: 5537 - DNA, 20 bp, Artificial Sequence
  chemically synthesized
caatacgattttgataagcc

SEQ ID NO: 5538 - DNA, 20 bp, Artificial Sequence
  chemically synthesized
aatacgattttgataagcct

SEQ ID NO: 5539 - DNA, 20 bp, Artificial Sequence
  chemically synthesized
ttttgataagcctaggaaaa

SEQ ID NO: 5540 - DNA, 20 bp, Artificial Sequence
  chemically synthesized
tttgataagcctaggaaaat

SEQ ID NO: 5541 - DNA, 20 bp, Artificial Sequence
  chemically synthesized
ttgataagcctaggaaaata

SEQ ID NO: 5542 - DNA, 20 bp, Artificial Sequence
  chemically synthesized
gataagcctaggaaaatagg

SEQ ID NO: 5543 - DNA, 20 bp, Artificial Sequence
  chemically synthesized
ataagcctaggaaaataggg

SEQ ID NO: 5544 - DNA, 20 bp, Artificial Sequence
  chemically synthesized
cctaggaaaatagggaggta

SEQ ID NO: 5545 - DNA, 20 bp, Artificial Sequence
  chemically synthesized
gaaaatagggaggtatagtg

SEQ ID NO: 5546 - DNA, 20 bp, Artificial Sequence
  chemically synthesized
aaatagggaggtatagtgta

SEQ ID NO: 5547 - DNA, 20 bp, Artificial Sequence
  chemically synthesized
tagggaggtatagtgtagag

SEQ ID NO: 5548 - DNA, 20 bp, Artificial Sequence
  chemically synthesized
ggtatagtgtagagcagtcc

SEQ ID NO: 5549 - DNA, 20 bp, Artificial Sequence
  chemically synthesized
gagcagtcctggccacttac

SEQ ID NO: 5550 - DNA, 20 bp, Artificial Sequence
  chemically synthesized
tcctggccacttaccagtac

SEQ ID NO: 5551 - DNA, 20 bp, Artificial Sequence
  chemically synthesized
cacttaccagtactggtccg

SEQ ID NO: 5552 - DNA, 20 bp, Artificial Sequence
  chemically synthesized
agtactggtccgtggcctgc

SEQ ID NO: 5553 - DNA, 20 bp, Artificial Sequence
  chemically synthesized
gtactggtccgtggcctgct

SEQ ID NO: 5554 - DNA, 20 bp, Artificial Sequence
  chemically synthesized
tccgtggcctgctaggaacc

SEQ ID NO: 5555 - DNA, 20 bp, Artificial Sequence
  chemically synthesized
ctgctaggaacctggtctca

SEQ ID NO: 5556 - DNA, 20 bp, Artificial Sequence
  chemically synthesized
ctaggaacctggtctcacag

SEQ ID NO: 5557 - DNA, 20 bp, Artificial Sequence
  chemically synthesized
taggaacctggtctcacagc

SEQ ID NO: 5558 - DNA, 20 bp, Artificial Sequence
  chemically synthesized
aggaacctggtctcacagca

SEQ ID NO: 5559 - DNA, 20 bp, Artificial Sequence
  chemically synthesized
ggaacctggtctcacagcag

SEQ ID NO: 5560 - DNA, 20 bp, Artificial Sequence
  chemically synthesized
gaacctggtctcacagcagg

SEQ ID NO: 5561 - DNA, 20 bp, Artificial Sequence
  chemically synthesized
tggtctcacagcagggggat

SEQ ID NO: 5562 - DNA, 20 bp, Artificial Sequence
  chemically synthesized
ctcacagcagggggatgagc

SEQ ID NO: 5563 - DNA, 20 bp, Artificial Sequence
  chemically synthesized
atgagcaagcattactgcct

SEQ ID NO: 5564 - DNA, 20 bp, Artificial Sequence
  chemically synthesized
agctcctcctcctgtcacat

SEQ ID NO: 5565 - DNA, 20 bp, Artificial Sequence
  chemically synthesized
tcctcctcctgtcacatcgg

SEQ ID NO: 5566 - DNA, 20 bp, Artificial Sequence
  chemically synthesized
tcctcctgtcacatcggcag

SEQ ID NO: 5567 - DNA, 20 bp, Artificial Sequence
  chemically synthesized
tcctgtcacatcggcagtgg

SEQ ID NO: 5568 - DNA, 20 bp, Artificial Sequence
  chemically synthesized
cacatcggcagtggcggcat

SEQ ID NO: 5569 - DNA, 20 bp, Artificial Sequence
  chemically synthesized
gtggcggcattagattctca

SEQ ID NO: 5570 - DNA, 20 bp, Artificial Sequence
  chemically synthesized
ggcggcattagattctcata

SEQ ID NO: 5571 - DNA, 20 bp, Artificial Sequence
  chemically synthesized
gcggcattagattctcatag

SEQ ID NO: 5572 - DNA, 20 bp, Artificial Sequence
  chemically synthesized
agattctcatagaggcatgc

SEQ ID NO: 5573 - DNA, 20 bp, Artificial Sequence
  chemically synthesized
gattctcatagaggcatgca

SEQ ID NO: 5574 - DNA, 20 bp, Artificial Sequence
  chemically synthesized
attctcatagaggcatgcaa

SEQ ID NO: 5575 - DNA, 20 bp, Artificial Sequence
  chemically synthesized
atagaggcatgcaagggatc

SEQ ID NO: 5576 - DNA, 20 bp, Artificial Sequence
  chemically synthesized
tagaggcatgcaagggatct

SEQ ID NO: 5577 - DNA, 20 bp, Artificial Sequence
  chemically synthesized
catgcaagggatctaggttg

SEQ ID NO: 5578 - DNA, 20 bp, Artificial Sequence
  chemically synthesized
tctaggttgcggcttcttat

SEQ ID NO: 5579 - DNA, 20 bp, Artificial Sequence
  chemically synthesized
aatctaatgcctaatgctct

SEQ ID NO: 5580 - DNA, 20 bp, Artificial Sequence
  chemically synthesized
atctaatgcctaatgctctg

SEQ ID NO: 5581 - DNA, 20 bp, Artificial Sequence
  chemically synthesized
taatgcctaatgctctgagg

SEQ ID NO: 5582 - DNA, 20 bp, Artificial Sequence
  chemically synthesized
cctaatgctctgaggtggaa

SEQ ID NO: 5583 - DNA, 20 bp, Artificial Sequence
  chemically synthesized
ctgcaccttgtcttccacaa

SEQ ID NO: 5584 - DNA, 20 bp, Artificial Sequence
  chemically synthesized
caccttgtcttccacaaaag

SEQ ID NO: 5585 - DNA, 20 bp, Artificial Sequence
  chemically synthesized
tcttccacaaaagcagtccc

SEQ ID NO: 5586 - DNA, 20 bp, Artificial Sequence
  chemically synthesized
ccctggtaccaaaaacattg

SEQ ID NO: 5587 - DNA, 20 bp, Artificial Sequence
  chemically synthesized
ccaaaaacattgaagactgc

SEQ ID NO: 5588 - DNA, 20 bp, Artificial Sequence
  chemically synthesized
cattgaagactgctggtgta

SEQ ID NO: 5589 - DNA, 20 bp, Artificial Sequence
  chemically synthesized
gtacagtgaacatctgcctg

SEQ ID NO: 5590 - DNA, 20 bp, Artificial Sequence
  chemically synthesized
tctgcctgtggatttattat

SEQ ID NO: 5591 - DNA, 20 bp, Artificial Sequence
  chemically synthesized
gcctgtggatttattattag

SEQ ID NO: 5592 - DNA, 20 bp, Artificial Sequence
  chemically synthesized
aatcatgtcctctcacttct

SEQ ID NO: 5593 - DNA, 20 bp, Artificial Sequence
  chemically synthesized
gaatcactgatttctcccac

SEQ ID NO: 5594 - DNA, 20 bp, Artificial Sequence
  chemically synthesized
tgatttctcccactggacct

SEQ ID NO: 5595 - DNA, 20 bp, Artificial Sequence
  chemically synthesized
cccactggaccttagctttt

SEQ ID NO: 5596 - DNA, 20 bp, Artificial Sequence
  chemically synthesized
ggaccttagcttttcggtgt

SEQ ID NO: 5597 - DNA, 20 bp, Artificial Sequence
  chemically synthesized
accttagcttttcggtgtaa

SEQ ID NO: 5598 - DNA, 20 bp, Artificial Sequence
  chemically synthesized
cggtgtaagagttaaatgaa

SEQ ID NO: 5599 - DNA, 20 bp, Artificial Sequence
  chemically synthesized
ttaaatgaatagcaattgaa

SEQ ID NO: 5600 - DNA, 20 bp, Artificial Sequence
  chemically synthesized
tgaatagcaattgaatggac

SEQ ID NO: 5601 - DNA, 20 bp, Artificial Sequence
  chemically synthesized
tacttttgtcaccttgttct

SEQ ID NO: 5602 - DNA, 20 bp, Artificial Sequence
  chemically synthesized
taataaccgtgacttcattt

SEQ ID NO: 5603 - DNA, 20 bp, Artificial Sequence
  chemically synthesized
aataaccgtgacttcattta

SEQ ID NO: 5604 - DNA, 20 bp, Artificial Sequence
  chemically synthesized
aaccgtgacttcatttaagg

SEQ ID NO: 5605 - DNA, 20 bp, Artificial Sequence
  chemically synthesized
cgtgacttcatttaaggcag

SEQ ID NO: 5606 - DNA, 20 bp, Artificial Sequence
  chemically synthesized
cagcagttacaatgatatga

SEQ ID NO: 5607 - DNA, 20 bp, Artificial Sequence
  chemically synthesized
gtctacctattaaaaaaaaa

SEQ ID NO: 5608 - DNA, 20 bp, Artificial Sequence
  chemically synthesized
tctacctattaaaaaaaaaa

SEQ ID NO: 5609 - DNA, 20 bp, Artificial Sequence
  chemically synthesized
tattaaaaaaaaaaaggcaa

SEQ ID NO: 5610 - DNA, 20 bp, Artificial Sequence
  chemically synthesized
ttaaaaaaaaaaaggcaaaa

SEQ ID NO: 5611 - DNA, 20 bp, Artificial Sequence
  chemically synthesized
gtgtttccctaacatcactg

SEQ ID NO: 5612 - DNA, 20 bp, Artificial Sequence
  chemically synthesized
gctgttttcgtaacgtttct

SEQ ID NO: 5613 - DNA, 20 bp, Artificial Sequence
  chemically synthesized
gtaacgtttctcagtgacgc

SEQ ID NO: 5614 - DNA, 20 bp, Artificial Sequence
  chemically synthesized
cgtttctcagtgacgctgga

SEQ ID NO: 5615 - DNA, 20 bp, Artificial Sequence
  chemically synthesized
ttctcagtgacgctggatag

SEQ ID NO: 5616 - DNA, 20 bp, Artificial Sequence
  chemically synthesized
gacgctggatagtagccttg

SEQ ID NO: 5617 - DNA, 20 bp, Artificial Sequence
  chemically synthesized
acgctggatagtagccttgc

SEQ ID NO: 5618 - DNA, 20 bp, Artificial Sequence
  chemically synthesized
gtagccttgcaggccttaca

SEQ ID NO: 5619 - DNA, 20 bp, Artificial Sequence
  chemically synthesized
tagccttgcaggccttacaa

SEQ ID NO: 5620 - DNA, 20 bp, Artificial Sequence
  chemically synthesized
atctgataactgcttctcac

SEQ ID NO: 5621 - DNA, 20 bp, Artificial Sequence
  chemically synthesized
actgcttctcactggctctg

SEQ ID NO: 5622 - DNA, 20 bp, Artificial Sequence
  chemically synthesized
ctgcttctcactggctctgc

SEQ ID NO: 5623 - DNA, 20 bp, Artificial Sequence
  chemically synthesized
gcaggctaccacatcaacaa

SEQ ID NO: 5624 - DNA, 20 bp, Artificial Sequence
  chemically synthesized
taccacatcaacaacagttt

SEQ ID NO: 5625 - DNA, 20 bp, Artificial Sequence
  chemically synthesized
agctgttgttgcctaattca

SEQ ID NO: 5626 - DNA, 20 bp, Artificial Sequence
  chemically synthesized
ttgcctaattcatggaaaac

SEQ ID NO: 5627 - DNA, 20 bp, Artificial Sequence
  chemically synthesized
tcatggaaaacaagtttcct

SEQ ID NO: 5628 - DNA, 20 bp, Artificial Sequence
  chemically synthesized
tggaaaacaagtttccttag

SEQ ID NO: 5629 - DNA, 20 bp, Artificial Sequence
  chemically synthesized
aaacaagtttccttagaagc

SEQ ID NO: 5630 - DNA, 20 bp, Artificial Sequence
  chemically synthesized
tccttagaagctggcttttt

SEQ ID NO: 5631 - DNA, 20 bp, Artificial Sequence
  chemically synthesized
agctggctttttgagatata

SEQ ID NO: 5632 - DNA, 20 bp, Artificial Sequence
  chemically synthesized
tatggaaaaatgtctccacc

SEQ ID NO: 5633 - DNA, 20 bp, Artificial Sequence
  chemically synthesized
gtctccacctggctactatg

SEQ ID NO: 5634 - DNA, 20 bp, Artificial Sequence
  chemically synthesized
tactatgtagcttttcaaaa

SEQ ID NO: 5635 - DNA, 20 bp, Artificial Sequence
  chemically synthesized
atgtagcttttcaaaacaga

SEQ ID NO: 5636 - DNA, 20 bp, Artificial Sequence
  chemically synthesized
tctccatctgctcttccttt

SEQ ID NO: 5637 - DNA, 20 bp, Artificial Sequence
  chemically synthesized
ctccatctgctcttcctttc

SEQ ID NO: 5638 - DNA, 20 bp, Artificial Sequence
  chemically synthesized
ctgctcttcctttcaggacc

SEQ ID NO: 5639 - DNA, 20 bp, Artificial Sequence
  chemically synthesized
tgctcttcctttcaggacct

SEQ ID NO: 5640 - DNA, 20 bp, Artificial Sequence
  chemically synthesized
tgaaattgccttttcttcct

SEQ ID NO: 5641 - DNA, 20 bp, Artificial Sequence
  chemically synthesized
gaaattgccttttcttcctc

SEQ ID NO: 5642 - DNA, 20 bp, Artificial Sequence
  chemically synthesized
aattgccttttcttcctcag

SEQ ID NO: 5643 - DNA, 20 bp, Artificial Sequence
  chemically synthesized
ttgccttttcttcctcagga

SEQ ID NO: 5644 - DNA, 20 bp, Artificial Sequence
  chemically synthesized
tgccttttcttcctcaggag

SEQ ID NO: 5645 - DNA, 20 bp, Artificial Sequence
  chemically synthesized
tttcttcctcaggagaggtt

SEQ ID NO: 5646 - DNA, 20 bp, Artificial Sequence
  chemically synthesized
agaggtttagttattttttt

SEQ ID NO: 5647 - DNA, 20 bp, Artificial Sequence
  chemically synthesized
tttttttaagtaattgcttc

SEQ ID NO: 5648 - DNA, 20 bp, Artificial Sequence
  chemically synthesized
tttaagtaattgcttccaga

SEQ ID NO: 5649 - DNA, 20 bp, Artificial Sequence
  chemically synthesized
taagtaattgcttccagata

SEQ ID NO: 5650 - DNA, 20 bp, Artificial Sequence
  chemically synthesized
aagtaattgcttccagatag

SEQ ID NO: 5651 - DNA, 20 bp, Artificial Sequence
  chemically synthesized
aacctgtttctttctgtata

SEQ ID NO: 5652 - DNA, 20 bp, Artificial Sequence
  chemically synthesized
gtttctttctgtataaagcc

SEQ ID NO: 5653 - DNA, 20 bp, Artificial Sequence
  chemically synthesized
taaagcccagtaatcatata

SEQ ID NO: 5654 - DNA, 20 bp, Artificial Sequence
  chemically synthesized
catataaagtttactttcat

SEQ ID NO: 5655 - DNA, 20 bp, Artificial Sequence
  chemically synthesized
tttactgattttcctccctt

SEQ ID NO: 5656 - DNA, 20 bp, Artificial Sequence
  chemically synthesized
ctccctttggctgaattgta

SEQ ID NO: 5657 - DNA, 20 bp, Artificial Sequence
  chemically synthesized
gctgaattgtaaagattctg

SEQ ID NO: 5658 - DNA, 20 bp, Artificial Sequence
  chemically synthesized
cttcataaatcttatcatca

SEQ ID NO: 5659 - DNA, 20 bp, Artificial Sequence
  chemically synthesized
atcatcatagtacaattata

SEQ ID NO: 5660 - DNA, 20 bp, Artificial Sequence
  chemically synthesized
caattatatagctctaaaat

SEQ ID NO: 5661 - DNA, 20 bp, Artificial Sequence
  chemically synthesized
taaaataagcaatgatttct

SEQ ID NO: 5662 - DNA, 20 bp, Artificial Sequence
  chemically synthesized
aaaataagcaatgatttctg

SEQ ID NO: 5663 - DNA, 20 bp, Artificial Sequence
  chemically synthesized
atgatttctgaggatactct

SEQ ID NO: 5664 - DNA, 20 bp, Artificial Sequence
  chemically synthesized
tgatttctgaggatactctt

SEQ ID NO: 5665 - DNA, 20 bp, Artificial Sequence
  chemically synthesized
ttttattaactgttttgtca

SEQ ID NO: 5666 - DNA, 20 bp, Artificial Sequence
  chemically synthesized
gccattatttcaaactattt

SEQ ID NO: 5667 - DNA, 20 bp, Artificial Sequence
  chemically synthesized
ctattttggttcacattcta

SEQ ID NO: 5668 - DNA, 20 bp, Artificial Sequence
  chemically synthesized
tattttggttcacattctat

SEQ ID NO: 5669 - DNA, 20 bp, Artificial Sequence
  chemically synthesized
tctataggttgcctaatctg

SEQ ID NO: 5670 - DNA, 20 bp, Artificial Sequence
  chemically synthesized
atctgaagcacaaacactca

SEQ ID NO: 5671 - DNA, 20 bp, Artificial Sequence
  chemically synthesized
gcacaaacactcatagtatg

SEQ ID NO: 5672 - DNA, 20 bp, Artificial Sequence
  chemically synthesized
cactcatagtatgaagtctt

SEQ ID NO: 5673 - DNA, 20 bp, Artificial Sequence
  chemically synthesized
atagtatgaagtcttcagat

SEQ ID NO: 5674 - DNA, 20 bp, Artificial Sequence
  chemically synthesized
taactctcaaaccaacaact

SEQ ID NO: 5675 - DNA, 20 bp, Artificial Sequence
  chemically synthesized
aaccaacaactcagttgtgt

SEQ ID NO: 5676 - DNA, 20 bp, Artificial Sequence
  chemically synthesized
tcattctgatgcttccctat

SEQ ID NO: 5677 - DNA, 20 bp, Artificial Sequence
  chemically synthesized
ttctgatgcttccctatgag

SEQ ID NO: 5678 - DNA, 20 bp, Artificial Sequence
  chemically synthesized
gatgcttccctatgagtggc

SEQ ID NO: 5679 - DNA, 20 bp, Artificial Sequence
  chemically synthesized
gcttccctatgagtggctgg

SEQ ID NO: 5680 - DNA, 20 bp, Artificial Sequence
  chemically synthesized
gctggtggaaaacatattgt

SEQ ID NO: 5681 - DNA, 20 bp, Artificial Sequence
  chemically synthesized
aaacatattgtcagttgttg

SEQ ID NO: 5682 - DNA, 20 bp, Artificial Sequence
  chemically synthesized
tgaagaattctctgcttccc

SEQ ID NO: 5683 - DNA, 20 bp, Artificial Sequence
  chemically synthesized
ctgcttccccagtgttgtgt

SEQ ID NO: 5684 - DNA, 20 bp, Artificial Sequence
  chemically synthesized
ccagtgttgtgtcagctctc

SEQ ID NO: 5685 - DNA, 20 bp, Artificial Sequence
  chemically synthesized
tgtgtcagctctccggcgta

SEQ ID NO: 5686 - DNA, 20 bp, Artificial Sequence
  chemically synthesized
gtgtcagctctccggcgtat

SEQ ID NO: 5687 - DNA, 20 bp, Artificial Sequence
  chemically synthesized
gtcagctctccggcgtatgg

SEQ ID NO: 5688 - DNA, 20 bp, Artificial Sequence
  chemically synthesized
tcagctctccggcgtatggg

SEQ ID NO: 5689 - DNA, 20 bp, Artificial Sequence
  chemically synthesized
cagctctccggcgtatggga

SEQ ID NO: 5690 - DNA, 20 bp, Artificial Sequence
  chemically synthesized
ctctccggcgtatgggaggg

SEQ ID NO: 5691 - DNA, 20 bp, Artificial Sequence
  chemically synthesized
tggatgcttattcactttca

SEQ ID NO: 5692 - DNA, 20 bp, Artificial Sequence
  chemically synthesized
cttattcactttcaaagcat

SEQ ID NO: 5693 - DNA, 20 bp, Artificial Sequence
  chemically synthesized
attcactttcaaagcattag

SEQ ID NO: 5694 - DNA, 20 bp, Artificial Sequence
  chemically synthesized
ttcactttcaaagcattaga

SEQ ID NO: 5695 - DNA, 20 bp, Artificial Sequence
  chemically synthesized
actttcaaagcattagaagg

SEQ ID NO: 5696 - DNA, 20 bp, Artificial Sequence
  chemically synthesized
gcattagaaggaagcttctt

SEQ ID NO: 5697 - DNA, 20 bp, Artificial Sequence
  chemically synthesized
aggaagcttctttggccatt

SEQ ID NO: 5698 - DNA, 20 bp, Artificial Sequence
  chemically synthesized
ttggccattgagaaatctat

SEQ ID NO: 5699 - DNA, 20 bp, Artificial Sequence
  chemically synthesized
agacattcacatgacctcta

SEQ ID NO: 5700 - DNA, 20 bp, Artificial Sequence
  chemically synthesized
tcacatgacctctacagatt

SEQ ID NO: 5701 - DNA, 20 bp, Artificial Sequence
  chemically synthesized
catgacctctacagattcag

SEQ ID NO: 5702 - DNA, 20 bp, Artificial Sequence
  chemically synthesized
ttctcttttcattataaaac

SEQ ID NO: 5703 - DNA, 20 bp, Artificial Sequence
  chemically synthesized
tctcttttcattataaaact

SEQ ID NO: 5704 - DNA, 20 bp, Artificial Sequence
  chemically synthesized
ctcttttcattataaaactg

SEQ ID NO: 5705 - DNA, 20 bp, Artificial Sequence
  chemically synthesized
ttcattataaaactggggca

SEQ ID NO: 5706 - DNA, 20 bp, Artificial Sequence
  chemically synthesized
tcattataaaactggggcat

SEQ ID NO: 5707 - DNA, 20 bp, Artificial Sequence
  chemically synthesized
ctggggcataggaatcttgt

SEQ ID NO: 5708 - DNA, 20 bp, Artificial Sequence
  chemically synthesized
gcataggaatcttgtcagat

SEQ ID NO: 5709 - DNA, 20 bp, Artificial Sequence
  chemically synthesized
ttgtcagattggccacattc

SEQ ID NO: 5710 - DNA, 20 bp, Artificial Sequence
  chemically synthesized
cagattggccacattccagt

SEQ ID NO: 5711 - DNA, 20 bp, Artificial Sequence
  chemically synthesized
ttggccacattccagtcggc

SEQ ID NO: 5712 - DNA, 20 bp, Artificial Sequence
  chemically synthesized
tggccacattccagtcggcc

SEQ ID NO: 5713 - DNA, 20 bp, Artificial Sequence
  chemically synthesized
gccacattccagtcggccag

SEQ ID NO: 5714 - DNA, 20 bp, Artificial Sequence
  chemically synthesized
ccacattccagtcggccagg

SEQ ID NO: 5715 - DNA, 20 bp, Artificial Sequence
  chemically synthesized
cacattccagtcggccagga

SEQ ID NO: 5716 - DNA, 20 bp, Artificial Sequence
  chemically synthesized
gtcggccaggagggaccatg

SEQ ID NO: 5717 - DNA, 20 bp, Artificial Sequence
  chemically synthesized
atgcagacatttattatcat

SEQ ID NO: 5718 - DNA, 20 bp, Artificial Sequence
  chemically synthesized
tgcagacatttattatcatt

SEQ ID NO: 5719 - DNA, 20 bp, Artificial Sequence
  chemically synthesized
gcagacatttattatcatta

SEQ ID NO: 5720 - DNA, 20 bp, Artificial Sequence
  chemically synthesized
tttattatcattagggaacc

SEQ ID NO: 5721 - DNA, 20 bp, Artificial Sequence
  chemically synthesized
tattatcattagggaacctg

SEQ ID NO: 5722 - DNA, 20 bp, Artificial Sequence
  chemically synthesized
tatcattagggaacctggag

SEQ ID NO: 5723 - DNA, 20 bp, Artificial Sequence
  chemically synthesized
ctcttttttttttttttttt

SEQ ID NO: 5724 - DNA, 20 bp, Artificial Sequence
  chemically synthesized
ttttttttttttttttgaga

SEQ ID NO: 5725 - DNA, 20 bp, Artificial Sequence
  chemically synthesized
ttttttttttttttgagaca

SEQ ID NO: 5726 - DNA, 20 bp, Artificial Sequence
  chemically synthesized
cagagtctctctctgtcgcc

SEQ ID NO: 5727 - DNA, 20 bp, Artificial Sequence
  chemically synthesized
agagtctctctctgtcgccc

SEQ ID NO: 5728 - DNA, 20 bp, Artificial Sequence
  chemically synthesized
tctctctctgtcgcccaggc

SEQ ID NO: 5729 - DNA, 20 bp, Artificial Sequence
  chemically synthesized
tctctctgtcgcccaggctg

SEQ ID NO: 5730 - DNA, 20 bp, Artificial Sequence
  chemically synthesized
ctgtcgcccaggctggagtg

SEQ ID NO: 5731 - DNA, 20 bp, Artificial Sequence
  chemically synthesized
tcgcccaggctggagtgcag

SEQ ID NO: 5732 - DNA, 20 bp, Artificial Sequence
  chemically synthesized
gcgtgatctcgactcactgc

SEQ ID NO: 5733 - DNA, 20 bp, Artificial Sequence
  chemically synthesized
tcactgcaagctccacctcc

SEQ ID NO: 5734 - DNA, 20 bp, Artificial Sequence
  chemically synthesized
cactgcaagctccacctccc

SEQ ID NO: 5735 - DNA, 20 bp, Artificial Sequence
  chemically synthesized
ttcacgccattctcctgtct

SEQ ID NO: 5736 - DNA, 20 bp, Artificial Sequence
  chemically synthesized
ttctcctgtctcagcctccc

SEQ ID NO: 5737 - DNA, 20 bp, Artificial Sequence
  chemically synthesized
gtctcagcctcccgagtacc

SEQ ID NO: 5738 - DNA, 20 bp, Artificial Sequence
  chemically synthesized
tctcagcctcccgagtacct

SEQ ID NO: 5739 - DNA, 20 bp, Artificial Sequence
  chemically synthesized
ctcccgagtacctgggacta

SEQ ID NO: 5740 - DNA, 20 bp, Artificial Sequence
  chemically synthesized
tcccgagtacctgggactac

SEQ ID NO: 5741 - DNA, 20 bp, Artificial Sequence
  chemically synthesized
caggtgcccgccaccacgcc

SEQ ID NO: 5742 - DNA, 20 bp, Artificial Sequence
  chemically synthesized
gatactttcttgtgtttttt

SEQ ID NO: 5743 - DNA, 20 bp, Artificial Sequence
  chemically synthesized
actttcttgtgtttttttag

SEQ ID NO: 5744 - DNA, 20 bp, Artificial Sequence
  chemically synthesized
tttcttgtgtttttttagta

SEQ ID NO: 5745 - DNA, 20 bp, Artificial Sequence
  chemically synthesized
ttgtgtttttttagtagaga

SEQ ID NO: 5746 - DNA, 20 bp, Artificial Sequence
  chemically synthesized
tgtgtttttttagtagagac

SEQ ID NO: 5747 - DNA, 20 bp, Artificial Sequence
  chemically synthesized
gtgtttttttagtagagacg

SEQ ID NO: 5748 - DNA, 20 bp, Artificial Sequence
  chemically synthesized
agacggggtttcaccattgc

SEQ ID NO: 5749 - DNA, 20 bp, Artificial Sequence
  chemically synthesized
ggggtttcaccattgctggc

SEQ ID NO: 5750 - DNA, 20 bp, Artificial Sequence
  chemically synthesized
gggtttcaccattgctggcc

SEQ ID NO: 5751 - DNA, 20 bp, Artificial Sequence
  chemically synthesized
ttcaccattgctggccagga

SEQ ID NO: 5752 - DNA, 20 bp, Artificial Sequence
  chemically synthesized
acctcatgatccgcccgcct

SEQ ID NO: 5753 - DNA, 20 bp, Artificial Sequence
  chemically synthesized
tcatgatccgcccgcctcgg

SEQ ID NO: 5754 - DNA, 20 bp, Artificial Sequence
  chemically synthesized
cggcagctactatgattata

SEQ ID NO: 5755 - DNA, 20 bp, Artificial Sequence
  chemically synthesized
tatattgacattttcccctc

SEQ ID NO: 5756 - DNA, 20 bp, Artificial Sequence
  chemically synthesized
cccctctagaacctacctca

SEQ ID NO: 5757 - DNA, 20 bp, Artificial Sequence
  chemically synthesized
ctcacagttttcacttctga

SEQ ID NO: 5758 - DNA, 20 bp, Artificial Sequence
  chemically synthesized
ttcacttctgatagctatac

SEQ ID NO: 5759 - DNA, 20 bp, Artificial Sequence
  chemically synthesized
acttctgatagctataccag

SEQ ID NO: 5760 - DNA, 20 bp, Artificial Sequence
  chemically synthesized
agctataccagaagatgcac

SEQ ID NO: 5761 - DNA, 20 bp, Artificial Sequence
  chemically synthesized
cactagatcctctttgacat

SEQ ID NO: 5762 - DNA, 20 bp, Artificial Sequence
  chemically synthesized
actagatcctctttgacatc

SEQ ID NO: 5763 - DNA, 20 bp, Artificial Sequence
  chemically synthesized
attaaccttatactgtaacc

SEQ ID NO: 5764 - DNA, 20 bp, Artificial Sequence
  chemically synthesized
aaccttatactgtaacccag

SEQ ID NO: 5765 - DNA, 20 bp, Artificial Sequence
  chemically synthesized
gaagacctaatttattgttc

SEQ ID NO: 5766 - DNA, 20 bp, Artificial Sequence
  chemically synthesized
aagacctaatttattgttct

SEQ ID NO: 5767 - DNA, 20 bp, Artificial Sequence
  chemically synthesized
tttacacttatctttctaac

SEQ ID NO: 5768 - DNA, 20 bp, Artificial Sequence
  chemically synthesized
accagatactttactctgtc

SEQ ID NO: 5769 - DNA, 20 bp, Artificial Sequence
  chemically synthesized
agaaacaatttcctcacttt

SEQ ID NO: 5770 - DNA, 20 bp, Artificial Sequence
  chemically synthesized
gaaacaatttcctcactttg

SEQ ID NO: 5771 - DNA, 20 bp, Artificial Sequence
  chemically synthesized
atttcctcactttgaggctt

SEQ ID NO: 5772 - DNA, 20 bp, Artificial Sequence
  chemically synthesized
cactttgaggcttaagctat

SEQ ID NO: 5773 - DNA, 20 bp, Artificial Sequence
  chemically synthesized
gcttaagctattagaaacca

SEQ ID NO: 5774 - DNA, 20 bp, Artificial Sequence
  chemically synthesized
ctgtatttttgtttccctct

SEQ ID NO: 5775 - DNA, 20 bp, Artificial Sequence
  chemically synthesized
tgtttccctctgagtcaaat

SEQ ID NO: 5776 - DNA, 20 bp, Artificial Sequence
  chemically synthesized
ttccctctgagtcaaataag

SEQ ID NO: 5777 - DNA, 20 bp, Artificial Sequence
  chemically synthesized
ctctgagtcaaataagtaga

SEQ ID NO: 5778 - DNA, 20 bp, Artificial Sequence
  chemically synthesized
ctgagtcaaataagtagaca

SEQ ID NO: 5779 - DNA, 20 bp, Artificial Sequence
  chemically synthesized
tgagtcaaataagtagacag

SEQ ID NO: 5780 - DNA, 20 bp, Artificial Sequence
  chemically synthesized
agaggctatgttattgaatg

SEQ ID NO: 5781 - DNA, 20 bp, Artificial Sequence
  chemically synthesized
atgttattgaatgaagtcca

SEQ ID NO: 5782 - DNA, 20 bp, Artificial Sequence
  chemically synthesized
ttgaatgaagtccaaagtga

SEQ ID NO: 5783 - DNA, 20 bp, Artificial Sequence
  chemically synthesized
tgaatgaagtccaaagtgaa

SEQ ID NO: 5784 - DNA, 20 bp, Artificial Sequence
  chemically synthesized
tgaagtccaaagtgaaagga

SEQ ID NO: 5785 - DNA, 20 bp, Artificial Sequence
  chemically synthesized
gaagtccaaagtgaaaggaa

SEQ ID NO: 5786 - DNA, 20 bp, Artificial Sequence
  chemically synthesized
gtccaaagtgaaaggaaagg

SEQ ID NO: 5787 - DNA, 20 bp, Artificial Sequence
  chemically synthesized
tccaaagtgaaaggaaagga

SEQ ID NO: 5788 - DNA, 20 bp, Artificial Sequence
  chemically synthesized
aggaaaggaaggcataatta

SEQ ID NO: 5789 - DNA, 20 bp, Artificial Sequence
  chemically synthesized
ggaaaggaaggcataattac

SEQ ID NO: 5790 - DNA, 20 bp, Artificial Sequence
  chemically synthesized
aaggaaggcataattacagg

SEQ ID NO: 5791 - DNA, 20 bp, Artificial Sequence
  chemically synthesized
taattacaggaagacaaatc

SEQ ID NO: 5792 - DNA, 20 bp, Artificial Sequence
  chemically synthesized
gaagacaaatctggttgttt

SEQ ID NO: 5793 - DNA, 20 bp, Artificial Sequence
  chemically synthesized
aaaaataaatatttgctttt

SEQ ID NO: 5794 - DNA, 20 bp, Artificial Sequence
  chemically synthesized
aattttaacacttaccttct

SEQ ID NO: 5795 - DNA, 20 bp, Artificial Sequence
  chemically synthesized
ttaccttcttagatacctaa

SEQ ID NO: 5796 - DNA, 20 bp, Artificial Sequence
  chemically synthesized
cttagatacctaatagaata

SEQ ID NO: 5797 - DNA, 20 bp, Artificial Sequence
  chemically synthesized
ttagatacctaatagaatat

SEQ ID NO: 5798 - DNA, 20 bp, Artificial Sequence
  chemically synthesized
gatacctaatagaatatagg

SEQ ID NO: 5799 - DNA, 20 bp, Artificial Sequence
  chemically synthesized
attttcttgttatccatgca

SEQ ID NO: 5800 - DNA, 20 bp, Artificial Sequence
  chemically synthesized
ccttcctttctttccttctt

SEQ ID NO: 5801 - DNA, 20 bp, Artificial Sequence
  chemically synthesized
cctttctttccttctttgga

SEQ ID NO: 5802 - DNA, 20 bp, Artificial Sequence
  chemically synthesized
ccttctttggaaagctgcac

SEQ ID NO: 5803 - DNA, 20 bp, Artificial Sequence
  chemically synthesized
gaaagctgcactagcttact

SEQ ID NO: 5804 - DNA, 20 bp, Artificial Sequence
  chemically synthesized
ctgcactagcttacttagaa

SEQ ID NO: 5805 - DNA, 20 bp, Artificial Sequence
  chemically synthesized
tatcttttttcttttaaact

SEQ ID NO: 5806 - DNA, 20 bp, Artificial Sequence
  chemically synthesized
ttttcttttaaactcagaat

SEQ ID NO: 5807 - DNA, 20 bp, Artificial Sequence
  chemically synthesized
cttttaaactcagaataagt

SEQ ID NO: 5808 - DNA, 20 bp, Artificial Sequence
  chemically synthesized
ttaaactcagaataagtcgg

SEQ ID NO: 5809 - DNA, 20 bp, Artificial Sequence
  chemically synthesized
aactcagaataagtcggtag

SEQ ID NO: 5810 - DNA, 20 bp, Artificial Sequence
  chemically synthesized
cagaataagtcggtagcgga

SEQ ID NO: 5811 - DNA, 20 bp, Artificial Sequence
  chemically synthesized
agcggacagtctcatctgtt

SEQ ID NO: 5812 - DNA, 20 bp, Artificial Sequence
  chemically synthesized
ggacagtctcatctgttcag

SEQ ID NO: 5813 - DNA, 20 bp, Artificial Sequence
  chemically synthesized
tgttcagaagatcccccact

SEQ ID NO: 5814 - DNA, 20 bp, Artificial Sequence
  chemically synthesized
gatcccccacttagatataa

SEQ ID NO: 5815 - DNA, 20 bp, Artificial Sequence
  chemically synthesized
ccacttagatataaaagcaa

SEQ ID NO: 5816 - DNA, 20 bp, Artificial Sequence
  chemically synthesized
agatataaaagcaaaagatc

SEQ ID NO: 5817 - DNA, 20 bp, Artificial Sequence
  chemically synthesized
atataaaagcaaaagatcta

SEQ ID NO: 5818 - DNA, 20 bp, Artificial Sequence
  chemically synthesized
tctagagcaaaatctgcttc

SEQ ID NO: 5819 - DNA, 20 bp, Artificial Sequence
  chemically synthesized
aaaatctgcttccagccttg

SEQ ID NO: 5820 - DNA, 20 bp, Artificial Sequence
  chemically synthesized
atctgcttccagccttgtag

SEQ ID NO: 5821 - DNA, 20 bp, Artificial Sequence
  chemically synthesized
tgcttccagccttgtagcag

SEQ ID NO: 5822 - DNA, 20 bp, Artificial Sequence
  chemically synthesized
cttccagccttgtagcagtg

SEQ ID NO: 5823 - DNA, 20 bp, Artificial Sequence
  chemically synthesized
acatataaaatctaaaaaat

SEQ ID NO: 5824 - DNA, 20 bp, Artificial Sequence
  chemically synthesized
catataaaatctaaaaaata

SEQ ID NO: 5825 - DNA, 20 bp, Artificial Sequence
  chemically synthesized
ataaggattctaatttaaat

SEQ ID NO: 5826 - DNA, 20 bp, Artificial Sequence
  chemically synthesized
attctaatttaaattagaca

SEQ ID NO: 5827 - DNA, 20 bp, Artificial Sequence
  chemically synthesized
ctaatttaaattagacatgg

SEQ ID NO: 5828 - DNA, 20 bp, Artificial Sequence
  chemically synthesized
atttaaattagacatggtag

SEQ ID NO: 5829 - DNA, 20 bp, Artificial Sequence
  chemically synthesized
catggtagaagttgaatcca

SEQ ID NO: 5830 - DNA, 20 bp, Artificial Sequence
  chemically synthesized
tgtgtcctctttatgaactg

SEQ ID NO: 5831 - DNA, 20 bp, Artificial Sequence
  chemically synthesized
tgtagcttccctgtccaata

SEQ ID NO: 5832 - DNA, 20 bp, Artificial Sequence
  chemically synthesized
agcttccctgtccaatatag

SEQ ID NO: 5833 - DNA, 20 bp, Artificial Sequence
  chemically synthesized
tgaactgaactgtccaatac

SEQ ID NO: 5834 - DNA, 20 bp, Artificial Sequence
  chemically synthesized
gaactgaactgtccaataca

SEQ ID NO: 5835 - DNA, 20 bp, Artificial Sequence
  chemically synthesized
tttaaatataaattaactta

SEQ ID NO: 5836 - DNA, 20 bp, Artificial Sequence
  chemically synthesized
agtaactgaaattgtaaatg

SEQ ID NO: 5837 - DNA, 20 bp, Artificial Sequence
  chemically synthesized
aattacactaccatcatttc

SEQ ID NO: 5838 - DNA, 20 bp, Artificial Sequence
  chemically synthesized
ctaccatcatttcaagcgca

SEQ ID NO: 5839 - DNA, 20 bp, Artificial Sequence
  chemically synthesized
taccatcatttcaagcgcac

SEQ ID NO: 5840 - DNA, 20 bp, Artificial Sequence
  chemically synthesized
ccatcatttcaagcgcacag

SEQ ID NO: 5841 - DNA, 20 bp, Artificial Sequence
  chemically synthesized
aggagccatatattccactt

SEQ ID NO: 5842 - DNA, 20 bp, Artificial Sequence
  chemically synthesized
attccactttagccatttta

SEQ ID NO: 5843 - DNA, 20 bp, Artificial Sequence
  chemically synthesized
agccattttatggtatttta

SEQ ID NO: 5844 - DNA, 20 bp, Artificial Sequence
  chemically synthesized
attttatagaacatcgccat

SEQ ID NO: 5845 - DNA, 20 bp, Artificial Sequence
  chemically synthesized
atagaacatcgccatcagtt

SEQ ID NO: 5846 - DNA, 20 bp, Artificial Sequence
  chemically synthesized
acatcgccatcagtttagaa

SEQ ID NO: 5847 - DNA, 20 bp, Artificial Sequence
  chemically synthesized
tcagtttagaaaagttccct

SEQ ID NO: 5848 - DNA, 20 bp, Artificial Sequence
  chemically synthesized
aaagttcccttggacaattc

SEQ ID NO: 5849 - DNA, 20 bp, Artificial Sequence
  chemically synthesized
ttggacaattctggtccata

SEQ ID NO: 5850 - DNA, 20 bp, Artificial Sequence
  chemically synthesized
agatatcacaacattcctgt

SEQ ID NO: 5851 - DNA, 20 bp, Artificial Sequence
  chemically synthesized
atcacaacattcctgtgagt

SEQ ID NO: 5852 - DNA, 20 bp, Artificial Sequence
  chemically synthesized
acattcctgtgagttggcta

SEQ ID NO: 5853 - DNA, 20 bp, Artificial Sequence
  chemically synthesized
tggctatagtctccattttg

SEQ ID NO: 5854 - DNA, 20 bp, Artificial Sequence
  chemically synthesized
ggctatagtctccattttga

SEQ ID NO: 5855 - DNA, 20 bp, Artificial Sequence
  chemically synthesized
ctccattttgaaggttaatt

SEQ ID NO: 5856 - DNA, 20 bp, Artificial Sequence
  chemically synthesized
aaggttaattaagtaaacct

SEQ ID NO: 5857 - DNA, 20 bp, Artificial Sequence
  chemically synthesized
ggttaattaagtaaacctca

SEQ ID NO: 5858 - DNA, 20 bp, Artificial Sequence
  chemically synthesized
aagtaaacctcagagaatga

SEQ ID NO: 5859 - DNA, 20 bp, Artificial Sequence
  chemically synthesized
cagagaatgaaagaaacttc

SEQ ID NO: 5860 - DNA, 20 bp, Artificial Sequence
  chemically synthesized
tactttgaaacttgaaaacc

SEQ ID NO: 5861 - DNA, 20 bp, Artificial Sequence
  chemically synthesized
actttgaaacttgaaaacct

SEQ ID NO: 5862 - DNA, 20 bp, Artificial Sequence
  chemically synthesized
gaaaacctaggtttttaatc

SEQ ID NO: 5863 - DNA, 20 bp, Artificial Sequence
  chemically synthesized
tttaatccagctttgtttta

SEQ ID NO: 5864 - DNA, 20 bp, Artificial Sequence
  chemically synthesized
tccagctttgttttacagca

SEQ ID NO: 5865 - DNA, 20 bp, Artificial Sequence
  chemically synthesized
ccagctttgttttacagcaa

SEQ ID NO: 5866 - DNA, 20 bp, Artificial Sequence
  chemically synthesized
acagcaaaggaaatgctcaa

SEQ ID NO: 5867 - DNA, 20 bp, Artificial Sequence
  chemically synthesized
aaatgctcaaaagtacattt

SEQ ID NO: 5868 - DNA, 20 bp, Artificial Sequence
  chemically synthesized
aatgctcaaaagtacatttc

SEQ ID NO: 5869 - DNA, 20 bp, Artificial Sequence
  chemically synthesized
tttttcctctttcttaaata

SEQ ID NO: 5870 - DNA, 20 bp, Artificial Sequence
  chemically synthesized
tcctctttcttaaatatggt

SEQ ID NO: 5871 - DNA, 20 bp, Artificial Sequence
  chemically synthesized
cttaaatatggtcagactga

SEQ ID NO: 5872 - DNA, 20 bp, Artificial Sequence
  chemically synthesized
taaatatggtcagactgata

SEQ ID NO: 5873 - DNA, 20 bp, Artificial Sequence
  chemically synthesized
tagagtgacctacatgtgtc

SEQ ID NO: 5874 - DNA, 20 bp, Artificial Sequence
  chemically synthesized
agagtgacctacatgtgtcc

SEQ ID NO: 5875 - DNA, 20 bp, Artificial Sequence
  chemically synthesized
atgtgtccaggctgacacaa

SEQ ID NO: 5876 - DNA, 20 bp, Artificial Sequence
  chemically synthesized
actatatttaaatatttttt

SEQ ID NO: 5877 - DNA, 20 bp, Artificial Sequence
  chemically synthesized
ctatatttaaatatttttta

SEQ ID NO: 5878 - DNA, 20 bp, Artificial Sequence
  chemically synthesized
ttttttaaggtcatttgtca

SEQ ID NO: 5879 - DNA, 20 bp, Artificial Sequence
  chemically synthesized
aaggtcatttgtcatggact

SEQ ID NO: 5880 - DNA, 20 bp, Artificial Sequence
  chemically synthesized
ggtcatttgtcatggactca

SEQ ID NO: 5881 - DNA, 20 bp, Artificial Sequence
  chemically synthesized
taataattttttctttttta

SEQ ID NO: 5882 - DNA, 20 bp, Artificial Sequence
  chemically synthesized
ctgcttttctttcttttttt

SEQ ID NO: 5883 - DNA, 20 bp, Artificial Sequence
  chemically synthesized
tgcttttctttctttttttt

SEQ ID NO: 5884 - DNA, 20 bp, Artificial Sequence
  chemically synthesized
aatatctctcaatatctttt

SEQ ID NO: 5885 - DNA, 20 bp, Artificial Sequence
  chemically synthesized
tatctctcaatatcttttca

SEQ ID NO: 5886 - DNA, 20 bp, Artificial Sequence
  chemically synthesized
ctcaatatcttttcagagaa

SEQ ID NO: 5887 - DNA, 20 bp, Artificial Sequence
  chemically synthesized
caatatcttttcagagaaaa

SEQ ID NO: 5888 - DNA, 20 bp, Artificial Sequence
  chemically synthesized
cttttcagagaaaagagtct

SEQ ID NO: 5889 - DNA, 20 bp, Artificial Sequence
  chemically synthesized
agaaaagagtctaagcattc

SEQ ID NO: 5890 - DNA, 20 bp, Artificial Sequence
  chemically synthesized
gcattctggtatgaatctgt

SEQ ID NO: 5891 - DNA, 20 bp, Artificial Sequence
  chemically synthesized
cattctggtatgaatctgtt

SEQ ID NO: 5892 - DNA, 20 bp, Artificial Sequence
  chemically synthesized
tctgttgggtcttgacactg

SEQ ID NO: 5893 - DNA, 20 bp, Artificial Sequence
  chemically synthesized
ggtcttgacactgtagatga

SEQ ID NO: 5894 - DNA, 20 bp, Artificial Sequence
  chemically synthesized
gtcttgacactgtagatgat

SEQ ID NO: 5895 - DNA, 20 bp, Artificial Sequence
  chemically synthesized
gtagatgatgggattcatta

SEQ ID NO: 5896 - DNA, 20 bp, Artificial Sequence
  chemically synthesized
tagatgatgggattcattaa

SEQ ID NO: 5897 - DNA, 20 bp, Artificial Sequence
  chemically synthesized
atgatgggattcattaaagg

SEQ ID NO: 5898 - DNA, 20 bp, Artificial Sequence
  chemically synthesized
tgatgggattcattaaaggt

SEQ ID NO: 5899 - DNA, 20 bp, Artificial Sequence
  chemically synthesized
ggattcattaaaggtgggaa

SEQ ID NO: 5900 - DNA, 20 bp, Artificial Sequence
  chemically synthesized
gattcattaaaggtgggaaa

SEQ ID NO: 5901 - DNA, 20 bp, Artificial Sequence
  chemically synthesized
ttaaaggtgggaaaaggatg

SEQ ID NO: 5902 - DNA, 20 bp, Artificial Sequence
  chemically synthesized
aggatgtagatgttgccaat

SEQ ID NO: 5903 - DNA, 20 bp, Artificial Sequence
  chemically synthesized
agatgttgccaatgagaacg

SEQ ID NO: 5904 - DNA, 20 bp, Artificial Sequence
  chemically synthesized
gatgttgccaatgagaacgt

SEQ ID NO: 5905 - DNA, 20 bp, Artificial Sequence
  chemically synthesized
gccaatgagaacgtgggcca

SEQ ID NO: 5906 - DNA, 20 bp, Artificial Sequence
  chemically synthesized
ccaatgagaacgtgggccac

SEQ ID NO: 5907 - DNA, 20 bp, Artificial Sequence
  chemically synthesized
caatgagaacgtgggccacg

SEQ ID NO: 5908 - DNA, 20 bp, Artificial Sequence
  chemically synthesized
aatgagaacgtgggccacgg

SEQ ID NO: 5909 - DNA, 20 bp, Artificial Sequence
  chemically synthesized
agaacgtgggccacggggga

SEQ ID NO: 5910 - DNA, 20 bp, Artificial Sequence
  chemically synthesized
gaacgtgggccacgggggaa

SEQ ID NO: 5911 - DNA, 20 bp, Artificial Sequence
  chemically synthesized
gggaaaggtgcttgccaaaa

SEQ ID NO: 5912 - DNA, 20 bp, Artificial Sequence
  chemically synthesized
ccaaaacggtgcaccattgt

SEQ ID NO: 5913 - DNA, 20 bp, Artificial Sequence
  chemically synthesized
caaaacggtgcaccattgtg

SEQ ID NO: 5914 - DNA, 20 bp, Artificial Sequence
  chemically synthesized
caccattgtgaggctaatga

SEQ ID NO: 5915 - DNA, 20 bp, Artificial Sequence
  chemically synthesized
accattgtgaggctaatgat

SEQ ID NO: 5916 - DNA, 20 bp, Artificial Sequence
  chemically synthesized
ccattgtgaggctaatgata

SEQ ID NO: 5917 - DNA, 20 bp, Artificial Sequence
  chemically synthesized
tgaggctaatgatagggatg

SEQ ID NO: 5918 - DNA, 20 bp, Artificial Sequence
  chemically synthesized
atgatagggatgtagaacac

SEQ ID NO: 5919 - DNA, 20 bp, Artificial Sequence
  chemically synthesized
tgatagggatgtagaacaca

SEQ ID NO: 5920 - DNA, 20 bp, Artificial Sequence
  chemically synthesized
agggatgtagaacacaagga

SEQ ID NO: 5921 - DNA, 20 bp, Artificial Sequence
  chemically synthesized
tgtagaacacaaggacagca

SEQ ID NO: 5922 - DNA, 20 bp, Artificial Sequence
  chemically synthesized
acacaaggacagcacagatg

SEQ ID NO: 5923 - DNA, 20 bp, Artificial Sequence
  chemically synthesized
cacaaggacagcacagatgt

SEQ ID NO: 5924 - DNA, 20 bp, Artificial Sequence
  chemically synthesized
caaggacagcacagatgtgg

SEQ ID NO: 5925 - DNA, 20 bp, Artificial Sequence
  chemically synthesized
cagcacagatgtgggagatg

SEQ ID NO: 5926 - DNA, 20 bp, Artificial Sequence
  chemically synthesized
agcacagatgtgggagatgc

SEQ ID NO: 5927 - DNA, 20 bp, Artificial Sequence
  chemically synthesized
taatttatgcctctcttcct

SEQ ID NO: 5928 - DNA, 20 bp, Artificial Sequence
  chemically synthesized
atttatgcctctcttcctga

SEQ ID NO: 5929 - DNA, 20 bp, Artificial Sequence
  chemically synthesized
tttatgcctctcttcctgag

SEQ ID NO: 5930 - DNA, 20 bp, Artificial Sequence
  chemically synthesized
tcttcctgagaggcaactgc

SEQ ID NO: 5931 - DNA, 20 bp, Artificial Sequence
  chemically synthesized
cttcctgagaggcaactgcc

SEQ ID NO: 5932 - DNA, 20 bp, Artificial Sequence
  chemically synthesized
gcaactgccaggactgactt

SEQ ID NO: 5933 - DNA, 20 bp, Artificial Sequence
  chemically synthesized
gccaggactgacttaagaat

SEQ ID NO: 5934 - DNA, 20 bp, Artificial Sequence
  chemically synthesized
ccaggactgacttaagaatc

SEQ ID NO: 5935 - DNA, 20 bp, Artificial Sequence
  chemically synthesized
ctgacttaagaatcaggatg

SEQ ID NO: 5936 - DNA, 20 bp, Artificial Sequence
  chemically synthesized
tgacttaagaatcaggatgt

SEQ ID NO: 5937 - DNA, 20 bp, Artificial Sequence
  chemically synthesized
acttaagaatcaggatgtag

SEQ ID NO: 5938 - DNA, 20 bp, Artificial Sequence
  chemically synthesized
agaatcaggatgtaggagaa

SEQ ID NO: 5939 - DNA, 20 bp, Artificial Sequence
  chemically synthesized
gaatcaggatgtaggagaaa

SEQ ID NO: 5940 - DNA, 20 bp, Artificial Sequence
  chemically synthesized
aggatgtaggagaaaaggat

SEQ ID NO: 5941 - DNA, 20 bp, Artificial Sequence
  chemically synthesized
gtaggagaaaaggatgagta

SEQ ID NO: 5942 - DNA, 20 bp, Artificial Sequence
  chemically synthesized
atgagtatagcatccaacaa

SEQ ID NO: 5943 - DNA, 20 bp, Artificial Sequence
  chemically synthesized
aacaacagtatgcaaataac

SEQ ID NO: 5944 - DNA, 20 bp, Artificial Sequence
  chemically synthesized
agtatgcaaataaccagcat

SEQ ID NO: 5945 - DNA, 20 bp, Artificial Sequence
  chemically synthesized
gtatgcaaataaccagcatc

SEQ ID NO: 5946 - DNA, 20 bp, Artificial Sequence
  chemically synthesized
tatgcaaataaccagcatca

SEQ ID NO: 5947 - DNA, 20 bp, Artificial Sequence
  chemically synthesized
aaataaccagcatcagggca

SEQ ID NO: 5948 - DNA, 20 bp, Artificial Sequence
  chemically synthesized
gggcatagtaactattgaat

SEQ ID NO: 5949 - DNA, 20 bp, Artificial Sequence
  chemically synthesized
tattgaatcggatgtctgaa

SEQ ID NO: 5950 - DNA, 20 bp, Artificial Sequence
  chemically synthesized
attgaatcggatgtctgaac

SEQ ID NO: 5951 - DNA, 20 bp, Artificial Sequence
  chemically synthesized
atcggatgtctgaacaggct

SEQ ID NO: 5952 - DNA, 20 bp, Artificial Sequence
  chemically synthesized
ggatgtctgaacaggctaag

SEQ ID NO: 5953 - DNA, 20 bp, Artificial Sequence
  chemically synthesized
atgtctgaacaggctaagcg

SEQ ID NO: 5954 - DNA, 20 bp, Artificial Sequence
  chemically synthesized
tctgaacaggctaagcggag

SEQ ID NO: 5955 - DNA, 20 bp, Artificial Sequence
  chemically synthesized
aggctaagcggagaagatcc

SEQ ID NO: 5956 - DNA, 20 bp, Artificial Sequence
  chemically synthesized
aagcggagaagatcctggtg

SEQ ID NO: 5957 - DNA, 20 bp, Artificial Sequence
  chemically synthesized
agcggagaagatcctggtgc

SEQ ID NO: 5958 - DNA, 20 bp, Artificial Sequence
  chemically synthesized
ggagaagatcctggtgcagg

SEQ ID NO: 5959 - DNA, 20 bp, Artificial Sequence
  chemically synthesized
aagatcctggtgcaggcaga

SEQ ID NO: 5960 - DNA, 20 bp, Artificial Sequence
  chemically synthesized
gatcctggtgcaggcagaaa

SEQ ID NO: 5961 - DNA, 20 bp, Artificial Sequence
  chemically synthesized
ctggtgcaggcagaaagagt

SEQ ID NO: 5962 - DNA, 20 bp, Artificial Sequence
  chemically synthesized
tgcaggcagaaagagtgaga

SEQ ID NO: 5963 - DNA, 20 bp, Artificial Sequence
  chemically synthesized
gcaggcagaaagagtgagaa

SEQ ID NO: 5964 - DNA, 20 bp, Artificial Sequence
  chemically synthesized
agaaagagtgagaaaggatg

SEQ ID NO: 5965 - DNA, 20 bp, Artificial Sequence
  chemically synthesized
gagaaaggatgtggaaatga

SEQ ID NO: 5966 - DNA, 20 bp, Artificial Sequence
  chemically synthesized
tgacagtaattaaaaaattt

SEQ ID NO: 5967 - DNA, 20 bp, Artificial Sequence
  chemically synthesized
agtaattaaaaaatttcaga

SEQ ID NO: 5968 - DNA, 20 bp, Artificial Sequence
  chemically synthesized
aaaaaatttcagacagatga

SEQ ID NO: 5969 - DNA, 20 bp, Artificial Sequence
  chemically synthesized
aaaaatttcagacagatgat

SEQ ID NO: 5970 - DNA, 20 bp, Artificial Sequence
  chemically synthesized
aaaatttcagacagatgatg

SEQ ID NO: 5971 - DNA, 20 bp, Artificial Sequence
  chemically synthesized
aaatttcagacagatgatgg

SEQ ID NO: 5972 - DNA, 20 bp, Artificial Sequence
  chemically synthesized
aatttcagacagatgatggg

SEQ ID NO: 5973 - DNA, 20 bp, Artificial Sequence
  chemically synthesized
agatgatggggggtgtaata

SEQ ID NO: 5974 - DNA, 20 bp, Artificial Sequence
  chemically synthesized
gaaaaaactcctacctatta

SEQ ID NO: 5975 - DNA, 20 bp, Artificial Sequence
  chemically synthesized
aaactcctacctattatagt

SEQ ID NO: 5976 - DNA, 20 bp, Artificial Sequence
  chemically synthesized
gagcccaattttgataattc

SEQ ID NO: 5977 - DNA, 20 bp, Artificial Sequence
  chemically synthesized
aattttgataattctggaat

SEQ ID NO: 5978 - DNA, 20 bp, Artificial Sequence
  chemically synthesized
ttgataattctggaattagt

SEQ ID NO: 5979 - DNA, 20 bp, Artificial Sequence
  chemically synthesized
tgataattctggaattagtc

SEQ ID NO: 5980 - DNA, 20 bp, Artificial Sequence
  chemically synthesized
aattctggaattagtcagga

SEQ ID NO: 5981 - DNA, 20 bp, Artificial Sequence
  chemically synthesized
ttctggaattagtcaggatg

SEQ ID NO: 5982 - DNA, 20 bp, Artificial Sequence
  chemically synthesized
tctggaattagtcaggatgg

SEQ ID NO: 5983 - DNA, 20 bp, Artificial Sequence
  chemically synthesized
gtcaggatggaggaataacg

SEQ ID NO: 5984 - DNA, 20 bp, Artificial Sequence
  chemically synthesized
aggatggaggaataacgtag

SEQ ID NO: 5985 - DNA, 20 bp, Artificial Sequence
  chemically synthesized
gattgcaaattgcaatgtac

SEQ ID NO: 5986 - DNA, 20 bp, Artificial Sequence
  chemically synthesized
aaattgcaatgtaccggtca

SEQ ID NO: 5987 - DNA, 20 bp, Artificial Sequence
  chemically synthesized
aattgcaatgtaccggtcaa

SEQ ID NO: 5988 - DNA, 20 bp, Artificial Sequence
  chemically synthesized
aatgtaccggtcaaaggcca

SEQ ID NO: 5989 - DNA, 20 bp, Artificial Sequence
  chemically synthesized
taccggtcaaaggccatagt

SEQ ID NO: 5990 - DNA, 20 bp, Artificial Sequence
  chemically synthesized
accggtcaaaggccatagtg

SEQ ID NO: 5991 - DNA, 20 bp, Artificial Sequence
  chemically synthesized
cggtcaaaggccatagtgag

SEQ ID NO: 5992 - DNA, 20 bp, Artificial Sequence
  chemically synthesized
ggtcaaaggccatagtgagg

SEQ ID NO: 5993 - DNA, 20 bp, Artificial Sequence
  chemically synthesized
aaaggccatagtgaggagga

SEQ ID NO: 5994 - DNA, 20 bp, Artificial Sequence
  chemically synthesized
aggccatagtgaggaggaca

SEQ ID NO: 5995 - DNA, 20 bp, Artificial Sequence
  chemically synthesized
ggccatagtgaggaggacag

SEQ ID NO: 5996 - DNA, 20 bp, Artificial Sequence
  chemically synthesized
ggaggacagaggactccatg

SEQ ID NO: 5997 - DNA, 20 bp, Artificial Sequence
  chemically synthesized
gaggacagaggactccatga

SEQ ID NO: 5998 - DNA, 20 bp, Artificial Sequence
  chemically synthesized
acagaggactccatgaagga

SEQ ID NO: 5999 - DNA, 20 bp, Artificial Sequence
  chemically synthesized
actccatgaaggacagacca

SEQ ID NO: 6000 - DNA, 20 bp, Artificial Sequence
  chemically synthesized
aggacagaccatggatgaaa

SEQ ID NO: 6001 - DNA, 20 bp, Artificial Sequence
  chemically synthesized
ggacagaccatggatgaaat

SEQ ID NO: 6002 - DNA, 20 bp, Artificial Sequence
  chemically synthesized
gaccatggatgaaataggac

SEQ ID NO: 6003 - DNA, 20 bp, Artificial Sequence
  chemically synthesized
accatggatgaaataggact

SEQ ID NO: 6004 - DNA, 20 bp, Artificial Sequence
  chemically synthesized
tgaaataggactgggcaatg

SEQ ID NO: 6005 - DNA, 20 bp, Artificial Sequence
  chemically synthesized
gaaataggactgggcaatgc

SEQ ID NO: 6006 - DNA, 20 bp, Artificial Sequence
  chemically synthesized
actgggcaatgcaggaatcc

SEQ ID NO: 6007 - DNA, 20 bp, Artificial Sequence
  chemically synthesized
atctctcgaatgatccccca

SEQ ID NO: 6008 - DNA, 20 bp, Artificial Sequence
  chemically synthesized
tctctcgaatgatcccccac

SEQ ID NO: 6009 - DNA, 20 bp, Artificial Sequence
  chemically synthesized
atgatcccccacaggatccc

SEQ ID NO: 6010 - DNA, 20 bp, Artificial Sequence
  chemically synthesized
gatccccagcactgtgtaca

SEQ ID NO: 6011 - DNA, 20 bp, Artificial Sequence
  chemically synthesized
ccccagcactgtgtacacag

SEQ ID NO: 6012 - DNA, 20 bp, Artificial Sequence
  chemically synthesized
agcactgtgtacacagtgga

SEQ ID NO: 6013 - DNA, 20 bp, Artificial Sequence
  chemically synthesized
acagtggacagccccatgca

SEQ ID NO: 6014 - DNA, 20 bp, Artificial Sequence
  chemically synthesized
cagtggacagccccatgcac

SEQ ID NO: 6015 - DNA, 20 bp, Artificial Sequence
  chemically synthesized
ggacagccccatgcacaggt

SEQ ID NO: 6016 - DNA, 20 bp, Artificial Sequence
  chemically synthesized
agccccatgcacaggtcagt

SEQ ID NO: 6017 - DNA, 20 bp, Artificial Sequence
  chemically synthesized
gccccatgcacaggtcagtg

SEQ ID NO: 6018 - DNA, 20 bp, Artificial Sequence
  chemically synthesized
ccccatgcacaggtcagtga

SEQ ID NO: 6019 - DNA, 20 bp, Artificial Sequence
  chemically synthesized
atgcacaggtcagtgagggc

SEQ ID NO: 6020 - DNA, 20 bp, Artificial Sequence
  chemically synthesized
caggtcagtgagggccagca

SEQ ID NO: 6021 - DNA, 20 bp, Artificial Sequence
  chemically synthesized
tcagtgagggccagcatgga

SEQ ID NO: 6022 - DNA, 20 bp, Artificial Sequence
  chemically synthesized
cagtgagggccagcatggac

SEQ ID NO: 6023 - DNA, 20 bp, Artificial Sequence
  chemically synthesized
tgagggccagcatggacagg

SEQ ID NO: 6024 - DNA, 20 bp, Artificial Sequence
  chemically synthesized
catggacaggaagtaaaaca

SEQ ID NO: 6025 - DNA, 20 bp, Artificial Sequence
  chemically synthesized
atggacaggaagtaaaacat

SEQ ID NO: 6026 - DNA, 20 bp, Artificial Sequence
  chemically synthesized
acaggaagtaaaacataggc

SEQ ID NO: 6027 - DNA, 20 bp, Artificial Sequence
  chemically synthesized
aagtaaaacataggctggtg

SEQ ID NO: 6028 - DNA, 20 bp, Artificial Sequence
  chemically synthesized
agtaaaacataggctggtgc

SEQ ID NO: 6029 - DNA, 20 bp, Artificial Sequence
  chemically synthesized
aacataggctggtgcaggct

SEQ ID NO: 6030 - DNA, 20 bp, Artificial Sequence
  chemically synthesized
aggctggtgcaggcttggct

SEQ ID NO: 6031 - DNA, 20 bp, Artificial Sequence
  chemically synthesized
ttggctcagtccatatcaca

SEQ ID NO: 6032 - DNA, 20 bp, Artificial Sequence
  chemically synthesized
ggctcagtccatatcacatg

SEQ ID NO: 6033 - DNA, 20 bp, Artificial Sequence
  chemically synthesized
agaaccatgcaattgcccaa

SEQ ID NO: 6034 - DNA, 20 bp, Artificial Sequence
  chemically synthesized
gcaattgcccaaaagcacca

SEQ ID NO: 6035 - DNA, 20 bp, Artificial Sequence
  chemically synthesized
tgcccaaaagcaccatggca

SEQ ID NO: 6036 - DNA, 20 bp, Artificial Sequence
  chemically synthesized
aaagcaccatggcatagatt

SEQ ID NO: 6037 - DNA, 20 bp, Artificial Sequence
  chemically synthesized
aagcaccatggcatagattg

SEQ ID NO: 6038 - DNA, 20 bp, Artificial Sequence
  chemically synthesized
gcaccatggcatagattgag

SEQ ID NO: 6039 - DNA, 20 bp, Artificial Sequence
  chemically synthesized
ccatggcatagattgaggag

SEQ ID NO: 6040 - DNA, 20 bp, Artificial Sequence
  chemically synthesized
catggcatagattgaggaga

SEQ ID NO: 6041 - DNA, 20 bp, Artificial Sequence
  chemically synthesized
atggcatagattgaggagaa

SEQ ID NO: 6042 - DNA, 20 bp, Artificial Sequence
  chemically synthesized
tggcatagattgaggagaag

SEQ ID NO: 6043 - DNA, 20 bp, Artificial Sequence
  chemically synthesized
atagattgaggagaagggga

SEQ ID NO: 6044 - DNA, 20 bp, Artificial Sequence
  chemically synthesized
attgaggagaaggggatgga

SEQ ID NO: 6045 - DNA, 20 bp, Artificial Sequence
  chemically synthesized
aggagaaggggatggaaagc

SEQ ID NO: 6046 - DNA, 20 bp, Artificial Sequence
  chemically synthesized
ggagaaggggatggaaagcc

SEQ ID NO: 6047 - DNA, 20 bp, Artificial Sequence
  chemically synthesized
gagaaggggatggaaagcca

SEQ ID NO: 6048 - DNA, 20 bp, Artificial Sequence
  chemically synthesized
agaaggggatggaaagccag

SEQ ID NO: 6049 - DNA, 20 bp, Artificial Sequence
  chemically synthesized
ggggtattgctgctccatgc

SEQ ID NO: 6050 - DNA, 20 bp, Artificial Sequence
  chemically synthesized
ctgctccatgccagaaaatc

SEQ ID NO: 6051 - DNA, 20 bp, Artificial Sequence
  chemically synthesized
tccatgccagaaaatccagt

SEQ ID NO: 6052 - DNA, 20 bp, Artificial Sequence
  chemically synthesized
atgccagaaaatccagtgag

SEQ ID NO: 6053 - DNA, 20 bp, Artificial Sequence
  chemically synthesized
cagaaaatccagtgagaaga

SEQ ID NO: 6054 - DNA, 20 bp, Artificial Sequence
  chemically synthesized
agaaaatccagtgagaagaa

SEQ ID NO: 6055 - DNA, 20 bp, Artificial Sequence
  chemically synthesized
aaatccagtgagaagaaagg

SEQ ID NO: 6056 - DNA, 20 bp, Artificial Sequence
  chemically synthesized
aagaaaggaagaattcgtgc

SEQ ID NO: 6057 - DNA, 20 bp, Artificial Sequence
  chemically synthesized
ggaagaattcgtgctggtgc

SEQ ID NO: 6058 - DNA, 20 bp, Artificial Sequence
  chemically synthesized
gaagaattcgtgctggtgct

SEQ ID NO: 6059 - DNA, 20 bp, Artificial Sequence
  chemically synthesized
aagaattcgtgctggtgcta

SEQ ID NO: 6060 - DNA, 20 bp, Artificial Sequence
  chemically synthesized
gctggtgctagggcttactg

SEQ ID NO: 6061 - DNA, 20 bp, Artificial Sequence
  chemically synthesized
gcttactgaagtaatcattc

SEQ ID NO: 6062 - DNA, 20 bp, Artificial Sequence
  chemically synthesized
gaagtaatcattctggaact

SEQ ID NO: 6063 - DNA, 20 bp, Artificial Sequence
  chemically synthesized
tctggaactgagaaacatgt

SEQ ID NO: 6064 - DNA, 20 bp, Artificial Sequence
  chemically synthesized
tggaactgagaaacatgtga

SEQ ID NO: 6065 - DNA, 20 bp, Artificial Sequence
  chemically synthesized
catgtgagagtattttttca

SEQ ID NO: 6066 - DNA, 20 bp, Artificial Sequence
  chemically synthesized
atgtgagagtattttttcaa

SEQ ID NO: 6067 - DNA, 20 bp, Artificial Sequence
  chemically synthesized
ctgaatacaatgaaatttct

SEQ ID NO: 6068 - DNA, 20 bp, Artificial Sequence
  chemically synthesized
acttactgacttaaaaaaaa

SEQ ID NO: 6069 - DNA, 20 bp, Artificial Sequence
  chemically synthesized
ctgacttaaaaaaaacagct

SEQ ID NO: 6070 - DNA, 20 bp, Artificial Sequence
  chemically synthesized
ctgagaaattctgtttcttt

SEQ ID NO: 6071 - DNA, 20 bp, Artificial Sequence
  chemically synthesized
aattctgtttctttgagaca

SEQ ID NO: 6072 - DNA, 20 bp, Artificial Sequence
  chemically synthesized
acatagtatccattgccttt

SEQ ID NO: 6073 - DNA, 20 bp, Artificial Sequence
  chemically synthesized
atccattgcctttgagaaaa

SEQ ID NO: 6074 - DNA, 20 bp, Artificial Sequence
  chemically synthesized
cttcttttgatgtcatttaa

SEQ ID NO: 6075 - DNA, 20 bp, Artificial Sequence
  chemically synthesized
gtcattattttttcactgtc

SEQ ID NO: 6076 - DNA, 20 bp, Artificial Sequence
  chemically synthesized
tctggatgtgaacatatcct

SEQ ID NO: 6077 - DNA, 20 bp, Artificial Sequence
  chemically synthesized
ggatgtgaacatatccttag

SEQ ID NO: 6078 - DNA, 20 bp, Artificial Sequence
  chemically synthesized
aacatatccttagaagccat

SEQ ID NO: 6079 - DNA, 20 bp, Artificial Sequence
  chemically synthesized
agccataagcaaaaacaaat

SEQ ID NO: 6080 - DNA, 20 bp, Artificial Sequence
  chemically synthesized
gccataagcaaaaacaaata

SEQ ID NO: 6081 - DNA, 20 bp, Artificial Sequence
  chemically synthesized
ataagcaaaaacaaataagg

SEQ ID NO: 6082 - DNA, 20 bp, Artificial Sequence
  chemically synthesized
aagcaaaaacaaataaggaa

SEQ ID NO: 6083 - DNA, 20 bp, Artificial Sequence
  chemically synthesized
aaaacaaataaggaagagat

SEQ ID NO: 6084 - DNA, 20 bp, Artificial Sequence
  chemically synthesized
aataaggaagagattagtaa

SEQ ID NO: 6085 - DNA, 20 bp, Artificial Sequence
  chemically synthesized
ataaggaagagattagtaaa

SEQ ID NO: 6086 - DNA, 20 bp, Artificial Sequence
  chemically synthesized
aaggaagagattagtaaaag

SEQ ID NO: 6087 - DNA, 20 bp, Artificial Sequence
  chemically synthesized
gaagagattagtaaaaggag

SEQ ID NO: 6088 - DNA, 20 bp, Artificial Sequence
  chemically synthesized
aagagattagtaaaaggaga

SEQ ID NO: 6089 - DNA, 20 bp, Artificial Sequence
  chemically synthesized
gattagtaaaaggagaaggc

SEQ ID NO: 6090 - DNA, 20 bp, Artificial Sequence
  chemically synthesized
ttttaaaaaaatacgttgct

SEQ ID NO: 6091 - DNA, 20 bp, Artificial Sequence
  chemically synthesized
cgttgcttagacattttccc

SEQ ID NO: 6092 - DNA, 20 bp, Artificial Sequence
  chemically synthesized
gttgcttagacattttccca

SEQ ID NO: 6093 - DNA, 20 bp, Artificial Sequence
  chemically synthesized
cttagacattttcccaagga

SEQ ID NO: 6094 - DNA, 20 bp, Artificial Sequence
  chemically synthesized
agacattttcccaaggatag

SEQ ID NO: 6095 - DNA, 20 bp, Artificial Sequence
  chemically synthesized
tagtggtaaaaattttatac

SEQ ID NO: 6096 - DNA, 20 bp, Artificial Sequence
  chemically synthesized
gtaaaaattttataccagta

SEQ ID NO: 6097 - DNA, 20 bp, Artificial Sequence
  chemically synthesized
aaaaattttataccagtaaa

SEQ ID NO: 6098 - DNA, 20 bp, Artificial Sequence
  chemically synthesized
ttttataccagtaaagagcc

SEQ ID NO: 6099 - DNA, 20 bp, Artificial Sequence
  chemically synthesized
tttataccagtaaagagccg

SEQ ID NO: 6100 - DNA, 20 bp, Artificial Sequence
  chemically synthesized
tccaattcattaaacattcg

SEQ ID NO: 6101 - DNA, 20 bp, Artificial Sequence
  chemically synthesized
ttcattaaacattcgaagtg

SEQ ID NO: 6102 - DNA, 20 bp, Artificial Sequence
  chemically synthesized
cattaaacattcgaagtgaa

SEQ ID NO: 6103 - DNA, 20 bp, Artificial Sequence
  chemically synthesized
tcgaagtgaagagtaatctt

SEQ ID NO: 6104 - DNA, 20 bp, Artificial Sequence
  chemically synthesized
cgaagtgaagagtaatcttt

SEQ ID NO: 6105 - DNA, 20 bp, Artificial Sequence
  chemically synthesized
ctttgggctttaaatatcat

SEQ ID NO: 6106 - DNA, 20 bp, Artificial Sequence
  chemically synthesized
aatatcataagtctattaaa

SEQ ID NO: 6107 - DNA, 20 bp, Artificial Sequence
  chemically synthesized
ttccattttgtgccgtctcc

SEQ ID NO: 6108 - DNA, 20 bp, Artificial Sequence
  chemically synthesized
tctccaaatactatttaatg

SEQ ID NO: 6109 - DNA, 20 bp, Artificial Sequence
  chemically synthesized
actcctgttttctccccctc

SEQ ID NO: 6110 - DNA, 20 bp, Artificial Sequence
  chemically synthesized
ttctccccctccagatgacg

SEQ ID NO: 6111 - DNA, 20 bp, Artificial Sequence
  chemically synthesized
ccccctccagatgacgtagc

SEQ ID NO: 6112 - DNA, 20 bp, Artificial Sequence
  chemically synthesized
agcaattactttttcttcat

SEQ ID NO: 6113 - DNA, 20 bp, Artificial Sequence
  chemically synthesized
actttttcttcattggtgat

SEQ ID NO: 6114 - DNA, 20 bp, Artificial Sequence
  chemically synthesized
ttttcttcattggtgataag

SEQ ID NO: 6115 - DNA, 20 bp, Artificial Sequence
  chemically synthesized
cttcattggtgataagcaga

SEQ ID NO: 6116 - DNA, 20 bp, Artificial Sequence
  chemically synthesized
ttcattggtgataagcagac

SEQ ID NO: 6117 - DNA, 20 bp, Artificial Sequence
  chemically synthesized
agacaggaatatttatgcat

SEQ ID NO: 6118 - DNA, 20 bp, Artificial Sequence
  chemically synthesized
aatatttatgcatgagacct

SEQ ID NO: 6119 - DNA, 20 bp, Artificial Sequence
  chemically synthesized
atatttatgcatgagacctt

SEQ ID NO: 6120 - DNA, 20 bp, Artificial Sequence
  chemically synthesized
ttgggtaaatgatttctcac

SEQ ID NO: 6121 - DNA, 20 bp, Artificial Sequence
  chemically synthesized
gggtaaatgatttctcactg

SEQ ID NO: 6122 - DNA, 20 bp, Artificial Sequence
  chemically synthesized
atgatttctcactggagctc

SEQ ID NO: 6123 - DNA, 20 bp, Artificial Sequence
  chemically synthesized
cactggagctctggcctctt

SEQ ID NO: 6124 - DNA, 20 bp, Artificial Sequence
  chemically synthesized
tcatttgtgcctttgtgatg

SEQ ID NO: 6125 - DNA, 20 bp, Artificial Sequence
  chemically synthesized
atttgtgcctttgtgatgta

SEQ ID NO: 6126 - DNA, 20 bp, Artificial Sequence
  chemically synthesized
gcctttgtgatgtagagaat

SEQ ID NO: 6127 - DNA, 20 bp, Artificial Sequence
  chemically synthesized
tgatgtagagaattagattg

SEQ ID NO: 6128 - DNA, 20 bp, Artificial Sequence
  chemically synthesized
agaattagattgaagacact

SEQ ID NO: 6129 - DNA, 20 bp, Artificial Sequence
  chemically synthesized
tgaagacactgagcctttga

SEQ ID NO: 6130 - DNA, 20 bp, Artificial Sequence
  chemically synthesized
agacactgagcctttgatag

SEQ ID NO: 6131 - DNA, 20 bp, Artificial Sequence
  chemically synthesized
ctgagcctttgatagcagct

SEQ ID NO: 6132 - DNA, 20 bp, Artificial Sequence
  chemically synthesized
ttcccattcctttatttatt

SEQ ID NO: 6133 - DNA, 20 bp, Artificial Sequence
  chemically synthesized
cctttatttattcagttaat

SEQ ID NO: 6134 - DNA, 20 bp, Artificial Sequence
  chemically synthesized
tatacatttattcaatgtat

SEQ ID NO: 6135 - DNA, 20 bp, Artificial Sequence
  chemically synthesized
gccaattgtgttttctttct

SEQ ID NO: 6136 - DNA, 20 bp, Artificial Sequence
  chemically synthesized
gttttctttcttagaacctg

SEQ ID NO: 6137 - DNA, 20 bp, Artificial Sequence
  chemically synthesized
tcttagaacctgcagttcta

SEQ ID NO: 6138 - DNA, 20 bp, Artificial Sequence
  chemically synthesized
ctgcagttctacagatcaca

SEQ ID NO: 6139 - DNA, 20 bp, Artificial Sequence
  chemically synthesized
agttctacagatcacaaagc

SEQ ID NO: 6140 - DNA, 20 bp, Artificial Sequence
  chemically synthesized
gttctacagatcacaaagcc

SEQ ID NO: 6141 - DNA, 20 bp, Artificial Sequence
  chemically synthesized
tcacaaagccaggctcaaac

SEQ ID NO: 6142 - DNA, 20 bp, Artificial Sequence
  chemically synthesized
aaagccaggctcaaacaagc

SEQ ID NO: 6143 - DNA, 20 bp, Artificial Sequence
  chemically synthesized
aagcaagcttataatttcaa

SEQ ID NO: 6144 - DNA, 20 bp, Artificial Sequence
  chemically synthesized
ttataatttcaaaagcctca

SEQ ID NO: 6145 - DNA, 20 bp, Artificial Sequence
  chemically synthesized
taatttcaaaagcctcatgg

SEQ ID NO: 6146 - DNA, 20 bp, Artificial Sequence
  chemically synthesized
tttcaaaagcctcatggtag

SEQ ID NO: 6147 - DNA, 20 bp, Artificial Sequence
  chemically synthesized
ctcatggtagcagaatcaat

SEQ ID NO: 6148 - DNA, 20 bp, Artificial Sequence
  chemically synthesized
ttacattgtttgcctgcttt

SEQ ID NO: 6149 - DNA, 20 bp, Artificial Sequence
  chemically synthesized
tgtttgcctgctttaagttc

SEQ ID NO: 6150 - DNA, 20 bp, Artificial Sequence
  chemically synthesized
ctgctttaagttccagacct

SEQ ID NO: 6151 - DNA, 20 bp, Artificial Sequence
  chemically synthesized
ccagacctgagaatcatcat

SEQ ID NO: 6152 - DNA, 20 bp, Artificial Sequence
  chemically synthesized
aatcatcataagttttttta

SEQ ID NO: 6153 - DNA, 20 bp, Artificial Sequence
  chemically synthesized
taaagctctaataatgtaaa

SEQ ID NO: 6154 - DNA, 20 bp, Artificial Sequence
  chemically synthesized
taatgtaaacagatgttcaa

SEQ ID NO: 6155 - DNA, 20 bp, Artificial Sequence
  chemically synthesized
ccatactttcatgtttgatt

SEQ ID NO: 6156 - DNA, 20 bp, Artificial Sequence
  chemically synthesized
atgtttgattgagtaacttc

SEQ ID NO: 6157 - DNA, 20 bp, Artificial Sequence
  chemically synthesized
tgagtaacttcgagatgtta

SEQ ID NO: 6158 - DNA, 20 bp, Artificial Sequence
  chemically synthesized
tcgagatgttaaagtaactt

SEQ ID NO: 6159 - DNA, 20 bp, Artificial Sequence
  chemically synthesized
tgttaaagtaacttcagatt

SEQ ID NO: 6160 - DNA, 20 bp, Artificial Sequence
  chemically synthesized
gttaaagtaacttcagattt

SEQ ID NO: 6161 - DNA, 20 bp, Artificial Sequence
  chemically synthesized
gccctttatgtcctactttt

SEQ ID NO: 6162 - DNA, 20 bp, Artificial Sequence
  chemically synthesized
acttttcagctttgtcttat

SEQ ID NO: 6163 - DNA, 20 bp, Artificial Sequence
  chemically synthesized
gtcttattagcctcacaaca

SEQ ID NO: 6164 - DNA, 20 bp, Artificial Sequence
  chemically synthesized
agcctcacaacacagttcca

SEQ ID NO: 6165 - DNA, 20 bp, Artificial Sequence
  chemically synthesized
tatactacactgacgtcttc

SEQ ID NO: 6166 - DNA, 20 bp, Artificial Sequence
  chemically synthesized
actacactgacgtcttctag

SEQ ID NO: 6167 - DNA, 20 bp, Artificial Sequence
  chemically synthesized
ttcttgccctgactccttct

SEQ ID NO: 6168 - DNA, 20 bp, Artificial Sequence
  chemically synthesized
cttctcagcattgaataact

SEQ ID NO: 6169 - DNA, 20 bp, Artificial Sequence
  chemically synthesized
ttttaatacttttttctcca

SEQ ID NO: 6170 - DNA, 20 bp, Artificial Sequence
  chemically synthesized
ttttctccatagaatgcttg

SEQ ID NO: 6171 - DNA, 20 bp, Artificial Sequence
  chemically synthesized
tgaagtttcttcgtttcttg

SEQ ID NO: 6172 - DNA, 20 bp, Artificial Sequence
  chemically synthesized
aagtttcttcgtttcttgca

SEQ ID NO: 6173 - DNA, 20 bp, Artificial Sequence
  chemically synthesized
agtttcttcgtttcttgcag

SEQ ID NO: 6174 - DNA, 20 bp, Artificial Sequence
  chemically synthesized
gtttcttgcagaggattttt

SEQ ID NO: 6175 - DNA, 20 bp, Artificial Sequence
  chemically synthesized
caactcaacaatcacttttc

SEQ ID NO: 6176 - DNA, 20 bp, Artificial Sequence
  chemically synthesized
ctcaacaatcacttttcaag

SEQ ID NO: 6177 - DNA, 20 bp, Artificial Sequence
  chemically synthesized
cacttttcaagaagtttctt

SEQ ID NO: 6178 - DNA, 20 bp, Artificial Sequence
  chemically synthesized
tatccatatatctattattt

SEQ ID NO: 6179 - DNA, 20 bp, Artificial Sequence
  chemically synthesized
acttataattttgtatttat

SEQ ID NO: 6180 - DNA, 20 bp, Artificial Sequence
  chemically synthesized
tctgttacaaactaaattct

SEQ ID NO: 6181 - DNA, 20 bp, Artificial Sequence
  chemically synthesized
attctcagttccttaatgtg

SEQ ID NO: 6182 - DNA, 20 bp, Artificial Sequence
  chemically synthesized
tctgattcctgaccactcct

SEQ ID NO: 6183 - DNA, 20 bp, Artificial Sequence
  chemically synthesized
tgattcctgaccactcctga

SEQ ID NO: 6184 - DNA, 20 bp, Artificial Sequence
  chemically synthesized
ctcaaattcatgaatacaac

SEQ ID NO: 6185 - DNA, 20 bp, Artificial Sequence
  chemically synthesized
gctatttaatatattcatct

SEQ ID NO: 6186 - DNA, 20 bp, Artificial Sequence
  chemically synthesized
tgagtgtttaatcttaaaat

SEQ ID NO: 6187 - DNA, 20 bp, Artificial Sequence
  chemically synthesized
aaataagaatgatgccaata

SEQ ID NO: 6188 - DNA, 20 bp, Artificial Sequence
  chemically synthesized
ccttttctcctaatattata

SEQ ID NO: 6189 - DNA, 20 bp, Artificial Sequence
  chemically synthesized
caccaataacacaattgcat

SEQ ID NO: 6190 - DNA, 20 bp, Artificial Sequence
  chemically synthesized
ataacacaattgcataagac

SEQ ID NO: 6191 - DNA, 20 bp, Artificial Sequence
  chemically synthesized
aattgcataagacaagtctt

SEQ ID NO: 6192 - DNA, 20 bp, Artificial Sequence
  chemically synthesized
tcaatttctaccatttctac

SEQ ID NO: 6193 - DNA, 20 bp, Artificial Sequence
  chemically synthesized
tttctaccagaaacacatcc

SEQ ID NO: 6194 - DNA, 20 bp, Artificial Sequence
  chemically synthesized
taccagaaacacatcccaga

SEQ ID NO: 6195 - DNA, 20 bp, Artificial Sequence
  chemically synthesized
accagaaacacatcccagat

SEQ ID NO: 6196 - DNA, 20 bp, Artificial Sequence
  chemically synthesized
cttttacacattgcccgtct

SEQ ID NO: 6197 - DNA, 20 bp, Artificial Sequence
  chemically synthesized
ttataatatcattgtttccc

SEQ ID NO: 6198 - DNA, 20 bp, Artificial Sequence
  chemically synthesized
taataatttaatattattac

SEQ ID NO: 6199 - DNA, 20 bp, Artificial Sequence
  chemically synthesized
tctaaaaaatgtattatctc

SEQ ID NO: 6200 - DNA, 20 bp, Artificial Sequence
  chemically synthesized
ctaaaaaatgtattatctcc

SEQ ID NO: 6201 - DNA, 20 bp, Artificial Sequence
  chemically synthesized
taaaaaatgtattatctcca

SEQ ID NO: 6202 - DNA, 20 bp, Artificial Sequence
  chemically synthesized
ttgttgaaaaaactctttga

SEQ ID NO: 6203 - DNA, 20 bp, Artificial Sequence
  chemically synthesized
aaaatacaaattctttatca

SEQ ID NO: 6204 - DNA, 20 bp, Artificial Sequence
  chemically synthesized
aattctttatcatagtcaaa

SEQ ID NO: 6205 - DNA, 20 bp, Artificial Sequence
  chemically synthesized
tcaaaaagccttgtataacg

SEQ ID NO: 6206 - DNA, 20 bp, Artificial Sequence
  chemically synthesized
tgcctcttctattacatctt

SEQ ID NO: 6207 - DNA, 20 bp, Artificial Sequence
  chemically synthesized
tgcctacactccttaatatt

SEQ ID NO: 6208 - DNA, 20 bp, Artificial Sequence
  chemically synthesized
gcctacactccttaatattt

SEQ ID NO: 6209 - DNA, 20 bp, Artificial Sequence
  chemically synthesized
atctttatcttcctcaaaac

SEQ ID NO: 6210 - DNA, 20 bp, Artificial Sequence
  chemically synthesized
tatcttcctcaaaacaagct

SEQ ID NO: 6211 - DNA, 20 bp, Artificial Sequence
  chemically synthesized
agctaagtacatgcatgtct

SEQ ID NO: 6212 - DNA, 20 bp, Artificial Sequence
  chemically synthesized
gctaagtacatgcatgtctc

SEQ ID NO: 6213 - DNA, 20 bp, Artificial Sequence
  chemically synthesized
tgtctcaggatctttgccca

SEQ ID NO: 6214 - DNA, 20 bp, Artificial Sequence
  chemically synthesized
tgctccgaattatctacccc

SEQ ID NO: 6215 - DNA, 20 bp, Artificial Sequence
  chemically synthesized
atctaccccaagtatttgca

SEQ ID NO: 6216 - DNA, 20 bp, Artificial Sequence
  chemically synthesized
tcctttcaccattaactttt

SEQ ID NO: 6217 - DNA, 20 bp, Artificial Sequence
  chemically synthesized
agttaaaatgattacttcct

SEQ ID NO: 6218 - DNA, 20 bp, Artificial Sequence
  chemically synthesized
gttaaaatgattacttcctc

SEQ ID NO: 6219 - DNA, 20 bp, Artificial Sequence
  chemically synthesized
ttaaaatgattacttcctca

SEQ ID NO: 6220 - DNA, 20 bp, Artificial Sequence
  chemically synthesized
taaaatgattacttcctcag

SEQ ID NO: 6221 - DNA, 20 bp, Artificial Sequence
  chemically synthesized
aaaatgattacttcctcagg

SEQ ID NO: 6222 - DNA, 20 bp, Artificial Sequence
  chemically synthesized
ttctaatactgctccccacc

SEQ ID NO: 6223 - DNA, 20 bp, Artificial Sequence
  chemically synthesized
taactaacttactctcatca

SEQ ID NO: 6224 - DNA, 20 bp, Artificial Sequence
  chemically synthesized
ttactctcatcacagtatac

SEQ ID NO: 6225 - DNA, 20 bp, Artificial Sequence
  chemically synthesized
attatacactgaatttccat

SEQ ID NO: 6226 - DNA, 20 bp, Artificial Sequence
  chemically synthesized
tgaatttccattagattcat

SEQ ID NO: 6227 - DNA, 20 bp, Artificial Sequence
  chemically synthesized
aatttccattagattcatta

SEQ ID NO: 6228 - DNA, 20 bp, Artificial Sequence
  chemically synthesized
atttccattagattcattag

SEQ ID NO: 6229 - DNA, 20 bp, Artificial Sequence
  chemically synthesized
attagattcattagaggctg

SEQ ID NO: 6230 - DNA, 20 bp, Artificial Sequence
  chemically synthesized
agattcattagaggctgtag

SEQ ID NO: 6231 - DNA, 20 bp, Artificial Sequence
  chemically synthesized
cattagaggctgtagaagat

SEQ ID NO: 6232 - DNA, 20 bp, Artificial Sequence
  chemically synthesized
attagaggctgtagaagatt

SEQ ID NO: 6233 - DNA, 20 bp, Artificial Sequence
  chemically synthesized
accatatctgttttttgctc

SEQ ID NO: 6234 - DNA, 20 bp, Artificial Sequence
  chemically synthesized
tgctcaagaatatgaaaaat

SEQ ID NO: 6235 - DNA, 20 bp, Artificial Sequence
  chemically synthesized
gctcaagaatatgaaaaata

SEQ ID NO: 6236 - DNA, 20 bp, Artificial Sequence
  chemically synthesized
ctcaagaatatgaaaaataa

SEQ ID NO: 6237 - DNA, 20 bp, Artificial Sequence
  chemically synthesized
agaatatgaaaaataagggt

SEQ ID NO: 6238 - DNA, 20 bp, Artificial Sequence
  chemically synthesized
atgaaaaataagggttagca

SEQ ID NO: 6239 - DNA, 20 bp, Artificial Sequence
  chemically synthesized
aaataagggttagcatagaa

SEQ ID NO: 6240 - DNA, 20 bp, Artificial Sequence
  chemically synthesized
aataagggttagcatagaat

SEQ ID NO: 6241 - DNA, 20 bp, Artificial Sequence
  chemically synthesized
aattaattattctatgaaat

SEQ ID NO: 6242 - DNA, 20 bp, Artificial Sequence
  chemically synthesized
ttaattattctatgaaataa

SEQ ID NO: 6243 - DNA, 20 bp, Artificial Sequence
  chemically synthesized
ttattctatgaaataagagc

SEQ ID NO: 6244 - DNA, 20 bp, Artificial Sequence
  chemically synthesized
aaataagagctagacaatca

SEQ ID NO: 6245 - DNA, 20 bp, Artificial Sequence
  chemically synthesized
ataagagctagacaatcaca

SEQ ID NO: 6246 - DNA, 20 bp, Artificial Sequence
  chemically synthesized
tagacaatcacagagatata

SEQ ID NO: 6247 - DNA, 20 bp, Artificial Sequence
  chemically synthesized
gaatgtgaacactcctatca

SEQ ID NO: 6248 - DNA, 20 bp, Artificial Sequence
  chemically synthesized
taaaatcatctgtgtacact

SEQ ID NO: 6249 - DNA, 20 bp, Artificial Sequence
  chemically synthesized
acttagtcttttctgacctt

SEQ ID NO: 6250 - DNA, 20 bp, Artificial Sequence
  chemically synthesized
ctgacctttggccaccaatt

SEQ ID NO: 6251 - DNA, 20 bp, Artificial Sequence
  chemically synthesized
caattgagtcatcatatacc

SEQ ID NO: 6252 - DNA, 20 bp, Artificial Sequence
  chemically synthesized
catcatataccaagtttgaa

SEQ ID NO: 6253 - DNA, 20 bp, Artificial Sequence
  chemically synthesized
agtttgaatggtttataaaa

SEQ ID NO: 6254 - DNA, 20 bp, Artificial Sequence
  chemically synthesized
ttataaaacagatgctgctc

SEQ ID NO: 6255 - DNA, 20 bp, Artificial Sequence
  chemically synthesized
tataaaacagatgctgctcc

SEQ ID NO: 6256 - DNA, 20 bp, Artificial Sequence
  chemically synthesized
ataaaacagatgctgctcca

SEQ ID NO: 6257 - DNA, 20 bp, Artificial Sequence
  chemically synthesized
aacatgatttctctcatttc

SEQ ID NO: 6258 - DNA, 20 bp, Artificial Sequence
  chemically synthesized
ctctcatttccagcctgact

SEQ ID NO: 6259 - DNA, 20 bp, Artificial Sequence
  chemically synthesized
cctgactcagacatatcgtc

SEQ ID NO: 6260 - DNA, 20 bp, Artificial Sequence
  chemically synthesized
ctgactcagacatatcgtca

SEQ ID NO: 6261 - DNA, 20 bp, Artificial Sequence
  chemically synthesized
cagacatatcgtcaaggatc

SEQ ID NO: 6262 - DNA, 20 bp, Artificial Sequence
  chemically synthesized
agacatatcgtcaaggatct

SEQ ID NO: 6263 - DNA, 20 bp, Artificial Sequence
  chemically synthesized
ggatctgggattgatcacaa

SEQ ID NO: 6264 - DNA, 20 bp, Artificial Sequence
  chemically synthesized
gatttaatattctgtgaatg

SEQ ID NO: 6265 - DNA, 20 bp, Artificial Sequence
  chemically synthesized
atttaatattctgtgaatgt

SEQ ID NO: 6266 - DNA, 20 bp, Artificial Sequence
  chemically synthesized
tgaatgtaggtatgtgttaa

SEQ ID NO: 6267 - DNA, 20 bp, Artificial Sequence
  chemically synthesized
gtgttaaaagtatctacttt

SEQ ID NO: 6268 - DNA, 20 bp, Artificial Sequence
  chemically synthesized
taaaagtatctactttcagc

SEQ ID NO: 6269 - DNA, 20 bp, Artificial Sequence
  chemically synthesized
aaaagtatctactttcagcc

SEQ ID NO: 6270 - DNA, 20 bp, Artificial Sequence
  chemically synthesized
tatctactttcagccaggct

SEQ ID NO: 6271 - DNA, 20 bp, Artificial Sequence
  chemically synthesized
ctactttcagccaggcttgg

SEQ ID NO: 6272 - DNA, 20 bp, Artificial Sequence
  chemically synthesized
gtggctcacgcctgtaatcc

SEQ ID NO: 6273 - DNA, 20 bp, Artificial Sequence
  chemically synthesized
cgcctgtaatcctagcactt

SEQ ID NO: 6274 - DNA, 20 bp, Artificial Sequence
  chemically synthesized
gcctgtaatcctagcacttt

SEQ ID NO: 6275 - DNA, 20 bp, Artificial Sequence
  chemically synthesized
ctgtaatcctagcactttgg

SEQ ID NO: 6276 - DNA, 20 bp, Artificial Sequence
  chemically synthesized
tgtaatcctagcactttggg

SEQ ID NO: 6277 - DNA, 20 bp, Artificial Sequence
  chemically synthesized
tcctagcactttgggaggcc

SEQ ID NO: 6278 - DNA, 20 bp, Artificial Sequence
  chemically synthesized
cctagcactttgggaggccg

SEQ ID NO: 6279 - DNA, 20 bp, Artificial Sequence
  chemically synthesized
agcactttgggaggccgagg

SEQ ID NO: 6280 - DNA, 20 bp, Artificial Sequence
  chemically synthesized
gcactttgggaggccgaggc

SEQ ID NO: 6281 - DNA, 20 bp, Artificial Sequence
  chemically synthesized
ctttgggaggccgaggcagg

SEQ ID NO: 6282 - DNA, 20 bp, Artificial Sequence
  chemically synthesized
ggaggccgaggcaggtggat

SEQ ID NO: 6283 - DNA, 20 bp, Artificial Sequence
  chemically synthesized
ccgaggcaggtggattggct

SEQ ID NO: 6284 - DNA, 20 bp, Artificial Sequence
  chemically synthesized
gcaggtggattggctgagct

SEQ ID NO: 6285 - DNA, 20 bp, Artificial Sequence
  chemically synthesized
caggtggattggctgagctc

SEQ ID NO: 6286 - DNA, 20 bp, Artificial Sequence
  chemically synthesized
ggtggattggctgagctcag

SEQ ID NO: 6287 - DNA, 20 bp, Artificial Sequence
  chemically synthesized
gattggctgagctcaggagt

SEQ ID NO: 6288 - DNA, 20 bp, Artificial Sequence
  chemically synthesized
ttggctgagctcaggagttg

SEQ ID NO: 6289 - DNA, 20 bp, Artificial Sequence
  chemically synthesized
tcaggagttggagaccaacc

SEQ ID NO: 6290 - DNA, 20 bp, Artificial Sequence
  chemically synthesized
caggagttggagaccaacct

SEQ ID NO: 6291 - DNA, 20 bp, Artificial Sequence
  chemically synthesized
ggagaccaacctgggcaaaa

SEQ ID NO: 6292 - DNA, 20 bp, Artificial Sequence
  chemically synthesized
tactaaaacacaaaaataat

SEQ ID NO: 6293 - DNA, 20 bp, Artificial Sequence
  chemically synthesized
aaaacacaaaaataattagc

SEQ ID NO: 6294 - DNA, 20 bp, Artificial Sequence
  chemically synthesized
aaacacaaaaataattagct

SEQ ID NO: 6295 - DNA, 20 bp, Artificial Sequence
  chemically synthesized
caaaaataattagctgggca

SEQ ID NO: 6296 - DNA, 20 bp, Artificial Sequence
  chemically synthesized
aaataattagctgggcatgg

SEQ ID NO: 6297 - DNA, 20 bp, Artificial Sequence
  chemically synthesized
gcagtgtgctcctgtaatcc

SEQ ID NO: 6298 - DNA, 20 bp, Artificial Sequence
  chemically synthesized
ctcctgtaatcccagttact

SEQ ID NO: 6299 - DNA, 20 bp, Artificial Sequence
  chemically synthesized
tcctgtaatcccagttactt

SEQ ID NO: 6300 - DNA, 20 bp, Artificial Sequence
  chemically synthesized
ctgtaatcccagttacttgg

SEQ ID NO: 6301 - DNA, 20 bp, Artificial Sequence
  chemically synthesized
tcccagttacttgggagact

SEQ ID NO: 6302 - DNA, 20 bp, Artificial Sequence
  chemically synthesized
cccagttacttgggagactg

SEQ ID NO: 6303 - DNA, 20 bp, Artificial Sequence
  chemically synthesized
agttacttgggagactgagg

SEQ ID NO: 6304 - DNA, 20 bp, Artificial Sequence
  chemically synthesized
gttacttgggagactgaggc

SEQ ID NO: 6305 - DNA, 20 bp, Artificial Sequence
  chemically synthesized
tacttgggagactgaggcag

SEQ ID NO: 6306 - DNA, 20 bp, Artificial Sequence
  chemically synthesized
gcaggagaattgcttgatcc

SEQ ID NO: 6307 - DNA, 20 bp, Artificial Sequence
  chemically synthesized
caggagaattgcttgatcct

SEQ ID NO: 6308 - DNA, 20 bp, Artificial Sequence
  chemically synthesized
ggagaattgcttgatcctgg

SEQ ID NO: 6309 - DNA, 20 bp, Artificial Sequence
  chemically synthesized
gagaattgcttgatcctggg

SEQ ID NO: 6310 - DNA, 20 bp, Artificial Sequence
  chemically synthesized
aattgcttgatcctgggagg

SEQ ID NO: 6311 - DNA, 20 bp, Artificial Sequence
  chemically synthesized
tgcttgatcctgggaggtgg

SEQ ID NO: 6312 - DNA, 20 bp, Artificial Sequence
  chemically synthesized
atcctgggaggtggaagttg

SEQ ID NO: 6313 - DNA, 20 bp, Artificial Sequence
  chemically synthesized
tgggaggtggaagttgcagt

SEQ ID NO: 6314 - DNA, 20 bp, Artificial Sequence
  chemically synthesized
ggtggaagttgcagtgagcc

SEQ ID NO: 6315 - DNA, 20 bp, Artificial Sequence
  chemically synthesized
gagatcgcgccattgcactc

SEQ ID NO: 6316 - DNA, 20 bp, Artificial Sequence
  chemically synthesized
cgcgccattgcactccagtc

SEQ ID NO: 6317 - DNA, 20 bp, Artificial Sequence
  chemically synthesized
gcgccattgcactccagtct

SEQ ID NO: 6318 - DNA, 20 bp, Artificial Sequence
  chemically synthesized
ttgcactccagtctgggcga

SEQ ID NO: 6319 - DNA, 20 bp, Artificial Sequence
  chemically synthesized
gcactccagtctgggcgaca

SEQ ID NO: 6320 - DNA, 20 bp, Artificial Sequence
  chemically synthesized
tccagtctgggcgacagagc

SEQ ID NO: 6321 - DNA, 20 bp, Artificial Sequence
  chemically synthesized
cagagcaagactctgtccca

SEQ ID NO: 6322 - DNA, 20 bp, Artificial Sequence
  chemically synthesized
agagcaagactctgtcccaa

SEQ ID NO: 6323 - DNA, 20 bp, Artificial Sequence
  chemically synthesized
aaaaaaaatctattttcatg

SEQ ID NO: 6324 - DNA, 20 bp, Artificial Sequence
  chemically synthesized
aaaaaaatctattttcatgc

SEQ ID NO: 6325 - DNA, 20 bp, Artificial Sequence
  chemically synthesized
tattttcatgcaggtttctt

SEQ ID NO: 6326 - DNA, 20 bp, Artificial Sequence
  chemically synthesized
gtttcttcagactgactaca

SEQ ID NO: 6327 - DNA, 20 bp, Artificial Sequence
  chemically synthesized
tttcttcagactgactacaa

SEQ ID NO: 6328 - DNA, 20 bp, Artificial Sequence
  chemically synthesized
cagactgactacaaaggctt

SEQ ID NO: 6329 - DNA, 20 bp, Artificial Sequence
  chemically synthesized
tgactacaaaggcttcagac

SEQ ID NO: 6330 - DNA, 20 bp, Artificial Sequence
  chemically synthesized
aaggcttcagactagctaca

SEQ ID NO: 6331 - DNA, 20 bp, Artificial Sequence
  chemically synthesized
cttaaaaatctactttcatt

SEQ ID NO: 6332 - DNA, 20 bp, Artificial Sequence
  chemically synthesized
ttaaaaatctactttcattc

SEQ ID NO: 6333 - DNA, 20 bp, Artificial Sequence
  chemically synthesized
tactttcattcaggcttctt

SEQ ID NO: 6334 - DNA, 20 bp, Artificial Sequence
  chemically synthesized
tcattcaggcttcttcagac

SEQ ID NO: 6335 - DNA, 20 bp, Artificial Sequence
  chemically synthesized
aggcttcttcagactagata

SEQ ID NO: 6336 - DNA, 20 bp, Artificial Sequence
  chemically synthesized
cttcttcagactagatacag

SEQ ID NO: 6337 - DNA, 20 bp, Artificial Sequence
  chemically synthesized
agactagatacagaagaaat

SEQ ID NO: 6338 - DNA, 20 bp, Artificial Sequence
  chemically synthesized
acagaagaaatgagaccatc

SEQ ID NO: 6339 - DNA, 20 bp, Artificial Sequence
  chemically synthesized
aagaaatgagaccatctaga

SEQ ID NO: 6340 - DNA, 20 bp, Artificial Sequence
  chemically synthesized
agaaatgagaccatctagat

SEQ ID NO: 6341 - DNA, 20 bp, Artificial Sequence
  chemically synthesized
gaaatgagaccatctagatg

SEQ ID NO: 6342 - DNA, 20 bp, Artificial Sequence
  chemically synthesized
gagaccatctagatggggaa

SEQ ID NO: 6343 - DNA, 20 bp, Artificial Sequence
  chemically synthesized
tattatccatgttgccacca

SEQ ID NO: 6344 - DNA, 20 bp, Artificial Sequence
  chemically synthesized
ttatccatgttgccaccata

SEQ ID NO: 6345 - DNA, 20 bp, Artificial Sequence
  chemically synthesized
gttgccaccatagagactat

SEQ ID NO: 6346 - DNA, 20 bp, Artificial Sequence
  chemically synthesized
catagagactatcagccttt

SEQ ID NO: 6347 - DNA, 20 bp, Artificial Sequence
  chemically synthesized
atagagactatcagcctttt

SEQ ID NO: 6348 - DNA, 20 bp, Artificial Sequence
  chemically synthesized
tatcagccttttgggattac

SEQ ID NO: 6349 - DNA, 20 bp, Artificial Sequence
  chemically synthesized
tcagccttttgggattacca

SEQ ID NO: 6350 - DNA, 20 bp, Artificial Sequence
  chemically synthesized
taccagagcaaaatacatgt

SEQ ID NO: 6351 - DNA, 20 bp, Artificial Sequence
  chemically synthesized
ccagagcaaaatacatgttg

SEQ ID NO: 6352 - DNA, 20 bp, Artificial Sequence
  chemically synthesized
cagagcaaaatacatgttgg

SEQ ID NO: 6353 - DNA, 20 bp, Artificial Sequence
  chemically synthesized
ttttttaaaatatgttttga

SEQ ID NO: 6354 - DNA, 20 bp, Artificial Sequence
  chemically synthesized
tttttaaaatatgttttgaa

SEQ ID NO: 6355 - DNA, 20 bp, Artificial Sequence
  chemically synthesized
ttaaaatatgttttgaaagg

SEQ ID NO: 6356 - DNA, 20 bp, Artificial Sequence
  chemically synthesized
taaaatatgttttgaaaggt

SEQ ID NO: 6357 - DNA, 20 bp, Artificial Sequence
  chemically synthesized
tgttttgaaaggtaggatga

SEQ ID NO: 6358 - DNA, 20 bp, Artificial Sequence
  chemically synthesized
ttttgaaaggtaggatgaaa

SEQ ID NO: 6359 - DNA, 20 bp, Artificial Sequence
  chemically synthesized
aaaggtaggatgaaagagca

SEQ ID NO: 6360 - DNA, 20 bp, Artificial Sequence
  chemically synthesized
tgaaagagcatagttttgat

SEQ ID NO: 6361 - DNA, 20 bp, Artificial Sequence
  chemically synthesized
gaaagagcatagttttgata

SEQ ID NO: 6362 - DNA, 20 bp, Artificial Sequence
  chemically synthesized
tttgataaggtaaataaatg

SEQ ID NO: 6363 - DNA, 20 bp, Artificial Sequence
  chemically synthesized
ggtaaataaatgaagattta

SEQ ID NO: 6364 - DNA, 20 bp, Artificial Sequence
  chemically synthesized
atgaagatttaaagaaaaac

SEQ ID NO: 6365 - DNA, 20 bp, Artificial Sequence
  chemically synthesized
gaaaaacaagatcaatatgt

SEQ ID NO: 6366 - DNA, 20 bp, Artificial Sequence
  chemically synthesized
aaaaacaagatcaatatgtc

SEQ ID NO: 6367 - DNA, 20 bp, Artificial Sequence
  chemically synthesized
gatcaatatgtcaggtgtgc

SEQ ID NO: 6368 - DNA, 20 bp, Artificial Sequence
  chemically synthesized
acctgtatttaaaaaacaaa

SEQ ID NO: 6369 - DNA, 20 bp, Artificial Sequence
  chemically synthesized
ttaaaaaacaaaaagattta

SEQ ID NO: 6370 - DNA, 20 bp, Artificial Sequence
  chemically synthesized
aaaaagatttacagttttcc

SEQ ID NO: 6371 - DNA, 20 bp, Artificial Sequence
  chemically synthesized
catgttgtgttatgctatct

SEQ ID NO: 6372 - DNA, 20 bp, Artificial Sequence
  chemically synthesized
tgttgtgttatgctatctga

SEQ ID NO: 6373 - DNA, 20 bp, Artificial Sequence
  chemically synthesized
gtgttatgctatctgagagt

SEQ ID NO: 6374 - DNA, 20 bp, Artificial Sequence
  chemically synthesized
gctatctgagagtcagtgta

SEQ ID NO: 6375 - DNA, 20 bp, Artificial Sequence
  chemically synthesized
agagtcagtgtatggtatct

SEQ ID NO: 6376 - DNA, 20 bp, Artificial Sequence
  chemically synthesized
agtgtatggtatctcagtct

SEQ ID NO: 6377 - DNA, 20 bp, Artificial Sequence
  chemically synthesized
ggtatctcagtctgagttcc

SEQ ID NO: 6378 - DNA, 20 bp, Artificial Sequence
  chemically synthesized
cagtctgagttcccagcaac

SEQ ID NO: 6379 - DNA, 20 bp, Artificial Sequence
  chemically synthesized
aatgcctataataaaataaa

SEQ ID NO: 6380 - DNA, 20 bp, Artificial Sequence
  chemically synthesized
tgcctataataaaataaata

SEQ ID NO: 6381 - DNA, 20 bp, Artificial Sequence
  chemically synthesized
ctataataaaataaatagag

SEQ ID NO: 6382 - DNA, 20 bp, Artificial Sequence
  chemically synthesized
aaataaatagagaagacaaa

SEQ ID NO: 6383 - DNA, 20 bp, Artificial Sequence
  chemically synthesized
taaatagagaagacaaatag

SEQ ID NO: 6384 - DNA, 20 bp, Artificial Sequence
  chemically synthesized
agacaaatagcagtgaattt

SEQ ID NO: 6385 - DNA, 20 bp, Artificial Sequence
  chemically synthesized
aatagcagtgaatttgagtc

SEQ ID NO: 6386 - DNA, 20 bp, Artificial Sequence
  chemically synthesized
tagcagtgaatttgagtctg

SEQ ID NO: 6387 - DNA, 20 bp, Artificial Sequence
  chemically synthesized
atttgagtctggagaaataa

SEQ ID NO: 6388 - DNA, 20 bp, Artificial Sequence
  chemically synthesized
tttgagtctggagaaataaa

SEQ ID NO: 6389 - DNA, 20 bp, Artificial Sequence
  chemically synthesized
ttgagtctggagaaataaaa

SEQ ID NO: 6390 - DNA, 20 bp, Artificial Sequence
  chemically synthesized
agggttttcgtatcccctct

SEQ ID NO: 6391 - DNA, 20 bp, Artificial Sequence
  chemically synthesized
tatcccctctgagcactgtc

SEQ ID NO: 6392 - DNA, 20 bp, Artificial Sequence
  chemically synthesized
cactgtctggaatgttgact

SEQ ID NO: 6393 - DNA, 20 bp, Artificial Sequence
  chemically synthesized
gtctggaatgttgacttgga

SEQ ID NO: 6394 - DNA, 20 bp, Artificial Sequence
  chemically synthesized
aaatctgtgattataataac

SEQ ID NO: 6395 - DNA, 20 bp, Artificial Sequence
  chemically synthesized
aatctgtgattataataacc

SEQ ID NO: 6396 - DNA, 20 bp, Artificial Sequence
  chemically synthesized
taataaccaggtcattcttt

SEQ ID NO: 6397 - DNA, 20 bp, Artificial Sequence
  chemically synthesized
aataaccaggtcattctttc

SEQ ID NO: 6398 - DNA, 20 bp, Artificial Sequence
  chemically synthesized
taaccaggtcattctttcag

SEQ ID NO: 6399 - DNA, 20 bp, Artificial Sequence
  chemically synthesized
ttaaaactgacctacatatg

SEQ ID NO: 6400 - DNA, 20 bp, Artificial Sequence
  chemically synthesized
ctacatatgcagaaatctct

SEQ ID NO: 6401 - DNA, 20 bp, Artificial Sequence
  chemically synthesized
tttttttttttctgtctttt

SEQ ID NO: 6402 - DNA, 20 bp, Artificial Sequence
  chemically synthesized
attacttgcttactttaaaa

SEQ ID NO: 6403 - DNA, 20 bp, Artificial Sequence
  chemically synthesized
ttacttgcttactttaaaat

SEQ ID NO: 6404 - DNA, 20 bp, Artificial Sequence
  chemically synthesized
tacttgcttactttaaaata

SEQ ID NO: 6405 - DNA, 20 bp, Artificial Sequence
  chemically synthesized
taaaatagggtaatgaccaa

SEQ ID NO: 6406 - DNA, 20 bp, Artificial Sequence
  chemically synthesized
gaccaatagtcattgttcca

SEQ ID NO: 6407 - DNA, 20 bp, Artificial Sequence
  chemically synthesized
tagtcattgttccaaagaca

SEQ ID NO: 6408 - DNA, 20 bp, Artificial Sequence
  chemically synthesized
gtcattgttccaaagacata

SEQ ID NO: 6409 - DNA, 20 bp, Artificial Sequence
  chemically synthesized
ttgttccaaagacatagaga

SEQ ID NO: 6410 - DNA, 20 bp, Artificial Sequence
  chemically synthesized
agaaagtatattgtgtttaa

SEQ ID NO: 6411 - DNA, 20 bp, Artificial Sequence
  chemically synthesized
agtatattgtgtttaaaaga

SEQ ID NO: 6412 - DNA, 20 bp, Artificial Sequence
  chemically synthesized
acagcttctttataattcta

SEQ ID NO: 6413 - DNA, 20 bp, Artificial Sequence
  chemically synthesized
ctaaaacattcctatttgcc

SEQ ID NO: 6414 - DNA, 20 bp, Artificial Sequence
  chemically synthesized
taaaacattcctatttgcca

SEQ ID NO: 6415 - DNA, 20 bp, Artificial Sequence
  chemically synthesized
aacattcctatttgccaagg

SEQ ID NO: 6416 - DNA, 20 bp, Artificial Sequence
  chemically synthesized
attcctatttgccaaggcag

SEQ ID NO: 6417 - DNA, 20 bp, Artificial Sequence
  chemically synthesized
tcctatttgccaaggcagtg

SEQ ID NO: 6418 - DNA, 20 bp, Artificial Sequence
  chemically synthesized
agtggagtttttgctgttct

SEQ ID NO: 6419 - DNA, 20 bp, Artificial Sequence
  chemically synthesized
tcttagaacataattactga

SEQ ID NO: 6420 - DNA, 20 bp, Artificial Sequence
  chemically synthesized
cacccacacatgtcctgcct

SEQ ID NO: 6421 - DNA, 20 bp, Artificial Sequence
  chemically synthesized
aattgtatgtccatccttta

SEQ ID NO: 6422 - DNA, 20 bp, Artificial Sequence
  chemically synthesized
attgtatgtccatcctttaa

SEQ ID NO: 6423 - DNA, 20 bp, Artificial Sequence
  chemically synthesized
tttaaaggtcattcctttaa

SEQ ID NO: 6424 - DNA, 20 bp, Artificial Sequence
  chemically synthesized
attcctttaatggtcttttc

SEQ ID NO: 6425 - DNA, 20 bp, Artificial Sequence
  chemically synthesized
tggtcttttctggacaccac

SEQ ID NO: 6426 - DNA, 20 bp, Artificial Sequence
  chemically synthesized
ggtcttttctggacaccact

SEQ ID NO: 6427 - DNA, 20 bp, Artificial Sequence
  chemically synthesized
gtcttttctggacaccacta

SEQ ID NO: 6428 - DNA, 20 bp, Artificial Sequence
  chemically synthesized
tcttttctggacaccactag

SEQ ID NO: 6429 - DNA, 20 bp, Artificial Sequence
  chemically synthesized
ttctggacaccactaggggt

SEQ ID NO: 6430 - DNA, 20 bp, Artificial Sequence
  chemically synthesized
tggacaccactaggggtcag

SEQ ID NO: 6431 - DNA, 20 bp, Artificial Sequence
  chemically synthesized
acaccactaggggtcagaag

SEQ ID NO: 6432 - DNA, 20 bp, Artificial Sequence
  chemically synthesized
actttcttccctccctactt

SEQ ID NO: 6433 - DNA, 20 bp, Artificial Sequence
  chemically synthesized
tccctacttcagtgatgcat

SEQ ID NO: 6434 - DNA, 20 bp, Artificial Sequence
  chemically synthesized
ccctacttcagtgatgcata

SEQ ID NO: 6435 - DNA, 20 bp, Artificial Sequence
  chemically synthesized
tacttcagtgatgcataagg

SEQ ID NO: 6436 - DNA, 20 bp, Artificial Sequence
  chemically synthesized
tgcataaggcagatctgctt

SEQ ID NO: 6437 - DNA, 20 bp, Artificial Sequence
  chemically synthesized
aggcagatctgctttagtgt

SEQ ID NO: 6438 - DNA, 20 bp, Artificial Sequence
  chemically synthesized
agatctgctttagtgtaagc

SEQ ID NO: 6439 - DNA, 20 bp, Artificial Sequence
  chemically synthesized
gatctgctttagtgtaagcg

SEQ ID NO: 6440 - DNA, 20 bp, Artificial Sequence
  chemically synthesized
tgctttagtgtaagcgaggt

SEQ ID NO: 6441 - DNA, 20 bp, Artificial Sequence
  chemically synthesized
gctttagtgtaagcgaggtc

SEQ ID NO: 6442 - DNA, 20 bp, Artificial Sequence
  chemically synthesized
gtaagcgaggtcaggccctc

SEQ ID NO: 6443 - DNA, 20 bp, Artificial Sequence
  chemically synthesized
aagcgaggtcaggccctcaa

SEQ ID NO: 6444 - DNA, 20 bp, Artificial Sequence
  chemically synthesized
ggtcaggccctcaagagtct

SEQ ID NO: 6445 - DNA, 20 bp, Artificial Sequence
  chemically synthesized
gtcaggccctcaagagtctt

SEQ ID NO: 6446 - DNA, 20 bp, Artificial Sequence
  chemically synthesized
ggccctcaagagtcttggga

SEQ ID NO: 6447 - DNA, 20 bp, Artificial Sequence
  chemically synthesized
caagagtcttgggatggctg

SEQ ID NO: 6448 - DNA, 20 bp, Artificial Sequence
  chemically synthesized
agagtcttgggatggctgaa

SEQ ID NO: 6449 - DNA, 20 bp, Artificial Sequence
  chemically synthesized
gagtcttgggatggctgaag

SEQ ID NO: 6450 - DNA, 20 bp, Artificial Sequence
  chemically synthesized
cttgggatggctgaagaggt

SEQ ID NO: 6451 - DNA, 20 bp, Artificial Sequence
  chemically synthesized
aagaggtaagaacattctat

SEQ ID NO: 6452 - DNA, 20 bp, Artificial Sequence
  chemically synthesized
cattctataagacttgtcca

SEQ ID NO: 6453 - DNA, 20 bp, Artificial Sequence
  chemically synthesized
tttaatgattctgaatatgc

SEQ ID NO: 6454 - DNA, 20 bp, Artificial Sequence
  chemically synthesized
tgattctgaatatgctagtt

SEQ ID NO: 6455 - DNA, 20 bp, Artificial Sequence
  chemically synthesized
attctgaatatgctagttca

SEQ ID NO: 6456 - DNA, 20 bp, Artificial Sequence
  chemically synthesized
tctgaatatgctagttcaga

SEQ ID NO: 6457 - DNA, 20 bp, Artificial Sequence
  chemically synthesized
atctatttaccacaaacctg

SEQ ID NO: 6458 - DNA, 20 bp, Artificial Sequence
  chemically synthesized
tatttaccacaaacctgaag

SEQ ID NO: 6459 - DNA, 20 bp, Artificial Sequence
  chemically synthesized
atttaccacaaacctgaagt

SEQ ID NO: 6460 - DNA, 20 bp, Artificial Sequence
  chemically synthesized
ctgaagtaggcttaaatttc

SEQ ID NO: 6461 - DNA, 20 bp, Artificial Sequence
  chemically synthesized
aaatttccagtttacctgaa

SEQ ID NO: 6462 - DNA, 20 bp, Artificial Sequence
  chemically synthesized
ctgaatggttatgacctaat

SEQ ID NO: 6463 - DNA, 20 bp, Artificial Sequence
  chemically synthesized
gaatggttatgacctaatta

SEQ ID NO: 6464 - DNA, 20 bp, Artificial Sequence
  chemically synthesized
aatggttatgacctaattag

SEQ ID NO: 6465 - DNA, 20 bp, Artificial Sequence
  chemically synthesized
aatgactttataaacatata

SEQ ID NO: 6466 - DNA, 20 bp, Artificial Sequence
  chemically synthesized
catatatagatacaaatata

SEQ ID NO: 6467 - DNA, 20 bp, Artificial Sequence
  chemically synthesized
atatttattatatattatat

SEQ ID NO: 6468 - DNA, 20 bp, Artificial Sequence
  chemically synthesized
tatataagcataaaatgtaa

SEQ ID NO: 6469 - DNA, 20 bp, Artificial Sequence
  chemically synthesized
tatgtatatacacatttatc

SEQ ID NO: 6470 - DNA, 20 bp, Artificial Sequence
  chemically synthesized
tatttcattatatattttat

SEQ ID NO: 6471 - DNA, 20 bp, Artificial Sequence
  chemically synthesized
ctaaaatattttttaaaaat

SEQ ID NO: 6472 - DNA, 20 bp, Artificial Sequence
  chemically synthesized
tttaaaaattagccatacct

SEQ ID NO: 6473 - DNA, 20 bp, Artificial Sequence
  chemically synthesized
aaaaattagccataccttag

SEQ ID NO: 6474 - DNA, 20 bp, Artificial Sequence
  chemically synthesized
attataaaaaatatatgaca

SEQ ID NO: 6475 - DNA, 20 bp, Artificial Sequence
  chemically synthesized
atggtccatctgttcaactg

SEQ ID NO: 6476 - DNA, 20 bp, Artificial Sequence
  chemically synthesized
ctgtagccatctaaccattt

SEQ ID NO: 6477 - DNA, 20 bp, Artificial Sequence
  chemically synthesized
tagccatctaaccatttgag

SEQ ID NO: 6478 - DNA, 20 bp, Artificial Sequence
  chemically synthesized
accatttgagaagtttttat

SEQ ID NO: 6479 - DNA, 20 bp, Artificial Sequence
  chemically synthesized
agaagtttttataagattta

SEQ ID NO: 6480 - DNA, 20 bp, Artificial Sequence
  chemically synthesized
tgacataaatcatctcatgc

SEQ ID NO: 6481 - DNA, 20 bp, Artificial Sequence
  chemically synthesized
ataaatcatctcatgcaaga

SEQ ID NO: 6482 - DNA, 20 bp, Artificial Sequence
  chemically synthesized
agatagtgtatttgttttgt

SEQ ID NO: 6483 - DNA, 20 bp, Artificial Sequence
  chemically synthesized
ttaatatgttcccttttctt

SEQ ID NO: 6484 - DNA, 20 bp, Artificial Sequence
  chemically synthesized
cccttttcttcagaaaatgt

SEQ ID NO: 6485 - DNA, 20 bp, Artificial Sequence
  chemically synthesized
tttcttcagaaaatgtgaga

SEQ ID NO: 6486 - DNA, 20 bp, Artificial Sequence
  chemically synthesized
cttaaaataaaattaactat

SEQ ID NO: 6487 - DNA, 20 bp, Artificial Sequence
  chemically synthesized
taaaattaactataagaaac

SEQ ID NO: 6488 - DNA, 20 bp, Artificial Sequence
  chemically synthesized
aactggtaaacactgaatga

SEQ ID NO: 6489 - DNA, 20 bp, Artificial Sequence
  chemically synthesized
tggtaaacactgaatgaaag

SEQ ID NO: 6490 - DNA, 20 bp, Artificial Sequence
  chemically synthesized
ctgaatgaaagaagaaaacc

SEQ ID NO: 6491 - DNA, 20 bp, Artificial Sequence
  chemically synthesized
aatgaaagaagaaaaccaag

SEQ ID NO: 6492 - DNA, 20 bp, Artificial Sequence
  chemically synthesized
aagaagaaaaccaagcagaa

SEQ ID NO: 6493 - DNA, 20 bp, Artificial Sequence
  chemically synthesized
aaaaccaagcagaaaagtaa

SEQ ID NO: 6494 - DNA, 20 bp, Artificial Sequence
  chemically synthesized
aaaccaagcagaaaagtaaa

SEQ ID NO: 6495 - DNA, 20 bp, Artificial Sequence
  chemically synthesized
accaagcagaaaagtaaaag

SEQ ID NO: 6496 - DNA, 20 bp, Artificial Sequence
  chemically synthesized
ccaagcagaaaagtaaaagg

SEQ ID NO: 6497 - DNA, 20 bp, Artificial Sequence
  chemically synthesized
aaaaacattttttatttgcc

SEQ ID NO: 6498 - DNA, 20 bp, Artificial Sequence
  chemically synthesized
ttatttgcctggcaaataat

SEQ ID NO: 6499 - DNA, 20 bp, Artificial Sequence
  chemically synthesized
ataataagtgcatatattaa

SEQ ID NO: 6500 - DNA, 20 bp, Artificial Sequence
  chemically synthesized
ataatatatataatatgtta

SEQ ID NO: 6501 - DNA, 20 bp, Artificial Sequence
  chemically synthesized
taatatatataatatgttat

SEQ ID NO: 6502 - DNA, 20 bp, Artificial Sequence
  chemically synthesized
tttgatctatatatacattg

SEQ ID NO: 6503 - DNA, 20 bp, Artificial Sequence
  chemically synthesized
tgatctatatatacattgta

SEQ ID NO: 6504 - DNA, 20 bp, Artificial Sequence
  chemically synthesized
atctatatatacattgtaga

SEQ ID NO: 6505 - DNA, 20 bp, Artificial Sequence
  chemically synthesized
ctatatatacattgtagaga

SEQ ID NO: 6506 - DNA, 20 bp, Artificial Sequence
  chemically synthesized
cattgtagagagagtctatc

SEQ ID NO: 6507 - DNA, 20 bp, Artificial Sequence
  chemically synthesized
agagagtctatcaagctaat

SEQ ID NO: 6508 - DNA, 20 bp, Artificial Sequence
  chemically synthesized
tcaccttccaactttttttg

SEQ ID NO: 6509 - DNA, 20 bp, Artificial Sequence
  chemically synthesized
cttccaactttttttgtggt

SEQ ID NO: 6510 - DNA, 20 bp, Artificial Sequence
  chemically synthesized
aacataaaatatttattttt

SEQ ID NO: 6511 - DNA, 20 bp, Artificial Sequence
  chemically synthesized
tattaactgtgttcactatg

SEQ ID NO: 6512 - DNA, 20 bp, Artificial Sequence
  chemically synthesized
ctgtgttcactatgcagtgt

SEQ ID NO: 6513 - DNA, 20 bp, Artificial Sequence
  chemically synthesized
gtgttcactatgcagtgtga

SEQ ID NO: 6514 - DNA, 20 bp, Artificial Sequence
  chemically synthesized
atcactaaaacttattcctc

SEQ ID NO: 6515 - DNA, 20 bp, Artificial Sequence
  chemically synthesized
ttattcctctagtctaactg

SEQ ID NO: 6516 - DNA, 20 bp, Artificial Sequence
  chemically synthesized
ccatccctcctctacactct

SEQ ID NO: 6517 - DNA, 20 bp, Artificial Sequence
  chemically synthesized
ccctcctctacactctcagt

SEQ ID NO: 6518 - DNA, 20 bp, Artificial Sequence
  chemically synthesized
ctacactctcagtcagccta

SEQ ID NO: 6519 - DNA, 20 bp, Artificial Sequence
  chemically synthesized
cttaaatatattaaaatgaa

SEQ ID NO: 6520 - DNA, 20 bp, Artificial Sequence
  chemically synthesized
aaatgaacagttaaatttat

SEQ ID NO: 6521 - DNA, 20 bp, Artificial Sequence
  chemically synthesized
aatgaacagttaaatttatg

SEQ ID NO: 6522 - DNA, 20 bp, Artificial Sequence
  chemically synthesized
aaaactattacacatatttt

SEQ ID NO: 6523 - DNA, 20 bp, Artificial Sequence
  chemically synthesized
aagttgtcctctgaaaattc

SEQ ID NO: 6524 - DNA, 20 bp, Artificial Sequence
  chemically synthesized
acttcaatacccttattttt

SEQ ID NO: 6525 - DNA, 20 bp, Artificial Sequence
  chemically synthesized
atacccttatttttaagata

SEQ ID NO: 6526 - DNA, 20 bp, Artificial Sequence
  chemically synthesized
tacccttatttttaagataa

SEQ ID NO: 6527 - DNA, 20 bp, Artificial Sequence
  chemically synthesized
ttaagataaaggaaattgta

SEQ ID NO: 6528 - DNA, 20 bp, Artificial Sequence
  chemically synthesized
taagataaaggaaattgtaa

SEQ ID NO: 6529 - DNA, 20 bp, Artificial Sequence
  chemically synthesized
ggaaattgtaaaggctttct

SEQ ID NO: 6530 - DNA, 20 bp, Artificial Sequence
  chemically synthesized
taaaggctttctaagaaatc

SEQ ID NO: 6531 - DNA, 20 bp, Artificial Sequence
  chemically synthesized
agaaatcgagtacccatacc

SEQ ID NO: 6532 - DNA, 20 bp, Artificial Sequence
  chemically synthesized
gaaatcgagtacccatacct

SEQ ID NO: 6533 - DNA, 20 bp, Artificial Sequence
  chemically synthesized
agtacccatacctaggctgc

SEQ ID NO: 6534 - DNA, 20 bp, Artificial Sequence
  chemically synthesized
atacctaggctgctagactc

SEQ ID NO: 6535 - DNA, 20 bp, Artificial Sequence
  chemically synthesized
tacctaggctgctagactcc

SEQ ID NO: 6536 - DNA, 20 bp, Artificial Sequence
  chemically synthesized
ctccaggtccaatttttctc

SEQ ID NO: 6537 - DNA, 20 bp, Artificial Sequence
  chemically synthesized
tccaggtccaatttttctcc

SEQ ID NO: 6538 - DNA, 20 bp, Artificial Sequence
  chemically synthesized
ccaggtccaatttttctcca

SEQ ID NO: 6539 - DNA, 20 bp, Artificial Sequence
  chemically synthesized
caggtccaatttttctccag

SEQ ID NO: 6540 - DNA, 20 bp, Artificial Sequence
  chemically synthesized
aggtccaatttttctccagg

SEQ ID NO: 6541 - DNA, 20 bp, Artificial Sequence
  chemically synthesized
ttttctccagggggttacta

SEQ ID NO: 6542 - DNA, 20 bp, Artificial Sequence
  chemically synthesized
ccagggggttactatggctt

SEQ ID NO: 6543 - DNA, 20 bp, Artificial Sequence
  chemically synthesized
cagggggttactatggcttc

SEQ ID NO: 6544 - DNA, 20 bp, Artificial Sequence
  chemically synthesized
agggggttactatggcttca

SEQ ID NO: 6545 - DNA, 20 bp, Artificial Sequence
  chemically synthesized
gggttactatggcttcaggg

SEQ ID NO: 6546 - DNA, 20 bp, Artificial Sequence
  chemically synthesized
ctatctataatcaccatctc

SEQ ID NO: 6547 - DNA, 20 bp, Artificial Sequence
  chemically synthesized
ctcactttctcatcaccaca

SEQ ID NO: 6548 - DNA, 20 bp, Artificial Sequence
  chemically synthesized
actttctcatcaccacacag

SEQ ID NO: 6549 - DNA, 20 bp, Artificial Sequence
  chemically synthesized
tcatcaccacacagtggaat

SEQ ID NO: 6550 - DNA, 20 bp, Artificial Sequence
  chemically synthesized
accacacagtggaataagaa

SEQ ID NO: 6551 - DNA, 20 bp, Artificial Sequence
  chemically synthesized
cagtggaataagaatagttt

SEQ ID NO: 6552 - DNA, 20 bp, Artificial Sequence
  chemically synthesized
tggaataagaatagttttgg

SEQ ID NO: 6553 - DNA, 20 bp, Artificial Sequence
  chemically synthesized
tagttttggcagcaataaaa

SEQ ID NO: 6554 - DNA, 20 bp, Artificial Sequence
  chemically synthesized
aaagtaatgccatatcaaat

SEQ ID NO: 6555 - DNA, 20 bp, Artificial Sequence
  chemically synthesized
aatgccatatcaaattagta

SEQ ID NO: 6556 - DNA, 20 bp, Artificial Sequence
  chemically synthesized
tatcaaattagtaaagcctt

SEQ ID NO: 6557 - DNA, 20 bp, Artificial Sequence
  chemically synthesized
attagtaaagccttcagaaa

SEQ ID NO: 6558 - DNA, 20 bp, Artificial Sequence
  chemically synthesized
gaaaaagtatgaatattaca

SEQ ID NO: 6559 - DNA, 20 bp, Artificial Sequence
  chemically synthesized
ttacacagttacacttatat

SEQ ID NO: 6560 - DNA, 20 bp, Artificial Sequence
  chemically synthesized
tgtctgattaaatgttatta

SEQ ID NO: 6561 - DNA, 20 bp, Artificial Sequence
  chemically synthesized
tatatactactattaatttc

SEQ ID NO: 6562 - DNA, 20 bp, Artificial Sequence
  chemically synthesized
ccagttctatctttctgttc

SEQ ID NO: 6563 - DNA, 20 bp, Artificial Sequence
  chemically synthesized
tctatctttctgttcaagaa

SEQ ID NO: 6564 - DNA, 20 bp, Artificial Sequence
  chemically synthesized
tctgttcaagaaaagaatgt

SEQ ID NO: 6565 - DNA, 20 bp, Artificial Sequence
  chemically synthesized
gttcaagaaaagaatgtgag

SEQ ID NO: 6566 - DNA, 20 bp, Artificial Sequence
  chemically synthesized
aaagaatgtgagaagtaaat

SEQ ID NO: 6567 - DNA, 20 bp, Artificial Sequence
  chemically synthesized
tttgcctacttcatccccaa

SEQ ID NO: 6568 - DNA, 20 bp, Artificial Sequence
  chemically synthesized
tgcctacttcatccccaaca

SEQ ID NO: 6569 - DNA, 20 bp, Artificial Sequence
  chemically synthesized
gcctacttcatccccaacag

SEQ ID NO: 6570 - DNA, 20 bp, Artificial Sequence
  chemically synthesized
ctacttcatccccaacagag

SEQ ID NO: 6571 - DNA, 20 bp, Artificial Sequence
  chemically synthesized
gatcatgactatatcaataa

SEQ ID NO: 6572 - DNA, 20 bp, Artificial Sequence
  chemically synthesized
tcatgactatatcaataatg

SEQ ID NO: 6573 - DNA, 20 bp, Artificial Sequence
  chemically synthesized
actatatcaataatggagcc

SEQ ID NO: 6574 - DNA, 20 bp, Artificial Sequence
  chemically synthesized
ctatatcaataatggagcct

SEQ ID NO: 6575 - DNA, 20 bp, Artificial Sequence
  chemically synthesized
tcaataatggagcctgggcc

SEQ ID NO: 6576 - DNA, 20 bp, Artificial Sequence
  chemically synthesized
ggagcctgggcccagacaac

SEQ ID NO: 6577 - DNA, 20 bp, Artificial Sequence
  chemically synthesized
ctgggcccagacaactggtt

SEQ ID NO: 6578 - DNA, 20 bp, Artificial Sequence
  chemically synthesized
gggcccagacaactggttaa

SEQ ID NO: 6579 - DNA, 20 bp, Artificial Sequence
  chemically synthesized
gcccagacaactggttaaga

SEQ ID NO: 6580 - DNA, 20 bp, Artificial Sequence
  chemically synthesized
ccagacaactggttaagaga

SEQ ID NO: 6581 - DNA, 20 bp, Artificial Sequence
  chemically synthesized
cagacaactggttaagagag

SEQ ID NO: 6582 - DNA, 20 bp, Artificial Sequence
  chemically synthesized
gagagaggtcattctgacct

SEQ ID NO: 6583 - DNA, 20 bp, Artificial Sequence
  chemically synthesized
gtcattctgacctcagaaca

SEQ ID NO: 6584 - DNA, 20 bp, Artificial Sequence
  chemically synthesized
tcattctgacctcagaacat

SEQ ID NO: 6585 - DNA, 20 bp, Artificial Sequence
  chemically synthesized
attctgacctcagaacatag

SEQ ID NO: 6586 - DNA, 20 bp, Artificial Sequence
  chemically synthesized
tctgacctcagaacatagga

SEQ ID NO: 6587 - DNA, 20 bp, Artificial Sequence
  chemically synthesized
acctcagaacataggagaga

SEQ ID NO: 6588 - DNA, 20 bp, Artificial Sequence
  chemically synthesized
gagatggatattgtacacca

SEQ ID NO: 6589 - DNA, 20 bp, Artificial Sequence
  chemically synthesized
gatggatattgtacaccaca

SEQ ID NO: 6590 - DNA, 20 bp, Artificial Sequence
  chemically synthesized
atattgtacaccacagagtc

SEQ ID NO: 6591 - DNA, 20 bp, Artificial Sequence
  chemically synthesized
tattgtacaccacagagtcc

SEQ ID NO: 6592 - DNA, 20 bp, Artificial Sequence
  chemically synthesized
accacagagtccaggatgac

SEQ ID NO: 6593 - DNA, 20 bp, Artificial Sequence
  chemically synthesized
acagagtccaggatgactag

SEQ ID NO: 6594 - DNA, 20 bp, Artificial Sequence
  chemically synthesized
gtccaggatgactagcagtg

SEQ ID NO: 6595 - DNA, 20 bp, Artificial Sequence
  chemically synthesized
tccaggatgactagcagtga

SEQ ID NO: 6596 - DNA, 20 bp, Artificial Sequence
  chemically synthesized
cagtgaaggattcaaatgcc

SEQ ID NO: 6597 - DNA, 20 bp, Artificial Sequence
  chemically synthesized
ggcgaaatctcctatacaac

SEQ ID NO: 6598 - DNA, 20 bp, Artificial Sequence
  chemically synthesized
cgaaatctcctatacaaccg

SEQ ID NO: 6599 - DNA, 20 bp, Artificial Sequence
  chemically synthesized
aaatctcctatacaaccgga

SEQ ID NO: 6600 - DNA, 20 bp, Artificial Sequence
  chemically synthesized
ctatacaaccggagagaccc

SEQ ID NO: 6601 - DNA, 20 bp, Artificial Sequence
  chemically synthesized
cggagagacccaagtcccca

SEQ ID NO: 6602 - DNA, 20 bp, Artificial Sequence
  chemically synthesized
agacccaagtccccaaagac

SEQ ID NO: 6603 - DNA, 20 bp, Artificial Sequence
  chemically synthesized
cccaagtccccaaagacaag

SEQ ID NO: 6604 - DNA, 20 bp, Artificial Sequence
  chemically synthesized
ccaagtccccaaagacaaga

SEQ ID NO: 6605 - DNA, 20 bp, Artificial Sequence
  chemically synthesized
caagtccccaaagacaagaa

SEQ ID NO: 6606 - DNA, 20 bp, Artificial Sequence
  chemically synthesized
gacaagaagggatgatgaaa

SEQ ID NO: 6607 - DNA, 20 bp, Artificial Sequence
  chemically synthesized
gcatgacatgacttgcctat

SEQ ID NO: 6608 - DNA, 20 bp, Artificial Sequence
  chemically synthesized
atgagccctcccattgctat

SEQ ID NO: 6609 - DNA, 20 bp, Artificial Sequence
  chemically synthesized
tgagccctcccattgctata

SEQ ID NO: 6610 - DNA, 20 bp, Artificial Sequence
  chemically synthesized
ccctcccattgctataagga

SEQ ID NO: 6611 - DNA, 20 bp, Artificial Sequence
  chemically synthesized
cctcccattgctataaggat

SEQ ID NO: 6612 - DNA, 20 bp, Artificial Sequence
  chemically synthesized
ctcccattgctataaggatg

SEQ ID NO: 6613 - DNA, 20 bp, Artificial Sequence
  chemically synthesized
tgctataaggatggggatct

SEQ ID NO: 6614 - DNA, 20 bp, Artificial Sequence
  chemically synthesized
taaggatggggatcttagca

SEQ ID NO: 6615 - DNA, 20 bp, Artificial Sequence
  chemically synthesized
agcacagtgccttgtgtgaa

SEQ ID NO: 6616 - DNA, 20 bp, Artificial Sequence
  chemically synthesized
ccttgtgtgaacagtaatgc

SEQ ID NO: 6617 - DNA, 20 bp, Artificial Sequence
  chemically synthesized
tgctagccttgattttacca

SEQ ID NO: 6618 - DNA, 20 bp, Artificial Sequence
  chemically synthesized
agccttgattttaccatggc

SEQ ID NO: 6619 - DNA, 20 bp, Artificial Sequence
  chemically synthesized
tttaccatggcaagtttgtt

SEQ ID NO: 6620 - DNA, 20 bp, Artificial Sequence
  chemically synthesized
ttaccatggcaagtttgttt

SEQ ID NO: 6621 - DNA, 20 bp, Artificial Sequence
  chemically synthesized
taccatggcaagtttgttta

SEQ ID NO: 6622 - DNA, 20 bp, Artificial Sequence
  chemically synthesized
aattccaacctcaaccaaat

SEQ ID NO: 6623 - DNA, 20 bp, Artificial Sequence
  chemically synthesized
attccaacctcaaccaaatg

SEQ ID NO: 6624 - DNA, 20 bp, Artificial Sequence
  chemically synthesized
ttccaacctcaaccaaatga

SEQ ID NO: 6625 - DNA, 20 bp, Artificial Sequence
  chemically synthesized
aacctcaaccaaatgaggga

SEQ ID NO: 6626 - DNA, 20 bp, Artificial Sequence
  chemically synthesized
tcaaccaaatgagggatggc

SEQ ID NO: 6627 - DNA, 20 bp, Artificial Sequence
  chemically synthesized
caaccaaatgagggatggct

SEQ ID NO: 6628 - DNA, 20 bp, Artificial Sequence
  chemically synthesized
aaccaaatgagggatggctg

SEQ ID NO: 6629 - DNA, 20 bp, Artificial Sequence
  chemically synthesized
tggctggggatgcaaccaca

SEQ ID NO: 6630 - DNA, 20 bp, Artificial Sequence
  chemically synthesized
accacaaagatactgtatct

SEQ ID NO: 6631 - DNA, 20 bp, Artificial Sequence
  chemically synthesized
ccacaaagatactgtatctt

SEQ ID NO: 6632 - DNA, 20 bp, Artificial Sequence
  chemically synthesized
acaaagatactgtatcttag

SEQ ID NO: 6633 - DNA, 20 bp, Artificial Sequence
  chemically synthesized
caaagatactgtatcttagg

SEQ ID NO: 6634 - DNA, 20 bp, Artificial Sequence
  chemically synthesized
aaagatactgtatcttagga

SEQ ID NO: 6635 - DNA, 20 bp, Artificial Sequence
  chemically synthesized
aagatactgtatcttaggag

SEQ ID NO: 6636 - DNA, 20 bp, Artificial Sequence
  chemically synthesized
gatactgtatcttaggaggg

SEQ ID NO: 6637 - DNA, 20 bp, Artificial Sequence
  chemically synthesized
aggggagtttttttttttta

SEQ ID NO: 6638 - DNA, 20 bp, Artificial Sequence
  chemically synthesized
ttttttttatagaaactcgt

SEQ ID NO: 6639 - DNA, 20 bp, Artificial Sequence
  chemically synthesized
tttttttatagaaactcgtc

SEQ ID NO: 6640 - DNA, 20 bp, Artificial Sequence
  chemically synthesized
actcgtcaggatattattgc

SEQ ID NO: 6641 - DNA, 20 bp, Artificial Sequence
  chemically synthesized
ctcgtcaggatattattgct

SEQ ID NO: 6642 - DNA, 20 bp, Artificial Sequence
  chemically synthesized
ttgctaggatgtgttgttac

SEQ ID NO: 6643 - DNA, 20 bp, Artificial Sequence
  chemically synthesized
tgctaggatgtgttgttact

SEQ ID NO: 6644 - DNA, 20 bp, Artificial Sequence
  chemically synthesized
atgtgttgttactgggaaaa

SEQ ID NO: 6645 - DNA, 20 bp, Artificial Sequence
  chemically synthesized
gttactgggaaaaaagctga

SEQ ID NO: 6646 - DNA, 20 bp, Artificial Sequence
  chemically synthesized
aaaaagctgatggaatacaa

SEQ ID NO: 6647 - DNA, 20 bp, Artificial Sequence
  chemically synthesized
aaagctgatggaatacaaaa

SEQ ID NO: 6648 - DNA, 20 bp, Artificial Sequence
  chemically synthesized
gctgatggaatacaaaagag

SEQ ID NO: 6649 - DNA, 20 bp, Artificial Sequence
  chemically synthesized
caaaagagtagacatcccca

SEQ ID NO: 6650 - DNA, 20 bp, Artificial Sequence
  chemically synthesized
aaaagagtagacatccccac

SEQ ID NO: 6651 - DNA, 20 bp, Artificial Sequence
  chemically synthesized
aaagagtagacatccccaca

SEQ ID NO: 6652 - DNA, 20 bp, Artificial Sequence
  chemically synthesized
catccccacagggattattt

SEQ ID NO: 6653 - DNA, 20 bp, Artificial Sequence
  chemically synthesized
atccccacagggattatttg

SEQ ID NO: 6654 - DNA, 20 bp, Artificial Sequence
  chemically synthesized
cagggattatttgaggcaat

SEQ ID NO: 6655 - DNA, 20 bp, Artificial Sequence
  chemically synthesized
accactttgctttctctatg

SEQ ID NO: 6656 - DNA, 20 bp, Artificial Sequence
  chemically synthesized
ccactttgctttctctatgc

SEQ ID NO: 6657 - DNA, 20 bp, Artificial Sequence
  chemically synthesized
aggtgtcatctattgtgata

SEQ ID NO: 6658 - DNA, 20 bp, Artificial Sequence
  chemically synthesized
catctattgtgatatagtgc

SEQ ID NO: 6659 - DNA, 20 bp, Artificial Sequence
  chemically synthesized
atctattgtgatatagtgcc

SEQ ID NO: 6660 - DNA, 20 bp, Artificial Sequence
  chemically synthesized
ctattgtgatatagtgccag

SEQ ID NO: 6661 - DNA, 20 bp, Artificial Sequence
  chemically synthesized
tattgtgatatagtgccagg

SEQ ID NO: 6662 - DNA, 20 bp, Artificial Sequence
  chemically synthesized
ccaggaggttgcctttgctg

SEQ ID NO: 6663 - DNA, 20 bp, Artificial Sequence
  chemically synthesized
tttgctgtggctttcgaccc

SEQ ID NO: 6664 - DNA, 20 bp, Artificial Sequence
  chemically synthesized
aataaaatgtccgtgtttat

SEQ ID NO: 6665 - DNA, 20 bp, Artificial Sequence
  chemically synthesized
attgttatattgtgaaattg

SEQ ID NO: 6666 - DNA, 20 bp, Artificial Sequence
  chemically synthesized
gttatattgtgaaattgtag

SEQ ID NO: 6667 - DNA, 20 bp, Artificial Sequence
  chemically synthesized
gatctaaaattgtaatttct

SEQ ID NO: 6668 - DNA, 20 bp, Artificial Sequence
  chemically synthesized
attgtaatttcttggattcc

SEQ ID NO: 6669 - DNA, 20 bp, Artificial Sequence
  chemically synthesized
tcctagaatttctaaatctg

SEQ ID NO: 6670 - DNA, 20 bp, Artificial Sequence
  chemically synthesized
tttctaaatctgtggatttt

SEQ ID NO: 6671 - DNA, 20 bp, Artificial Sequence
  chemically synthesized
tgtggatttttagaattctc

SEQ ID NO: 6672 - DNA, 20 bp, Artificial Sequence
  chemically synthesized
tggatttttagaattctcta

SEQ ID NO: 6673 - DNA, 20 bp, Artificial Sequence
  chemically synthesized
ggatttttagaattctctag

SEQ ID NO: 6674 - DNA, 20 bp, Artificial Sequence
  chemically synthesized
agaattctctagaggtgaca

SEQ ID NO: 6675 - DNA, 20 bp, Artificial Sequence
  chemically synthesized
gaattctctagaggtgacaa

SEQ ID NO: 6676 - DNA, 20 bp, Artificial Sequence
  chemically synthesized
gtgacaaaggtttattatct

SEQ ID NO: 6677 - DNA, 20 bp, Artificial Sequence
  chemically synthesized
aggtttattatctaagctac

SEQ ID NO: 6678 - DNA, 20 bp, Artificial Sequence
  chemically synthesized
gtttattatctaagctaccg

SEQ ID NO: 6679 - DNA, 20 bp, Artificial Sequence
  chemically synthesized
ctaccggagctatgtacttt

SEQ ID NO: 6680 - DNA, 20 bp, Artificial Sequence
  chemically synthesized
agctatgtacttttggatat

SEQ ID NO: 6681 - DNA, 20 bp, Artificial Sequence
  chemically synthesized
ctatgtacttttggatataa

SEQ ID NO: 6682 - DNA, 20 bp, Artificial Sequence
  chemically synthesized
atctccattgccttacaaat

SEQ ID NO: 6683 - DNA, 20 bp, Artificial Sequence
  chemically synthesized
tctccattgccttacaaatc

SEQ ID NO: 6684 - DNA, 20 bp, Artificial Sequence
  chemically synthesized
ttgccttacaaatcaggtgt

SEQ ID NO: 6685 - DNA, 20 bp, Artificial Sequence
  chemically synthesized
cttacaaatcaggtgtgagc

SEQ ID NO: 6686 - DNA, 20 bp, Artificial Sequence
  chemically synthesized
ttacaaatcaggtgtgagcc

SEQ ID NO: 6687 - DNA, 20 bp, Artificial Sequence
  chemically synthesized
tgtgagccaggcatgtctct

SEQ ID NO: 6688 - DNA, 20 bp, Artificial Sequence
  chemically synthesized
gccaggcatgtctctcagac

SEQ ID NO: 6689 - DNA, 20 bp, Artificial Sequence
  chemically synthesized
gcatgtctctcagactggaa

SEQ ID NO: 6690 - DNA, 20 bp, Artificial Sequence
  chemically synthesized
catgtctctcagactggaaa

SEQ ID NO: 6691 - DNA, 20 bp, Artificial Sequence
  chemically synthesized
gactggaaaaggtaactaat

SEQ ID NO: 6692 - DNA, 20 bp, Artificial Sequence
  chemically synthesized
tggaaaaggtaactaatcag

SEQ ID NO: 6693 - DNA, 20 bp, Artificial Sequence
  chemically synthesized
ggaaaaggtaactaatcaga

SEQ ID NO: 6694 - DNA, 20 bp, Artificial Sequence
  chemically synthesized
atcagaaggaaccattgtcc

SEQ ID NO: 6695 - DNA, 20 bp, Artificial Sequence
  chemically synthesized
aaggaaccattgtcctagaa

SEQ ID NO: 6696 - DNA, 20 bp, Artificial Sequence
  chemically synthesized
aggaaccattgtcctagaat

SEQ ID NO: 6697 - DNA, 20 bp, Artificial Sequence
  chemically synthesized
ggaaccattgtcctagaatg

SEQ ID NO: 6698 - DNA, 20 bp, Artificial Sequence
  chemically synthesized
ccattgtcctagaatggggc

SEQ ID NO: 6699 - DNA, 20 bp, Artificial Sequence
  chemically synthesized
tggggcaagtgtacaatacc

SEQ ID NO: 6700 - DNA, 20 bp, Artificial Sequence
  chemically synthesized
gcaagtgtacaatacccaga

SEQ ID NO: 6701 - DNA, 20 bp, Artificial Sequence
  chemically synthesized
acaatacccagaaagaccac

SEQ ID NO: 6702 - DNA, 20 bp, Artificial Sequence
  chemically synthesized
cagaaagaccactggtgccg

SEQ ID NO: 6703 - DNA, 20 bp, Artificial Sequence
  chemically synthesized
tatttattttatttatttat

SEQ ID NO: 6704 - DNA, 20 bp, Artificial Sequence
  chemically synthesized
tttattttatttatttatta

SEQ ID NO: 6705 - DNA, 20 bp, Artificial Sequence
  chemically synthesized
tatttatttattagagatca

SEQ ID NO: 6706 - DNA, 20 bp, Artificial Sequence
  chemically synthesized
gtgtgtgcaacacctatgtc

SEQ ID NO: 6707 - DNA, 20 bp, Artificial Sequence
  chemically synthesized
tgtgtgcaacacctatgtcc

SEQ ID NO: 6708 - DNA, 20 bp, Artificial Sequence
  chemically synthesized
acacctatgtccaggttctg

SEQ ID NO: 6709 - DNA, 20 bp, Artificial Sequence
  chemically synthesized
ccaggttctgtggtaaacgt

SEQ ID NO: 6710 - DNA, 20 bp, Artificial Sequence
  chemically synthesized
ttctgtggtaaacgtcagcg

SEQ ID NO: 6711 - DNA, 20 bp, Artificial Sequence
  chemically synthesized
ctgtggtaaacgtcagcgtg

SEQ ID NO: 6712 - DNA, 20 bp, Artificial Sequence
  chemically synthesized
aaacgtcagcgtggagaaat

SEQ ID NO: 6713 - DNA, 20 bp, Artificial Sequence
  chemically synthesized
cgtcagcgtggagaaattag

SEQ ID NO: 6714 - DNA, 20 bp, Artificial Sequence
  chemically synthesized
gtggagaaattagtagctat

SEQ ID NO: 6715 - DNA, 20 bp, Artificial Sequence
  chemically synthesized
agtagctattagatcataaa

SEQ ID NO: 6716 - DNA, 20 bp, Artificial Sequence
  chemically synthesized
gtagctattagatcataaaa

SEQ ID NO: 6717 - DNA, 20 bp, Artificial Sequence
  chemically synthesized
ctattagatcataaaaaggt

SEQ ID NO: 6718 - DNA, 20 bp, Artificial Sequence
  chemically synthesized
tattagatcataaaaaggtg

SEQ ID NO: 6719 - DNA, 20 bp, Artificial Sequence
  chemically synthesized
gcataatcatatttgtcttt

SEQ ID NO: 6720 - DNA, 20 bp, Artificial Sequence
  chemically synthesized
taatcatatttgtctttgag

SEQ ID NO: 6721 - DNA, 20 bp, Artificial Sequence
  chemically synthesized
tgtctttgagaagctgactg

SEQ ID NO: 6722 - DNA, 20 bp, Artificial Sequence
  chemically synthesized
tgagaagctgactgtggcta

SEQ ID NO: 6723 - DNA, 20 bp, Artificial Sequence
  chemically synthesized
gagaagctgactgtggctat

SEQ ID NO: 6724 - DNA, 20 bp, Artificial Sequence
  chemically synthesized
gctgactgtggctataggtg

SEQ ID NO: 6725 - DNA, 20 bp, Artificial Sequence
  chemically synthesized
gaagaaaaaaattataattt

SEQ ID NO: 6726 - DNA, 20 bp, Artificial Sequence
  chemically synthesized
accatgatcatcatgataaa

SEQ ID NO: 6727 - DNA, 20 bp, Artificial Sequence
  chemically synthesized
gataaaaagttaatatttac

SEQ ID NO: 6728 - DNA, 20 bp, Artificial Sequence
  chemically synthesized
ataaaaagttaatatttact

SEQ ID NO: 6729 - DNA, 20 bp, Artificial Sequence
  chemically synthesized
atatttactgggaacttatt

SEQ ID NO: 6730 - DNA, 20 bp, Artificial Sequence
  chemically synthesized
atttggtttgtcatttttcg

SEQ ID NO: 6731 - DNA, 20 bp, Artificial Sequence
  chemically synthesized
tttggtttgtcatttttcga

SEQ ID NO: 6732 - DNA, 20 bp, Artificial Sequence
  chemically synthesized
tatgttaatttactcactat

SEQ ID NO: 6733 - DNA, 20 bp, Artificial Sequence
  chemically synthesized
ctcactataagaaatttata

SEQ ID NO: 6734 - DNA, 20 bp, Artificial Sequence
  chemically synthesized
actataagaaatttataaag

SEQ ID NO: 6735 - DNA, 20 bp, Artificial Sequence
  chemically synthesized
ttataaagtagattccatta

SEQ ID NO: 6736 - DNA, 20 bp, Artificial Sequence
  chemically synthesized
atagctcttaatttattatt

SEQ ID NO: 6737 - DNA, 20 bp, Artificial Sequence
  chemically synthesized
tagctcttaatttattattg

SEQ ID NO: 6738 - DNA, 20 bp, Artificial Sequence
  chemically synthesized
aatttattattgaggaatgt

SEQ ID NO: 6739 - DNA, 20 bp, Artificial Sequence
  chemically synthesized
atttattattgaggaatgta

SEQ ID NO: 6740 - DNA, 20 bp, Artificial Sequence
  chemically synthesized
ttattgaggaatgtaaggca

SEQ ID NO: 6741 - DNA, 20 bp, Artificial Sequence
  chemically synthesized
attgaggaatgtaaggcata

SEQ ID NO: 6742 - DNA, 20 bp, Artificial Sequence
  chemically synthesized
gaggaatgtaaggcatagag

SEQ ID NO: 6743 - DNA, 20 bp, Artificial Sequence
  chemically synthesized
agtaacttatcctcaaaaca

SEQ ID NO: 6744 - DNA, 20 bp, Artificial Sequence
  chemically synthesized
aaaacaaagctattaactta

SEQ ID NO: 6745 - DNA, 20 bp, Artificial Sequence
  chemically synthesized
agctattaacttatggacct

SEQ ID NO: 6746 - DNA, 20 bp, Artificial Sequence
  chemically synthesized
ctattaacttatggacctga

SEQ ID NO: 6747 - DNA, 20 bp, Artificial Sequence
  chemically synthesized
ttaacttatggacctgagag

SEQ ID NO: 6748 - DNA, 20 bp, Artificial Sequence
  chemically synthesized
aacttatggacctgagagta

SEQ ID NO: 6749 - DNA, 20 bp, Artificial Sequence
  chemically synthesized
atggacctgagagtagagcc

SEQ ID NO: 6750 - DNA, 20 bp, Artificial Sequence
  chemically synthesized
tggacctgagagtagagccc

SEQ ID NO: 6751 - DNA, 20 bp, Artificial Sequence
  chemically synthesized
gagcccgggctgtctcatgc

SEQ ID NO: 6752 - DNA, 20 bp, Artificial Sequence
  chemically synthesized
aacctattatcccatgttgc

SEQ ID NO: 6753 - DNA, 20 bp, Artificial Sequence
  chemically synthesized
cccatgttgcaagacacaaa

SEQ ID NO: 6754 - DNA, 20 bp, Artificial Sequence
  chemically synthesized
ccatgttgcaagacacaaat

SEQ ID NO: 6755 - DNA, 20 bp, Artificial Sequence
  chemically synthesized
gcaagacacaaataggaaaa

SEQ ID NO: 6756 - DNA, 20 bp, Artificial Sequence
  chemically synthesized
cacaaataggaaaatagaac

SEQ ID NO: 6757 - DNA, 20 bp, Artificial Sequence
  chemically synthesized
aataggaaaatagaaccggt

SEQ ID NO: 6758 - DNA, 20 bp, Artificial Sequence
  chemically synthesized
aggaaaatagaaccggttag

SEQ ID NO: 6759 - DNA, 20 bp, Artificial Sequence
  chemically synthesized
gaaccggttagaagttattg

SEQ ID NO: 6760 - DNA, 20 bp, Artificial Sequence
  chemically synthesized
aaccggttagaagttattga

SEQ ID NO: 6761 - DNA, 20 bp, Artificial Sequence
  chemically synthesized
accggttagaagttattgaa

SEQ ID NO: 6762 - DNA, 20 bp, Artificial Sequence
  chemically synthesized
tattgaagggcatgaaataa

SEQ ID NO: 6763 - DNA, 20 bp, Artificial Sequence
  chemically synthesized
tgaagggcatgaaataatag

SEQ ID NO: 6764 - DNA, 20 bp, Artificial Sequence
  chemically synthesized
ataatagtggtttgaaattt

SEQ ID NO: 6765 - DNA, 20 bp, Artificial Sequence
  chemically synthesized
atagtggtttgaaatttgag

SEQ ID NO: 6766 - DNA, 20 bp, Artificial Sequence
  chemically synthesized
agtggtttgaaatttgagta

SEQ ID NO: 6767 - DNA, 20 bp, Artificial Sequence
  chemically synthesized
ggtttgaaatttgagtagag

SEQ ID NO: 6768 - DNA, 20 bp, Artificial Sequence
  chemically synthesized
gtttgaaatttgagtagagt

SEQ ID NO: 6769 - DNA, 20 bp, Artificial Sequence
  chemically synthesized
aatttgagtagagtaggacc

SEQ ID NO: 6770 - DNA, 20 bp, Artificial Sequence
  chemically synthesized
gaccaagaaaatgcatattt

SEQ ID NO: 6771 - DNA, 20 bp, Artificial Sequence
  chemically synthesized
accaagaaaatgcatatttc

SEQ ID NO: 6772 - DNA, 20 bp, Artificial Sequence
  chemically synthesized
ccaagaaaatgcatatttca

SEQ ID NO: 6773 - DNA, 20 bp, Artificial Sequence
  chemically synthesized
gcatatttcagggaatacct

SEQ ID NO: 6774 - DNA, 20 bp, Artificial Sequence
  chemically synthesized
atatttcagggaatacctga

SEQ ID NO: 6775 - DNA, 20 bp, Artificial Sequence
  chemically synthesized
tatttcagggaatacctgag

SEQ ID NO: 6776 - DNA, 20 bp, Artificial Sequence
  chemically synthesized
gaggaaaaaaaaaaactatg

SEQ ID NO: 6777 - DNA, 20 bp, Artificial Sequence
  chemically synthesized
aggaaaaaaaaaaactatga

SEQ ID NO: 6778 - DNA, 20 bp, Artificial Sequence
  chemically synthesized
aaaaaaactatgaaggaacg

SEQ ID NO: 6779 - DNA, 20 bp, Artificial Sequence
  chemically synthesized
ctatgaaggaacgcagtaat

SEQ ID NO: 6780 - DNA, 20 bp, Artificial Sequence
  chemically synthesized
gaacgcagtaattagctcct

SEQ ID NO: 6781 - DNA, 20 bp, Artificial Sequence
  chemically synthesized
gtaattagctccttagctga

SEQ ID NO: 6782 - DNA, 20 bp, Artificial Sequence
  chemically synthesized
tagctgaaagaatgatcttc

SEQ ID NO: 6783 - DNA, 20 bp, Artificial Sequence
  chemically synthesized
tgaaagaatgatcttctggt

SEQ ID NO: 6784 - DNA, 20 bp, Artificial Sequence
  chemically synthesized
agaatgatcttctggtcagt

SEQ ID NO: 6785 - DNA, 20 bp, Artificial Sequence
  chemically synthesized
atcttctggtcagtgagaac

SEQ ID NO: 6786 - DNA, 20 bp, Artificial Sequence
  chemically synthesized
tgagaactggtttcaaatct

SEQ ID NO: 6787 - DNA, 20 bp, Artificial Sequence
  chemically synthesized
atcttggttttgtcatttct

SEQ ID NO: 6788 - DNA, 20 bp, Artificial Sequence
  chemically synthesized
tcttggttttgtcatttctt

SEQ ID NO: 6789 - DNA, 20 bp, Artificial Sequence
  chemically synthesized
tttcttaggtatataatttt

SEQ ID NO: 6790 - DNA, 20 bp, Artificial Sequence
  chemically synthesized
ataatttttagctcaacact

SEQ ID NO: 6791 - DNA, 20 bp, Artificial Sequence
  chemically synthesized
acaatttttaaaaatattgt

SEQ ID NO: 6792 - DNA, 20 bp, Artificial Sequence
  chemically synthesized
atgatgataatatataaaaa

SEQ ID NO: 6793 - DNA, 20 bp, Artificial Sequence
  chemically synthesized
gctcattatctgccactcaa

SEQ ID NO: 6794 - DNA, 20 bp, Artificial Sequence
  chemically synthesized
atctgccactcaaaagctat

SEQ ID NO: 6795 - DNA, 20 bp, Artificial Sequence
  chemically synthesized
agtatttatgataataattc

SEQ ID NO: 6796 - DNA, 20 bp, Artificial Sequence
  chemically synthesized
atgataataattctagttgt

SEQ ID NO: 6797 - DNA, 20 bp, Artificial Sequence
  chemically synthesized
attgattattaaatatatat

SEQ ID NO: 6798 - DNA, 20 bp, Artificial Sequence
  chemically synthesized
ttgattattaaatatatata

SEQ ID NO: 6799 - DNA, 20 bp, Artificial Sequence
  chemically synthesized
tgattattaaatatatataa

SEQ ID NO: 6800 - DNA, 20 bp, Artificial Sequence
  chemically synthesized
tattaaatatatataaggga

SEQ ID NO: 6801 - DNA, 20 bp, Artificial Sequence
  chemically synthesized
taaatatatataagggatag

SEQ ID NO: 6802 - DNA, 20 bp, Artificial Sequence
  chemically synthesized
aatatatataagggatagaa

SEQ ID NO: 6803 - DNA, 20 bp, Artificial Sequence
  chemically synthesized
tatatataagggatagaaga

SEQ ID NO: 6804 - DNA, 20 bp, Artificial Sequence
  chemically synthesized
atataagggatagaagagag

SEQ ID NO: 6805 - DNA, 20 bp, Artificial Sequence
  chemically synthesized
ataagggatagaagagagtg

SEQ ID NO: 6806 - DNA, 20 bp, Artificial Sequence
  chemically synthesized
aagggatagaagagagtgga

SEQ ID NO: 6807 - DNA, 20 bp, Artificial Sequence
  chemically synthesized
atagaagagagtggagagta

SEQ ID NO: 6808 - DNA, 20 bp, Artificial Sequence
  chemically synthesized
tagaagagagtggagagtaa

SEQ ID NO: 6809 - DNA, 20 bp, Artificial Sequence
  chemically synthesized
tgattgacaaaattttgtct

SEQ ID NO: 6810 - DNA, 20 bp, Artificial Sequence
  chemically synthesized
aaattttgtcttggaaatct

SEQ ID NO: 6811 - DNA, 20 bp, Artificial Sequence
  chemically synthesized
atctgagtgaaccattcatc

SEQ ID NO: 6812 - DNA, 20 bp, Artificial Sequence
  chemically synthesized
agtgaaccattcatcaagtt

SEQ ID NO: 6813 - DNA, 20 bp, Artificial Sequence
  chemically synthesized
gaaccattcatcaagtttgg

SEQ ID NO: 6814 - DNA, 20 bp, Artificial Sequence
  chemically synthesized
ttcatcaagtttggaagcat

SEQ ID NO: 6815 - DNA, 20 bp, Artificial Sequence
  chemically synthesized
catcaagtttggaagcatta

SEQ ID NO: 6816 - DNA, 20 bp, Artificial Sequence
  chemically synthesized
atcaagtttggaagcattag

SEQ ID NO: 6817 - DNA, 20 bp, Artificial Sequence
  chemically synthesized
gaagcattagaggaaactga

SEQ ID NO: 6818 - DNA, 20 bp, Artificial Sequence
  chemically synthesized
gcattagaggaaactgaaag

SEQ ID NO: 6819 - DNA, 20 bp, Artificial Sequence
  chemically synthesized
ttagaggaaactgaaagaag

SEQ ID NO: 6820 - DNA, 20 bp, Artificial Sequence
  chemically synthesized
agaggaaactgaaagaagtg

SEQ ID NO: 6821 - DNA, 20 bp, Artificial Sequence
  chemically synthesized
gaggaaactgaaagaagtgg

SEQ ID NO: 6822 - DNA, 20 bp, Artificial Sequence
  chemically synthesized
tactatcttttcaactcgct

SEQ ID NO: 6823 - DNA, 20 bp, Artificial Sequence
  chemically synthesized
cttttcaactcgctgagttt

SEQ ID NO: 6824 - DNA, 20 bp, Artificial Sequence
  chemically synthesized
tttcaactcgctgagtttaa

SEQ ID NO: 6825 - DNA, 20 bp, Artificial Sequence
  chemically synthesized
ttcaactcgctgagtttaag

SEQ ID NO: 6826 - DNA, 20 bp, Artificial Sequence
  chemically synthesized
cgctgagtttaagaggtcca

SEQ ID NO: 6827 - DNA, 20 bp, Artificial Sequence
  chemically synthesized
gctgagtttaagaggtccat

SEQ ID NO: 6828 - DNA, 20 bp, Artificial Sequence
  chemically synthesized
aagaggtccataggtcatat

SEQ ID NO: 6829 - DNA, 20 bp, Artificial Sequence
  chemically synthesized
aggtccataggtcatataag

SEQ ID NO: 6830 - DNA, 20 bp, Artificial Sequence
  chemically synthesized
gtccataggtcatataagtg

SEQ ID NO: 6831 - DNA, 20 bp, Artificial Sequence
  chemically synthesized
tccataggtcatataagtgg

SEQ ID NO: 6832 - DNA, 20 bp, Artificial Sequence
  chemically synthesized
tataagtggaggtgacctgt

SEQ ID NO: 6833 - DNA, 20 bp, Artificial Sequence
  chemically synthesized
aaatgttaatgtatccctaa

SEQ ID NO: 6834 - DNA, 20 bp, Artificial Sequence
  chemically synthesized
atgttaatgtatccctaaca

SEQ ID NO: 6835 - DNA, 20 bp, Artificial Sequence
  chemically synthesized
gttaatgtatccctaacaga

SEQ ID NO: 6836 - DNA, 20 bp, Artificial Sequence
  chemically synthesized
atccctaacagagagcaatg

SEQ ID NO: 6837 - DNA, 20 bp, Artificial Sequence
  chemically synthesized
gagagcaatgaagttctttt

SEQ ID NO: 6838 - DNA, 20 bp, Artificial Sequence
  chemically synthesized
agcaatgaagttctttttag

SEQ ID NO: 6839 - DNA, 20 bp, Artificial Sequence
  chemically synthesized
caatgaagttctttttagtg

SEQ ID NO: 6840 - DNA, 20 bp, Artificial Sequence
  chemically synthesized
ggagtttctctttcttgaca

SEQ ID NO: 6841 - DNA, 20 bp, Artificial Sequence
  chemically synthesized
tttcttgacatagtaccatg

SEQ ID NO: 6842 - DNA, 20 bp, Artificial Sequence
  chemically synthesized
tgacatagtaccatgtagtg

SEQ ID NO: 6843 - DNA, 20 bp, Artificial Sequence
  chemically synthesized
agtgaagacactgctgactt

SEQ ID NO: 6844 - DNA, 20 bp, Artificial Sequence
  chemically synthesized
actgctgactttggaattga

SEQ ID NO: 6845 - DNA, 20 bp, Artificial Sequence
  chemically synthesized
ctttggaattgaaagaatct

SEQ ID NO: 6846 - DNA, 20 bp, Artificial Sequence
  chemically synthesized
gaattgaaagaatcttagct

SEQ ID NO: 6847 - DNA, 20 bp, Artificial Sequence
  chemically synthesized
atcttagctcagctacttac

SEQ ID NO: 6848 - DNA, 20 bp, Artificial Sequence
  chemically synthesized
agctcagctacttactagct

SEQ ID NO: 6849 - DNA, 20 bp, Artificial Sequence
  chemically synthesized
tcagctacttactagctgag

SEQ ID NO: 6850 - DNA, 20 bp, Artificial Sequence
  chemically synthesized
aacaccttaatgcccatccc

SEQ ID NO: 6851 - DNA, 20 bp, Artificial Sequence
  chemically synthesized
ccttaatgcccatcccaaga

SEQ ID NO: 6852 - DNA, 20 bp, Artificial Sequence
  chemically synthesized
tcccaagacagtgtgtgtaa

SEQ ID NO: 6853 - DNA, 20 bp, Artificial Sequence
  chemically synthesized
aaagacgaataacaacatct

SEQ ID NO: 6854 - DNA, 20 bp, Artificial Sequence
  chemically synthesized
aagacgaataacaacatctc

SEQ ID NO: 6855 - DNA, 20 bp, Artificial Sequence
  chemically synthesized
acgaataacaacatctcagg

SEQ ID NO: 6856 - DNA, 20 bp, Artificial Sequence
  chemically synthesized
taacaacatctcaggaagca

SEQ ID NO: 6857 - DNA, 20 bp, Artificial Sequence
  chemically synthesized
aacaacatctcaggaagcac

SEQ ID NO: 6858 - DNA, 20 bp, Artificial Sequence
  chemically synthesized
tcaggaagcacaggatgtac

SEQ ID NO: 6859 - DNA, 20 bp, Artificial Sequence
  chemically synthesized
aggaagcacaggatgtacca

SEQ ID NO: 6860 - DNA, 20 bp, Artificial Sequence
  chemically synthesized
gaagcacaggatgtaccaga

SEQ ID NO: 6861 - DNA, 20 bp, Artificial Sequence
  chemically synthesized
atcttttcatgttgctttcc

SEQ ID NO: 6862 - DNA, 20 bp, Artificial Sequence
  chemically synthesized
tcttttcatgttgctttcct

SEQ ID NO: 6863 - DNA, 20 bp, Artificial Sequence
  chemically synthesized
ggctttttatttccctcctc

SEQ ID NO: 6864 - DNA, 20 bp, Artificial Sequence
  chemically synthesized
gctttttatttccctcctct

SEQ ID NO: 6865 - DNA, 20 bp, Artificial Sequence
  chemically synthesized
attatttcttccctcttctt

SEQ ID NO: 6866 - DNA, 20 bp, Artificial Sequence
  chemically synthesized
ttatttcttccctcttcttc

SEQ ID NO: 6867 - DNA, 20 bp, Artificial Sequence
  chemically synthesized
tttcttccctcttcttcagg

SEQ ID NO: 6868 - DNA, 20 bp, Artificial Sequence
  chemically synthesized
tccctcttcttcaggaagtt

SEQ ID NO: 6869 - DNA, 20 bp, Artificial Sequence
  chemically synthesized
tcttcttcaggaagttaaga

SEQ ID NO: 6870 - DNA, 20 bp, Artificial Sequence
  chemically synthesized
ggaagttaagacagtctacc

SEQ ID NO: 6871 - DNA, 20 bp, Artificial Sequence
  chemically synthesized
taagacagtctacctagatt

SEQ ID NO: 6872 - DNA, 20 bp, Artificial Sequence
  chemically synthesized
gacagtctacctagatttag

SEQ ID NO: 6873 - DNA, 20 bp, Artificial Sequence
  chemically synthesized
tttagaagcaaatgtttata

SEQ ID NO: 6874 - DNA, 20 bp, Artificial Sequence
  chemically synthesized
agaagcaaatgtttatatag

SEQ ID NO: 6875 - DNA, 20 bp, Artificial Sequence
  chemically synthesized
ttatatagtggtgaaattta

SEQ ID NO: 6876 - DNA, 20 bp, Artificial Sequence
  chemically synthesized
atttaaagcctaattgacta

SEQ ID NO: 6877 - DNA, 20 bp, Artificial Sequence
  chemically synthesized
ctaattgactaaagccattt

SEQ ID NO: 6878 - DNA, 20 bp, Artificial Sequence
  chemically synthesized
catttaagaatgtaatatct

SEQ ID NO: 6879 - DNA, 20 bp, Artificial Sequence
  chemically synthesized
taagaatgtaatatctcagt

SEQ ID NO: 6880 - DNA, 20 bp, Artificial Sequence
  chemically synthesized
tatgcacttcttgaaatgca

SEQ ID NO: 6881 - DNA, 20 bp, Artificial Sequence
  chemically synthesized
cttcttgaaatgcaaagaaa

SEQ ID NO: 6882 - DNA, 20 bp, Artificial Sequence
  chemically synthesized
tctgacttttttccattgtt

SEQ ID NO: 6883 - DNA, 20 bp, Artificial Sequence
  chemically synthesized
cattgtttagtttctaaatt

SEQ ID NO: 6884 - DNA, 20 bp, Artificial Sequence
  chemically synthesized
agtttttattttaatatttt

SEQ ID NO: 6885 - DNA, 20 bp, Artificial Sequence
  chemically synthesized
ttattttaatattttaagta

SEQ ID NO: 6886 - DNA, 20 bp, Artificial Sequence
  chemically synthesized
agtacagcatgcatatataa

SEQ ID NO: 6887 - DNA, 20 bp, Artificial Sequence
  chemically synthesized
gtacacaaattatacatgca

SEQ ID NO: 6888 - DNA, 20 bp, Artificial Sequence
  chemically synthesized
tgcacagctgaattaacttt

SEQ ID NO: 6889 - DNA, 20 bp, Artificial Sequence
  chemically synthesized
acagctgaattaacttttgg

SEQ ID NO: 6890 - DNA, 20 bp, Artificial Sequence
  chemically synthesized
cagctgaattaacttttgga

SEQ ID NO: 6891 - DNA, 20 bp, Artificial Sequence
  chemically synthesized
acacccatgtaacaactaat

SEQ ID NO: 6892 - DNA, 20 bp, Artificial Sequence
  chemically synthesized
ccatgtaacaactaataaga

SEQ ID NO: 6893 - DNA, 20 bp, Artificial Sequence
  chemically synthesized
catgtaacaactaataagat

SEQ ID NO: 6894 - DNA, 20 bp, Artificial Sequence
  chemically synthesized
actaataagataggaaatta

SEQ ID NO: 6895 - DNA, 20 bp, Artificial Sequence
  chemically synthesized
taataagataggaaattaaa

SEQ ID NO: 6896 - DNA, 20 bp, Artificial Sequence
  chemically synthesized
cattccactaattgtctcca

SEQ ID NO: 6897 - DNA, 20 bp, Artificial Sequence
  chemically synthesized
actcatgtccctttttttaa

SEQ ID NO: 6898 - DNA, 20 bp, Artificial Sequence
  chemically synthesized
tttgtgaattgcattcatac

SEQ ID NO: 6899 - DNA, 20 bp, Artificial Sequence
  chemically synthesized
ttcatactagtgtatgactg

SEQ ID NO: 6900 - DNA, 20 bp, Artificial Sequence
  chemically synthesized
caatatatttattgactcca

SEQ ID NO: 6901 - DNA, 20 bp, Artificial Sequence
  chemically synthesized
tttattgactccacagttga

SEQ ID NO: 6902 - DNA, 20 bp, Artificial Sequence
  chemically synthesized
tccacagttgatagatattt

SEQ ID NO: 6903 - DNA, 20 bp, Artificial Sequence
  chemically synthesized
atagatatttgagtaccttc

SEQ ID NO: 6904 - DNA, 20 bp, Artificial Sequence
  chemically synthesized
tttgagtaccttctagcttt

SEQ ID NO: 6905 - DNA, 20 bp, Artificial Sequence
  chemically synthesized
taatataaattgctgctatg

SEQ ID NO: 6906 - DNA, 20 bp, Artificial Sequence
  chemically synthesized
atatatattctgtaaattgc

SEQ ID NO: 6907 - DNA, 20 bp, Artificial Sequence
  chemically synthesized
tatatattctgtaaattgct

SEQ ID NO: 6908 - DNA, 20 bp, Artificial Sequence
  chemically synthesized
cactataatttaatgtcatt

SEQ ID NO: 6909 - DNA, 20 bp, Artificial Sequence
  chemically synthesized
ttggtcaacctataatatca

SEQ ID NO: 6910 - DNA, 20 bp, Artificial Sequence
  chemically synthesized
atcatagatgttttctctta

SEQ ID NO: 6911 - DNA, 20 bp, Artificial Sequence
  chemically synthesized
atagatgttttctcttatag

SEQ ID NO: 6912 - DNA, 20 bp, Artificial Sequence
  chemically synthesized
tatagcagcctgcatgtgcc

SEQ ID NO: 6913 - DNA, 20 bp, Artificial Sequence
  chemically synthesized
atcctttgtatatttacatt

SEQ ID NO: 6914 - DNA, 20 bp, Artificial Sequence
  chemically synthesized
tagttctgtattattacaat

SEQ ID NO: 6915 - DNA, 20 bp, Artificial Sequence
  chemically synthesized
gtattattacaattagttcg

SEQ ID NO: 6916 - DNA, 20 bp, Artificial Sequence
  chemically synthesized
gttattattattctcatttg

SEQ ID NO: 6917 - DNA, 20 bp, Artificial Sequence
  chemically synthesized
attattctcatttgtagttg

SEQ ID NO: 6918 - DNA, 20 bp, Artificial Sequence
  chemically synthesized
tagttgaagaaattgcactc

SEQ ID NO: 6919 - DNA, 20 bp, Artificial Sequence
  chemically synthesized
tgaagaaattgcactccagc

SEQ ID NO: 6920 - DNA, 20 bp, Artificial Sequence
  chemically synthesized
cagcaagtttaaattgctcc

SEQ ID NO: 6921 - DNA, 20 bp, Artificial Sequence
  chemically synthesized
aattgctcctggctacatcc

SEQ ID NO: 6922 - DNA, 20 bp, Artificial Sequence
  chemically synthesized
actttttgcccctacttgac

SEQ ID NO: 6923 - DNA, 20 bp, Artificial Sequence
  chemically synthesized
ctttttgcccctacttgact

SEQ ID NO: 6924 - DNA, 20 bp, Artificial Sequence
  chemically synthesized
acttgactaggaattgtata

SEQ ID NO: 6925 - DNA, 20 bp, Artificial Sequence
  chemically synthesized
ttgactaggaattgtataaa

SEQ ID NO: 6926 - DNA, 20 bp, Artificial Sequence
  chemically synthesized
taggaattgtataaagagaa

SEQ ID NO: 6927 - DNA, 20 bp, Artificial Sequence
  chemically synthesized
aaagagaacagttattcttc

SEQ ID NO: 6928 - DNA, 20 bp, Artificial Sequence
  chemically synthesized
gagaacagttattcttctag

SEQ ID NO: 6929 - DNA, 20 bp, Artificial Sequence
  chemically synthesized
agaacagttattcttctagt

SEQ ID NO: 6930 - DNA, 20 bp, Artificial Sequence
  chemically synthesized
acagttattcttctagtggg

SEQ ID NO: 6931 - DNA, 20 bp, Artificial Sequence
  chemically synthesized
ttattcttctagtgggaagc

SEQ ID NO: 6932 - DNA, 20 bp, Artificial Sequence
  chemically synthesized
tcttctagtgggaagcaagc

SEQ ID NO: 6933 - DNA, 20 bp, Artificial Sequence
  chemically synthesized
ggaagcaagctggcctcaac

SEQ ID NO: 6934 - DNA, 20 bp, Artificial Sequence
  chemically synthesized
caagctggcctcaactggaa

SEQ ID NO: 6935 - DNA, 20 bp, Artificial Sequence
  chemically synthesized
ggcctcaactggaacagaat

SEQ ID NO: 6936 - DNA, 20 bp, Artificial Sequence
  chemically synthesized
cctcaactggaacagaatga

SEQ ID NO: 6937 - DNA, 20 bp, Artificial Sequence
  chemically synthesized
gaacagaatgagagaaatgc

SEQ ID NO: 6938 - DNA, 20 bp, Artificial Sequence
  chemically synthesized
caagacatctaataatccaa

SEQ ID NO: 6939 - DNA, 20 bp, Artificial Sequence
  chemically synthesized
gtactttttccttttcccca

SEQ ID NO: 6940 - DNA, 20 bp, Artificial Sequence
  chemically synthesized
actttttccttttccccatg

SEQ ID NO: 6941 - DNA, 20 bp, Artificial Sequence
  chemically synthesized
ttccttttccccatggagtc

SEQ ID NO: 6942 - DNA, 20 bp, Artificial Sequence
  chemically synthesized
tccttttccccatggagtca

SEQ ID NO: 6943 - DNA, 20 bp, Artificial Sequence
  chemically synthesized
aggctatctaaacttccttt

SEQ ID NO: 6944 - DNA, 20 bp, Artificial Sequence
  chemically synthesized
taaacttcctttaagtgcac

SEQ ID NO: 6945 - DNA, 20 bp, Artificial Sequence
  chemically synthesized
tttaagtgcacaagctaata

SEQ ID NO: 6946 - DNA, 20 bp, Artificial Sequence
  chemically synthesized
aagtgcacaagctaatatgg

SEQ ID NO: 6947 - DNA, 20 bp, Artificial Sequence
  chemically synthesized
agtgcacaagctaatatggt

SEQ ID NO: 6948 - DNA, 20 bp, Artificial Sequence
  chemically synthesized
gtgcacaagctaatatggta

SEQ ID NO: 6949 - DNA, 20 bp, Artificial Sequence
  chemically synthesized
taatatggtagggaaatata

SEQ ID NO: 6950 - DNA, 20 bp, Artificial Sequence
  chemically synthesized
taaagcctaatcctgccatc

SEQ ID NO: 6951 - DNA, 20 bp, Artificial Sequence
  chemically synthesized
ctaatcctgccatccagaat

SEQ ID NO: 6952 - DNA, 20 bp, Artificial Sequence
  chemically synthesized
tcctgccatccagaatgagc

SEQ ID NO: 6953 - DNA, 20 bp, Artificial Sequence
  chemically synthesized
tgccatccagaatgagcaag

SEQ ID NO: 6954 - DNA, 20 bp, Artificial Sequence
  chemically synthesized
atccagaatgagcaagtgga

SEQ ID NO: 6955 - DNA, 20 bp, Artificial Sequence
  chemically synthesized
tccagaatgagcaagtggat

SEQ ID NO: 6956 - DNA, 20 bp, Artificial Sequence
  chemically synthesized
ccagaatgagcaagtggatg

SEQ ID NO: 6957 - DNA, 20 bp, Artificial Sequence
  chemically synthesized
atgagcaagtggatggggaa

SEQ ID NO: 6958 - DNA, 20 bp, Artificial Sequence
  chemically synthesized
tgagcaagtggatggggaaa

SEQ ID NO: 6959 - DNA, 20 bp, Artificial Sequence
  chemically synthesized
gagcaagtggatggggaaaa

SEQ ID NO: 6960 - DNA, 20 bp, Artificial Sequence
  chemically synthesized
caagtggatggggaaaaggg

SEQ ID NO: 6961 - DNA, 20 bp, Artificial Sequence
  chemically synthesized
aagtggatggggaaaaggga

SEQ ID NO: 6962 - DNA, 20 bp, Artificial Sequence
  chemically synthesized
agtggatggggaaaagggaa

SEQ ID NO: 6963 - DNA, 20 bp, Artificial Sequence
  chemically synthesized
tggggaaaagggaagggaaa

SEQ ID NO: 6964 - DNA, 20 bp, Artificial Sequence
  chemically synthesized
ggggaaaagggaagggaaaa

SEQ ID NO: 6965 - DNA, 20 bp, Artificial Sequence
  chemically synthesized
ggaaaagggaagggaaaaag

SEQ ID NO: 6966 - DNA, 20 bp, Artificial Sequence
  chemically synthesized
aaagggaagggaaaaaggag

SEQ ID NO: 6967 - DNA, 20 bp, Artificial Sequence
  chemically synthesized
aaaaaggagcagaatctgcc

SEQ ID NO: 6968 - DNA, 20 bp, Artificial Sequence
  chemically synthesized
tgtttctcccacttgctctg

SEQ ID NO: 6969 - DNA, 20 bp, Artificial Sequence
  chemically synthesized
gtttctcccacttgctctgc

SEQ ID NO: 6970 - DNA, 20 bp, Artificial Sequence
  chemically synthesized
ctcccacttgctctgcagga

SEQ ID NO: 6971 - DNA, 20 bp, Artificial Sequence
  chemically synthesized
acttgctctgcaggatggct

SEQ ID NO: 6972 - DNA, 20 bp, Artificial Sequence
  chemically synthesized
tgctctgcaggatggcttag

SEQ ID NO: 6973 - DNA, 20 bp, Artificial Sequence
  chemically synthesized
caggatggcttagcagctcc

SEQ ID NO: 6974 - DNA, 20 bp, Artificial Sequence
  chemically synthesized
tggcttagcagctcccagct

SEQ ID NO: 6975 - DNA, 20 bp, Artificial Sequence
  chemically synthesized
ggcttagcagctcccagctc

SEQ ID NO: 6976 - DNA, 20 bp, Artificial Sequence
  chemically synthesized
gcttagcagctcccagctca

SEQ ID NO: 6977 - DNA, 20 bp, Artificial Sequence
  chemically synthesized
gctcccagctcagggcctat

SEQ ID NO: 6978 - DNA, 20 bp, Artificial Sequence
  chemically synthesized
tcccagctcagggcctatca

SEQ ID NO: 6979 - DNA, 20 bp, Artificial Sequence
  chemically synthesized
cccagctcagggcctatcag

SEQ ID NO: 6980 - DNA, 20 bp, Artificial Sequence
  chemically synthesized
ctcagggcctatcagaggct

SEQ ID NO: 6981 - DNA, 20 bp, Artificial Sequence
  chemically synthesized
agggcctatcagaggctgag

SEQ ID NO: 6982 - DNA, 20 bp, Artificial Sequence
  chemically synthesized
gggcctatcagaggctgaga

SEQ ID NO: 6983 - DNA, 20 bp, Artificial Sequence
  chemically synthesized
ctatcagaggctgagaaggt

SEQ ID NO: 6984 - DNA, 20 bp, Artificial Sequence
  chemically synthesized
attttattccttcactaaca

SEQ ID NO: 6985 - DNA, 20 bp, Artificial Sequence
  chemically synthesized
cttcactaacaaagcaaacc

SEQ ID NO: 6986 - DNA, 20 bp, Artificial Sequence
  chemically synthesized
ctctcctctatgcactctct

SEQ ID NO: 6987 - DNA, 20 bp, Artificial Sequence
  chemically synthesized
tctcctctatgcactctctc

SEQ ID NO: 6988 - DNA, 20 bp, Artificial Sequence
  chemically synthesized
ctcctctatgcactctctcg

SEQ ID NO: 6989 - DNA, 20 bp, Artificial Sequence
  chemically synthesized
ggggcacttcctaatctcgt

SEQ ID NO: 6990 - DNA, 20 bp, Artificial Sequence
  chemically synthesized
ctcgttagtaccttttgaat

SEQ ID NO: 6991 - DNA, 20 bp, Artificial Sequence
  chemically synthesized
taccttttgaattagttttc

SEQ ID NO: 6992 - DNA, 20 bp, Artificial Sequence
  chemically synthesized
ttttgaattagttttcaaga

SEQ ID NO: 6993 - DNA, 20 bp, Artificial Sequence
  chemically synthesized
tttgaattagttttcaagat

SEQ ID NO: 6994 - DNA, 20 bp, Artificial Sequence
  chemically synthesized
tagttttcaagataggactt

SEQ ID NO: 6995 - DNA, 20 bp, Artificial Sequence
  chemically synthesized
gataggacttgagttcctcg

SEQ ID NO: 6996 - DNA, 20 bp, Artificial Sequence
  chemically synthesized
ataggacttgagttcctcga

SEQ ID NO: 6997 - DNA, 20 bp, Artificial Sequence
  chemically synthesized
acttgagttcctcgaaggat

SEQ ID NO: 6998 - DNA, 20 bp, Artificial Sequence
  chemically synthesized
ctcgaaggattagaaaataa

SEQ ID NO: 6999 - DNA, 20 bp, Artificial Sequence
  chemically synthesized
ggattagaaaataacagtaa

SEQ ID NO: 7000 - DNA, 20 bp, Artificial Sequence
  chemically synthesized
cagtaacagttcatgttgtc

SEQ ID NO: 7001 - DNA, 20 bp, Artificial Sequence
  chemically synthesized
agtaacagttcatgttgtct

SEQ ID NO: 7002 - DNA, 20 bp, Artificial Sequence
  chemically synthesized
cagttcatgttgtctgggcc

SEQ ID NO: 7003 - DNA, 20 bp, Artificial Sequence
  chemically synthesized
catgttgtctgggccaagca

SEQ ID NO: 7004 - DNA, 20 bp, Artificial Sequence
  chemically synthesized
gttgtctgggccaagcacag

SEQ ID NO: 7005 - DNA, 20 bp, Artificial Sequence
  chemically synthesized
gtggctcacacctgtaatca

SEQ ID NO: 7006 - DNA, 20 bp, Artificial Sequence
  chemically synthesized
tcacacctgtaatcacagcc

SEQ ID NO: 7007 - DNA, 20 bp, Artificial Sequence
  chemically synthesized
cacacctgtaatcacagccg

SEQ ID NO: 7008 - DNA, 20 bp, Artificial Sequence
  chemically synthesized
cctgtaatcacagccgaggc

SEQ ID NO: 7009 - DNA, 20 bp, Artificial Sequence
  chemically synthesized
tgtaatcacagccgaggccg

SEQ ID NO: 7010 - DNA, 20 bp, Artificial Sequence
  chemically synthesized
gtaatcacagccgaggccgg

SEQ ID NO: 7011 - DNA, 20 bp, Artificial Sequence
  chemically synthesized
taatcacagccgaggccgga

SEQ ID NO: 7012 - DNA, 20 bp, Artificial Sequence
  chemically synthesized
atcacagccgaggccggagg

SEQ ID NO: 7013 - DNA, 20 bp, Artificial Sequence
  chemically synthesized
ggccggagggagaacgattt

SEQ ID NO: 7014 - DNA, 20 bp, Artificial Sequence
  chemically synthesized
gagggagaacgatttgagct

SEQ ID NO: 7015 - DNA, 20 bp, Artificial Sequence
  chemically synthesized
agggagaacgatttgagctc

SEQ ID NO: 7016 - DNA, 20 bp, Artificial Sequence
  chemically synthesized
ggagaacgatttgagctcag

SEQ ID NO: 7017 - DNA, 20 bp, Artificial Sequence
  chemically synthesized
aacgatttgagctcaggagt

SEQ ID NO: 7018 - DNA, 20 bp, Artificial Sequence
  chemically synthesized
cgatttgagctcaggagttg

SEQ ID NO: 7019 - DNA, 20 bp, Artificial Sequence
  chemically synthesized
tgagctcaggagttggagac

SEQ ID NO: 7020 - DNA, 20 bp, Artificial Sequence
  chemically synthesized
tcaggagttggagaccagct

SEQ ID NO: 7021 - DNA, 20 bp, Artificial Sequence
  chemically synthesized
caggagttggagaccagctt

SEQ ID NO: 7022 - DNA, 20 bp, Artificial Sequence
  chemically synthesized
ggagaccagcttgggcaaca

SEQ ID NO: 7023 - DNA, 20 bp, Artificial Sequence
  chemically synthesized
agaccagcttgggcaacatg

SEQ ID NO: 7024 - DNA, 20 bp, Artificial Sequence
  chemically synthesized
tctctacaaaaaattttaaa

SEQ ID NO: 7025 - DNA, 20 bp, Artificial Sequence
  chemically synthesized
ctacaaaaaattttaaaaag

SEQ ID NO: 7026 - DNA, 20 bp, Artificial Sequence
  chemically synthesized
ttttaaaaagtagccgaata

SEQ ID NO: 7027 - DNA, 20 bp, Artificial Sequence
  chemically synthesized
aatatggtgttacgtgcctg

SEQ ID NO: 7028 - DNA, 20 bp, Artificial Sequence
  chemically synthesized
gtgttacgtgcctgtagtcc

SEQ ID NO: 7029 - DNA, 20 bp, Artificial Sequence
  chemically synthesized
tgcctgtagtcccagctact

SEQ ID NO: 7030 - DNA, 20 bp, Artificial Sequence
  chemically synthesized
gcctgtagtcccagctactt

SEQ ID NO: 7031 - DNA, 20 bp, Artificial Sequence
  chemically synthesized
ctgtagtcccagctacttgg

SEQ ID NO: 7032 - DNA, 20 bp, Artificial Sequence
  chemically synthesized
tgtagtcccagctacttggg

SEQ ID NO: 7033 - DNA, 20 bp, Artificial Sequence
  chemically synthesized
tcccagctacttgggaggct

SEQ ID NO: 7034 - DNA, 20 bp, Artificial Sequence
  chemically synthesized
cccagctacttgggaggctg

SEQ ID NO: 7035 - DNA, 20 bp, Artificial Sequence
  chemically synthesized
agctacttgggaggctgagg

SEQ ID NO: 7036 - DNA, 20 bp, Artificial Sequence
  chemically synthesized
tacttgggaggctgaggtgg

SEQ ID NO: 7037 - DNA, 20 bp, Artificial Sequence
  chemically synthesized
acttgggaggctgaggtgga

SEQ ID NO: 7038 - DNA, 20 bp, Artificial Sequence
  chemically synthesized
ctgaggtggaaggatatctt

SEQ ID NO: 7039 - DNA, 20 bp, Artificial Sequence
  chemically synthesized
gtggaaggatatcttgagcc

SEQ ID NO: 7040 - DNA, 20 bp, Artificial Sequence
  chemically synthesized
tggaaggatatcttgagcca

SEQ ID NO: 7041 - DNA, 20 bp, Artificial Sequence
  chemically synthesized
gaaggatatcttgagccaag

SEQ ID NO: 7042 - DNA, 20 bp, Artificial Sequence
  chemically synthesized
aaggatatcttgagccaagg

SEQ ID NO: 7043 - DNA, 20 bp, Artificial Sequence
  chemically synthesized
aggatatcttgagccaagga

SEQ ID NO: 7044 - DNA, 20 bp, Artificial Sequence
  chemically synthesized
ggatatcttgagccaaggag

SEQ ID NO: 7045 - DNA, 20 bp, Artificial Sequence
  chemically synthesized
gatatcttgagccaaggagg

SEQ ID NO: 7046 - DNA, 20 bp, Artificial Sequence
  chemically synthesized
tatcttgagccaaggagggg

SEQ ID NO: 7047 - DNA, 20 bp, Artificial Sequence
  chemically synthesized
agccaaggagggggagattg

SEQ ID NO: 7048 - DNA, 20 bp, Artificial Sequence
  chemically synthesized
aaggagggggagattgcagt

SEQ ID NO: 7049 - DNA, 20 bp, Artificial Sequence
  chemically synthesized
gggggagattgcagtgagca

SEQ ID NO: 7050 - DNA, 20 bp, Artificial Sequence
  chemically synthesized
tgtaccactgcactccaacc

SEQ ID NO: 7051 - DNA, 20 bp, Artificial Sequence
  chemically synthesized
gtaccactgcactccaacct

SEQ ID NO: 7052 - DNA, 20 bp, Artificial Sequence
  chemically synthesized
gcactccaacctgggcaaca

SEQ ID NO: 7053 - DNA, 20 bp, Artificial Sequence
  chemically synthesized
tccaacctgggcaacacagc

SEQ ID NO: 7054 - DNA, 20 bp, Artificial Sequence
  chemically synthesized
accctgtcaaaaaaaaaaaa

SEQ ID NO: 7055 - DNA, 20 bp, Artificial Sequence
  chemically synthesized
cctgtcaaaaaaaaaaaaaa

SEQ ID NO: 7056 - DNA, 20 bp, Artificial Sequence
  chemically synthesized
tgtcaaaaaaaaaaaaaaga

SEQ ID NO: 7057 - DNA, 20 bp, Artificial Sequence
  chemically synthesized
aaaaaaaaaaaaaagagagc

SEQ ID NO: 7058 - DNA, 20 bp, Artificial Sequence
  chemically synthesized
aaaaaaaaaagagagctaga

SEQ ID NO: 7059 - DNA, 20 bp, Artificial Sequence
  chemically synthesized
aaaaaagagagctagaaaga

SEQ ID NO: 7060 - DNA, 20 bp, Artificial Sequence
  chemically synthesized
aaagaaagaaattaacaatt

SEQ ID NO: 7061 - DNA, 20 bp, Artificial Sequence
  chemically synthesized
aagaaagaaattaacaattc

SEQ ID NO: 7062 - DNA, 20 bp, Artificial Sequence
  chemically synthesized
aaattaacaattcaggttgt

SEQ ID NO: 7063 - DNA, 20 bp, Artificial Sequence
  chemically synthesized
ttaacaattcaggttgtcag

SEQ ID NO: 7064 - DNA, 20 bp, Artificial Sequence
  chemically synthesized
aactgaatgtctttaacaaa

SEQ ID NO: 7065 - DNA, 20 bp, Artificial Sequence
  chemically synthesized
actgaatgtctttaacaaat

SEQ ID NO: 7066 - DNA, 20 bp, Artificial Sequence
  chemically synthesized
tgaatgtctttaacaaatag

SEQ ID NO: 7067 - DNA, 20 bp, Artificial Sequence
  chemically synthesized
tctttaacaaataggagcca

SEQ ID NO: 7068 - DNA, 20 bp, Artificial Sequence
  chemically synthesized
ctttaacaaataggagccat

SEQ ID NO: 7069 - DNA, 20 bp, Artificial Sequence
  chemically synthesized
taaattgctcacattatttt

SEQ ID NO: 7070 - DNA, 20 bp, Artificial Sequence
  chemically synthesized
aaattgctcacattattttg

SEQ ID NO: 7071 - DNA, 20 bp, Artificial Sequence
  chemically synthesized
aattgctcacattattttga

SEQ ID NO: 7072 - DNA, 20 bp, Artificial Sequence
  chemically synthesized
ttttacctccaacatatata

SEQ ID NO: 7073 - DNA, 20 bp, Artificial Sequence
  chemically synthesized
cagtttttatatttactata

SEQ ID NO: 7074 - DNA, 20 bp, Artificial Sequence
  chemically synthesized
agtttttatatttactatat

SEQ ID NO: 7075 - DNA, 20 bp, Artificial Sequence
  chemically synthesized
ttgcataaaatcaaattaca

SEQ ID NO: 7076 - DNA, 20 bp, Artificial Sequence
  chemically synthesized
cataaaatcaaattacaaag

SEQ ID NO: 7077 - DNA, 20 bp, Artificial Sequence
  chemically synthesized
ataaaatcaaattacaaaga

SEQ ID NO: 7078 - DNA, 20 bp, Artificial Sequence
  chemically synthesized
aatcaaattacaaagaagga

SEQ ID NO: 7079 - DNA, 20 bp, Artificial Sequence
  chemically synthesized
tcaaattacaaagaaggaca

SEQ ID NO: 7080 - DNA, 20 bp, Artificial Sequence
  chemically synthesized
cgcataaaacaacattttgt

SEQ ID NO: 7081 - DNA, 20 bp, Artificial Sequence
  chemically synthesized
attttgttagacttaaaaac

SEQ ID NO: 7082 - DNA, 20 bp, Artificial Sequence
  chemically synthesized
aagctgattataactataaa

SEQ ID NO: 7083 - DNA, 20 bp, Artificial Sequence
  chemically synthesized
ataaaaagatatgtgactaa

SEQ ID NO: 7084 - DNA, 20 bp, Artificial Sequence
  chemically synthesized
taaaaagatatgtgactaat

SEQ ID NO: 7085 - DNA, 20 bp, Artificial Sequence
  chemically synthesized
aaagatatgtgactaatagg

SEQ ID NO: 7086 - DNA, 20 bp, Artificial Sequence
  chemically synthesized
atatgtgactaataggtgga

SEQ ID NO: 7087 - DNA, 20 bp, Artificial Sequence
  chemically synthesized
atgtgactaataggtggaaa

SEQ ID NO: 7088 - DNA, 20 bp, Artificial Sequence
  chemically synthesized
tgtgactaataggtggaaag

SEQ ID NO: 7089 - DNA, 20 bp, Artificial Sequence
  chemically synthesized
tgactaataggtggaaagag

SEQ ID NO: 7090 - DNA, 20 bp, Artificial Sequence
  chemically synthesized
taataggtggaaagaggagc

SEQ ID NO: 7091 - DNA, 20 bp, Artificial Sequence
  chemically synthesized
aataggtggaaagaggagca

SEQ ID NO: 7092 - DNA, 20 bp, Artificial Sequence
  chemically synthesized
aggtggaaagaggagcaagg

SEQ ID NO: 7093 - DNA, 20 bp, Artificial Sequence
  chemically synthesized
aggagcaaggaagaataaaa

SEQ ID NO: 7094 - DNA, 20 bp, Artificial Sequence
  chemically synthesized
ggagcaaggaagaataaaat

SEQ ID NO: 7095 - DNA, 20 bp, Artificial Sequence
  chemically synthesized
agcaaggaagaataaaatgg

SEQ ID NO: 7096 - DNA, 20 bp, Artificial Sequence
  chemically synthesized
gcaaggaagaataaaatggg

SEQ ID NO: 7097 - DNA, 20 bp, Artificial Sequence
  chemically synthesized
ggaagaataaaatgggagga

SEQ ID NO: 7098 - DNA, 20 bp, Artificial Sequence
  chemically synthesized
atgggaggaaagaactgcta

SEQ ID NO: 7099 - DNA, 20 bp, Artificial Sequence
  chemically synthesized
gaactgctaaagactcacga

SEQ ID NO: 7100 - DNA, 20 bp, Artificial Sequence
  chemically synthesized
actcacgatggtttgttaca

SEQ ID NO: 7101 - DNA, 20 bp, Artificial Sequence
  chemically synthesized
acatagctaaacacatgtca

SEQ ID NO: 7102 - DNA, 20 bp, Artificial Sequence
  chemically synthesized
catagctaaacacatgtcat

SEQ ID NO: 7103 - DNA, 20 bp, Artificial Sequence
  chemically synthesized
catgtcatgggtttgtcgta

SEQ ID NO: 7104 - DNA, 20 bp, Artificial Sequence
  chemically synthesized
gtacagattatttcatctcc

SEQ ID NO: 7105 - DNA, 20 bp, Artificial Sequence
  chemically synthesized
tttcatctcccagtactcaa

SEQ ID NO: 7106 - DNA, 20 bp, Artificial Sequence
  chemically synthesized
tcccaccctccaaactcaat

SEQ ID NO: 7107 - DNA, 20 bp, Artificial Sequence
  chemically synthesized
cccaccctccaaactcaatt

SEQ ID NO: 7108 - DNA, 20 bp, Artificial Sequence
  chemically synthesized
ctccaaactcaattaggctg

SEQ ID NO: 7109 - DNA, 20 bp, Artificial Sequence
  chemically synthesized
gtgcatgttttctcatcatt

SEQ ID NO: 7110 - DNA, 20 bp, Artificial Sequence
  chemically synthesized
atcatttagttcctacttgt

SEQ ID NO: 7111 - DNA, 20 bp, Artificial Sequence
  chemically synthesized
tacttgtaagtgataatatg

SEQ ID NO: 7112 - DNA, 20 bp, Artificial Sequence
  chemically synthesized
aagtgataatatgtagtatt

SEQ ID NO: 7113 - DNA, 20 bp, Artificial Sequence
  chemically synthesized
ttggttttctgttcttacat

SEQ ID NO: 7114 - DNA, 20 bp, Artificial Sequence
  chemically synthesized
tgttcttacattagtttgtt

SEQ ID NO: 7115 - DNA, 20 bp, Artificial Sequence
  chemically synthesized
gttcttacattagtttgtta

SEQ ID NO: 7116 - DNA, 20 bp, Artificial Sequence
  chemically synthesized
cattagtttgttaaggataa

SEQ ID NO: 7117 - DNA, 20 bp, Artificial Sequence
  chemically synthesized
ttgttaaggataatggtgtc

SEQ ID NO: 7118 - DNA, 20 bp, Artificial Sequence
  chemically synthesized
gctccatccatgttcctgca

SEQ ID NO: 7119 - DNA, 20 bp, Artificial Sequence
  chemically synthesized
ctccatccatgttcctgcaa

SEQ ID NO: 7120 - DNA, 20 bp, Artificial Sequence
  chemically synthesized
catgatctcattctttttta

SEQ ID NO: 7121 - DNA, 20 bp, Artificial Sequence
  chemically synthesized
cattcttttttatggccaca

SEQ ID NO: 7122 - DNA, 20 bp, Artificial Sequence
  chemically synthesized
tatggccacatagtattcca

SEQ ID NO: 7123 - DNA, 20 bp, Artificial Sequence
  chemically synthesized
tatatgtacatgttctttat

SEQ ID NO: 7124 - DNA, 20 bp, Artificial Sequence
  chemically synthesized
ctttatcggtataccactaa

SEQ ID NO: 7125 - DNA, 20 bp, Artificial Sequence
  chemically synthesized
tttatcggtataccactaat

SEQ ID NO: 7126 - DNA, 20 bp, Artificial Sequence
  chemically synthesized
gtataccactaatgggcctt

SEQ ID NO: 7127 - DNA, 20 bp, Artificial Sequence
  chemically synthesized
tataccactaatgggccttc

SEQ ID NO: 7128 - DNA, 20 bp, Artificial Sequence
  chemically synthesized
ctattgtgattatgctgcaa

SEQ ID NO: 7129 - DNA, 20 bp, Artificial Sequence
  chemically synthesized
tgattatgctgcaatggaca

SEQ ID NO: 7130 - DNA, 20 bp, Artificial Sequence
  chemically synthesized
gattatgctgcaatggacac

SEQ ID NO: 7131 - DNA, 20 bp, Artificial Sequence
  chemically synthesized
gtgtgcatgtgtctttgtga

SEQ ID NO: 7132 - DNA, 20 bp, Artificial Sequence
  chemically synthesized
catgtgtctttgtgatagaa

SEQ ID NO: 7133 - DNA, 20 bp, Artificial Sequence
  chemically synthesized
tagaatggtttattttcctt

SEQ ID NO: 7134 - DNA, 20 bp, Artificial Sequence
  chemically synthesized
agaatggtttattttccttt

SEQ ID NO: 7135 - DNA, 20 bp, Artificial Sequence
  chemically synthesized
tttaggtatatactcaataa

SEQ ID NO: 7136 - DNA, 20 bp, Artificial Sequence
  chemically synthesized
ttaggtatatactcaataat

SEQ ID NO: 7137 - DNA, 20 bp, Artificial Sequence
  chemically synthesized
atactcaataataggattgt

SEQ ID NO: 7138 - DNA, 20 bp, Artificial Sequence
  chemically synthesized
tactcaataataggattgtt

SEQ ID NO: 7139 - DNA, 20 bp, Artificial Sequence
  chemically synthesized
aataggattgttgggttaaa

SEQ ID NO: 7140 - DNA, 20 bp, Artificial Sequence
  chemically synthesized
ttaaatggtatttctgtttt

SEQ ID NO: 7141 - DNA, 20 bp, Artificial Sequence
  chemically synthesized
taaatggtatttctgttttt

SEQ ID NO: 7142 - DNA, 20 bp, Artificial Sequence
  chemically synthesized
tatttctgtttttaggtctt

SEQ ID NO: 7143 - DNA, 20 bp, Artificial Sequence
  chemically synthesized
atttctgtttttaggtcttt

SEQ ID NO: 7144 - DNA, 20 bp, Artificial Sequence
  chemically synthesized
tttctgtttttaggtcttta

SEQ ID NO: 7145 - DNA, 20 bp, Artificial Sequence
  chemically synthesized
tgccacactgctgtctacaa

SEQ ID NO: 7146 - DNA, 20 bp, Artificial Sequence
  chemically synthesized
ctaatttatattgccaccaa

SEQ ID NO: 7147 - DNA, 20 bp, Artificial Sequence
  chemically synthesized
attttttgactatttaatta

SEQ ID NO: 7148 - DNA, 20 bp, Artificial Sequence
  chemically synthesized
tatttaattatagatatttt

SEQ ID NO: 7149 - DNA, 20 bp, Artificial Sequence
  chemically synthesized
atagatattttaagtgatgt

SEQ ID NO: 7150 - DNA, 20 bp, Artificial Sequence
  chemically synthesized
atattttaagtgatgtgaga

SEQ ID NO: 7151 - DNA, 20 bp, Artificial Sequence
  chemically synthesized
tgtgagatagtatctcattt

SEQ ID NO: 7152 - DNA, 20 bp, Artificial Sequence
  chemically synthesized
gtgagatagtatctcatttt

SEQ ID NO: 7153 - DNA, 20 bp, Artificial Sequence
  chemically synthesized
tatctcattttgggtttgat

SEQ ID NO: 7154 - DNA, 20 bp, Artificial Sequence
  chemically synthesized
attggcatttctctaatgat

SEQ ID NO: 7155 - DNA, 20 bp, Artificial Sequence
  chemically synthesized
ctctaatgatcagtgacact

SEQ ID NO: 7156 - DNA, 20 bp, Artificial Sequence
  chemically synthesized
ctgagcttttttcatatgct

SEQ ID NO: 7157 - DNA, 20 bp, Artificial Sequence
  chemically synthesized
agcttttttcatatgcttgg

SEQ ID NO: 7158 - DNA, 20 bp, Artificial Sequence
  chemically synthesized
tgtcctttacccattttttg

SEQ ID NO: 7159 - DNA, 20 bp, Artificial Sequence
  chemically synthesized
cattgtttgttttgttcttg

SEQ ID NO: 7160 - DNA, 20 bp, Artificial Sequence
  chemically synthesized
ttgttcttgtagattcattt

SEQ ID NO: 7161 - DNA, 20 bp, Artificial Sequence
  chemically synthesized
agattcatttaagttcctta

SEQ ID NO: 7162 - DNA, 20 bp, Artificial Sequence
  chemically synthesized
tccttatagattctgaatat

SEQ ID NO: 7163 - DNA, 20 bp, Artificial Sequence
  chemically synthesized
ccttatagattctgaatatt

SEQ ID NO: 7164 - DNA, 20 bp, Artificial Sequence
  chemically synthesized
tctgaatattaggcctttgt

SEQ ID NO: 7165 - DNA, 20 bp, Artificial Sequence
  chemically synthesized
ttaggcctttgttggatgca

SEQ ID NO: 7166 - DNA, 20 bp, Artificial Sequence
  chemically synthesized
aaaaattttctcccattcta

SEQ ID NO: 7167 - DNA, 20 bp, Artificial Sequence
  chemically synthesized
aaaattttctcccattctat

SEQ ID NO: 7168 - DNA, 20 bp, Artificial Sequence
  chemically synthesized
cattctataggttgtttact

SEQ ID NO: 7169 - DNA, 20 bp, Artificial Sequence
  chemically synthesized
taggttgtttactcagttga

SEQ ID NO: 7170 - DNA, 20 bp, Artificial Sequence
  chemically synthesized
tgatagtttcttttgctgtg

SEQ ID NO: 7171 - DNA, 20 bp, Artificial Sequence
  chemically synthesized
tgcagaaactttattttaat

SEQ ID NO: 7172 - DNA, 20 bp, Artificial Sequence
  chemically synthesized
gcttttgctgcaatgactgt

SEQ ID NO: 7173 - DNA, 20 bp, Artificial Sequence
  chemically synthesized
tctttgcccctgcttatgtc

SEQ ID NO: 7174 - DNA, 20 bp, Artificial Sequence
  chemically synthesized
gcccctgcttatgtccggaa

SEQ ID NO: 7175 - DNA, 20 bp, Artificial Sequence
  chemically synthesized
atgtccggaatggtattgcc

SEQ ID NO: 7176 - DNA, 20 bp, Artificial Sequence
  chemically synthesized
tgtccggaatggtattgcct

SEQ ID NO: 7177 - DNA, 20 bp, Artificial Sequence
  chemically synthesized
gtattgcctaggttgctttc

SEQ ID NO: 7178 - DNA, 20 bp, Artificial Sequence
  chemically synthesized
gttgctttcaagcattttta

SEQ ID NO: 7179 - DNA, 20 bp, Artificial Sequence
  chemically synthesized
tttcaagcatttttatagtt

SEQ ID NO: 7180 - DNA, 20 bp, Artificial Sequence
  chemically synthesized
ttcaagcatttttatagttt

SEQ ID NO: 7181 - DNA, 20 bp, Artificial Sequence
  chemically synthesized
atagtttgggttttgcattt

SEQ ID NO: 7182 - DNA, 20 bp, Artificial Sequence
  chemically synthesized
ttaagtctctaatccatctt

SEQ ID NO: 7183 - DNA, 20 bp, Artificial Sequence
  chemically synthesized
gtttatttgtgtatatgata

SEQ ID NO: 7184 - DNA, 20 bp, Artificial Sequence
  chemically synthesized
tttgtgtatatgatatagaa

SEQ ID NO: 7185 - DNA, 20 bp, Artificial Sequence
  chemically synthesized
ttgtgtatatgatatagaac

SEQ ID NO: 7186 - DNA, 20 bp, Artificial Sequence
  chemically synthesized
tgtgtatatgatatagaacg

SEQ ID NO: 7187 - DNA, 20 bp, Artificial Sequence
  chemically synthesized
atatgatatagaacggggtc

SEQ ID NO: 7188 - DNA, 20 bp, Artificial Sequence
  chemically synthesized
tggtttcaatcttctacata

SEQ ID NO: 7189 - DNA, 20 bp, Artificial Sequence
  chemically synthesized
ttcaatcttctacatacggt

SEQ ID NO: 7190 - DNA, 20 bp, Artificial Sequence
  chemically synthesized
atcttctacatacggttagt

SEQ ID NO: 7191 - DNA, 20 bp, Artificial Sequence
  chemically synthesized
tcccaacaccacttgttgaa

SEQ ID NO: 7192 - DNA, 20 bp, Artificial Sequence
  chemically synthesized
cccaacaccacttgttgaat

SEQ ID NO: 7193 - DNA, 20 bp, Artificial Sequence
  chemically synthesized
ccaacaccacttgttgaata

SEQ ID NO: 7194 - DNA, 20 bp, Artificial Sequence
  chemically synthesized
tcctcattgcttgtttttat

SEQ ID NO: 7195 - DNA, 20 bp, Artificial Sequence
  chemically synthesized
tgtttttatcagctttgtca

SEQ ID NO: 7196 - DNA, 20 bp, Artificial Sequence
  chemically synthesized
ttatcagctttgtcaaagat

SEQ ID NO: 7197 - DNA, 20 bp, Artificial Sequence
  chemically synthesized
cagctttgtcaaagatcaga

SEQ ID NO: 7198 - DNA, 20 bp, Artificial Sequence
  chemically synthesized
tgtcaaagatcagatggttg

SEQ ID NO: 7199 - DNA, 20 bp, Artificial Sequence
  chemically synthesized
gtcaaagatcagatggttgt

SEQ ID NO: 7200 - DNA, 20 bp, Artificial Sequence
  chemically synthesized
atcagatggttgtaggcatg

SEQ ID NO: 7201 - DNA, 20 bp, Artificial Sequence
  chemically synthesized
taggcatgtggtcttatttc

SEQ ID NO: 7202 - DNA, 20 bp, Artificial Sequence
  chemically synthesized
aggcatgtggtcttatttct

SEQ ID NO: 7203 - DNA, 20 bp, Artificial Sequence
  chemically synthesized
tctgtgtgtcttttctgtaa

SEQ ID NO: 7204 - DNA, 20 bp, Artificial Sequence
  chemically synthesized
gtaacagtaccacactgttt

SEQ ID NO: 7205 - DNA, 20 bp, Artificial Sequence
  chemically synthesized
ccacactgttttggttactg

SEQ ID NO: 7206 - DNA, 20 bp, Artificial Sequence
  chemically synthesized
ttttggttactgtagccctg

SEQ ID NO: 7207 - DNA, 20 bp, Artificial Sequence
  chemically synthesized
gttactgtagccctgtggta

SEQ ID NO: 7208 - DNA, 20 bp, Artificial Sequence
  chemically synthesized
tagccctgtggtatggtttg

SEQ ID NO: 7209 - DNA, 20 bp, Artificial Sequence
  chemically synthesized
cctgtggtatggtttgaagt

SEQ ID NO: 7210 - DNA, 20 bp, Artificial Sequence
  chemically synthesized
ctgtggtatggtttgaagtt

SEQ ID NO: 7211 - DNA, 20 bp, Artificial Sequence
  chemically synthesized
gttaggcaatgtattatctc

SEQ ID NO: 7212 - DNA, 20 bp, Artificial Sequence
  chemically synthesized
tttttttttttttgtactct

SEQ ID NO: 7213 - DNA, 20 bp, Artificial Sequence
  chemically synthesized
tttttgtactctaagttcta

SEQ ID NO: 7214 - DNA, 20 bp, Artificial Sequence
  chemically synthesized
taagttctacggtacctgtg

SEQ ID NO: 7215 - DNA, 20 bp, Artificial Sequence
  chemically synthesized
tatgtatacgtgtgccatat

SEQ ID NO: 7216 - DNA, 20 bp, Artificial Sequence
  chemically synthesized
cgttaactcgtcatttacat

SEQ ID NO: 7217 - DNA, 20 bp, Artificial Sequence
  chemically synthesized
tctctcctaccaccccacga

SEQ ID NO: 7218 - DNA, 20 bp, Artificial Sequence
  chemically synthesized
ctctcctaccaccccacgac

SEQ ID NO: 7219 - DNA, 20 bp, Artificial Sequence
  chemically synthesized
taccaccccacgacaggccc

SEQ ID NO: 7220 - DNA, 20 bp, Artificial Sequence
  chemically synthesized
atgttccccaccctgtgtcc

SEQ ID NO: 7221 - DNA, 20 bp, Artificial Sequence
  chemically synthesized
atttttcaattcccacctgt

SEQ ID NO: 7222 - DNA, 20 bp, Artificial Sequence
  chemically synthesized
caattcccacctgtgagtat

SEQ ID NO: 7223 - DNA, 20 bp, Artificial Sequence
  chemically synthesized
aattcccacctgtgagtatt

SEQ ID NO: 7224 - DNA, 20 bp, Artificial Sequence
  chemically synthesized
ctgtgagtattaggatttcc

SEQ ID NO: 7225 - DNA, 20 bp, Artificial Sequence
  chemically synthesized
tgtgagtattaggatttcct

SEQ ID NO: 7226 - DNA, 20 bp, Artificial Sequence
  chemically synthesized
ttaggatttcctaggctatt

SEQ ID NO: 7227 - DNA, 20 bp, Artificial Sequence
  chemically synthesized
gttgttccatatgaacttta

SEQ ID NO: 7228 - DNA, 20 bp, Artificial Sequence
  chemically synthesized
aactttaaagtgtatttttc

SEQ ID NO: 7229 - DNA, 20 bp, Artificial Sequence
  chemically synthesized
tgtatttttctagttctgtg

SEQ ID NO: 7230 - DNA, 20 bp, Artificial Sequence
  chemically synthesized
agttctgtgaagaatgtcat

SEQ ID NO: 7231 - DNA, 20 bp, Artificial Sequence
  chemically synthesized
tctgtgaagaatgtcattgg

SEQ ID NO: 7232 - DNA, 20 bp, Artificial Sequence
  chemically synthesized
gaatgtcattggtagtttga

SEQ ID NO: 7233 - DNA, 20 bp, Artificial Sequence
  chemically synthesized
aatgtcattggtagtttgat

SEQ ID NO: 7234 - DNA, 20 bp, Artificial Sequence
  chemically synthesized
cattggtagtttgataggaa

SEQ ID NO: 7235 - DNA, 20 bp, Artificial Sequence
  chemically synthesized
tttgaaactgtaaattgctc

SEQ ID NO: 7236 - DNA, 20 bp, Artificial Sequence
  chemically synthesized
ttgaaactgtaaattgctct

SEQ ID NO: 7237 - DNA, 20 bp, Artificial Sequence
  chemically synthesized
aaactgtaaattgctctagg

SEQ ID NO: 7238 - DNA, 20 bp, Artificial Sequence
  chemically synthesized
gtaaattgctctaggcagta

SEQ ID NO: 7239 - DNA, 20 bp, Artificial Sequence
  chemically synthesized
tattgattctttttatccat

SEQ ID NO: 7240 - DNA, 20 bp, Artificial Sequence
  chemically synthesized
attctttttatccatgagca

SEQ ID NO: 7241 - DNA, 20 bp, Artificial Sequence
  chemically synthesized
tttttatccatgagcatgga

SEQ ID NO: 7242 - DNA, 20 bp, Artificial Sequence
  chemically synthesized
gtttttccatttgtttctat

SEQ ID NO: 7243 - DNA, 20 bp, Artificial Sequence
  chemically synthesized
ctatcagctctgatttcttt

SEQ ID NO: 7244 - DNA, 20 bp, Artificial Sequence
  chemically synthesized
tcagctctgatttctttgag

SEQ ID NO: 7245 - DNA, 20 bp, Artificial Sequence
  chemically synthesized
gtgttttgtaaatctcattg

SEQ ID NO: 7246 - DNA, 20 bp, Artificial Sequence
  chemically synthesized
gttttgtaaatctcattgta

SEQ ID NO: 7247 - DNA, 20 bp, Artificial Sequence
  chemically synthesized
gtagagatctttcaactgct

SEQ ID NO: 7248 - DNA, 20 bp, Artificial Sequence
  chemically synthesized
agatctttcaactgcttggt

SEQ ID NO: 7249 - DNA, 20 bp, Artificial Sequence
  chemically synthesized
tgcttggttagatatatcct

SEQ ID NO: 7250 - DNA, 20 bp, Artificial Sequence
  chemically synthesized
gcttggttagatatatcctt

SEQ ID NO: 7251 - DNA, 20 bp, Artificial Sequence
  chemically synthesized
taggtattttattctttttg

SEQ ID NO: 7252 - DNA, 20 bp, Artificial Sequence
  chemically synthesized
ttttattctttttgtggcaa

SEQ ID NO: 7253 - DNA, 20 bp, Artificial Sequence
  chemically synthesized
ctttttgtggcaacggtaaa

SEQ ID NO: 7254 - DNA, 20 bp, Artificial Sequence
  chemically synthesized
tttttgtggcaacggtaaat

SEQ ID NO: 7255 - DNA, 20 bp, Artificial Sequence
  chemically synthesized
atgggattgacttcctgatt

SEQ ID NO: 7256 - DNA, 20 bp, Artificial Sequence
  chemically synthesized
ttgacttcctgatttggctc

SEQ ID NO: 7257 - DNA, 20 bp, Artificial Sequence
  chemically synthesized
tgacttcctgatttggctct

SEQ ID NO: 7258 - DNA, 20 bp, Artificial Sequence
  chemically synthesized
tcctgatttggctctaggct

SEQ ID NO: 7259 - DNA, 20 bp, Artificial Sequence
  chemically synthesized
gcttggctattgttgatgta

SEQ ID NO: 7260 - DNA, 20 bp, Artificial Sequence
  chemically synthesized
cttggctattgttgatgtat

SEQ ID NO: 7261 - DNA, 20 bp, Artificial Sequence
  chemically synthesized
ttgttgatgtatgggaatgc

SEQ ID NO: 7262 - DNA, 20 bp, Artificial Sequence
  chemically synthesized
tatatcctgaaactttgctg

SEQ ID NO: 7263 - DNA, 20 bp, Artificial Sequence
  chemically synthesized
tgaaactttgctgaagttat

SEQ ID NO: 7264 - DNA, 20 bp, Artificial Sequence
  chemically synthesized
tttgctgaagttatcagctg

SEQ ID NO: 7265 - DNA, 20 bp, Artificial Sequence
  chemically synthesized
ttgctgaagttatcagctga

SEQ ID NO: 7266 - DNA, 20 bp, Artificial Sequence
  chemically synthesized
gctgaagttatcagctgaag

SEQ ID NO: 7267 - DNA, 20 bp, Artificial Sequence
  chemically synthesized
ttatcagctgaaggagcttt

SEQ ID NO: 7268 - DNA, 20 bp, Artificial Sequence
  chemically synthesized
tatcagctgaaggagctttt

SEQ ID NO: 7269 - DNA, 20 bp, Artificial Sequence
  chemically synthesized
gagcttttgggccttgacta

SEQ ID NO: 7270 - DNA, 20 bp, Artificial Sequence
  chemically synthesized
gccttgactatggtgttttc

SEQ ID NO: 7271 - DNA, 20 bp, Artificial Sequence
  chemically synthesized
actatggtgttttctagata

SEQ ID NO: 7272 - DNA, 20 bp, Artificial Sequence
  chemically synthesized
tgttttctagatacagaaaa

SEQ ID NO: 7273 - DNA, 20 bp, Artificial Sequence
  chemically synthesized
gttttctagatacagaaaac

SEQ ID NO: 7274 - DNA, 20 bp, Artificial Sequence
  chemically synthesized
ttttctagatacagaaaaca

SEQ ID NO: 7275 - DNA, 20 bp, Artificial Sequence
  chemically synthesized
tgactttctctcttcctatt

SEQ ID NO: 7276 - DNA, 20 bp, Artificial Sequence
  chemically synthesized
cttctcttgcctgattgctc

SEQ ID NO: 7277 - DNA, 20 bp, Artificial Sequence
  chemically synthesized
tcttgcctgattgctctggc

SEQ ID NO: 7278 - DNA, 20 bp, Artificial Sequence
  chemically synthesized
cttgcctgattgctctggcc

SEQ ID NO: 7279 - DNA, 20 bp, Artificial Sequence
  chemically synthesized
attgctctggccaggactgc

SEQ ID NO: 7280 - DNA, 20 bp, Artificial Sequence
  chemically synthesized
actgccagtactatactgaa

SEQ ID NO: 7281 - DNA, 20 bp, Artificial Sequence
  chemically synthesized
gccagtactatactgaatag

SEQ ID NO: 7282 - DNA, 20 bp, Artificial Sequence
  chemically synthesized
agtactatactgaatagcag

SEQ ID NO: 7283 - DNA, 20 bp, Artificial Sequence
  chemically synthesized
ctatactgaatagcagtggt

SEQ ID NO: 7284 - DNA, 20 bp, Artificial Sequence
  chemically synthesized
atactgaatagcagtggtga

SEQ ID NO: 7285 - DNA, 20 bp, Artificial Sequence
  chemically synthesized
actgaatagcagtggtgaga

SEQ ID NO: 7286 - DNA, 20 bp, Artificial Sequence
  chemically synthesized
ctgaatagcagtggtgagag

SEQ ID NO: 7287 - DNA, 20 bp, Artificial Sequence
  chemically synthesized
tgaatagcagtggtgagaga

SEQ ID NO: 7288 - DNA, 20 bp, Artificial Sequence
  chemically synthesized
agggcatccttgtcttgtgc

SEQ ID NO: 7289 - DNA, 20 bp, Artificial Sequence
  chemically synthesized
cttgtcttgtgccagttttc

SEQ ID NO: 7290 - DNA, 20 bp, Artificial Sequence
  chemically synthesized
gtcttgtgccagttttcaag

SEQ ID NO: 7291 - DNA, 20 bp, Artificial Sequence
  chemically synthesized
gttttcaagaagaatgcttc

SEQ ID NO: 7292 - DNA, 20 bp, Artificial Sequence
  chemically synthesized
ttttcaagaagaatgcttcc

SEQ ID NO: 7293 - DNA, 20 bp, Artificial Sequence
  chemically synthesized
ttgcccattctgtatgatgt

SEQ ID NO: 7294 - DNA, 20 bp, Artificial Sequence
  chemically synthesized
attctgtatgatgttggctg

SEQ ID NO: 7295 - DNA, 20 bp, Artificial Sequence
  chemically synthesized
ttctgtatgatgttggctgt

SEQ ID NO: 7296 - DNA, 20 bp, Artificial Sequence
  chemically synthesized
tgttggctgtgggtttgtca

SEQ ID NO: 7297 - DNA, 20 bp, Artificial Sequence
  chemically synthesized
ggctgtgggtttgtcataga

SEQ ID NO: 7298 - DNA, 20 bp, Artificial Sequence
  chemically synthesized
tagatggctcatattatttt

SEQ ID NO: 7299 - DNA, 20 bp, Artificial Sequence
  chemically synthesized
agatggctcatattattttg

SEQ ID NO: 7300 - DNA, 20 bp, Artificial Sequence
  chemically synthesized
tttgaggtcatgtccttaaa

SEQ ID NO: 7301 - DNA, 20 bp, Artificial Sequence
  chemically synthesized
aggtcatgtccttaaatagc

SEQ ID NO: 7302 - DNA, 20 bp, Artificial Sequence
  chemically synthesized
ccttaaatagctagtttgtt

SEQ ID NO: 7303 - DNA, 20 bp, Artificial Sequence
  chemically synthesized
ttaaatagctagtttgttga

SEQ ID NO: 7304 - DNA, 20 bp, Artificial Sequence
  chemically synthesized
taaatagctagtttgttgag

SEQ ID NO: 7305 - DNA, 20 bp, Artificial Sequence
  chemically synthesized
tgttgagaggttttaacatg

SEQ ID NO: 7306 - DNA, 20 bp, Artificial Sequence
  chemically synthesized
agaggttttaacatgaagtg

SEQ ID NO: 7307 - DNA, 20 bp, Artificial Sequence
  chemically synthesized
cacatattgaaatgatcatg

SEQ ID NO: 7308 - DNA, 20 bp, Artificial Sequence
  chemically synthesized
gatcatgtggtttctgtttt

SEQ ID NO: 7309 - DNA, 20 bp, Artificial Sequence
  chemically synthesized
gctgaaccaatcttgcttct

SEQ ID NO: 7310 - DNA, 20 bp, Artificial Sequence
  chemically synthesized
ctgaaccaatcttgcttctc

SEQ ID NO: 7311 - DNA, 20 bp, Artificial Sequence
  chemically synthesized
tgaaccaatcttgcttctca

SEQ ID NO: 7312 - DNA, 20 bp, Artificial Sequence
  chemically synthesized
aatcttgcttctcagggata

SEQ ID NO: 7313 - DNA, 20 bp, Artificial Sequence
  chemically synthesized
gggataaagcctacttgatt

SEQ ID NO: 7314 - DNA, 20 bp, Artificial Sequence
  chemically synthesized
ggataaagcctacttgattg

SEQ ID NO: 7315 - DNA, 20 bp, Artificial Sequence
  chemically synthesized
taaagcctacttgattgagg

SEQ ID NO: 7316 - DNA, 20 bp, Artificial Sequence
  chemically synthesized
cctacttgattgaggtggat

SEQ ID NO: 7317 - DNA, 20 bp, Artificial Sequence
  chemically synthesized
ttagctttgtgatgtgttgc

SEQ ID NO: 7318 - DNA, 20 bp, Artificial Sequence
  chemically synthesized
ttgtgatgtgttgctggatt

SEQ ID NO: 7319 - DNA, 20 bp, Artificial Sequence
  chemically synthesized
tgttgctggatttggcttgc

SEQ ID NO: 7320 - DNA, 20 bp, Artificial Sequence
  chemically synthesized
gtatttttgcatcaatgttc

SEQ ID NO: 7321 - DNA, 20 bp, Artificial Sequence
  chemically synthesized
tatttttgcatcaatgttca

SEQ ID NO: 7322 - DNA, 20 bp, Artificial Sequence
  chemically synthesized
gcatcaatgttcaaggatat

SEQ ID NO: 7323 - DNA, 20 bp, Artificial Sequence
  chemically synthesized
tgttcaaggatattggcctg

SEQ ID NO: 7324 - DNA, 20 bp, Artificial Sequence
  chemically synthesized
ttttgttgttgtgtgtctat

SEQ ID NO: 7325 - DNA, 20 bp, Artificial Sequence
  chemically synthesized
tttgttgttgtgtgtctatc

SEQ ID NO: 7326 - DNA, 20 bp, Artificial Sequence
  chemically synthesized
gttgtgtgtctatcaggttt

SEQ ID NO: 7327 - DNA, 20 bp, Artificial Sequence
  chemically synthesized
tgtctatcaggttttggtat

SEQ ID NO: 7328 - DNA, 20 bp, Artificial Sequence
  chemically synthesized
gtctatcaggttttggtatc

SEQ ID NO: 7329 - DNA, 20 bp, Artificial Sequence
  chemically synthesized
ttttggtatcaggatgatgc

SEQ ID NO: 7330 - DNA, 20 bp, Artificial Sequence
  chemically synthesized
tgatgctggcctcataaaat

SEQ ID NO: 7331 - DNA, 20 bp, Artificial Sequence
  chemically synthesized
ctggcctcataaaatgagct

SEQ ID NO: 7332 - DNA, 20 bp, Artificial Sequence
  chemically synthesized
tggcctcataaaatgagctg

SEQ ID NO: 7333 - DNA, 20 bp, Artificial Sequence
  chemically synthesized
atccctccccctcaattttt

SEQ ID NO: 7334 - DNA, 20 bp, Artificial Sequence
  chemically synthesized
ccctccccctcaattttttg

SEQ ID NO: 7335 - DNA, 20 bp, Artificial Sequence
  chemically synthesized
tccccctcaattttttggag

SEQ ID NO: 7336 - DNA, 20 bp, Artificial Sequence
  chemically synthesized
tcaattttttggagtagctt

SEQ ID NO: 7337 - DNA, 20 bp, Artificial Sequence
  chemically synthesized
attttttggagtagcttcag

SEQ ID NO: 7338 - DNA, 20 bp, Artificial Sequence
  chemically synthesized
ttttttggagtagcttcagt

SEQ ID NO: 7339 - DNA, 20 bp, Artificial Sequence
  chemically synthesized
actcttctttgtgcatctga

SEQ ID NO: 7340 - DNA, 20 bp, Artificial Sequence
  chemically synthesized
tttgtgcatctgatagaatt

SEQ ID NO: 7341 - DNA, 20 bp, Artificial Sequence
  chemically synthesized
tggttgtgaatcatattgtc

SEQ ID NO: 7342 - DNA, 20 bp, Artificial Sequence
  chemically synthesized
ggttgtgaatcatattgtcc

SEQ ID NO: 7343 - DNA, 20 bp, Artificial Sequence
  chemically synthesized
gttgtgaatcatattgtcca

SEQ ID NO: 7344 - DNA, 20 bp, Artificial Sequence
  chemically synthesized
ccagggctttttttgtttga

SEQ ID NO: 7345 - DNA, 20 bp, Artificial Sequence
  chemically synthesized
cagggctttttttgtttgat

SEQ ID NO: 7346 - DNA, 20 bp, Artificial Sequence
  chemically synthesized
atttattactgaatcatttt

SEQ ID NO: 7347 - DNA, 20 bp, Artificial Sequence
  chemically synthesized
ttattactgaatcattttca

SEQ ID NO: 7348 - DNA, 20 bp, Artificial Sequence
  chemically synthesized
atcattttcagagctcatca

SEQ ID NO: 7349 - DNA, 20 bp, Artificial Sequence
  chemically synthesized
gagctcatcatggatctctt

SEQ ID NO: 7350 - DNA, 20 bp, Artificial Sequence
  chemically synthesized
agctcatcatggatctcttc

SEQ ID NO: 7351 - DNA, 20 bp, Artificial Sequence
  chemically synthesized
tcaggaaattgatttcttcc

SEQ ID NO: 7352 - DNA, 20 bp, Artificial Sequence
  chemically synthesized
aaattgatttcttcctggtt

SEQ ID NO: 7353 - DNA, 20 bp, Artificial Sequence
  chemically synthesized
atttcttcctggttcagcct

SEQ ID NO: 7354 - DNA, 20 bp, Artificial Sequence
  chemically synthesized
tttcttcctggttcagcctt

SEQ ID NO: 7355 - DNA, 20 bp, Artificial Sequence
  chemically synthesized
tcttcctggttcagccttgg

SEQ ID NO: 7356 - DNA, 20 bp, Artificial Sequence
  chemically synthesized
cttcctggttcagccttggg

SEQ ID NO: 7357 - DNA, 20 bp, Artificial Sequence
  chemically synthesized
ggaggacctaaaacaatcct

SEQ ID NO: 7358 - DNA, 20 bp, Artificial Sequence
  chemically synthesized
aaaatcatatcaatcactct

SEQ ID NO: 7359 - DNA, 20 bp, Artificial Sequence
  chemically synthesized
tatcaatcactctcagacca

SEQ ID NO: 7360 - DNA, 20 bp, Artificial Sequence
  chemically synthesized
tcaatcactctcagaccaca

SEQ ID NO: 7361 - DNA, 20 bp, Artificial Sequence
  chemically synthesized
caatcactctcagaccacag

SEQ ID NO: 7362 - DNA, 20 bp, Artificial Sequence
  chemically synthesized
agaccacagaggaataaaaa

SEQ ID NO: 7363 - DNA, 20 bp, Artificial Sequence
  chemically synthesized
gaggaataaaaatagatttc

SEQ ID NO: 7364 - DNA, 20 bp, Artificial Sequence
  chemically synthesized
tagatttcaagactaatgaa

SEQ ID NO: 7365 - DNA, 20 bp, Artificial Sequence
  chemically synthesized
ctgaaaactatgcaattaca

SEQ ID NO: 7366 - DNA, 20 bp, Artificial Sequence
  chemically synthesized
acctgctcctgaatgaattt

SEQ ID NO: 7367 - DNA, 20 bp, Artificial Sequence
  chemically synthesized
cctgctcctgaatgaatttt

SEQ ID NO: 7368 - DNA, 20 bp, Artificial Sequence
  chemically synthesized
ttgggtaaataatgaaaact

SEQ ID NO: 7369 - DNA, 20 bp, Artificial Sequence
  chemically synthesized
tgggtaaataatgaaaacta

SEQ ID NO: 7370 - DNA, 20 bp, Artificial Sequence
  chemically synthesized
aaactaaggcaaaaataaaa

SEQ ID NO: 7371 - DNA, 20 bp, Artificial Sequence
  chemically synthesized
aatagttctttgaaactaat

SEQ ID NO: 7372 - DNA, 20 bp, Artificial Sequence
  chemically synthesized
ctttgaaactaatgagaaca

SEQ ID NO: 7373 - DNA, 20 bp, Artificial Sequence
  chemically synthesized
agaacaaagatacaatatac

SEQ ID NO: 7374 - DNA, 20 bp, Artificial Sequence
  chemically synthesized
atacaatataccggaatctc

SEQ ID NO: 7375 - DNA, 20 bp, Artificial Sequence
  chemically synthesized
tacaatataccggaatctct

SEQ ID NO: 7376 - DNA, 20 bp, Artificial Sequence
  chemically synthesized
ataccggaatctctgggaca

SEQ ID NO: 7377 - DNA, 20 bp, Artificial Sequence
  chemically synthesized
ggaatctctgggacacagct

SEQ ID NO: 7378 - DNA, 20 bp, Artificial Sequence
  chemically synthesized
tctctgggacacagcttaga

SEQ ID NO: 7379 - DNA, 20 bp, Artificial Sequence
  chemically synthesized
gacacagcttagacagtgtt

SEQ ID NO: 7380 - DNA, 20 bp, Artificial Sequence
  chemically synthesized
cacagcttagacagtgttaa

SEQ ID NO: 7381 - DNA, 20 bp, Artificial Sequence
  chemically synthesized
cagcttagacagtgttaaga

SEQ ID NO: 7382 - DNA, 20 bp, Artificial Sequence
  chemically synthesized
cactaaatgcccacatcaaa

SEQ ID NO: 7383 - DNA, 20 bp, Artificial Sequence
  chemically synthesized
gcccacatcaaaaagtctta

SEQ ID NO: 7384 - DNA, 20 bp, Artificial Sequence
  chemically synthesized
caacctaatgtcacaactaa

SEQ ID NO: 7385 - DNA, 20 bp, Artificial Sequence
  chemically synthesized
aatgtcacaactaaaagaac

SEQ ID NO: 7386 - DNA, 20 bp, Artificial Sequence
  chemically synthesized
tgtcacaactaaaagaacca

SEQ ID NO: 7387 - DNA, 20 bp, Artificial Sequence
  chemically synthesized
actaaaagaaccagagaacc

SEQ ID NO: 7388 - DNA, 20 bp, Artificial Sequence
  chemically synthesized
taaaagaaccagagaaccaa

SEQ ID NO: 7389 - DNA, 20 bp, Artificial Sequence
  chemically synthesized
gagcaaaccaaccctaaatc

SEQ ID NO: 7390 - DNA, 20 bp, Artificial Sequence
  chemically synthesized
caaaccaaccctaaatctag

SEQ ID NO: 7391 - DNA, 20 bp, Artificial Sequence
  chemically synthesized
accaaccctaaatctagcag

SEQ ID NO: 7392 - DNA, 20 bp, Artificial Sequence
  chemically synthesized
ccctaaatctagcagaagac

SEQ ID NO: 7393 - DNA, 20 bp, Artificial Sequence
  chemically synthesized
gcagaagacaagaaataaac

SEQ ID NO: 7394 - DNA, 20 bp, Artificial Sequence
  chemically synthesized
acaagaaataaacaagatca

SEQ ID NO: 7395 - DNA, 20 bp, Artificial Sequence
  chemically synthesized
aacaagatcaaagctaactg

SEQ ID NO: 7396 - DNA, 20 bp, Artificial Sequence
  chemically synthesized
acaagatcaaagctaactga

SEQ ID NO: 7397 - DNA, 20 bp, Artificial Sequence
  chemically synthesized
aaacacaaaataccattcaa

SEQ ID NO: 7398 - DNA, 20 bp, Artificial Sequence
  chemically synthesized
ataccattcaaaagattaat

SEQ ID NO: 7399 - DNA, 20 bp, Artificial Sequence
  chemically synthesized
ttcaaaagattaatgagtcc

SEQ ID NO: 7400 - DNA, 20 bp, Artificial Sequence
  chemically synthesized
caaaagattaatgagtccaa

SEQ ID NO: 7401 - DNA, 20 bp, Artificial Sequence
  chemically synthesized
agattaatgagtccaagagc

SEQ ID NO: 7402 - DNA, 20 bp, Artificial Sequence
  chemically synthesized
ggttttgtgaaaaaattaat

SEQ ID NO: 7403 - DNA, 20 bp, Artificial Sequence
  chemically synthesized
gttttgtgaaaaaattaata

SEQ ID NO: 7404 - DNA, 20 bp, Artificial Sequence
  chemically synthesized
ttgtgaaaaaattaataagg

SEQ ID NO: 7405 - DNA, 20 bp, Artificial Sequence
  chemically synthesized
aaattaataaggtagatcac

SEQ ID NO: 7406 - DNA, 20 bp, Artificial Sequence
  chemically synthesized
taataaggtagatcactagc

SEQ ID NO: 7407 - DNA, 20 bp, Artificial Sequence
  chemically synthesized
gatcactagctagactaata

SEQ ID NO: 7408 - DNA, 20 bp, Artificial Sequence
  chemically synthesized
cactagctagactaataaag

SEQ ID NO: 7409 - DNA, 20 bp, Artificial Sequence
  chemically synthesized
gctagactaataaagaagac

SEQ ID NO: 7410 - DNA, 20 bp, Artificial Sequence
  chemically synthesized
tagactaataaagaagacaa

SEQ ID NO: 7411 - DNA, 20 bp, Artificial Sequence
  chemically synthesized
gactaataaagaagacaaga

SEQ ID NO: 7412 - DNA, 20 bp, Artificial Sequence
  chemically synthesized
taataaagaagacaagagag

SEQ ID NO: 7413 - DNA, 20 bp, Artificial Sequence
  chemically synthesized
acaagagagaagatccaaat

SEQ ID NO: 7414 - DNA, 20 bp, Artificial Sequence
  chemically synthesized
agagaagatccaaataagca

SEQ ID NO: 7415 - DNA, 20 bp, Artificial Sequence
  chemically synthesized
aagatccaaataagcacagt

SEQ ID NO: 7416 - DNA, 20 bp, Artificial Sequence
  chemically synthesized
aagcacagttagaaatgaaa

SEQ ID NO: 7417 - DNA, 20 bp, Artificial Sequence
  chemically synthesized
agcacagttagaaatgaaaa

SEQ ID NO: 7418 - DNA, 20 bp, Artificial Sequence
  chemically synthesized
gcacagttagaaatgaaaaa

SEQ ID NO: 7419 - DNA, 20 bp, Artificial Sequence
  chemically synthesized
gaatattatcactcacccca

SEQ ID NO: 7420 - DNA, 20 bp, Artificial Sequence
  chemically synthesized
acatctctatgtacataaac

SEQ ID NO: 7421 - DNA, 20 bp, Artificial Sequence
  chemically synthesized
acataaactagaaaatctaa

SEQ ID NO: 7422 - DNA, 20 bp, Artificial Sequence
  chemically synthesized
actagaaaatctaaaagaaa

SEQ ID NO: 7423 - DNA, 20 bp, Artificial Sequence
  chemically synthesized
aaaagaaatggataacttcc

SEQ ID NO: 7424 - DNA, 20 bp, Artificial Sequence
  chemically synthesized
tcctggactgctcattgtct

SEQ ID NO: 7425 - DNA, 20 bp, Artificial Sequence
  chemically synthesized
cctggactgctcattgtctt

SEQ ID NO: 7426 - DNA, 20 bp, Artificial Sequence
  chemically synthesized
actgctcattgtcttaggca

SEQ ID NO: 7427 - DNA, 20 bp, Artificial Sequence
  chemically synthesized
gctcattgtcttaggcaaag

SEQ ID NO: 7428 - DNA, 20 bp, Artificial Sequence
  chemically synthesized
ttgtcttaggcaaagaagac

SEQ ID NO: 7429 - DNA, 20 bp, Artificial Sequence
  chemically synthesized
agactagccgtactttattt

SEQ ID NO: 7430 - DNA, 20 bp, Artificial Sequence
  chemically synthesized
gactagccgtactttatttg

SEQ ID NO: 7431 - DNA, 20 bp, Artificial Sequence
  chemically synthesized
actagccgtactttatttga

SEQ ID NO: 7432 - DNA, 20 bp, Artificial Sequence
  chemically synthesized
actttatttgagggctcttt

SEQ ID NO: 7433 - DNA, 20 bp, Artificial Sequence
  chemically synthesized
ttatttgagggctctttgag

SEQ ID NO: 7434 - DNA, 20 bp, Artificial Sequence
  chemically synthesized
atttgagggctctttgagta

SEQ ID NO: 7435 - DNA, 20 bp, Artificial Sequence
  chemically synthesized
caactctatgtccccctccc

SEQ ID NO: 7436 - DNA, 20 bp, Artificial Sequence
  chemically synthesized
gtccccctccccagaataca

SEQ ID NO: 7437 - DNA, 20 bp, Artificial Sequence
  chemically synthesized
gatgcctcctttgcttcttt

SEQ ID NO: 7438 - DNA, 20 bp, Artificial Sequence
  chemically synthesized
ctgtgttatatctgaatata

SEQ ID NO: 7439 - DNA, 20 bp, Artificial Sequence
  chemically synthesized
tatatctgaatatatggctc

SEQ ID NO: 7440 - DNA, 20 bp, Artificial Sequence
  chemically synthesized
tatctgaatatatggctcta

SEQ ID NO: 7441 - DNA, 20 bp, Artificial Sequence
  chemically synthesized
atatggctctagagaatccc

SEQ ID NO: 7442 - DNA, 20 bp, Artificial Sequence
  chemically synthesized
ctctagagaatcccaagaaa

SEQ ID NO: 7443 - DNA, 20 bp, Artificial Sequence
  chemically synthesized
agaatcccaagaaatagaaa

SEQ ID NO: 7444 - DNA, 20 bp, Artificial Sequence
  chemically synthesized
tcccaagaaatagaaaaagc

SEQ ID NO: 7445 - DNA, 20 bp, Artificial Sequence
  chemically synthesized
aaaaagctagtccaaaatcc

SEQ ID NO: 7446 - DNA, 20 bp, Artificial Sequence
  chemically synthesized
ccaaaatccaagctctgaat

SEQ ID NO: 7447 - DNA, 20 bp, Artificial Sequence
  chemically synthesized
aatccaagctctgaataaga

SEQ ID NO: 7448 - DNA, 20 bp, Artificial Sequence
  chemically synthesized
atccaagctctgaataagac

SEQ ID NO: 7449 - DNA, 20 bp, Artificial Sequence
  chemically synthesized
aagctctgaataagacaggt

SEQ ID NO: 7450 - DNA, 20 bp, Artificial Sequence
  chemically synthesized
aataagacaggtgagacctt

SEQ ID NO: 7451 - DNA, 20 bp, Artificial Sequence
  chemically synthesized
tggatgaatatcttttcaca

SEQ ID NO: 7452 - DNA, 20 bp, Artificial Sequence
  chemically synthesized
gaatatcttttcacaaagtt

SEQ ID NO: 7453 - DNA, 20 bp, Artificial Sequence
  chemically synthesized
tatcttttcacaaagttgag

SEQ ID NO: 7454 - DNA, 20 bp, Artificial Sequence
  chemically synthesized
cacaaagttgagaagatgtg

SEQ ID NO: 7455 - DNA, 20 bp, Artificial Sequence
  chemically synthesized
tgagaagatgtgaagaaccc

SEQ ID NO: 7456 - DNA, 20 bp, Artificial Sequence
  chemically synthesized
tgaagaacccaagaatccac

SEQ ID NO: 7457 - DNA, 20 bp, Artificial Sequence
  chemically synthesized
aagaacccaagaatccactg

SEQ ID NO: 7458 - DNA, 20 bp, Artificial Sequence
  chemically synthesized
ccaagaatccactggagaaa

SEQ ID NO: 7459 - DNA, 20 bp, Artificial Sequence
  chemically synthesized
tccactggagaaacagcccc

SEQ ID NO: 7460 - DNA, 20 bp, Artificial Sequence
  chemically synthesized
ccactggagaaacagccccg

SEQ ID NO: 7461 - DNA, 20 bp, Artificial Sequence
  chemically synthesized
aaacagccccgaggcactgc

SEQ ID NO: 7462 - DNA, 20 bp, Artificial Sequence
  chemically synthesized
aacagccccgaggcactgca

SEQ ID NO: 7463 - DNA, 20 bp, Artificial Sequence
  chemically synthesized
acagccccgaggcactgcaa

SEQ ID NO: 7464 - DNA, 20 bp, Artificial Sequence
  chemically synthesized
cagccccgaggcactgcaag

SEQ ID NO: 7465 - DNA, 20 bp, Artificial Sequence
  chemically synthesized
ccgaggcactgcaaggggtt

SEQ ID NO: 7466 - DNA, 20 bp, Artificial Sequence
  chemically synthesized
caaggggttcagacctgtgt

SEQ ID NO: 7467 - DNA, 20 bp, Artificial Sequence
  chemically synthesized
aggggttcagacctgtgttg

SEQ ID NO: 7468 - DNA, 20 bp, Artificial Sequence
  chemically synthesized
cttgtttgtttgtttttcct

SEQ ID NO: 7469 - DNA, 20 bp, Artificial Sequence
  chemically synthesized
tgtttgtttgtttttcctca

SEQ ID NO: 7470 - DNA, 20 bp, Artificial Sequence
  chemically synthesized
tgtttgtttttcctcagaga

SEQ ID NO: 7471 - DNA, 20 bp, Artificial Sequence
  chemically synthesized
gtttgtttttcctcagagac

SEQ ID NO: 7472 - DNA, 20 bp, Artificial Sequence
  chemically synthesized
tttcctcagagacaggatct

SEQ ID NO: 7473 - DNA, 20 bp, Artificial Sequence
  chemically synthesized
gagacaggatctcagtcacc

SEQ ID NO: 7474 - DNA, 20 bp, Artificial Sequence
  chemically synthesized
agacaggatctcagtcacca

SEQ ID NO: 7475 - DNA, 20 bp, Artificial Sequence
  chemically synthesized
aggatctcagtcaccaaggc

SEQ ID NO: 7476 - DNA, 20 bp, Artificial Sequence
  chemically synthesized
gatctcagtcaccaaggcta

SEQ ID NO: 7477 - DNA, 20 bp, Artificial Sequence
  chemically synthesized
tctcagtcaccaaggctaga

SEQ ID NO: 7478 - DNA, 20 bp, Artificial Sequence
  chemically synthesized
cagtcaccaaggctagagag

SEQ ID NO: 7479 - DNA, 20 bp, Artificial Sequence
  chemically synthesized
tcaccaaggctagagagcag

SEQ ID NO: 7480 - DNA, 20 bp, Artificial Sequence
  chemically synthesized
tcactgcaaccctgaaatcc

SEQ ID NO: 7481 - DNA, 20 bp, Artificial Sequence
  chemically synthesized
cactgcaaccctgaaatcct

SEQ ID NO: 7482 - DNA, 20 bp, Artificial Sequence
  chemically synthesized
aaccctgaaatcctgggctc

SEQ ID NO: 7483 - DNA, 20 bp, Artificial Sequence
  chemically synthesized
ctcaagtgatcctatcactt

SEQ ID NO: 7484 - DNA, 20 bp, Artificial Sequence
  chemically synthesized
atcctatcacttcagcctcc

SEQ ID NO: 7485 - DNA, 20 bp, Artificial Sequence
  chemically synthesized
tcctatcacttcagcctcct

SEQ ID NO: 7486 - DNA, 20 bp, Artificial Sequence
  chemically synthesized
acttcagcctcctgggttac

SEQ ID NO: 7487 - DNA, 20 bp, Artificial Sequence
  chemically synthesized
cttcagcctcctgggttact

SEQ ID NO: 7488 - DNA, 20 bp, Artificial Sequence
  chemically synthesized
ctcctgggttactgggacta

SEQ ID NO: 7489 - DNA, 20 bp, Artificial Sequence
  chemically synthesized
gttactgggactacagatgc

SEQ ID NO: 7490 - DNA, 20 bp, Artificial Sequence
  chemically synthesized
cagatgcaagccactgtgcc

SEQ ID NO: 7491 - DNA, 20 bp, Artificial Sequence
  chemically synthesized
gcaagccactgtgcccagct

SEQ ID NO: 7492 - DNA, 20 bp, Artificial Sequence
  chemically synthesized
ctctttctttttattttaat

SEQ ID NO: 7493 - DNA, 20 bp, Artificial Sequence
  chemically synthesized
ttaattggtcactttgtttt

SEQ ID NO: 7494 - DNA, 20 bp, Artificial Sequence
  chemically synthesized
tcacctctgacttgacctcc

SEQ ID NO: 7495 - DNA, 20 bp, Artificial Sequence
  chemically synthesized
ttgtcaaatatttgacttaa

SEQ ID NO: 7496 - DNA, 20 bp, Artificial Sequence
  chemically synthesized
tgtcaaatatttgacttaat

SEQ ID NO: 7497 - DNA, 20 bp, Artificial Sequence
  chemically synthesized
tcaaatatttgacttaatgg

SEQ ID NO: 7498 - DNA, 20 bp, Artificial Sequence
  chemically synthesized
cttaatgggagactttcccc

SEQ ID NO: 7499 - DNA, 20 bp, Artificial Sequence
  chemically synthesized
ttcccctagcttgttgattc

SEQ ID NO: 7500 - DNA, 20 bp, Artificial Sequence
  chemically synthesized
ccagaaattcaactttattc

SEQ ID NO: 7501 - DNA, 20 bp, Artificial Sequence
  chemically synthesized
cagaaattcaactttattct

SEQ ID NO: 7502 - DNA, 20 bp, Artificial Sequence
  chemically synthesized
attcaactttattctaggct

SEQ ID NO: 7503 - DNA, 20 bp, Artificial Sequence
  chemically synthesized
ttctaggcttggctcctgtt

SEQ ID NO: 7504 - DNA, 20 bp, Artificial Sequence
  chemically synthesized
ctgtttagtattgctgcttt

SEQ ID NO: 7505 - DNA, 20 bp, Artificial Sequence
  chemically synthesized
ttgctgctttgagattgttc

SEQ ID NO: 7506 - DNA, 20 bp, Artificial Sequence
  chemically synthesized
tgttctggttcatgaaaaac

SEQ ID NO: 7507 - DNA, 20 bp, Artificial Sequence
  chemically synthesized
ctaaattcttataaacaaat

SEQ ID NO: 7508 - DNA, 20 bp, Artificial Sequence
  chemically synthesized
aattcttataaacaaataag

SEQ ID NO: 7509 - DNA, 20 bp, Artificial Sequence
  chemically synthesized
attcttataaacaaataaga

SEQ ID NO: 7510 - DNA, 20 bp, Artificial Sequence
  chemically synthesized
cttataaacaaataagaagg

SEQ ID NO: 7511 - DNA, 20 bp, Artificial Sequence
  chemically synthesized
caaataagaaggaagactct

SEQ ID NO: 7512 - DNA, 20 bp, Artificial Sequence
  chemically synthesized
ggaagactctcagaaatata

SEQ ID NO: 7513 - DNA, 20 bp, Artificial Sequence
  chemically synthesized
aagactctcagaaatatatg

SEQ ID NO: 7514 - DNA, 20 bp, Artificial Sequence
  chemically synthesized
gactctcagaaatatatgga

SEQ ID NO: 7515 - DNA, 20 bp, Artificial Sequence
  chemically synthesized
cagaaatatatggagagact

SEQ ID NO: 7516 - DNA, 20 bp, Artificial Sequence
  chemically synthesized
agaaatatatggagagactg

SEQ ID NO: 7517 - DNA, 20 bp, Artificial Sequence
  chemically synthesized
atatatggagagactgaggt

SEQ ID NO: 7518 - DNA, 20 bp, Artificial Sequence
  chemically synthesized
atatggagagactgaggtta

SEQ ID NO: 7519 - DNA, 20 bp, Artificial Sequence
  chemically synthesized
gagagactgaggttagagtt

SEQ ID NO: 7520 - DNA, 20 bp, Artificial Sequence
  chemically synthesized
gactgaggttagagttgagc

SEQ ID NO: 7521 - DNA, 20 bp, Artificial Sequence
  chemically synthesized
actgaggttagagttgagca

SEQ ID NO: 7522 - DNA, 20 bp, Artificial Sequence
  chemically synthesized
aaattttgtcacaactaatc

SEQ ID NO: 7523 - DNA, 20 bp, Artificial Sequence
  chemically synthesized
tgtcacaactaatctagttg

SEQ ID NO: 7524 - DNA, 20 bp, Artificial Sequence
  chemically synthesized
gtcacaactaatctagttga

SEQ ID NO: 7525 - DNA, 20 bp, Artificial Sequence
  chemically synthesized
tgaaggaatgttaactgact

SEQ ID NO: 7526 - DNA, 20 bp, Artificial Sequence
  chemically synthesized
ctaaatttctgtctatttca

SEQ ID NO: 7527 - DNA, 20 bp, Artificial Sequence
  chemically synthesized
aaatttctgtctatttcaaa

SEQ ID NO: 7528 - DNA, 20 bp, Artificial Sequence
  chemically synthesized
ttctgtctatttcaaagaga

SEQ ID NO: 7529 - DNA, 20 bp, Artificial Sequence
  chemically synthesized
caaagagaaagacttgataa

SEQ ID NO: 7530 - DNA, 20 bp, Artificial Sequence
  chemically synthesized
aagacttgataatggctcta

SEQ ID NO: 7531 - DNA, 20 bp, Artificial Sequence
  chemically synthesized
taatggctctacggatgtgt

SEQ ID NO: 7532 - DNA, 20 bp, Artificial Sequence
  chemically synthesized
gctctacggatgtgtgagat

SEQ ID NO: 7533 - DNA, 20 bp, Artificial Sequence
  chemically synthesized
atgtgtgagatcagttttaa

SEQ ID NO: 7534 - DNA, 20 bp, Artificial Sequence
  chemically synthesized
tgtgtgagatcagttttaat

SEQ ID NO: 7535 - DNA, 20 bp, Artificial Sequence
  chemically synthesized
tttttttattattatacttc

SEQ ID NO: 7536 - DNA, 20 bp, Artificial Sequence
  chemically synthesized
tattattatacttcaagttt

SEQ ID NO: 7537 - DNA, 20 bp, Artificial Sequence
  chemically synthesized
attattatacttcaagtttt

SEQ ID NO: 7538 - DNA, 20 bp, Artificial Sequence
  chemically synthesized
ttattatacttcaagtttta

SEQ ID NO: 7539 - DNA, 20 bp, Artificial Sequence
  chemically synthesized
gggtacatgtgcacaacatg

SEQ ID NO: 7540 - DNA, 20 bp, Artificial Sequence
  chemically synthesized
ggtacatgtgcacaacatgc

SEQ ID NO: 7541 - DNA, 20 bp, Artificial Sequence
  chemically synthesized
tatgtatacatgtgccatgt

SEQ ID NO: 7542 - DNA, 20 bp, Artificial Sequence
  chemically synthesized
gcacccattaactcgtcatt

SEQ ID NO: 7543 - DNA, 20 bp, Artificial Sequence
  chemically synthesized
attaactcgtcatttagcat

SEQ ID NO: 7544 - DNA, 20 bp, Artificial Sequence
  chemically synthesized
ttaactcgtcatttagcatt

SEQ ID NO: 7545 - DNA, 20 bp, Artificial Sequence
  chemically synthesized
ttagcattaggtatatctcc

SEQ ID NO: 7546 - DNA, 20 bp, Artificial Sequence
  chemically synthesized
ccctgccccccaccccataa

SEQ ID NO: 7547 - DNA, 20 bp, Artificial Sequence
  chemically synthesized
ccccaccccataacagtccc

SEQ ID NO: 7548 - DNA, 20 bp, Artificial Sequence
  chemically synthesized
ccaccccataacagtcccca

SEQ ID NO: 7549 - DNA, 20 bp, Artificial Sequence
  chemically synthesized
attgttcaattcccacctat

SEQ ID NO: 7550 - DNA, 20 bp, Artificial Sequence
  chemically synthesized
ttcaattcccacctatgagt

SEQ ID NO: 7551 - DNA, 20 bp, Artificial Sequence
  chemically synthesized
cacctatgagtgagaacatg

SEQ ID NO: 7552 - DNA, 20 bp, Artificial Sequence
  chemically synthesized
gagtgagaacatgcggtgtt

SEQ ID NO: 7553 - DNA, 20 bp, Artificial Sequence
  chemically synthesized
ttggtttattctccttgtga

SEQ ID NO: 7554 - DNA, 20 bp, Artificial Sequence
  chemically synthesized
tctccttgtgatagtttgct

SEQ ID NO: 7555 - DNA, 20 bp, Artificial Sequence
  chemically synthesized
tgatagtttgctgagaatga

SEQ ID NO: 7556 - DNA, 20 bp, Artificial Sequence
  chemically synthesized
ttgctgagaatgatagtttc

SEQ ID NO: 7557 - DNA, 20 bp, Artificial Sequence
  chemically synthesized
gcttcatccatgtccctaca

SEQ ID NO: 7558 - DNA, 20 bp, Artificial Sequence
  chemically synthesized
cttcatccatgtccctacaa

SEQ ID NO: 7559 - DNA, 20 bp, Artificial Sequence
  chemically synthesized
catgaactcatcatttttta

SEQ ID NO: 7560 - DNA, 20 bp, Artificial Sequence
  chemically synthesized
catcattttttatggctgca

SEQ ID NO: 7561 - DNA, 20 bp, Artificial Sequence
  chemically synthesized
tatggctgcatagtattcca

SEQ ID NO: 7562 - DNA, 20 bp, Artificial Sequence
  chemically synthesized
tgtgccacattttcttaatc

SEQ ID NO: 7563 - DNA, 20 bp, Artificial Sequence
  chemically synthesized
ttaatccagtctatcgttgt

SEQ ID NO: 7564 - DNA, 20 bp, Artificial Sequence
  chemically synthesized
gtctatcgttgttggacatt

SEQ ID NO: 7565 - DNA, 20 bp, Artificial Sequence
  chemically synthesized
tctatcgttgttggacattt

SEQ ID NO: 7566 - DNA, 20 bp, Artificial Sequence
  chemically synthesized
tcgttgttggacatttgggt

SEQ ID NO: 7567 - DNA, 20 bp, Artificial Sequence
  chemically synthesized
tggacatttgggttggttcc

SEQ ID NO: 7568 - DNA, 20 bp, Artificial Sequence
  chemically synthesized
caagtctttgctattgtgaa

SEQ ID NO: 7569 - DNA, 20 bp, Artificial Sequence
  chemically synthesized
tacgtgtgcatgtgtcttta

SEQ ID NO: 7570 - DNA, 20 bp, Artificial Sequence
  chemically synthesized
gtgtgcatgtgtctttatag

SEQ ID NO: 7571 - DNA, 20 bp, Artificial Sequence
  chemically synthesized
cagcatgatttataatcctt

SEQ ID NO: 7572 - DNA, 20 bp, Artificial Sequence
  chemically synthesized
agcatgatttataatccttt

SEQ ID NO: 7573 - DNA, 20 bp, Artificial Sequence
  chemically synthesized
taatcctttgggtatgtacc

SEQ ID NO: 7574 - DNA, 20 bp, Artificial Sequence
  chemically synthesized
tttgggtatgtacccagtaa

SEQ ID NO: 7575 - DNA, 20 bp, Artificial Sequence
  chemically synthesized
ttgggtatgtacccagtaat

SEQ ID NO: 7576 - DNA, 20 bp, Artificial Sequence
  chemically synthesized
gtatgtacccagtaatggga

SEQ ID NO: 7577 - DNA, 20 bp, Artificial Sequence
  chemically synthesized
gtacccagtaatgggatggc

SEQ ID NO: 7578 - DNA, 20 bp, Artificial Sequence
  chemically synthesized
tacccagtaatgggatggct

SEQ ID NO: 7579 - DNA, 20 bp, Artificial Sequence
  chemically synthesized
aatgggatggctgggtcaaa

SEQ ID NO: 7580 - DNA, 20 bp, Artificial Sequence
  chemically synthesized
gctgggtcaaatggtatttc

SEQ ID NO: 7581 - DNA, 20 bp, Artificial Sequence
  chemically synthesized
tcaaatggtatttctagttc

SEQ ID NO: 7582 - DNA, 20 bp, Artificial Sequence
  chemically synthesized
atttctagttctagattcct

SEQ ID NO: 7583 - DNA, 20 bp, Artificial Sequence
  chemically synthesized
tttctagttctagattcctg

SEQ ID NO: 7584 - DNA, 20 bp, Artificial Sequence
  chemically synthesized
tgccacactgacttccgcaa

SEQ ID NO: 7585 - DNA, 20 bp, Artificial Sequence
  chemically synthesized
gacttccgcaatggttgaac

SEQ ID NO: 7586 - DNA, 20 bp, Artificial Sequence
  chemically synthesized
gcaatggttgaactagttta

SEQ ID NO: 7587 - DNA, 20 bp, Artificial Sequence
  chemically synthesized
ctagtttacagtcccaccaa

SEQ ID NO: 7588 - DNA, 20 bp, Artificial Sequence
  chemically synthesized
cagtcccaccaacagtgtaa

SEQ ID NO: 7589 - DNA, 20 bp, Artificial Sequence
  chemically synthesized
ctgtttctccacatcctctc

SEQ ID NO: 7590 - DNA, 20 bp, Artificial Sequence
  chemically synthesized
ttaatgatcgccattctaac

SEQ ID NO: 7591 - DNA, 20 bp, Artificial Sequence
  chemically synthesized
atcgccattctaactggtgt

SEQ ID NO: 7592 - DNA, 20 bp, Artificial Sequence
  chemically synthesized
ccattctaactggtgtgaga

SEQ ID NO: 7593 - DNA, 20 bp, Artificial Sequence
  chemically synthesized
tgtgagatggtatctcattg

SEQ ID NO: 7594 - DNA, 20 bp, Artificial Sequence
  chemically synthesized
tttgatttgcatttctctga

SEQ ID NO: 7595 - DNA, 20 bp, Artificial Sequence
  chemically synthesized
atttgcatttctctgatggc

SEQ ID NO: 7596 - DNA, 20 bp, Artificial Sequence
  chemically synthesized
ctctgatggctagtgatgat

SEQ ID NO: 7597 - DNA, 20 bp, Artificial Sequence
  chemically synthesized
cataaatgtcttcttttgcg

SEQ ID NO: 7598 - DNA, 20 bp, Artificial Sequence
  chemically synthesized
atcctttgcccactttttga

SEQ ID NO: 7599 - DNA, 20 bp, Artificial Sequence
  chemically synthesized
tcctttgcccactttttgat

SEQ ID NO: 7600 - DNA, 20 bp, Artificial Sequence
  chemically synthesized
cctttgcccactttttgatg

SEQ ID NO: 7601 - DNA, 20 bp, Artificial Sequence
  chemically synthesized
tttttcttgtaaatttgttt

SEQ ID NO: 7602 - DNA, 20 bp, Artificial Sequence
  chemically synthesized
aaatttgtttgagttcattg

SEQ ID NO: 7603 - DNA, 20 bp, Artificial Sequence
  chemically synthesized
tttgagttcattgtagattc

SEQ ID NO: 7604 - DNA, 20 bp, Artificial Sequence
  chemically synthesized
tcattgtagattctggatat

SEQ ID NO: 7605 - DNA, 20 bp, Artificial Sequence
  chemically synthesized
tctggatattagccctttgt

SEQ ID NO: 7606 - DNA, 20 bp, Artificial Sequence
  chemically synthesized
atattagccctttgtcagat

SEQ ID NO: 7607 - DNA, 20 bp, Artificial Sequence
  chemically synthesized
ttagccctttgtcagatgag

SEQ ID NO: 7608 - DNA, 20 bp, Artificial Sequence
  chemically synthesized
aaaaattttctcccattttg

SEQ ID NO: 7609 - DNA, 20 bp, Artificial Sequence
  chemically synthesized
aaaattttctcccattttgt

SEQ ID NO: 7610 - DNA, 20 bp, Artificial Sequence
  chemically synthesized
aggttgcctgttcactctga

SEQ ID NO: 7611 - DNA, 20 bp, Artificial Sequence
  chemically synthesized
ttgcctgttcactctgatgg

SEQ ID NO: 7612 - DNA, 20 bp, Artificial Sequence
  chemically synthesized
cactctgatggtagtttctt

SEQ ID NO: 7613 - DNA, 20 bp, Artificial Sequence
  chemically synthesized
tggtagtttctttagctgtg

SEQ ID NO: 7614 - DNA, 20 bp, Artificial Sequence
  chemically synthesized
tagtttctttagctgtgcag

SEQ ID NO: 7615 - DNA, 20 bp, Artificial Sequence
  chemically synthesized
ttagctgtgcagaagctctt

SEQ ID NO: 7616 - DNA, 20 bp, Artificial Sequence
  chemically synthesized
cagaagctctttagtttaat

SEQ ID NO: 7617 - DNA, 20 bp, Artificial Sequence
  chemically synthesized
tcttttgttgccattgcttt

SEQ ID NO: 7618 - DNA, 20 bp, Artificial Sequence
  chemically synthesized
tgccattgcttttggtgttt

SEQ ID NO: 7619 - DNA, 20 bp, Artificial Sequence
  chemically synthesized
cttttggtgttttagacatg

SEQ ID NO: 7620 - DNA, 20 bp, Artificial Sequence
  chemically synthesized
gcccatgcctatgtcctgaa

SEQ ID NO: 7621 - DNA, 20 bp, Artificial Sequence
  chemically synthesized
atgtcctgaatggtattgcc

SEQ ID NO: 7622 - DNA, 20 bp, Artificial Sequence
  chemically synthesized
tgtcctgaatggtattgcct

SEQ ID NO: 7623 - DNA, 20 bp, Artificial Sequence
  chemically synthesized
gtattgcctaggtttttttc

SEQ ID NO: 7624 - DNA, 20 bp, Artificial Sequence
  chemically synthesized
tattgcctaggtttttttct

SEQ ID NO: 7625 - DNA, 20 bp, Artificial Sequence
  chemically synthesized
attgcctaggtttttttcta

SEQ ID NO: 7626 - DNA, 20 bp, Artificial Sequence
  chemically synthesized
gtttttttctagggttttta

SEQ ID NO: 7627 - DNA, 20 bp, Artificial Sequence
  chemically synthesized
ttctagggtttttatggttt

SEQ ID NO: 7628 - DNA, 20 bp, Artificial Sequence
  chemically synthesized
tctagggtttttatggtttt

SEQ ID NO: 7629 - DNA, 20 bp, Artificial Sequence
  chemically synthesized
tggttttaggtctaacatgt

SEQ ID NO: 7630 - DNA, 20 bp, Artificial Sequence
  chemically synthesized
tcttgaattaatttttgtat

SEQ ID NO: 7631 - DNA, 20 bp, Artificial Sequence
  chemically synthesized
cttgaattaatttttgtata

SEQ ID NO: 7632 - DNA, 20 bp, Artificial Sequence
  chemically synthesized
ttaatttttgtataaggtgt

SEQ ID NO: 7633 - DNA, 20 bp, Artificial Sequence
  chemically synthesized
taatttttgtataaggtgta

SEQ ID NO: 7634 - DNA, 20 bp, Artificial Sequence
  chemically synthesized
tttttgtataaggtgtaagg

SEQ ID NO: 7635 - DNA, 20 bp, Artificial Sequence
  chemically synthesized
ttttgtataaggtgtaagga

SEQ ID NO: 7636 - DNA, 20 bp, Artificial Sequence
  chemically synthesized
tttgtataaggtgtaaggaa

SEQ ID NO: 7637 - DNA, 20 bp, Artificial Sequence
  chemically synthesized
taaggtgtaaggaagggatc

SEQ ID NO: 7638 - DNA, 20 bp, Artificial Sequence
  chemically synthesized
gtaaggaagggatccagttt

SEQ ID NO: 7639 - DNA, 20 bp, Artificial Sequence
  chemically synthesized
cagtttcagctttctacata

SEQ ID NO: 7640 - DNA, 20 bp, Artificial Sequence
  chemically synthesized
ttcagctttctacatatggc

SEQ ID NO: 7641 - DNA, 20 bp, Artificial Sequence
  chemically synthesized
gctttctacatatggctagc

SEQ ID NO: 7642 - DNA, 20 bp, Artificial Sequence
  chemically synthesized
atatggctagccagttttcc

SEQ ID NO: 7643 - DNA, 20 bp, Artificial Sequence
  chemically synthesized
tcccagcaccatttattaaa

SEQ ID NO: 7644 - DNA, 20 bp, Artificial Sequence
  chemically synthesized
cccagcaccatttattaaat

SEQ ID NO: 7645 - DNA, 20 bp, Artificial Sequence
  chemically synthesized
ccagcaccatttattaaata

SEQ ID NO: 7646 - DNA, 20 bp, Artificial Sequence
  chemically synthesized
tccccattgcttgtttctct

SEQ ID NO: 7647 - DNA, 20 bp, Artificial Sequence
  chemically synthesized
ccccattgcttgtttctctc

SEQ ID NO: 7648 - DNA, 20 bp, Artificial Sequence
  chemically synthesized
tgtttctctcaggtttgtca

SEQ ID NO: 7649 - DNA, 20 bp, Artificial Sequence
  chemically synthesized
ctctcaggtttgtcaaagat

SEQ ID NO: 7650 - DNA, 20 bp, Artificial Sequence
  chemically synthesized
caggtttgtcaaagatcaga

SEQ ID NO: 7651 - DNA, 20 bp, Artificial Sequence
  chemically synthesized
tgtcaaagatcagatagttg

SEQ ID NO: 7652 - DNA, 20 bp, Artificial Sequence
  chemically synthesized
atcagatagttgtagatatg

SEQ ID NO: 7653 - DNA, 20 bp, Artificial Sequence
  chemically synthesized
agatatgcggcattatttct

SEQ ID NO: 7654 - DNA, 20 bp, Artificial Sequence
  chemically synthesized
gatatgcggcattatttctg

SEQ ID NO: 7655 - DNA, 20 bp, Artificial Sequence
  chemically synthesized
atatgcggcattatttctga

SEQ ID NO: 7656 - DNA, 20 bp, Artificial Sequence
  chemically synthesized
agggctctgttctgttccat

SEQ ID NO: 7657 - DNA, 20 bp, Artificial Sequence
  chemically synthesized
tctgttctgttccattggtc

SEQ ID NO: 7658 - DNA, 20 bp, Artificial Sequence
  chemically synthesized
attggtctagatctctgttt

SEQ ID NO: 7659 - DNA, 20 bp, Artificial Sequence
  chemically synthesized
ctagatctctgttttggtac

SEQ ID NO: 7660 - DNA, 20 bp, Artificial Sequence
  chemically synthesized
gtaccagtaccatgctgttt

SEQ ID NO: 7661 - DNA, 20 bp, Artificial Sequence
  chemically synthesized
ccatgctgttttggttaccg

SEQ ID NO: 7662 - DNA, 20 bp, Artificial Sequence
  chemically synthesized
ttttggttaccgtagcattg

SEQ ID NO: 7663 - DNA, 20 bp, Artificial Sequence
  chemically synthesized
gttaccgtagcattgtagta

SEQ ID NO: 7664 - DNA, 20 bp, Artificial Sequence
  chemically synthesized
tagcattgtagtatagtttg

SEQ ID NO: 7665 - DNA, 20 bp, Artificial Sequence
  chemically synthesized
attgtagtatagtttgaagt

SEQ ID NO: 7666 - DNA, 20 bp, Artificial Sequence
  chemically synthesized
ttgtagtatagtttgaagtc

SEQ ID NO: 7667 - DNA, 20 bp, Artificial Sequence
  chemically synthesized
tagtatagtttgaagtcagg

SEQ ID NO: 7668 - DNA, 20 bp, Artificial Sequence
  chemically synthesized
gtcaggtagcgtgatgcctc

SEQ ID NO: 7669 - DNA, 20 bp, Artificial Sequence
  chemically synthesized
tgcctccagctttgttcttt

SEQ ID NO: 7670 - DNA, 20 bp, Artificial Sequence
  chemically synthesized
ccagctttgttcttttggct

SEQ ID NO: 7671 - DNA, 20 bp, Artificial Sequence
  chemically synthesized
cagctttgttcttttggctt

SEQ ID NO: 7672 - DNA, 20 bp, Artificial Sequence
  chemically synthesized
cttttggcttaggattgcct

SEQ ID NO: 7673 - DNA, 20 bp, Artificial Sequence
  chemically synthesized
ttaggattgccttggtgatg

SEQ ID NO: 7674 - DNA, 20 bp, Artificial Sequence
  chemically synthesized
taggattgccttggtgatgt

SEQ ID NO: 7675 - DNA, 20 bp, Artificial Sequence
  chemically synthesized
tggtgatgtgggctcttttt

SEQ ID NO: 7676 - DNA, 20 bp, Artificial Sequence
  chemically synthesized
ttggttccatatgaacttta

SEQ ID NO: 7677 - DNA, 20 bp, Artificial Sequence
  chemically synthesized
gttccatatgaactttaaag

SEQ ID NO: 7678 - DNA, 20 bp, Artificial Sequence
  chemically synthesized
aactttaaagtagttttttc

SEQ ID NO: 7679 - DNA, 20 bp, Artificial Sequence
  chemically synthesized
tagttttttccagttctgtg

SEQ ID NO: 7680 - DNA, 20 bp, Artificial Sequence
  chemically synthesized
tttttccagttctgtgaaga

SEQ ID NO: 7681 - DNA, 20 bp, Artificial Sequence
  chemically synthesized
agttctgtgaagaaagtcat

SEQ ID NO: 7682 - DNA, 20 bp, Artificial Sequence
  chemically synthesized
tctgtgaagaaagtcattgg

SEQ ID NO: 7683 - DNA, 20 bp, Artificial Sequence
  chemically synthesized
gaaagtcattggtagcttga

SEQ ID NO: 7684 - DNA, 20 bp, Artificial Sequence
  chemically synthesized
aaagtcattggtagcttgat

SEQ ID NO: 7685 - DNA, 20 bp, Artificial Sequence
  chemically synthesized
aagtcattggtagcttgatg

SEQ ID NO: 7686 - DNA, 20 bp, Artificial Sequence
  chemically synthesized
cattggtagcttgatgggga

SEQ ID NO: 7687 - DNA, 20 bp, Artificial Sequence
  chemically synthesized
attgaatctataaattacct

SEQ ID NO: 7688 - DNA, 20 bp, Artificial Sequence
  chemically synthesized
ttgaatctataaattacctt

SEQ ID NO: 7689 - DNA, 20 bp, Artificial Sequence
  chemically synthesized
aatctataaattaccttggg

SEQ ID NO: 7690 - DNA, 20 bp, Artificial Sequence
  chemically synthesized
tattgattcttcctacccat

SEQ ID NO: 7691 - DNA, 20 bp, Artificial Sequence
  chemically synthesized
attcttcctacccatgagca

SEQ ID NO: 7692 - DNA, 20 bp, Artificial Sequence
  chemically synthesized
gtatcctcttttatttcatt

SEQ ID NO: 7693 - DNA, 20 bp, Artificial Sequence
  chemically synthesized
tcctcttttatttcattgag

SEQ ID NO: 7694 - DNA, 20 bp, Artificial Sequence
  chemically synthesized
tcttttatttcattgagcag

SEQ ID NO: 7695 - DNA, 20 bp, Artificial Sequence
  chemically synthesized
tttcattgagcagtggtttg

SEQ ID NO: 7696 - DNA, 20 bp, Artificial Sequence
  chemically synthesized
gtggtttgtagttctccttg

SEQ ID NO: 7697 - DNA, 20 bp, Artificial Sequence
  chemically synthesized
ggtttgtagttctccttgaa

SEQ ID NO: 7698 - DNA, 20 bp, Artificial Sequence
  chemically synthesized
gtttgtagttctccttgaag

SEQ ID NO: 7699 - DNA, 20 bp, Artificial Sequence
  chemically synthesized
aggtccttcacatcccttgt

SEQ ID NO: 7700 - DNA, 20 bp, Artificial Sequence
  chemically synthesized
ccttcacatcccttgtaagt

SEQ ID NO: 7701 - DNA, 20 bp, Artificial Sequence
  chemically synthesized
tcccttgtaagttggattcc

SEQ ID NO: 7702 - DNA, 20 bp, Artificial Sequence
  chemically synthesized
cccttgtaagttggattcct

SEQ ID NO: 7703 - DNA, 20 bp, Artificial Sequence
  chemically synthesized
taggtattttattctctttg

SEQ ID NO: 7704 - DNA, 20 bp, Artificial Sequence
  chemically synthesized
ctctttgaagcaattgtgaa

SEQ ID NO: 7705 - DNA, 20 bp, Artificial Sequence
  chemically synthesized
tctttgaagcaattgtgaat

SEQ ID NO: 7706 - DNA, 20 bp, Artificial Sequence
  chemically synthesized
tttgaagcaattgtgaatgg

SEQ ID NO: 7707 - DNA, 20 bp, Artificial Sequence
  chemically synthesized
atgggagttcactcatgatt

SEQ ID NO: 7708 - DNA, 20 bp, Artificial Sequence
  chemically synthesized
gctctctgtttgtctgttat

SEQ ID NO: 7709 - DNA, 20 bp, Artificial Sequence
  chemically synthesized
gtttgtctgttattggtgca

SEQ ID NO: 7710 - DNA, 20 bp, Artificial Sequence
  chemically synthesized
tttgtctgttattggtgcat

SEQ ID NO: 7711 - DNA, 20 bp, Artificial Sequence
  chemically synthesized
gcacactgattttatatcct

SEQ ID NO: 7712 - DNA, 20 bp, Artificial Sequence
  chemically synthesized
tatatcctgagactttgctg

SEQ ID NO: 7713 - DNA, 20 bp, Artificial Sequence
  chemically synthesized
actttgctgaagttgcttat

SEQ ID NO: 7714 - DNA, 20 bp, Artificial Sequence
  chemically synthesized
ctgaagttgcttatcagctt

SEQ ID NO: 7715 - DNA, 20 bp, Artificial Sequence
  chemically synthesized
tgaagttgcttatcagctta

SEQ ID NO: 7716 - DNA, 20 bp, Artificial Sequence
  chemically synthesized
aagttgcttatcagcttaag

SEQ ID NO: 7717 - DNA, 20 bp, Artificial Sequence
  chemically synthesized
ttatcagcttaaggagattt

SEQ ID NO: 7718 - DNA, 20 bp, Artificial Sequence
  chemically synthesized
tatcagcttaaggagatttt

SEQ ID NO: 7719 - DNA, 20 bp, Artificial Sequence
  chemically synthesized
gcttaaggagattttgggct

SEQ ID NO: 7720 - DNA, 20 bp, Artificial Sequence
  chemically synthesized
gagattttgggctgagacaa

SEQ ID NO: 7721 - DNA, 20 bp, Artificial Sequence
  chemically synthesized
agattttgggctgagacaat

SEQ ID NO: 7722 - DNA, 20 bp, Artificial Sequence
  chemically synthesized
gattttgggctgagacaatg

SEQ ID NO: 7723 - DNA, 20 bp, Artificial Sequence
  chemically synthesized
gctgagacaatggggttttc

SEQ ID NO: 7724 - DNA, 20 bp, Artificial Sequence
  chemically synthesized
acaatcatgtcatctgcaaa

SEQ ID NO: 7725 - DNA, 20 bp, Artificial Sequence
  chemically synthesized
caatcatgtcatctgcaaac

SEQ ID NO: 7726 - DNA, 20 bp, Artificial Sequence
  chemically synthesized
aatcatgtcatctgcaaaca

SEQ ID NO: 7727 - DNA, 20 bp, Artificial Sequence
  chemically synthesized
cttctcctgcctgattgccc

SEQ ID NO: 7728 - DNA, 20 bp, Artificial Sequence
  chemically synthesized
tcctgcctgattgccctggc

SEQ ID NO: 7729 - DNA, 20 bp, Artificial Sequence
  chemically synthesized
acttacaacactatgttgaa

SEQ ID NO: 7730 - DNA, 20 bp, Artificial Sequence
  chemically synthesized
cttacaacactatgttgaat

SEQ ID NO: 7731 - DNA, 20 bp, Artificial Sequence
  chemically synthesized
tacaacactatgttgaatag

SEQ ID NO: 7732 - DNA, 20 bp, Artificial Sequence
  chemically synthesized
aacactatgttgaataggag

SEQ ID NO: 7733 - DNA, 20 bp, Artificial Sequence
  chemically synthesized
ctatgttgaataggagtggt

SEQ ID NO: 7734 - DNA, 20 bp, Artificial Sequence
  chemically synthesized
atgttgaataggagtggtga

SEQ ID NO: 7735 - DNA, 20 bp, Artificial Sequence
  chemically synthesized
gttgaataggagtggtgaga

SEQ ID NO: 7736 - DNA, 20 bp, Artificial Sequence
  chemically synthesized
ttgaataggagtggtgagag

SEQ ID NO: 7737 - DNA, 20 bp, Artificial Sequence
  chemically synthesized
tgaataggagtggtgagaga

SEQ ID NO: 7738 - DNA, 20 bp, Artificial Sequence
  chemically synthesized
agggcatccctgccttgtgc

SEQ ID NO: 7739 - DNA, 20 bp, Artificial Sequence
  chemically synthesized
ctgccttgtgccagttttca

SEQ ID NO: 7740 - DNA, 20 bp, Artificial Sequence
  chemically synthesized
tgccttgtgccagttttcaa

SEQ ID NO: 7741 - DNA, 20 bp, Artificial Sequence
  chemically synthesized
gccttgtgccagttttcaaa

SEQ ID NO: 7742 - DNA, 20 bp, Artificial Sequence
  chemically synthesized
gttttcaaagggaatgcttc

SEQ ID NO: 7743 - DNA, 20 bp, Artificial Sequence
  chemically synthesized
gcttccagtttttgtccact

SEQ ID NO: 7744 - DNA, 20 bp, Artificial Sequence
  chemically synthesized
ttgtccactcagtatgatat

SEQ ID NO: 7745 - DNA, 20 bp, Artificial Sequence
  chemically synthesized
actcagtatgatattggctg

SEQ ID NO: 7746 - DNA, 20 bp, Artificial Sequence
  chemically synthesized
ctcagtatgatattggctgt

SEQ ID NO: 7747 - DNA, 20 bp, Artificial Sequence
  chemically synthesized
tattggctgtgggtttgtca

SEQ ID NO: 7748 - DNA, 20 bp, Artificial Sequence
  chemically synthesized
ggctgtgggtttgtcataga

SEQ ID NO: 7749 - DNA, 20 bp, Artificial Sequence
  chemically synthesized
tagatagctcttattatttt

SEQ ID NO: 7750 - DNA, 20 bp, Artificial Sequence
  chemically synthesized
ccatcaatacctaatttatt

SEQ ID NO: 7751 - DNA, 20 bp, Artificial Sequence
  chemically synthesized
atcaatacctaatttattga

SEQ ID NO: 7752 - DNA, 20 bp, Artificial Sequence
  chemically synthesized
cctaatttattgagagtttt

SEQ ID NO: 7753 - DNA, 20 bp, Artificial Sequence
  chemically synthesized
tattgagagtttttagcatg

SEQ ID NO: 7754 - DNA, 20 bp, Artificial Sequence
  chemically synthesized
agcgttgttgaattttgtca

SEQ ID NO: 7755 - DNA, 20 bp, Artificial Sequence
  chemically synthesized
gcgttgttgaattttgtcaa

SEQ ID NO: 7756 - DNA, 20 bp, Artificial Sequence
  chemically synthesized
aggccttttctgcatctatt

SEQ ID NO: 7757 - DNA, 20 bp, Artificial Sequence
  chemically synthesized
catctattgagataatcata

SEQ ID NO: 7758 - DNA, 20 bp, Artificial Sequence
  chemically synthesized
aatcatatggtttgtgtctt

SEQ ID NO: 7759 - DNA, 20 bp, Artificial Sequence
  chemically synthesized
ctttggttctgtttatatgc

SEQ ID NO: 7760 - DNA, 20 bp, Artificial Sequence
  chemically synthesized
ttgattttcgtatgttgaac

SEQ ID NO: 7761 - DNA, 20 bp, Artificial Sequence
  chemically synthesized
tatgttgaaccagccttgca

SEQ ID NO: 7762 - DNA, 20 bp, Artificial Sequence
  chemically synthesized
gttgaaccagccttgcatgg

SEQ ID NO: 7763 - DNA, 20 bp, Artificial Sequence
  chemically synthesized
ttgaaccagccttgcatggc

SEQ ID NO: 7764 - DNA, 20 bp, Artificial Sequence
  chemically synthesized
tgaaccagccttgcatggca

SEQ ID NO: 7765 - DNA, 20 bp, Artificial Sequence
  chemically synthesized
agccttgcatggcagggatg

SEQ ID NO: 7766 - DNA, 20 bp, Artificial Sequence
  chemically synthesized
ggatgaagcccacttgatca

SEQ ID NO: 7767 - DNA, 20 bp, Artificial Sequence
  chemically synthesized
tgaagcccacttgatcatgg

SEQ ID NO: 7768 - DNA, 20 bp, Artificial Sequence
  chemically synthesized
cccacttgatcatggtggat

SEQ ID NO: 7769 - DNA, 20 bp, Artificial Sequence
  chemically synthesized
atcatggtggatcagtttgc

SEQ ID NO: 7770 - DNA, 20 bp, Artificial Sequence
  chemically synthesized
cagtttgccagtattttatt

SEQ ID NO: 7771 - DNA, 20 bp, Artificial Sequence
  chemically synthesized
agtttgccagtattttattg

SEQ ID NO: 7772 - DNA, 20 bp, Artificial Sequence
  chemically synthesized
tttttgcatcaatgttcatc

SEQ ID NO: 7773 - DNA, 20 bp, Artificial Sequence
  chemically synthesized
ttttgcatcaatgttcatca

SEQ ID NO: 7774 - DNA, 20 bp, Artificial Sequence
  chemically synthesized
tcaatgttcatcaaggatat

SEQ ID NO: 7775 - DNA, 20 bp, Artificial Sequence
  chemically synthesized
tttttttgttgtgtctctgt

SEQ ID NO: 7776 - DNA, 20 bp, Artificial Sequence
  chemically synthesized
ttttttgttgtgtctctgtc

SEQ ID NO: 7777 - DNA, 20 bp, Artificial Sequence
  chemically synthesized
gttgtgtctctgtcaggctt

SEQ ID NO: 7778 - DNA, 20 bp, Artificial Sequence
  chemically synthesized
tctctgtcaggctttggtat

SEQ ID NO: 7779 - DNA, 20 bp, Artificial Sequence
  chemically synthesized
ctctgtcaggctttggtatc

SEQ ID NO: 7780 - DNA, 20 bp, Artificial Sequence
  chemically synthesized
ctttggtatcaggatgatgc

SEQ ID NO: 7781 - DNA, 20 bp, Artificial Sequence
  chemically synthesized
tgatgctggcctcataaaat

SEQ ID NO: 7782 - DNA, 20 bp, Artificial Sequence
  chemically synthesized
gctggcctcataaaatgagt

SEQ ID NO: 7783 - DNA, 20 bp, Artificial Sequence
  chemically synthesized
ctggcctcataaaatgagtt

SEQ ID NO: 7784 - DNA, 20 bp, Artificial Sequence
  chemically synthesized
tggcctcataaaatgagtta

SEQ ID NO: 7785 - DNA, 20 bp, Artificial Sequence
  chemically synthesized
gcctcataaaatgagttagg

SEQ ID NO: 7786 - DNA, 20 bp, Artificial Sequence
  chemically synthesized
cctcataaaatgagttaggg

SEQ ID NO: 7787 - DNA, 20 bp, Artificial Sequence
  chemically synthesized
ttccctctttttctattgat

SEQ ID NO: 7788 - DNA, 20 bp, Artificial Sequence
  chemically synthesized
tctttttctattgattggaa

SEQ ID NO: 7789 - DNA, 20 bp, Artificial Sequence
  chemically synthesized
tctattgattggaatagttt

SEQ ID NO: 7790 - DNA, 20 bp, Artificial Sequence
  chemically synthesized
attgattggaatagtttcag

SEQ ID NO: 7791 - DNA, 20 bp, Artificial Sequence
  chemically synthesized
ttgattggaatagtttcaga

SEQ ID NO: 7792 - DNA, 20 bp, Artificial Sequence
  chemically synthesized
tggaatagtttcagaaggaa

SEQ ID NO: 7793 - DNA, 20 bp, Artificial Sequence
  chemically synthesized
agtttcagaaggaatggtac

SEQ ID NO: 7794 - DNA, 20 bp, Artificial Sequence
  chemically synthesized
ccagctcctccttgtacctc

SEQ ID NO: 7795 - DNA, 20 bp, Artificial Sequence
  chemically synthesized
gctcctccttgtacctctgg

SEQ ID NO: 7796 - DNA, 20 bp, Artificial Sequence
  chemically synthesized
cttgtacctctggtagaatt

SEQ ID NO: 7797 - DNA, 20 bp, Artificial Sequence
  chemically synthesized
aattcggctatgaatcctac

SEQ ID NO: 7798 - DNA, 20 bp, Artificial Sequence
  chemically synthesized
gctatgaatcctactggtcc

SEQ ID NO: 7799 - DNA, 20 bp, Artificial Sequence
  chemically synthesized
tactggtcccggactttttt

SEQ ID NO: 7800 - DNA, 20 bp, Artificial Sequence
  chemically synthesized
ccggactttttttggttgat

SEQ ID NO: 7801 - DNA, 20 bp, Artificial Sequence
  chemically synthesized
attaattattgcctcaattt

SEQ ID NO: 7802 - DNA, 20 bp, Artificial Sequence
  chemically synthesized
taattattgcctcaatttca

SEQ ID NO: 7803 - DNA, 20 bp, Artificial Sequence
  chemically synthesized
tcaatttcagagcctgttat

SEQ ID NO: 7804 - DNA, 20 bp, Artificial Sequence
  chemically synthesized
gagcctgttattggtctatt

SEQ ID NO: 7805 - DNA, 20 bp, Artificial Sequence
  chemically synthesized
gcctgttattggtctattca

SEQ ID NO: 7806 - DNA, 20 bp, Artificial Sequence
  chemically synthesized
tcagagatacaacttcttcc

SEQ ID NO: 7807 - DNA, 20 bp, Artificial Sequence
  chemically synthesized
gatacaacttcttcctggtt

SEQ ID NO: 7808 - DNA, 20 bp, Artificial Sequence
  chemically synthesized
acttcttcctggtttagtct

SEQ ID NO: 7809 - DNA, 20 bp, Artificial Sequence
  chemically synthesized
tcttcctggtttagtcttgg

SEQ ID NO: 7810 - DNA, 20 bp, Artificial Sequence
  chemically synthesized
ttcctggtttagtcttggca

SEQ ID NO: 7811 - DNA, 20 bp, Artificial Sequence
  chemically synthesized
cttggcagagtgtatgtgtc

SEQ ID NO: 7812 - DNA, 20 bp, Artificial Sequence
  chemically synthesized
ttggcagagtgtatgtgtcg

SEQ ID NO: 7813 - DNA, 20 bp, Artificial Sequence
  chemically synthesized
aggaatttatccatttcttc

SEQ ID NO: 7814 - DNA, 20 bp, Artificial Sequence
  chemically synthesized
tccatttcttctagattttc

SEQ ID NO: 7815 - DNA, 20 bp, Artificial Sequence
  chemically synthesized
gattttctagtttatttgcg

SEQ ID NO: 7816 - DNA, 20 bp, Artificial Sequence
  chemically synthesized
ttttctagtttatttgcgta

SEQ ID NO: 7817 - DNA, 20 bp, Artificial Sequence
  chemically synthesized
tttctagtttatttgcgtag

SEQ ID NO: 7818 - DNA, 20 bp, Artificial Sequence
  chemically synthesized
tatttgcgtagaggtgttta

SEQ ID NO: 7819 - DNA, 20 bp, Artificial Sequence
  chemically synthesized
gtgtttatagtattctctga

SEQ ID NO: 7820 - DNA, 20 bp, Artificial Sequence
  chemically synthesized
tttatagtattctctgacgg

SEQ ID NO: 7821 - DNA, 20 bp, Artificial Sequence
  chemically synthesized
gacggtagtttgtatttctg

SEQ ID NO: 7822 - DNA, 20 bp, Artificial Sequence
  chemically synthesized
acggtagtttgtatttctgt

SEQ ID NO: 7823 - DNA, 20 bp, Artificial Sequence
  chemically synthesized
agtttgtatttctgtgggat

SEQ ID NO: 7824 - DNA, 20 bp, Artificial Sequence
  chemically synthesized
ttgtatttctgtgggatcag

SEQ ID NO: 7825 - DNA, 20 bp, Artificial Sequence
  chemically synthesized
ttctctcttttcttctttat

SEQ ID NO: 7826 - DNA, 20 bp, Artificial Sequence
  chemically synthesized
ttcttctttattagtcttgc

SEQ ID NO: 7827 - DNA, 20 bp, Artificial Sequence
  chemically synthesized
ttctttattagtcttgctag

SEQ ID NO: 7828 - DNA, 20 bp, Artificial Sequence
  chemically synthesized
tgttgatcttttcaaaaaaa

SEQ ID NO: 7829 - DNA, 20 bp, Artificial Sequence
  chemically synthesized
cttttcaaaaaaacagcttc

SEQ ID NO: 7830 - DNA, 20 bp, Artificial Sequence
  chemically synthesized
tggattcattgatttttttg

SEQ ID NO: 7831 - DNA, 20 bp, Artificial Sequence
  chemically synthesized
ggattcattgatttttttga

SEQ ID NO: 7832 - DNA, 20 bp, Artificial Sequence
  chemically synthesized
gattcattgatttttttgaa

SEQ ID NO: 7833 - DNA, 20 bp, Artificial Sequence
  chemically synthesized
cttcacttctgctctgatct

SEQ ID NO: 7834 - DNA, 20 bp, Artificial Sequence
  chemically synthesized
agttatttcttgtcttctgt

SEQ ID NO: 7835 - DNA, 20 bp, Artificial Sequence
  chemically synthesized
tgtgtttgctcctgcttctc

SEQ ID NO: 7836 - DNA, 20 bp, Artificial Sequence
  chemically synthesized
tagttttttaattgtgatgt

SEQ ID NO: 7837 - DNA, 20 bp, Artificial Sequence
  chemically synthesized
agttttttaattgtgatgtt

SEQ ID NO: 7838 - DNA, 20 bp, Artificial Sequence
  chemically synthesized
gttttttaattgtgatgtta

SEQ ID NO: 7839 - DNA, 20 bp, Artificial Sequence
  chemically synthesized
tgatgttagggtgtcaattt

SEQ ID NO: 7840 - DNA, 20 bp, Artificial Sequence
  chemically synthesized
atctttcctgctttcccttg

SEQ ID NO: 7841 - DNA, 20 bp, Artificial Sequence
  chemically synthesized
tctttcctgctttcccttgt

SEQ ID NO: 7842 - DNA, 20 bp, Artificial Sequence
  chemically synthesized
tgctttcccttgtgggcatt

SEQ ID NO: 7843 - DNA, 20 bp, Artificial Sequence
  chemically synthesized
acactgctttgaatgtgtct

SEQ ID NO: 7844 - DNA, 20 bp, Artificial Sequence
  chemically synthesized
actgctttgaatgtgtctca

SEQ ID NO: 7845 - DNA, 20 bp, Artificial Sequence
  chemically synthesized
tgaatgtgtctcagagattc

SEQ ID NO: 7846 - DNA, 20 bp, Artificial Sequence
  chemically synthesized
tgttgtgtctttgttctcgt

SEQ ID NO: 7847 - DNA, 20 bp, Artificial Sequence
  chemically synthesized
ctttgttctcgttggtttca

SEQ ID NO: 7848 - DNA, 20 bp, Artificial Sequence
  chemically synthesized
ccttcattttgttatgtacc

SEQ ID NO: 7849 - DNA, 20 bp, Artificial Sequence
  chemically synthesized
tcattttgttatgtacccag

SEQ ID NO: 7850 - DNA, 20 bp, Artificial Sequence
  chemically synthesized
ttatgtacccagtagtcatt

SEQ ID NO: 7851 - DNA, 20 bp, Artificial Sequence
  chemically synthesized
tatgtacccagtagtcattc

SEQ ID NO: 7852 - DNA, 20 bp, Artificial Sequence
  chemically synthesized
tgtacccagtagtcattcag

SEQ ID NO: 7853 - DNA, 20 bp, Artificial Sequence
  chemically synthesized
acccagtagtcattcaggag

SEQ ID NO: 7854 - DNA, 20 bp, Artificial Sequence
  chemically synthesized
cccagtagtcattcaggagc

SEQ ID NO: 7855 - DNA, 20 bp, Artificial Sequence
  chemically synthesized
tcattcaggagcaggctgtt

SEQ ID NO: 7856 - DNA, 20 bp, Artificial Sequence
  chemically synthesized
caggctgttcagtttccatg

SEQ ID NO: 7857 - DNA, 20 bp, Artificial Sequence
  chemically synthesized
tgttcagtttccatgtagct

SEQ ID NO: 7858 - DNA, 20 bp, Artificial Sequence
  chemically synthesized
tcagtttccatgtagctgag

SEQ ID NO: 7859 - DNA, 20 bp, Artificial Sequence
  chemically synthesized
ccatgtagctgagtggtttt

SEQ ID NO: 7860 - DNA, 20 bp, Artificial Sequence
  chemically synthesized
gtagctgagtggttttgagt

SEQ ID NO: 7861 - DNA, 20 bp, Artificial Sequence
  chemically synthesized
tgagtgagtttcttaatcct

SEQ ID NO: 7862 - DNA, 20 bp, Artificial Sequence
  chemically synthesized
agtttcttaatcctgagttc

SEQ ID NO: 7863 - DNA, 20 bp, Artificial Sequence
  chemically synthesized
gttctagtttgattgcactg

SEQ ID NO: 7864 - DNA, 20 bp, Artificial Sequence
  chemically synthesized
gtttgattgcactgtggtct

SEQ ID NO: 7865 - DNA, 20 bp, Artificial Sequence
  chemically synthesized
ttgattgcactgtggtctga

SEQ ID NO: 7866 - DNA, 20 bp, Artificial Sequence
  chemically synthesized
ttgcactgtggtctgagaga

SEQ ID NO: 7867 - DNA, 20 bp, Artificial Sequence
  chemically synthesized
gtctgagagacagtttgtta

SEQ ID NO: 7868 - DNA, 20 bp, Artificial Sequence
  chemically synthesized
tctgttcttttacatttgct

SEQ ID NO: 7869 - DNA, 20 bp, Artificial Sequence
  chemically synthesized
ctgttcttttacatttgctg

SEQ ID NO: 7870 - DNA, 20 bp, Artificial Sequence
  chemically synthesized
gttcttttacatttgctgag

SEQ ID NO: 7871 - DNA, 20 bp, Artificial Sequence
  chemically synthesized
tcttttacatttgctgagga

SEQ ID NO: 7872 - DNA, 20 bp, Artificial Sequence
  chemically synthesized
gagctttacttccaactatg

SEQ ID NO: 7873 - DNA, 20 bp, Artificial Sequence
  chemically synthesized
tttacttccaactatgtggt

SEQ ID NO: 7874 - DNA, 20 bp, Artificial Sequence
  chemically synthesized
tccaactatgtggtcagttt

SEQ ID NO: 7875 - DNA, 20 bp, Artificial Sequence
  chemically synthesized
ctatgtggtcagttttggaa

SEQ ID NO: 7876 - DNA, 20 bp, Artificial Sequence
  chemically synthesized
tatgtggtcagttttggaat

SEQ ID NO: 7877 - DNA, 20 bp, Artificial Sequence
  chemically synthesized
ggtcagttttggaataggtg

SEQ ID NO: 7878 - DNA, 20 bp, Artificial Sequence
  chemically synthesized
gttttggaataggtgtggtg

SEQ ID NO: 7879 - DNA, 20 bp, Artificial Sequence
  chemically synthesized
aggtgtggtgtggtgctgaa

SEQ ID NO: 7880 - DNA, 20 bp, Artificial Sequence
  chemically synthesized
gaatgtatattctgttgatt

SEQ ID NO: 7881 - DNA, 20 bp, Artificial Sequence
  chemically synthesized
aatgtatattctgttgattt

SEQ ID NO: 7882 - DNA, 20 bp, Artificial Sequence
  chemically synthesized
atgtatattctgttgatttg

SEQ ID NO: 7883 - DNA, 20 bp, Artificial Sequence
  chemically synthesized
tatattctgttgatttgggg

SEQ ID NO: 7884 - DNA, 20 bp, Artificial Sequence
  chemically synthesized
tattctgttgatttggggtg

SEQ ID NO: 7885 - DNA, 20 bp, Artificial Sequence
  chemically synthesized
ttctgttgatttggggtgga

SEQ ID NO: 7886 - DNA, 20 bp, Artificial Sequence
  chemically synthesized
atttggggtggagagttctg

SEQ ID NO: 7887 - DNA, 20 bp, Artificial Sequence
  chemically synthesized
agagttctgtagatgtctat

SEQ ID NO: 7888 - DNA, 20 bp, Artificial Sequence
  chemically synthesized
gagttctgtagatgtctatt

SEQ ID NO: 7889 - DNA, 20 bp, Artificial Sequence
  chemically synthesized
agatgtctattaggtctgct

SEQ ID NO: 7890 - DNA, 20 bp, Artificial Sequence
  chemically synthesized
tctattaggtctgcttggtg

SEQ ID NO: 7891 - DNA, 20 bp, Artificial Sequence
  chemically synthesized
tattaggtctgcttggtgca

SEQ ID NO: 7892 - DNA, 20 bp, Artificial Sequence
  chemically synthesized
ggtctgcttggtgcagagct

SEQ ID NO: 7893 - DNA, 20 bp, Artificial Sequence
  chemically synthesized
gcagagctgagtccaattcc

SEQ ID NO: 7894 - DNA, 20 bp, Artificial Sequence
  chemically synthesized
gttgatctgtctaatgttga

SEQ ID NO: 7895 - DNA, 20 bp, Artificial Sequence
  chemically synthesized
gatctgtctaatgttgacag

SEQ ID NO: 7896 - DNA, 20 bp, Artificial Sequence
  chemically synthesized
atctgtctaatgttgacagt

SEQ ID NO: 7897 - DNA, 20 bp, Artificial Sequence
  chemically synthesized
tctgtctaatgttgacagtg

SEQ ID NO: 7898 - DNA, 20 bp, Artificial Sequence
  chemically synthesized
atgttgacagtggggtgtta

SEQ ID NO: 7899 - DNA, 20 bp, Artificial Sequence
  chemically synthesized
agtctcccattattattgtg

SEQ ID NO: 7900 - DNA, 20 bp, Artificial Sequence
  chemically synthesized
gtctcccattattattgtgt

SEQ ID NO: 7901 - DNA, 20 bp, Artificial Sequence
  chemically synthesized
ttattattgtgtgggcatct

SEQ ID NO: 7902 - DNA, 20 bp, Artificial Sequence
  chemically synthesized
tgggcatctaagtctctttg

SEQ ID NO: 7903 - DNA, 20 bp, Artificial Sequence
  chemically synthesized
gggcatctaagtctctttgt

SEQ ID NO: 7904 - DNA, 20 bp, Artificial Sequence
  chemically synthesized
aagtctctttgtaggtcact

SEQ ID NO: 7905 - DNA, 20 bp, Artificial Sequence
  chemically synthesized
agtctctttgtaggtcactc

SEQ ID NO: 7906 - DNA, 20 bp, Artificial Sequence
  chemically synthesized
caggacttgttttatgaatc

SEQ ID NO: 7907 - DNA, 20 bp, Artificial Sequence
  chemically synthesized
aggacttgttttatgaatct

SEQ ID NO: 7908 - DNA, 20 bp, Artificial Sequence
  chemically synthesized
gaatctgggtgctcctgtat

SEQ ID NO: 7909 - DNA, 20 bp, Artificial Sequence
  chemically synthesized
aatctgggtgctcctgtatt

SEQ ID NO: 7910 - DNA, 20 bp, Artificial Sequence
  chemically synthesized
gtattgggtgcatatatatt

SEQ ID NO: 7911 - DNA, 20 bp, Artificial Sequence
  chemically synthesized
gggtgcatatatatttagta

SEQ ID NO: 7912 - DNA, 20 bp, Artificial Sequence
  chemically synthesized
gcatatatatttagtatagt

SEQ ID NO: 7913 - DNA, 20 bp, Artificial Sequence
  chemically synthesized
agttagttcttcttcttgaa

SEQ ID NO: 7914 - DNA, 20 bp, Artificial Sequence
  chemically synthesized
atccctttgccattatgtaa

SEQ ID NO: 7915 - DNA, 20 bp, Artificial Sequence
  chemically synthesized
ttgtctcttttgatctttgt

SEQ ID NO: 7916 - DNA, 20 bp, Artificial Sequence
  chemically synthesized
tggtttaaaatctgttttat

SEQ ID NO: 7917 - DNA, 20 bp, Artificial Sequence
  chemically synthesized
gtttaaaatctgttttatca

SEQ ID NO: 7918 - DNA, 20 bp, Artificial Sequence
  chemically synthesized
aaatctgttttatcagagac

SEQ ID NO: 7919 - DNA, 20 bp, Artificial Sequence
  chemically synthesized
aatctgttttatcagagact

SEQ ID NO: 7920 - DNA, 20 bp, Artificial Sequence
  chemically synthesized
ttttttgttttccatttgct

SEQ ID NO: 7921 - DNA, 20 bp, Artificial Sequence
  chemically synthesized
tttgttttccatttgcttgg

SEQ ID NO: 7922 - DNA, 20 bp, Artificial Sequence
  chemically synthesized
ttcctccatccttttatttc

SEQ ID NO: 7923 - DNA, 20 bp, Artificial Sequence
  chemically synthesized
ctatgtgtgtctctgcacgt

SEQ ID NO: 7924 - DNA, 20 bp, Artificial Sequence
  chemically synthesized
gtgtgtctctgcacgtgaga

SEQ ID NO: 7925 - DNA, 20 bp, Artificial Sequence
  chemically synthesized
tgtgtctctgcacgtgagat

SEQ ID NO: 7926 - DNA, 20 bp, Artificial Sequence
  chemically synthesized
tgagatgggtttcctgaata

SEQ ID NO: 7927 - DNA, 20 bp, Artificial Sequence
  chemically synthesized
ggtttcctgaatacagaaca

SEQ ID NO: 7928 - DNA, 20 bp, Artificial Sequence
  chemically synthesized
tcctgaatacagaacacaga

SEQ ID NO: 7929 - DNA, 20 bp, Artificial Sequence
  chemically synthesized
cctgaatacagaacacagat

SEQ ID NO: 7930 - DNA, 20 bp, Artificial Sequence
  chemically synthesized
tgactccttatccaatttgc

SEQ ID NO: 7931 - DNA, 20 bp, Artificial Sequence
  chemically synthesized
gccagtctgtgtcttttaat

SEQ ID NO: 7932 - DNA, 20 bp, Artificial Sequence
  chemically synthesized
cagtctgtgtcttttaattg

SEQ ID NO: 7933 - DNA, 20 bp, Artificial Sequence
  chemically synthesized
tgtcttttaattggagcatt

SEQ ID NO: 7934 - DNA, 20 bp, Artificial Sequence
  chemically synthesized
catttagcctatttacattt

SEQ ID NO: 7935 - DNA, 20 bp, Artificial Sequence
  chemically synthesized
atttagcctatttacattta

SEQ ID NO: 7936 - DNA, 20 bp, Artificial Sequence
  chemically synthesized
agcctatttacatttaaggt

SEQ ID NO: 7937 - DNA, 20 bp, Artificial Sequence
  chemically synthesized
tgatcctgtcattatgatgt

SEQ ID NO: 7938 - DNA, 20 bp, Artificial Sequence
  chemically synthesized
cctgtcattatgatgttagc

SEQ ID NO: 7939 - DNA, 20 bp, Artificial Sequence
  chemically synthesized
ggttattttgctcgttgatg

SEQ ID NO: 7940 - DNA, 20 bp, Artificial Sequence
  chemically synthesized
tcgttgatgcagtttcttcc

SEQ ID NO: 7941 - DNA, 20 bp, Artificial Sequence
  chemically synthesized
cagtttcttcctagccttga

SEQ ID NO: 7942 - DNA, 20 bp, Artificial Sequence
  chemically synthesized
ccttgatggtctttacaatt

SEQ ID NO: 7943 - DNA, 20 bp, Artificial Sequence
  chemically synthesized
tacaatttggcatgtttttg

SEQ ID NO: 7944 - DNA, 20 bp, Artificial Sequence
  chemically synthesized
aatttggcatgtttttgcag

SEQ ID NO: 7945 - DNA, 20 bp, Artificial Sequence
  chemically synthesized
gtttttgcagtggctgatac

SEQ ID NO: 7946 - DNA, 20 bp, Artificial Sequence
  chemically synthesized
tagttgttcctttccatgtt

SEQ ID NO: 7947 - DNA, 20 bp, Artificial Sequence
  chemically synthesized
tccatgtttagtgcttcctt

SEQ ID NO: 7948 - DNA, 20 bp, Artificial Sequence
  chemically synthesized
ccatgtttagtgcttccttc

SEQ ID NO: 7949 - DNA, 20 bp, Artificial Sequence
  chemically synthesized
atgtttagtgcttccttcag

SEQ ID NO: 7950 - DNA, 20 bp, Artificial Sequence
  chemically synthesized
gcttccttcaggagctcttg

SEQ ID NO: 7951 - DNA, 20 bp, Artificial Sequence
  chemically synthesized
cttccttcaggagctcttgt

SEQ ID NO: 7952 - DNA, 20 bp, Artificial Sequence
  chemically synthesized
ttccttcaggagctcttgta

SEQ ID NO: 7953 - DNA, 20 bp, Artificial Sequence
  chemically synthesized
cttcaggagctcttgtaggg

SEQ ID NO: 7954 - DNA, 20 bp, Artificial Sequence
  chemically synthesized
ttcaggagctcttgtagggc

SEQ ID NO: 7955 - DNA, 20 bp, Artificial Sequence
  chemically synthesized
gagctcttgtagggcaggcc

SEQ ID NO: 7956 - DNA, 20 bp, Artificial Sequence
  chemically synthesized
ctcttgtagggcaggcctgg

SEQ ID NO: 7957 - DNA, 20 bp, Artificial Sequence
  chemically synthesized
ctggtggtgacaaaatctct

SEQ ID NO: 7958 - DNA, 20 bp, Artificial Sequence
  chemically synthesized
tcagcatttgcttgtctgta

SEQ ID NO: 7959 - DNA, 20 bp, Artificial Sequence
  chemically synthesized
cagcatttgcttgtctgtaa

SEQ ID NO: 7960 - DNA, 20 bp, Artificial Sequence
  chemically synthesized
ttatttctccttcacttatg

SEQ ID NO: 7961 - DNA, 20 bp, Artificial Sequence
  chemically synthesized
tctccttcacttatgaagct

SEQ ID NO: 7962 - DNA, 20 bp, Artificial Sequence
  chemically synthesized
ttcacttatgaagcttagtt

SEQ ID NO: 7963 - DNA, 20 bp, Artificial Sequence
  chemically synthesized
cttatgaagcttagtttggc

SEQ ID NO: 7964 - DNA, 20 bp, Artificial Sequence
  chemically synthesized
tttggctggatatgaaattc

SEQ ID NO: 7965 - DNA, 20 bp, Artificial Sequence
  chemically synthesized
ttggctggatatgaaattct

SEQ ID NO: 7966 - DNA, 20 bp, Artificial Sequence
  chemically synthesized
tctttaacaatgttgaatat

SEQ ID NO: 7967 - DNA, 20 bp, Artificial Sequence
  chemically synthesized
tattggcccccactttcttc

SEQ ID NO: 7968 - DNA, 20 bp, Artificial Sequence
  chemically synthesized
ccccactttcttctggcttg

SEQ ID NO: 7969 - DNA, 20 bp, Artificial Sequence
  chemically synthesized
ccactttcttctggcttgta

SEQ ID NO: 7970 - DNA, 20 bp, Artificial Sequence
  chemically synthesized
gcttgtagagtttctgccga

SEQ ID NO: 7971 - DNA, 20 bp, Artificial Sequence
  chemically synthesized
tagagtttctgccgatagat

SEQ ID NO: 7972 - DNA, 20 bp, Artificial Sequence
  chemically synthesized
tctgccgatagatcagctgt

SEQ ID NO: 7973 - DNA, 20 bp, Artificial Sequence
  chemically synthesized
tagatcagctgttagtctga

SEQ ID NO: 7974 - DNA, 20 bp, Artificial Sequence
  chemically synthesized
agatcagctgttagtctgat

SEQ ID NO: 7975 - DNA, 20 bp, Artificial Sequence
  chemically synthesized
gtctgatgggcttccctttg

SEQ ID NO: 7976 - DNA, 20 bp, Artificial Sequence
  chemically synthesized
tctgatgggcttccctttgt

SEQ ID NO: 7977 - DNA, 20 bp, Artificial Sequence
  chemically synthesized
ggtaacccgacctttctctc

SEQ ID NO: 7978 - DNA, 20 bp, Artificial Sequence
  chemically synthesized
tttttccttcatttcaactt

SEQ ID NO: 7979 - DNA, 20 bp, Artificial Sequence
  chemically synthesized
ttcaactttggtgaatctga

SEQ ID NO: 7980 - DNA, 20 bp, Artificial Sequence
  chemically synthesized
aatctgacagttatgtgtct

SEQ ID NO: 7981 - DNA, 20 bp, Artificial Sequence
  chemically synthesized
tctgacagttatgtgtcttg

SEQ ID NO: 7982 - DNA, 20 bp, Artificial Sequence
  chemically synthesized
gtcttggagttgcttttctc

SEQ ID NO: 7983 - DNA, 20 bp, Artificial Sequence
  chemically synthesized
tcttggagttgcttttctct

SEQ ID NO: 7984 - DNA, 20 bp, Artificial Sequence
  chemically synthesized
ttggagttgcttttctctag

SEQ ID NO: 7985 - DNA, 20 bp, Artificial Sequence
  chemically synthesized
tttctctaggagtatctttg

SEQ ID NO: 7986 - DNA, 20 bp, Artificial Sequence
  chemically synthesized
gtatttcctgaatgtgaatt

SEQ ID NO: 7987 - DNA, 20 bp, Artificial Sequence
  chemically synthesized
tatttcctgaatgtgaattt

SEQ ID NO: 7988 - DNA, 20 bp, Artificial Sequence
  chemically synthesized
tgaatttgggcttgccttgc

SEQ ID NO: 7989 - DNA, 20 bp, Artificial Sequence
  chemically synthesized
ttgggcttgccttgctagat

SEQ ID NO: 7990 - DNA, 20 bp, Artificial Sequence
  chemically synthesized
tgggcttgccttgctagatt

SEQ ID NO: 7991 - DNA, 20 bp, Artificial Sequence
  chemically synthesized
gggcttgccttgctagattg

SEQ ID NO: 7992 - DNA, 20 bp, Artificial Sequence
  chemically synthesized
cttgccttgctagattgggg

SEQ ID NO: 7993 - DNA, 20 bp, Artificial Sequence
  chemically synthesized
ctagattggggaagttctcc

SEQ ID NO: 7994 - DNA, 20 bp, Artificial Sequence
  chemically synthesized
ttctcctggataatatcctg

SEQ ID NO: 7995 - DNA, 20 bp, Artificial Sequence
  chemically synthesized
ctcctggataatatcctgca

SEQ ID NO: 7996 - DNA, 20 bp, Artificial Sequence
  chemically synthesized
ctgcagagtgttttccaact

SEQ ID NO: 7997 - DNA, 20 bp, Artificial Sequence
  chemically synthesized
tccattctccccatcacttt

SEQ ID NO: 7998 - DNA, 20 bp, Artificial Sequence
  chemically synthesized
tcactttcagctacaccaat

SEQ ID NO: 7999 - DNA, 20 bp, Artificial Sequence
  chemically synthesized
tcagctacaccaattagatg

SEQ ID NO: 8000 - DNA, 20 bp, Artificial Sequence
  chemically synthesized
acaccaattagatgtagatt

SEQ ID NO: 8001 - DNA, 20 bp, Artificial Sequence
  chemically synthesized
gtagatttggtcttttcaca

SEQ ID NO: 8002 - DNA, 20 bp, Artificial Sequence
  chemically synthesized
tcacatagtcccatatttct

SEQ ID NO: 8003 - DNA, 20 bp, Artificial Sequence
  chemically synthesized
acatagtcccatatttcttg

SEQ ID NO: 8004 - DNA, 20 bp, Artificial Sequence
  chemically synthesized
catagtcccatatttcttgg

SEQ ID NO: 8005 - DNA, 20 bp, Artificial Sequence
  chemically synthesized
gtcattgataccctttcttc

SEQ ID NO: 8006 - DNA, 20 bp, Artificial Sequence
  chemically synthesized
tttcttccagttgatctcat

SEQ ID NO: 8007 - DNA, 20 bp, Artificial Sequence
  chemically synthesized
agttgatctcatcggttact

SEQ ID NO: 8008 - DNA, 20 bp, Artificial Sequence
  chemically synthesized
gttgatctcatcggttactg

SEQ ID NO: 8009 - DNA, 20 bp, Artificial Sequence
  chemically synthesized
aggcttgtgtatttgtcacg

SEQ ID NO: 8010 - DNA, 20 bp, Artificial Sequence
  chemically synthesized
gtcacgtagttctcctgcct

SEQ ID NO: 8011 - DNA, 20 bp, Artificial Sequence
  chemically synthesized
agttctcctgccttggtttt

SEQ ID NO: 8012 - DNA, 20 bp, Artificial Sequence
  chemically synthesized
gccttggttttcagctccat

SEQ ID NO: 8013 - DNA, 20 bp, Artificial Sequence
  chemically synthesized
ccttggttttcagctccatc

SEQ ID NO: 8014 - DNA, 20 bp, Artificial Sequence
  chemically synthesized
tcagctccatcaggtccttt

SEQ ID NO: 8015 - DNA, 20 bp, Artificial Sequence
  chemically synthesized
cagctccatcaggtccttta

SEQ ID NO: 8016 - DNA, 20 bp, Artificial Sequence
  chemically synthesized
ctttaaggacttctgtgcat

SEQ ID NO: 8017 - DNA, 20 bp, Artificial Sequence
  chemically synthesized
cttctgtgcattggttattc

SEQ ID NO: 8018 - DNA, 20 bp, Artificial Sequence
  chemically synthesized
attcatctaattttttttca

SEQ ID NO: 8019 - DNA, 20 bp, Artificial Sequence
  chemically synthesized
tttgttcgaacttcctcctt

SEQ ID NO: 8020 - DNA, 20 bp, Artificial Sequence
  chemically synthesized
tcgaacttcctcctttagct

SEQ ID NO: 8021 - DNA, 20 bp, Artificial Sequence
  chemically synthesized
gaacttcctcctttagcttg

SEQ ID NO: 8022 - DNA, 20 bp, Artificial Sequence
  chemically synthesized
cttcctcctttagcttggag

SEQ ID NO: 8023 - DNA, 20 bp, Artificial Sequence
  chemically synthesized
tggagtagtttgatcttctg

SEQ ID NO: 8024 - DNA, 20 bp, Artificial Sequence
  chemically synthesized
cttcctctctcaactcgtca

SEQ ID NO: 8025 - DNA, 20 bp, Artificial Sequence
  chemically synthesized
cgtcaaagtcattctctgcc

SEQ ID NO: 8026 - DNA, 20 bp, Artificial Sequence
  chemically synthesized
gcccagctttgttccattgc

SEQ ID NO: 8027 - DNA, 20 bp, Artificial Sequence
  chemically synthesized
agctttgttccattgctggt

SEQ ID NO: 8028 - DNA, 20 bp, Artificial Sequence
  chemically synthesized
gctttgttccattgctggtg

SEQ ID NO: 8029 - DNA, 20 bp, Artificial Sequence
  chemically synthesized
tttgttccattgctggtgag

SEQ ID NO: 8030 - DNA, 20 bp, Artificial Sequence
  chemically synthesized
ggtgaggagctgcgttactt

SEQ ID NO: 8031 - DNA, 20 bp, Artificial Sequence
  chemically synthesized
tgaggagctgcgttactttg

SEQ ID NO: 8032 - DNA, 20 bp, Artificial Sequence
  chemically synthesized
gaggagctgcgttactttgg

SEQ ID NO: 8033 - DNA, 20 bp, Artificial Sequence
  chemically synthesized
ggagctgcgttactttggag

SEQ ID NO: 8034 - DNA, 20 bp, Artificial Sequence
  chemically synthesized
gagctgcgttactttggagg

SEQ ID NO: 8035 - DNA, 20 bp, Artificial Sequence
  chemically synthesized
gctgcgttactttggaggag

SEQ ID NO: 8036 - DNA, 20 bp, Artificial Sequence
  chemically synthesized
tgcgttactttggaggagga

SEQ ID NO: 8037 - DNA, 20 bp, Artificial Sequence
  chemically synthesized
gcgttactttggaggaggag

SEQ ID NO: 8038 - DNA, 20 bp, Artificial Sequence
  chemically synthesized
aggagaggcactctcatttt

SEQ ID NO: 8039 - DNA, 20 bp, Artificial Sequence
  chemically synthesized
gagaggcactctcattttta

SEQ ID NO: 8040 - DNA, 20 bp, Artificial Sequence
  chemically synthesized
actctcatttttagagtgtc

SEQ ID NO: 8041 - DNA, 20 bp, Artificial Sequence
  chemically synthesized
ctgctttttccccatcttta

SEQ ID NO: 8042 - DNA, 20 bp, Artificial Sequence
  chemically synthesized
tttatggttttatctacctt

SEQ ID NO: 8043 - DNA, 20 bp, Artificial Sequence
  chemically synthesized
ctacctttggtctttgatga

SEQ ID NO: 8044 - DNA, 20 bp, Artificial Sequence
  chemically synthesized
tctttgatgatggcgatgta

SEQ ID NO: 8045 - DNA, 20 bp, Artificial Sequence
  chemically synthesized
tgatgatggcgatgtacaga

SEQ ID NO: 8046 - DNA, 20 bp, Artificial Sequence
  chemically synthesized
gatgatggcgatgtacagat

SEQ ID NO: 8047 - DNA, 20 bp, Artificial Sequence
  chemically synthesized
gcgatgtacagatgggtttt

SEQ ID NO: 8048 - DNA, 20 bp, Artificial Sequence
  chemically synthesized
gtacagatgggtttttggtg

SEQ ID NO: 8049 - DNA, 20 bp, Artificial Sequence
  chemically synthesized
tggatgtcctttctgtttgt

SEQ ID NO: 8050 - DNA, 20 bp, Artificial Sequence
  chemically synthesized
tttgttagttttccttctaa

SEQ ID NO: 8051 - DNA, 20 bp, Artificial Sequence
  chemically synthesized
ttagttttccttctaacagt

SEQ ID NO: 8052 - DNA, 20 bp, Artificial Sequence
  chemically synthesized
tagttttccttctaacagtc

SEQ ID NO: 8053 - DNA, 20 bp, Artificial Sequence
  chemically synthesized
cttctaacagtcaggaccct

SEQ ID NO: 8054 - DNA, 20 bp, Artificial Sequence
  chemically synthesized
acagtcaggaccctcagctg

SEQ ID NO: 8055 - DNA, 20 bp, Artificial Sequence
  chemically synthesized
cagtcaggaccctcagctgc

SEQ ID NO: 8056 - DNA, 20 bp, Artificial Sequence
  chemically synthesized
accctcagctgcaggtctgt

SEQ ID NO: 8057 - DNA, 20 bp, Artificial Sequence
  chemically synthesized
cctcagctgcaggtctgttg

SEQ ID NO: 8058 - DNA, 20 bp, Artificial Sequence
  chemically synthesized
gcaggtctgttggagtttac

SEQ ID NO: 8059 - DNA, 20 bp, Artificial Sequence
  chemically synthesized
aggtctgttggagtttactg

SEQ ID NO: 8060 - DNA, 20 bp, Artificial Sequence
  chemically synthesized
ggtctgttggagtttactgg

SEQ ID NO: 8061 - DNA, 20 bp, Artificial Sequence
  chemically synthesized
agtttactggaggtccactc

SEQ ID NO: 8062 - DNA, 20 bp, Artificial Sequence
  chemically synthesized
ttactggaggtccactccag

SEQ ID NO: 8063 - DNA, 20 bp, Artificial Sequence
  chemically synthesized
cactccagaagctgttttcc

SEQ ID NO: 8064 - DNA, 20 bp, Artificial Sequence
  chemically synthesized
actccagaagctgttttcct

SEQ ID NO: 8065 - DNA, 20 bp, Artificial Sequence
  chemically synthesized
gctgttttcctgggtatcaa

SEQ ID NO: 8066 - DNA, 20 bp, Artificial Sequence
  chemically synthesized
gttttcctgggtatcaacag

SEQ ID NO: 8067 - DNA, 20 bp, Artificial Sequence
  chemically synthesized
ttcctgggtatcaacagcgg

SEQ ID NO: 8068 - DNA, 20 bp, Artificial Sequence
  chemically synthesized
ggtatcaacagcggtggctg

SEQ ID NO: 8069 - DNA, 20 bp, Artificial Sequence
  chemically synthesized
caacagcggtggctgcagaa

SEQ ID NO: 8070 - DNA, 20 bp, Artificial Sequence
  chemically synthesized
cagcggtggctgcagaacag

SEQ ID NO: 8071 - DNA, 20 bp, Artificial Sequence
  chemically synthesized
ggctgcagaacagtggatat

SEQ ID NO: 8072 - DNA, 20 bp, Artificial Sequence
  chemically synthesized
ctgctgcctgatcattcctc

SEQ ID NO: 8073 - DNA, 20 bp, Artificial Sequence
  chemically synthesized
ctgcctgatcattcctctgg

SEQ ID NO: 8074 - DNA, 20 bp, Artificial Sequence
  chemically synthesized
ttcctctggaagttttgtct

SEQ ID NO: 8075 - DNA, 20 bp, Artificial Sequence
  chemically synthesized
cctctggaagttttgtctta

SEQ ID NO: 8076 - DNA, 20 bp, Artificial Sequence
  chemically synthesized
ctctggaagttttgtcttag

SEQ ID NO: 8077 - DNA, 20 bp, Artificial Sequence
  chemically synthesized
ctggaagttttgtcttagag

SEQ ID NO: 8078 - DNA, 20 bp, Artificial Sequence
  chemically synthesized
gttttgtcttagaggagtac

SEQ ID NO: 8079 - DNA, 20 bp, Artificial Sequence
  chemically synthesized
tagaggagtaccagccatgt

SEQ ID NO: 8080 - DNA, 20 bp, Artificial Sequence
  chemically synthesized
agaggagtaccagccatgtg

SEQ ID NO: 8081 - DNA, 20 bp, Artificial Sequence
  chemically synthesized
gtaccagccatgtgaggtgt

SEQ ID NO: 8082 - DNA, 20 bp, Artificial Sequence
  chemically synthesized
aggtgtcagtctgcccctac

SEQ ID NO: 8083 - DNA, 20 bp, Artificial Sequence
  chemically synthesized
ggtgtcagtctgcccctact

SEQ ID NO: 8084 - DNA, 20 bp, Artificial Sequence
  chemically synthesized
gtgtcagtctgcccctactg

SEQ ID NO: 8085 - DNA, 20 bp, Artificial Sequence
  chemically synthesized
tgtcagtctgcccctactgg

SEQ ID NO: 8086 - DNA, 20 bp, Artificial Sequence
  chemically synthesized
ccctactgggggatgcctcc

SEQ ID NO: 8087 - DNA, 20 bp, Artificial Sequence
  chemically synthesized
actgggggatgcctcccagt

SEQ ID NO: 8088 - DNA, 20 bp, Artificial Sequence
  chemically synthesized
ctgggggatgcctcccagtt

SEQ ID NO: 8089 - DNA, 20 bp, Artificial Sequence
  chemically synthesized
tgcctcccagttaggctact

SEQ ID NO: 8090 - DNA, 20 bp, Artificial Sequence
  chemically synthesized
gcctcccagttaggctactc

SEQ ID NO: 8091 - DNA, 20 bp, Artificial Sequence
  chemically synthesized
cctcccagttaggctactcg

SEQ ID NO: 8092 - DNA, 20 bp, Artificial Sequence
  chemically synthesized
ctcccagttaggctactcgg

SEQ ID NO: 8093 - DNA, 20 bp, Artificial Sequence
  chemically synthesized
cagttaggctactcgggggt

SEQ ID NO: 8094 - DNA, 20 bp, Artificial Sequence
  chemically synthesized
agttaggctactcgggggtc

SEQ ID NO: 8095 - DNA, 20 bp, Artificial Sequence
  chemically synthesized
gttaggctactcgggggtca

SEQ ID NO: 8096 - DNA, 20 bp, Artificial Sequence
  chemically synthesized
cgggggtcagggacccactt

SEQ ID NO: 8097 - DNA, 20 bp, Artificial Sequence
  chemically synthesized
gggggtcagggacccacttg

SEQ ID NO: 8098 - DNA, 20 bp, Artificial Sequence
  chemically synthesized
gggtcagggacccacttgag

SEQ ID NO: 8099 - DNA, 20 bp, Artificial Sequence
  chemically synthesized
ggtcagggacccacttgagg

SEQ ID NO: 8100 - DNA, 20 bp, Artificial Sequence
  chemically synthesized
cagggacccacttgaggagg

SEQ ID NO: 8101 - DNA, 20 bp, Artificial Sequence
  chemically synthesized
ggaggcagtctgcctgttct

SEQ ID NO: 8102 - DNA, 20 bp, Artificial Sequence
  chemically synthesized
tctgcctgttctcagatctg

SEQ ID NO: 8103 - DNA, 20 bp, Artificial Sequence
  chemically synthesized
tcagatctgaagctatgtgc

SEQ ID NO: 8104 - DNA, 20 bp, Artificial Sequence
  chemically synthesized
cagatctgaagctatgtgct

SEQ ID NO: 8105 - DNA, 20 bp, Artificial Sequence
  chemically synthesized
gatctgaagctatgtgctgg

SEQ ID NO: 8106 - DNA, 20 bp, Artificial Sequence
  chemically synthesized
gagaaccactactctcttca

SEQ ID NO: 8107 - DNA, 20 bp, Artificial Sequence
  chemically synthesized
actactctcttcaaagctgt

SEQ ID NO: 8108 - DNA, 20 bp, Artificial Sequence
  chemically synthesized
ctctcttcaaagctgtcaga

SEQ ID NO: 8109 - DNA, 20 bp, Artificial Sequence
  chemically synthesized
tctcttcaaagctgtcagac

SEQ ID NO: 8110 - DNA, 20 bp, Artificial Sequence
  chemically synthesized
ctcttcaaagctgtcagaca

SEQ ID NO: 8111 - DNA, 20 bp, Artificial Sequence
  chemically synthesized
gctgtcagacagggacattt

SEQ ID NO: 8112 - DNA, 20 bp, Artificial Sequence
  chemically synthesized
gacagggacatttaagtctg

SEQ ID NO: 8113 - DNA, 20 bp, Artificial Sequence
  chemically synthesized
cagggacatttaagtctgca

SEQ ID NO: 8114 - DNA, 20 bp, Artificial Sequence
  chemically synthesized
agggacatttaagtctgcag

SEQ ID NO: 8115 - DNA, 20 bp, Artificial Sequence
  chemically synthesized
gtttgtctgtgccctgcccc

SEQ ID NO: 8116 - DNA, 20 bp, Artificial Sequence
  chemically synthesized
ttgtctgtgccctgccccta

SEQ ID NO: 8117 - DNA, 20 bp, Artificial Sequence
  chemically synthesized
tgtctgtgccctgcccctag

SEQ ID NO: 8118 - DNA, 20 bp, Artificial Sequence
  chemically synthesized
ctgtgccctgcccctagagg

SEQ ID NO: 8119 - DNA, 20 bp, Artificial Sequence
  chemically synthesized
gtgccctgcccctagaggtg

SEQ ID NO: 8120 - DNA, 20 bp, Artificial Sequence
  chemically synthesized
gcccctagaggtggagccta

SEQ ID NO: 8121 - DNA, 20 bp, Artificial Sequence
  chemically synthesized
ccctagaggtggagcctaca

SEQ ID NO: 8122 - DNA, 20 bp, Artificial Sequence
  chemically synthesized
cctagaggtggagcctacag

SEQ ID NO: 8123 - DNA, 20 bp, Artificial Sequence
  chemically synthesized
agaggtggagcctacagagg

SEQ ID NO: 8124 - DNA, 20 bp, Artificial Sequence
  chemically synthesized
gaggtggagcctacagaggc

SEQ ID NO: 8125 - DNA, 20 bp, Artificial Sequence
  chemically synthesized
gtggagcctacagaggcagg

SEQ ID NO: 8126 - DNA, 20 bp, Artificial Sequence
  chemically synthesized
tggagcctacagaggcaggc

SEQ ID NO: 8127 - DNA, 20 bp, Artificial Sequence
  chemically synthesized
agaggcaggcaggcctcctt

SEQ ID NO: 8128 - DNA, 20 bp, Artificial Sequence
  chemically synthesized
aggcaggcctccttgagctg

SEQ ID NO: 8129 - DNA, 20 bp, Artificial Sequence
  chemically synthesized
caggcctccttgagctgtgg

SEQ ID NO: 8130 - DNA, 20 bp, Artificial Sequence
  chemically synthesized
aggcctccttgagctgtggt

SEQ ID NO: 8131 - DNA, 20 bp, Artificial Sequence
  chemically synthesized
gagctgtggtgggctccacc

SEQ ID NO: 8132 - DNA, 20 bp, Artificial Sequence
  chemically synthesized
tggtgggctccacccagttc

SEQ ID NO: 8133 - DNA, 20 bp, Artificial Sequence
  chemically synthesized
ctccacccagttcgagcttc

SEQ ID NO: 8134 - DNA, 20 bp, Artificial Sequence
  chemically synthesized
tccacccagttcgagcttcc

SEQ ID NO: 8135 - DNA, 20 bp, Artificial Sequence
  chemically synthesized
acccagttcgagcttccagg

SEQ ID NO: 8136 - DNA, 20 bp, Artificial Sequence
  chemically synthesized
gcggctttgtttacctgctc

SEQ ID NO: 8137 - DNA, 20 bp, Artificial Sequence
  chemically synthesized
tttgtttacctgctcaagcc

SEQ ID NO: 8138 - DNA, 20 bp, Artificial Sequence
  chemically synthesized
acctgctcaagcctggacaa

SEQ ID NO: 8139 - DNA, 20 bp, Artificial Sequence
  chemically synthesized
tgctcaagcctggacaatgg

SEQ ID NO: 8140 - DNA, 20 bp, Artificial Sequence
  chemically synthesized
gctcaagcctggacaatggt

SEQ ID NO: 8141 - DNA, 20 bp, Artificial Sequence
  chemically synthesized
aatggtgggcacccctcccc

SEQ ID NO: 8142 - DNA, 20 bp, Artificial Sequence
  chemically synthesized
ccagcctcactgccaccttg

SEQ ID NO: 8143 - DNA, 20 bp, Artificial Sequence
  chemically synthesized
gccaccttgcagtttgacct

SEQ ID NO: 8144 - DNA, 20 bp, Artificial Sequence
  chemically synthesized
ttgacctcagactgctgtgc

SEQ ID NO: 8145 - DNA, 20 bp, Artificial Sequence
  chemically synthesized
cagactgctgtgctagcaat

SEQ ID NO: 8146 - DNA, 20 bp, Artificial Sequence
  chemically synthesized
ctgctgtgctagcaatgagc

SEQ ID NO: 8147 - DNA, 20 bp, Artificial Sequence
  chemically synthesized
tgctgtgctagcaatgagcg

SEQ ID NO: 8148 - DNA, 20 bp, Artificial Sequence
  chemically synthesized
tagcaatgagcgaggctcca

SEQ ID NO: 8149 - DNA, 20 bp, Artificial Sequence
  chemically synthesized
agcaatgagcgaggctccat

SEQ ID NO: 8150 - DNA, 20 bp, Artificial Sequence
  chemically synthesized
tgagcgaggctccatgggcg

SEQ ID NO: 8151 - DNA, 20 bp, Artificial Sequence
  chemically synthesized
gagcgaggctccatgggcgt

SEQ ID NO: 8152 - DNA, 20 bp, Artificial Sequence
  chemically synthesized
ccatgggcgtaggaccctct

SEQ ID NO: 8153 - DNA, 20 bp, Artificial Sequence
  chemically synthesized
gggcgtaggaccctctgagc

SEQ ID NO: 8154 - DNA, 20 bp, Artificial Sequence
  chemically synthesized
ggcgtaggaccctctgagcc

SEQ ID NO: 8155 - DNA, 20 bp, Artificial Sequence
  chemically synthesized
aggaccctctgagccaggca

SEQ ID NO: 8156 - DNA, 20 bp, Artificial Sequence
  chemically synthesized
ggaccctctgagccaggcat

SEQ ID NO: 8157 - DNA, 20 bp, Artificial Sequence
  chemically synthesized
aggcatgggatataatctcc

SEQ ID NO: 8158 - DNA, 20 bp, Artificial Sequence
  chemically synthesized
ctcctggtgtgccatttgtt

SEQ ID NO: 8159 - DNA, 20 bp, Artificial Sequence
  chemically synthesized
gtgccatttgttaagcttgt

SEQ ID NO: 8160 - DNA, 20 bp, Artificial Sequence
  chemically synthesized
ccatttgttaagcttgttgg

SEQ ID NO: 8161 - DNA, 20 bp, Artificial Sequence
  chemically synthesized
atttgttaagcttgttggaa

SEQ ID NO: 8162 - DNA, 20 bp, Artificial Sequence
  chemically synthesized
ttaagcttgttggaagagcg

SEQ ID NO: 8163 - DNA, 20 bp, Artificial Sequence
  chemically synthesized
ttgttggaagagcgcagtat

SEQ ID NO: 8164 - DNA, 20 bp, Artificial Sequence
  chemically synthesized
tgttggaagagcgcagtatt

SEQ ID NO: 8165 - DNA, 20 bp, Artificial Sequence
  chemically synthesized
gttggaagagcgcagtatta

SEQ ID NO: 8166 - DNA, 20 bp, Artificial Sequence
  chemically synthesized
ggaagagcgcagtattaggg

SEQ ID NO: 8167 - DNA, 20 bp, Artificial Sequence
  chemically synthesized
gaagagcgcagtattagggc

SEQ ID NO: 8168 - DNA, 20 bp, Artificial Sequence
  chemically synthesized
agagcgcagtattagggcgg

SEQ ID NO: 8169 - DNA, 20 bp, Artificial Sequence
  chemically synthesized
gcgggagtgacccgattttc

SEQ ID NO: 8170 - DNA, 20 bp, Artificial Sequence
  chemically synthesized
cgggagtgacccgattttcc

SEQ ID NO: 8171 - DNA, 20 bp, Artificial Sequence
  chemically synthesized
ctgtcacccttttctttgac

SEQ ID NO: 8172 - DNA, 20 bp, Artificial Sequence
  chemically synthesized
tgtcacccttttctttgact

SEQ ID NO: 8173 - DNA, 20 bp, Artificial Sequence
  chemically synthesized
acccttttctttgactagga

SEQ ID NO: 8174 - DNA, 20 bp, Artificial Sequence
  chemically synthesized
cccttttctttgactaggaa

SEQ ID NO: 8175 - DNA, 20 bp, Artificial Sequence
  chemically synthesized
ccttttctttgactaggaaa

SEQ ID NO: 8176 - DNA, 20 bp, Artificial Sequence
  chemically synthesized
ccctgaccccttgtgcttcc

SEQ ID NO: 8177 - DNA, 20 bp, Artificial Sequence
  chemically synthesized
cctgaccccttgtgcttccc

SEQ ID NO: 8178 - DNA, 20 bp, Artificial Sequence
  chemically synthesized
accccttgtgcttcccgggt

SEQ ID NO: 8179 - DNA, 20 bp, Artificial Sequence
  chemically synthesized
ccccttgtgcttcccgggtg

SEQ ID NO: 8180 - DNA, 20 bp, Artificial Sequence
  chemically synthesized
ggtgatgcctcgccctgctt

SEQ ID NO: 8181 - DNA, 20 bp, Artificial Sequence
  chemically synthesized
gccctgctttggctcatgca

SEQ ID NO: 8182 - DNA, 20 bp, Artificial Sequence
  chemically synthesized
actgtcctgcacccactgcc

SEQ ID NO: 8183 - DNA, 20 bp, Artificial Sequence
  chemically synthesized
actgcctggcacttccctgt

SEQ ID NO: 8184 - DNA, 20 bp, Artificial Sequence
  chemically synthesized
acttccctgtgagatgaacc

SEQ ID NO: 8185 - DNA, 20 bp, Artificial Sequence
  chemically synthesized
gtgagatgaacctggtacct

SEQ ID NO: 8186 - DNA, 20 bp, Artificial Sequence
  chemically synthesized
gatgaacctggtacctcagt

SEQ ID NO: 8187 - DNA, 20 bp, Artificial Sequence
  chemically synthesized
tggtacctcagttggaaatg

SEQ ID NO: 8188 - DNA, 20 bp, Artificial Sequence
  chemically synthesized
gtcttctgcgtcactcacga

SEQ ID NO: 8189 - DNA, 20 bp, Artificial Sequence
  chemically synthesized
tcttctgcgtcactcacgat

SEQ ID NO: 8190 - DNA, 20 bp, Artificial Sequence
  chemically synthesized
ttctgcgtcactcacgatgg

SEQ ID NO: 8191 - DNA, 20 bp, Artificial Sequence
  chemically synthesized
gtcactcacgatgggagcta

SEQ ID NO: 8192 - DNA, 20 bp, Artificial Sequence
  chemically synthesized
tcacgatgggagctatagac

SEQ ID NO: 8193 - DNA, 20 bp, Artificial Sequence
  chemically synthesized
acgatgggagctatagactg

SEQ ID NO: 8194 - DNA, 20 bp, Artificial Sequence
  chemically synthesized
agactggagctgttcctatt

SEQ ID NO: 8195 - DNA, 20 bp, Artificial Sequence
  chemically synthesized
ctgttcctattcggtcatct

SEQ ID NO: 8196 - DNA, 20 bp, Artificial Sequence
  chemically synthesized
tttttcttttttttttgtga

SEQ ID NO: 8197 - DNA, 20 bp, Artificial Sequence
  chemically synthesized
tttcttttttttttgtgacg

SEQ ID NO: 8198 - DNA, 20 bp, Artificial Sequence
  chemically synthesized
cggagtctcatgctgtcacc

SEQ ID NO: 8199 - DNA, 20 bp, Artificial Sequence
  chemically synthesized
ggagtctcatgctgtcacct

SEQ ID NO: 8200 - DNA, 20 bp, Artificial Sequence
  chemically synthesized
tctcatgctgtcacctgggc

SEQ ID NO: 8201 - DNA, 20 bp, Artificial Sequence
  chemically synthesized
ctgtcacctgggctggaatg

SEQ ID NO: 8202 - DNA, 20 bp, Artificial Sequence
  chemically synthesized
tcacctgggctggaatgcag

SEQ ID NO: 8203 - DNA, 20 bp, Artificial Sequence
  chemically synthesized
ggaatgcagtggcacaatct

SEQ ID NO: 8204 - DNA, 20 bp, Artificial Sequence
  chemically synthesized
tcactgcaacctctgcctcc

SEQ ID NO: 8205 - DNA, 20 bp, Artificial Sequence
  chemically synthesized
cactgcaacctctgcctccc

SEQ ID NO: 8206 - DNA, 20 bp, Artificial Sequence
  chemically synthesized
aacctctgcctcccaggatc

SEQ ID NO: 8207 - DNA, 20 bp, Artificial Sequence
  chemically synthesized
atcaagcgattctcctgcct

SEQ ID NO: 8208 - DNA, 20 bp, Artificial Sequence
  chemically synthesized
gcctcagcctcccaaattgc

SEQ ID NO: 8209 - DNA, 20 bp, Artificial Sequence
  chemically synthesized
cctcagcctcccaaattgct

SEQ ID NO: 8210 - DNA, 20 bp, Artificial Sequence
  chemically synthesized
acacatgcctgccaccacgc

SEQ ID NO: 8211 - DNA, 20 bp, Artificial Sequence
  chemically synthesized
cacatgcctgccaccacgcc

SEQ ID NO: 8212 - DNA, 20 bp, Artificial Sequence
  chemically synthesized
gcctgccaccacgccaggct

SEQ ID NO: 8213 - DNA, 20 bp, Artificial Sequence
  chemically synthesized
aggctaagtttttatatttt

SEQ ID NO: 8214 - DNA, 20 bp, Artificial Sequence
  chemically synthesized
ctaagtttttatatttttag

SEQ ID NO: 8215 - DNA, 20 bp, Artificial Sequence
  chemically synthesized
tttatatttttagtagcgat

SEQ ID NO: 8216 - DNA, 20 bp, Artificial Sequence
  chemically synthesized
ttatatttttagtagcgatg

SEQ ID NO: 8217 - DNA, 20 bp, Artificial Sequence
  chemically synthesized
gcgatgaggtttcactatgt

SEQ ID NO: 8218 - DNA, 20 bp, Artificial Sequence
  chemically synthesized
tgaggtttcactatgttggc

SEQ ID NO: 8219 - DNA, 20 bp, Artificial Sequence
  chemically synthesized
gaggtttcactatgttggcc

SEQ ID NO: 8220 - DNA, 20 bp, Artificial Sequence
  chemically synthesized
gacgtcgtgatccgcctgtc

SEQ ID NO: 8221 - DNA, 20 bp, Artificial Sequence
  chemically synthesized
acgtcgtgatccgcctgtct

SEQ ID NO: 8222 - DNA, 20 bp, Artificial Sequence
  chemically synthesized
ccgcctgtctaggcctccca

SEQ ID NO: 8223 - DNA, 20 bp, Artificial Sequence
  chemically synthesized
ctcccaaagtgctgcaattg

SEQ ID NO: 8224 - DNA, 20 bp, Artificial Sequence
  chemically synthesized
tcccaaagtgctgcaattgc

SEQ ID NO: 8225 - DNA, 20 bp, Artificial Sequence
  chemically synthesized
agtgctgcaattgcaggtgt

SEQ ID NO: 8226 - DNA, 20 bp, Artificial Sequence
  chemically synthesized
caggtgtgagccaccgctcc

SEQ ID NO: 8227 - DNA, 20 bp, Artificial Sequence
  chemically synthesized
gtgagccaccgctcccagcc

SEQ ID NO: 8228 - DNA, 20 bp, Artificial Sequence
  chemically synthesized
tgaatttatttctcccttga

SEQ ID NO: 8229 - DNA, 20 bp, Artificial Sequence
  chemically synthesized
tcccttgatagtttctactt

SEQ ID NO: 8230 - DNA, 20 bp, Artificial Sequence
  chemically synthesized
cccttgatagtttctacttt

SEQ ID NO: 8231 - DNA, 20 bp, Artificial Sequence
  chemically synthesized
ttgggttgataattaaataa

SEQ ID NO: 8232 - DNA, 20 bp, Artificial Sequence
  chemically synthesized
taaataacagtgttatctct

SEQ ID NO: 8233 - DNA, 20 bp, Artificial Sequence
  chemically synthesized
gtcttcccatatttttattc

SEQ ID NO: 8234 - DNA, 20 bp, Artificial Sequence
  chemically synthesized
cctaattgtgtaatcgattg

SEQ ID NO: 8235 - DNA, 20 bp, Artificial Sequence
  chemically synthesized
gtaatcgattgtggtatatg

SEQ ID NO: 8236 - DNA, 20 bp, Artificial Sequence
  chemically synthesized
cgattgtggtatatgcagtt

SEQ ID NO: 8237 - DNA, 20 bp, Artificial Sequence
  chemically synthesized
ttcactttactcttttcaaa

SEQ ID NO: 8238 - DNA, 20 bp, Artificial Sequence
  chemically synthesized
tttactcttttcaaaaagta

SEQ ID NO: 8239 - DNA, 20 bp, Artificial Sequence
  chemically synthesized
actgtttgttttttatttcc

SEQ ID NO: 8240 - DNA, 20 bp, Artificial Sequence
  chemically synthesized
tatttccaagctaaatttaa

SEQ ID NO: 8241 - DNA, 20 bp, Artificial Sequence
  chemically synthesized
tatatcacattattatattt

SEQ ID NO: 8242 - DNA, 20 bp, Artificial Sequence
  chemically synthesized
tcacattattatattttagt

SEQ ID NO: 8243 - DNA, 20 bp, Artificial Sequence
  chemically synthesized
tattatattttagtgagatt

SEQ ID NO: 8244 - DNA, 20 bp, Artificial Sequence
  chemically synthesized
ttttagtgagatttagtttt

SEQ ID NO: 8245 - DNA, 20 bp, Artificial Sequence
  chemically synthesized
ccactatcttacttacacat

SEQ ID NO: 8246 - DNA, 20 bp, Artificial Sequence
  chemically synthesized
ctatcttacttacacatgag

SEQ ID NO: 8247 - DNA, 20 bp, Artificial Sequence
  chemically synthesized
gtattaatttaacatgattt

SEQ ID NO: 8248 - DNA, 20 bp, Artificial Sequence
  chemically synthesized
tttaacatgattttagaatg

SEQ ID NO: 8249 - DNA, 20 bp, Artificial Sequence
  chemically synthesized
attttagaatgaagaaaatg

SEQ ID NO: 8250 - DNA, 20 bp, Artificial Sequence
  chemically synthesized
gaagaaaatgaagccatttt

SEQ ID NO: 8251 - DNA, 20 bp, Artificial Sequence
  chemically synthesized
gccatttttagataaaccaa

SEQ ID NO: 8252 - DNA, 20 bp, Artificial Sequence
  chemically synthesized
caaaagtaacaatgtatttc

SEQ ID NO: 8253 - DNA, 20 bp, Artificial Sequence
  chemically synthesized
aagtaacaatgtatttccag

SEQ ID NO: 8254 - DNA, 20 bp, Artificial Sequence
  chemically synthesized
aacaatgtatttccagcaga

SEQ ID NO: 8255 - DNA, 20 bp, Artificial Sequence
  chemically synthesized
caatgtatttccagcagaaa

SEQ ID NO: 8256 - DNA, 20 bp, Artificial Sequence
  chemically synthesized
cagcagaaagagataatatt

SEQ ID NO: 8257 - DNA, 20 bp, Artificial Sequence
  chemically synthesized
agcagaaagagataatatta

SEQ ID NO: 8258 - DNA, 20 bp, Artificial Sequence
  chemically synthesized
gagataatattaaggataat

SEQ ID NO: 8259 - DNA, 20 bp, Artificial Sequence
  chemically synthesized
taaggataatcagaaaaaaa

SEQ ID NO: 8260 - DNA, 20 bp, Artificial Sequence
  chemically synthesized
agaaaaaaatagaataaact

SEQ ID NO: 8261 - DNA, 20 bp, Artificial Sequence
  chemically synthesized
aaaaaaatagaataaactta

SEQ ID NO: 8262 - DNA, 20 bp, Artificial Sequence
  chemically synthesized
aaaaatagaataaacttaga

SEQ ID NO: 8263 - DNA, 20 bp, Artificial Sequence
  chemically synthesized
aataaacttagagagaatgt

SEQ ID NO: 8264 - DNA, 20 bp, Artificial Sequence
  chemically synthesized
tagagagaatgttagaaatg

SEQ ID NO: 8265 - DNA, 20 bp, Artificial Sequence
  chemically synthesized
agaatgttagaaatgaagaa

SEQ ID NO: 8266 - DNA, 20 bp, Artificial Sequence
  chemically synthesized
atgcaaaacattttgtacat

SEQ ID NO: 8267 - DNA, 20 bp, Artificial Sequence
  chemically synthesized
tcactatttaataataacac

SEQ ID NO: 8268 - DNA, 20 bp, Artificial Sequence
  chemically synthesized
aataataacactagaaaatc

SEQ ID NO: 8269 - DNA, 20 bp, Artificial Sequence
  chemically synthesized
ataataacactagaaaatct

SEQ ID NO: 8270 - DNA, 20 bp, Artificial Sequence
  chemically synthesized
taataacactagaaaatcta

SEQ ID NO: 8271 - DNA, 20 bp, Artificial Sequence
  chemically synthesized
ataacactagaaaatctagg

SEQ ID NO: 8272 - DNA, 20 bp, Artificial Sequence
  chemically synthesized
aatatatatatatataatta

SEQ ID NO: 8273 - DNA, 20 bp, Artificial Sequence
  chemically synthesized
atatatatataattatagat

SEQ ID NO: 8274 - DNA, 20 bp, Artificial Sequence
  chemically synthesized
tatatatataattatagatt

SEQ ID NO: 8275 - DNA, 20 bp, Artificial Sequence
  chemically synthesized
atatataattatagattggg

SEQ ID NO: 8276 - DNA, 20 bp, Artificial Sequence
  chemically synthesized
tatataattatagattggga

SEQ ID NO: 8277 - DNA, 20 bp, Artificial Sequence
  chemically synthesized
atataattatagattgggaa

SEQ ID NO: 8278 - DNA, 20 bp, Artificial Sequence
  chemically synthesized
tataattatagattgggaag

SEQ ID NO: 8279 - DNA, 20 bp, Artificial Sequence
  chemically synthesized
agattgggaaggggaaaatg

SEQ ID NO: 8280 - DNA, 20 bp, Artificial Sequence
  chemically synthesized
ggaaggggaaaatgaagata

SEQ ID NO: 8281 - DNA, 20 bp, Artificial Sequence
  chemically synthesized
taaaatttattgtattgttt

SEQ ID NO: 8282 - DNA, 20 bp, Artificial Sequence
  chemically synthesized
tttattgtattgttttggaa

SEQ ID NO: 8283 - DNA, 20 bp, Artificial Sequence
  chemically synthesized
tattgtattgttttggaaaa

SEQ ID NO: 8284 - DNA, 20 bp, Artificial Sequence
  chemically synthesized
ttgttttggaaaagagtaaa

SEQ ID NO: 8285 - DNA, 20 bp, Artificial Sequence
  chemically synthesized
gaaaagagtaaacagtcaaa

SEQ ID NO: 8286 - DNA, 20 bp, Artificial Sequence
  chemically synthesized
atatttgtatctgaaaaatc

SEQ ID NO: 8287 - DNA, 20 bp, Artificial Sequence
  chemically synthesized
agaatgcaattctaatcatc

SEQ ID NO: 8288 - DNA, 20 bp, Artificial Sequence
  chemically synthesized
agatgcatttttttattttt

SEQ ID NO: 8289 - DNA, 20 bp, Artificial Sequence
  chemically synthesized
tattattcttcaactttatt

SEQ ID NO: 8290 - DNA, 20 bp, Artificial Sequence
  chemically synthesized
attattcttcaactttattg

SEQ ID NO: 8291 - DNA, 20 bp, Artificial Sequence
  chemically synthesized
aataaaaattgtatatattt

SEQ ID NO: 8292 - DNA, 20 bp, Artificial Sequence
  chemically synthesized
ataaaaattgtatatattta

SEQ ID NO: 8293 - DNA, 20 bp, Artificial Sequence
  chemically synthesized
gtgaaatgattaccacaatc

SEQ ID NO: 8294 - DNA, 20 bp, Artificial Sequence
  chemically synthesized
aacatacccattatctcaca

SEQ ID NO: 8295 - DNA, 20 bp, Artificial Sequence
  chemically synthesized
acatagttacctttttcttg

SEQ ID NO: 8296 - DNA, 20 bp, Artificial Sequence
  chemically synthesized
ttcttgtggtaaatgctttt

SEQ ID NO: 8297 - DNA, 20 bp, Artificial Sequence
  chemically synthesized
atgcttttaagatctactct

SEQ ID NO: 8298 - DNA, 20 bp, Artificial Sequence
  chemically synthesized
ttttaagatctactctcggc

SEQ ID NO: 8299 - DNA, 20 bp, Artificial Sequence
  chemically synthesized
tttaagatctactctcggcc

SEQ ID NO: 8300 - DNA, 20 bp, Artificial Sequence
  chemically synthesized
gatctactctcggccaggcc

SEQ ID NO: 8301 - DNA, 20 bp, Artificial Sequence
  chemically synthesized
ctactctcggccaggcccgg

SEQ ID NO: 8302 - DNA, 20 bp, Artificial Sequence
  chemically synthesized
gtggctcacgcctgtaatcc

SEQ ID NO: 8303 - DNA, 20 bp, Artificial Sequence
  chemically synthesized
cgcctgtaatcccagccctt

SEQ ID NO: 8304 - DNA, 20 bp, Artificial Sequence
  chemically synthesized
gcctgtaatcccagcccttt

SEQ ID NO: 8305 - DNA, 20 bp, Artificial Sequence
  chemically synthesized
tgtaatcccagccctttggg

SEQ ID NO: 8306 - DNA, 20 bp, Artificial Sequence
  chemically synthesized
tcccagccctttgggtggcc

SEQ ID NO: 8307 - DNA, 20 bp, Artificial Sequence
  chemically synthesized
cccagccctttgggtggccg

SEQ ID NO: 8308 - DNA, 20 bp, Artificial Sequence
  chemically synthesized
agccctttgggtggccgagg

SEQ ID NO: 8309 - DNA, 20 bp, Artificial Sequence
  chemically synthesized
gccctttgggtggccgaggc

SEQ ID NO: 8310 - DNA, 20 bp, Artificial Sequence
  chemically synthesized
ctttgggtggccgaggcagg

SEQ ID NO: 8311 - DNA, 20 bp, Artificial Sequence
  chemically synthesized
ggtggccgaggcaggcggat

SEQ ID NO: 8312 - DNA, 20 bp, Artificial Sequence
  chemically synthesized
gcggatcagcctgaccaaca

SEQ ID NO: 8313 - DNA, 20 bp, Artificial Sequence
  chemically synthesized
ggatcagcctgaccaacatg

SEQ ID NO: 8314 - DNA, 20 bp, Artificial Sequence
  chemically synthesized
ctctactaaaaatacaaaat

SEQ ID NO: 8315 - DNA, 20 bp, Artificial Sequence
  chemically synthesized
actaaaaatacaaaattagc

SEQ ID NO: 8316 - DNA, 20 bp, Artificial Sequence
  chemically synthesized
ctaaaaatacaaaattagct

SEQ ID NO: 8317 - DNA, 20 bp, Artificial Sequence
  chemically synthesized
aatacaaaattagctgggca

SEQ ID NO: 8318 - DNA, 20 bp, Artificial Sequence
  chemically synthesized
gtgtcgcatgcctgtaatcc

SEQ ID NO: 8319 - DNA, 20 bp, Artificial Sequence
  chemically synthesized
tgcctgtaatcccagctact

SEQ ID NO: 8320 - DNA, 20 bp, Artificial Sequence
  chemically synthesized
gcctgtaatcccagctactc

SEQ ID NO: 8321 - DNA, 20 bp, Artificial Sequence
  chemically synthesized
ctgtaatcccagctactcgg

SEQ ID NO: 8322 - DNA, 20 bp, Artificial Sequence
  chemically synthesized
tgtaatcccagctactcggg

SEQ ID NO: 8323 - DNA, 20 bp, Artificial Sequence
  chemically synthesized
tcccagctactcgggaggct

SEQ ID NO: 8324 - DNA, 20 bp, Artificial Sequence
  chemically synthesized
cccagctactcgggaggctg

SEQ ID NO: 8325 - DNA, 20 bp, Artificial Sequence
  chemically synthesized
agctactcgggaggctgagg

SEQ ID NO: 8326 - DNA, 20 bp, Artificial Sequence
  chemically synthesized
gctactcgggaggctgaggc

SEQ ID NO: 8327 - DNA, 20 bp, Artificial Sequence
  chemically synthesized
tactcgggaggctgaggcag

SEQ ID NO: 8328 - DNA, 20 bp, Artificial Sequence
  chemically synthesized
gcaggagatttgcttgaacc

SEQ ID NO: 8329 - DNA, 20 bp, Artificial Sequence
  chemically synthesized
caggagatttgcttgaaccc

SEQ ID NO: 8330 - DNA, 20 bp, Artificial Sequence
  chemically synthesized
ggagatttgcttgaacccag

SEQ ID NO: 8331 - DNA, 20 bp, Artificial Sequence
  chemically synthesized
gagatttgcttgaacccagg

SEQ ID NO: 8332 - DNA, 20 bp, Artificial Sequence
  chemically synthesized
atttgcttgaacccaggagg

SEQ ID NO: 8333 - DNA, 20 bp, Artificial Sequence
  chemically synthesized
ttgcttgaacccaggaggcg

SEQ ID NO: 8334 - DNA, 20 bp, Artificial Sequence
  chemically synthesized
tgcttgaacccaggaggcgg

SEQ ID NO: 8335 - DNA, 20 bp, Artificial Sequence
  chemically synthesized
aacccaggaggcggaggttg

SEQ ID NO: 8336 - DNA, 20 bp, Artificial Sequence
  chemically synthesized
caggaggcggaggttgcagt

SEQ ID NO: 8337 - DNA, 20 bp, Artificial Sequence
  chemically synthesized
ggcggaggttgcagtgagcc

SEQ ID NO: 8338 - DNA, 20 bp, Artificial Sequence
  chemically synthesized
aagatcttgccattgcactc

SEQ ID NO: 8339 - DNA, 20 bp, Artificial Sequence
  chemically synthesized
cttgccattgcactccagcc

SEQ ID NO: 8340 - DNA, 20 bp, Artificial Sequence
  chemically synthesized
tgcactccagcctggacaac

SEQ ID NO: 8341 - DNA, 20 bp, Artificial Sequence
  chemically synthesized
cactccagcctggacaacaa

SEQ ID NO: 8342 - DNA, 20 bp, Artificial Sequence
  chemically synthesized
gcaaattttaaatatactta

SEQ ID NO: 8343 - DNA, 20 bp, Artificial Sequence
  chemically synthesized
acttacagtacaattaacta

SEQ ID NO: 8344 - DNA, 20 bp, Artificial Sequence
  chemically synthesized
acagtcacgatgctgtacat

SEQ ID NO: 8345 - DNA, 20 bp, Artificial Sequence
  chemically synthesized
gatgctgtacattagatatc

SEQ ID NO: 8346 - DNA, 20 bp, Artificial Sequence
  chemically synthesized
actgaaattttatacccttt

SEQ ID NO: 8347 - DNA, 20 bp, Artificial Sequence
  chemically synthesized
attttataccctttgagtaa

SEQ ID NO: 8348 - DNA, 20 bp, Artificial Sequence
  chemically synthesized
attctcccacccccaacccc

SEQ ID NO: 8349 - DNA, 20 bp, Artificial Sequence
  chemically synthesized
cctctactgtctgtttccat

SEQ ID NO: 8350 - DNA, 20 bp, Artificial Sequence
  chemically synthesized
tctactgtctgtttccatga

SEQ ID NO: 8351 - DNA, 20 bp, Artificial Sequence
  chemically synthesized
cttttttatgtttcacatat

SEQ ID NO: 8352 - DNA, 20 bp, Artificial Sequence
  chemically synthesized
tttatgtttcacatatgagc

SEQ ID NO: 8353 - DNA, 20 bp, Artificial Sequence
  chemically synthesized
ttatgtttcacatatgagca

SEQ ID NO: 8354 - DNA, 20 bp, Artificial Sequence
  chemically synthesized
cacatatgagcaaggttgtg

SEQ ID NO: 8355 - DNA, 20 bp, Artificial Sequence
  chemically synthesized
tagtatttgtctttttgtgt

SEQ ID NO: 8356 - DNA, 20 bp, Artificial Sequence
  chemically synthesized
agtatttgtctttttgtgtc

SEQ ID NO: 8357 - DNA, 20 bp, Artificial Sequence
  chemically synthesized
tgtgtcaggcttatttttct

SEQ ID NO: 8358 - DNA, 20 bp, Artificial Sequence
  chemically synthesized
tttcttagttttacatcctc

SEQ ID NO: 8359 - DNA, 20 bp, Artificial Sequence
  chemically synthesized
ttcttagttttacatcctcc

SEQ ID NO: 8360 - DNA, 20 bp, Artificial Sequence
  chemically synthesized
ttcatcaattctgccataaa

SEQ ID NO: 8361 - DNA, 20 bp, Artificial Sequence
  chemically synthesized
atcaattctgccataaatgg

SEQ ID NO: 8362 - DNA, 20 bp, Artificial Sequence
  chemically synthesized
tcaattctgccataaatggc

SEQ ID NO: 8363 - DNA, 20 bp, Artificial Sequence
  chemically synthesized
tctgtgtttcttatatattt

SEQ ID NO: 8364 - DNA, 20 bp, Artificial Sequence
  chemically synthesized
ggatattaaccaaaatattt

SEQ ID NO: 8365 - DNA, 20 bp, Artificial Sequence
  chemically synthesized
caaaatatttaagaaatatt

SEQ ID NO: 8366 - DNA, 20 bp, Artificial Sequence
  chemically synthesized
tttgcaaatatgccatttca

SEQ ID NO: 8367 - DNA, 20 bp, Artificial Sequence
  chemically synthesized
tcattgttttgttttttgtg

SEQ ID NO: 8368 - DNA, 20 bp, Artificial Sequence
  chemically synthesized
ttttttgtgtggaaattttt

SEQ ID NO: 8369 - DNA, 20 bp, Artificial Sequence
  chemically synthesized
ggaaattttttagtttgatg

SEQ ID NO: 8370 - DNA, 20 bp, Artificial Sequence
  chemically synthesized
ctcatatcaaattcaaaaaa

SEQ ID NO: 8371 - DNA, 20 bp, Artificial Sequence
  chemically synthesized
aacggctgcaacgtgaatat

SEQ ID NO: 8372 - DNA, 20 bp, Artificial Sequence
  chemically synthesized
gatttctttaaaaattttta

SEQ ID NO: 8373 - DNA, 20 bp, Artificial Sequence
  chemically synthesized
tttaaaaatttttatggttt

SEQ ID NO: 8374 - DNA, 20 bp, Artificial Sequence
  chemically synthesized
ttaaaaatttttatggtttt

SEQ ID NO: 8375 - DNA, 20 bp, Artificial Sequence
  chemically synthesized
atttttatggttttaggtct

SEQ ID NO: 8376 - DNA, 20 bp, Artificial Sequence
  chemically synthesized
ttcaaatttatttttgttta

SEQ ID NO: 8377 - DNA, 20 bp, Artificial Sequence
  chemically synthesized
tttatttttgtttatggtgt

SEQ ID NO: 8378 - DNA, 20 bp, Artificial Sequence
  chemically synthesized
ttttgtttatggtgtaagac

SEQ ID NO: 8379 - DNA, 20 bp, Artificial Sequence
  chemically synthesized
tttgtttatggtgtaagaca

SEQ ID NO: 8380 - DNA, 20 bp, Artificial Sequence
  chemically synthesized
ttgtttatggtgtaagacaa

SEQ ID NO: 8381 - DNA, 20 bp, Artificial Sequence
  chemically synthesized
gtctgatttcatttcatttt

SEQ ID NO: 8382 - DNA, 20 bp, Artificial Sequence
  chemically synthesized
tctgatttcatttcattttg

SEQ ID NO: 8383 - DNA, 20 bp, Artificial Sequence
  chemically synthesized
ctgatttcatttcattttga

SEQ ID NO: 8384 - DNA, 20 bp, Artificial Sequence
  chemically synthesized
ctgattatatgccttgattt

SEQ ID NO: 8385 - DNA, 20 bp, Artificial Sequence
  chemically synthesized
gatttcagaatcttgccaac

SEQ ID NO: 8386 - DNA, 20 bp, Artificial Sequence
  chemically synthesized
agaatcttgccaactagatt

SEQ ID NO: 8387 - DNA, 20 bp, Artificial Sequence
  chemically synthesized
aactagattcagaatttgac

SEQ ID NO: 8388 - DNA, 20 bp, Artificial Sequence
  chemically synthesized
actagattcagaatttgact

SEQ ID NO: 8389 - DNA, 20 bp, Artificial Sequence
  chemically synthesized
tagattcagaatttgactgg

SEQ ID NO: 8390 - DNA, 20 bp, Artificial Sequence
  chemically synthesized
gattcagaatttgactggga

SEQ ID NO: 8391 - DNA, 20 bp, Artificial Sequence
  chemically synthesized
ttcagaatttgactgggaga

SEQ ID NO: 8392 - DNA, 20 bp, Artificial Sequence
  chemically synthesized
tcagaatttgactgggagag

SEQ ID NO: 8393 - DNA, 20 bp, Artificial Sequence
  chemically synthesized
atttgactgggagagaggac

SEQ ID NO: 8394 - DNA, 20 bp, Artificial Sequence
  chemically synthesized
tttgactgggagagaggaca

SEQ ID NO: 8395 - DNA, 20 bp, Artificial Sequence
  chemically synthesized
agagaggacaaggaccactt

SEQ ID NO: 8396 - DNA, 20 bp, Artificial Sequence
  chemically synthesized
tgagactcatattttatttc

SEQ ID NO: 8397 - DNA, 20 bp, Artificial Sequence
  chemically synthesized
catattttatttccagaatc

SEQ ID NO: 8398 - DNA, 20 bp, Artificial Sequence
  chemically synthesized
gaatctagcatctacctacc

SEQ ID NO: 8399 - DNA, 20 bp, Artificial Sequence
  chemically synthesized
aatctagcatctacctacct

SEQ ID NO: 8400 - DNA, 20 bp, Artificial Sequence
  chemically synthesized
tacctacctaggtattgaat

SEQ ID NO: 8401 - DNA, 20 bp, Artificial Sequence
  chemically synthesized
ggtattgaataagaaaaatg

SEQ ID NO: 8402 - DNA, 20 bp, Artificial Sequence
  chemically synthesized
tgaataagaaaaatgaagtt

SEQ ID NO: 8403 - DNA, 20 bp, Artificial Sequence
  chemically synthesized
gaataagaaaaatgaagtta

SEQ ID NO: 8404 - DNA, 20 bp, Artificial Sequence
  chemically synthesized
taagaaaaatgaagttaagg

SEQ ID NO: 8405 - DNA, 20 bp, Artificial Sequence
  chemically synthesized
aatgaagttaaggtggttga

SEQ ID NO: 8406 - DNA, 20 bp, Artificial Sequence
  chemically synthesized
taacactatgctaataactg

SEQ ID NO: 8407 - DNA, 20 bp, Artificial Sequence
  chemically synthesized
acactatgctaataactgca

SEQ ID NO: 8408 - DNA, 20 bp, Artificial Sequence
  chemically synthesized
tatgctaataactgcagagc

SEQ ID NO: 8409 - DNA, 20 bp, Artificial Sequence
  chemically synthesized
gctaataactgcagagccag

SEQ ID NO: 8410 - DNA, 20 bp, Artificial Sequence
  chemically synthesized
tgcagagccagaagcaccat

SEQ ID NO: 8411 - DNA, 20 bp, Artificial Sequence
  chemically synthesized
gcagagccagaagcaccata

SEQ ID NO: 8412 - DNA, 20 bp, Artificial Sequence
  chemically synthesized
cagagccagaagcaccataa

SEQ ID NO: 8413 - DNA, 20 bp, Artificial Sequence
  chemically synthesized
agcaccataagggacatgat

SEQ ID NO: 8414 - DNA, 20 bp, Artificial Sequence
  chemically synthesized
gcaccataagggacatgata

SEQ ID NO: 8415 - DNA, 20 bp, Artificial Sequence
  chemically synthesized
caccataagggacatgataa

SEQ ID NO: 8416 - DNA, 20 bp, Artificial Sequence
  chemically synthesized
ccataagggacatgataagg

SEQ ID NO: 8417 - DNA, 20 bp, Artificial Sequence
  chemically synthesized
aagggacatgataagggagc

SEQ ID NO: 8418 - DNA, 20 bp, Artificial Sequence
  chemically synthesized
ggacatgataagggagccag

SEQ ID NO: 8419 - DNA, 20 bp, Artificial Sequence
  chemically synthesized
atgctaatcttaaacatcct

SEQ ID NO: 8420 - DNA, 20 bp, Artificial Sequence
  chemically synthesized
tgctaatcttaaacatcctg

SEQ ID NO: 8421 - DNA, 20 bp, Artificial Sequence
  chemically synthesized
taatcttaaacatcctgagg

SEQ ID NO: 8422 - DNA, 20 bp, Artificial Sequence
  chemically synthesized
ttaaacatcctgaggaagaa

SEQ ID NO: 8423 - DNA, 20 bp, Artificial Sequence
  chemically synthesized
taaacatcctgaggaagaat

SEQ ID NO: 8424 - DNA, 20 bp, Artificial Sequence
  chemically synthesized
ggaagaatgggacttccatt

SEQ ID NO: 8425 - DNA, 20 bp, Artificial Sequence
  chemically synthesized
gaagaatgggacttccattt

SEQ ID NO: 8426 - DNA, 20 bp, Artificial Sequence
  chemically synthesized
aagaatgggacttccatttg

SEQ ID NO: 8427 - DNA, 20 bp, Artificial Sequence
  chemically synthesized
aatgggacttccatttgggg

SEQ ID NO: 8428 - DNA, 20 bp, Artificial Sequence
  chemically synthesized
atgggacttccatttggggt

SEQ ID NO: 8429 - DNA, 20 bp, Artificial Sequence
  chemically synthesized
catttggggtgggcctatga

SEQ ID NO: 8430 - DNA, 20 bp, Artificial Sequence
  chemically synthesized
atttggggtgggcctatgac

SEQ ID NO: 8431 - DNA, 20 bp, Artificial Sequence
  chemically synthesized
tttggggtgggcctatgaca

SEQ ID NO: 8432 - DNA, 20 bp, Artificial Sequence
  chemically synthesized
tgggcctatgacagggtaat

SEQ ID NO: 8433 - DNA, 20 bp, Artificial Sequence
  chemically synthesized
cctatgacagggtaataaga

SEQ ID NO: 8434 - DNA, 20 bp, Artificial Sequence
  chemically synthesized
atgacagggtaataagacag

SEQ ID NO: 8435 - DNA, 20 bp, Artificial Sequence
  chemically synthesized
ataagacagtagtgaatatc

SEQ ID NO: 8436 - DNA, 20 bp, Artificial Sequence
  chemically synthesized
agtgaatatcaagctacaaa

SEQ ID NO: 8437 - DNA, 20 bp, Artificial Sequence
  chemically synthesized
gccgcctttcaaattcttct

SEQ ID NO: 8438 - DNA, 20 bp, Artificial Sequence
  chemically synthesized
cagtcctaacttttcatact

SEQ ID NO: 8439 - DNA, 20 bp, Artificial Sequence
  chemically synthesized
ctaacttttcatactaagcc

SEQ ID NO: 8440 - DNA, 20 bp, Artificial Sequence
  chemically synthesized
tactaagcccagtccttcca

SEQ ID NO: 8441 - DNA, 20 bp, Artificial Sequence
  chemically synthesized
taagcccagtccttccaaag

SEQ ID NO: 8442 - DNA, 20 bp, Artificial Sequence
  chemically synthesized
ccttccaaagcagactgtga

SEQ ID NO: 8443 - DNA, 20 bp, Artificial Sequence
  chemically synthesized
ttccaaagcagactgtgaaa

SEQ ID NO: 8444 - DNA, 20 bp, Artificial Sequence
  chemically synthesized
agcagactgtgaaagagtga

SEQ ID NO: 8445 - DNA, 20 bp, Artificial Sequence
  chemically synthesized
ctgtgaaagagtgatagttc

SEQ ID NO: 8446 - DNA, 20 bp, Artificial Sequence
  chemically synthesized
tgtgaaagagtgatagttcc

SEQ ID NO: 8447 - DNA, 20 bp, Artificial Sequence
  chemically synthesized
tgaaagagtgatagttccgg

SEQ ID NO: 8448 - DNA, 20 bp, Artificial Sequence
  chemically synthesized
gagtgatagttccgggagac

SEQ ID NO: 8449 - DNA, 20 bp, Artificial Sequence
  chemically synthesized
gttccgggagactagcactg

SEQ ID NO: 8450 - DNA, 20 bp, Artificial Sequence
  chemically synthesized
gagactagcactgcagattc

SEQ ID NO: 8451 - DNA, 20 bp, Artificial Sequence
  chemically synthesized
agactagcactgcagattcc

SEQ ID NO: 8452 - DNA, 20 bp, Artificial Sequence
  chemically synthesized
tgcagattccgggtcactgt

SEQ ID NO: 8453 - DNA, 20 bp, Artificial Sequence
  chemically synthesized
agattccgggtcactgtgag

SEQ ID NO: 8454 - DNA, 20 bp, Artificial Sequence
  chemically synthesized
gattccgggtcactgtgagt

SEQ ID NO: 8455 - DNA, 20 bp, Artificial Sequence
  chemically synthesized
attccgggtcactgtgagtg

SEQ ID NO: 8456 - DNA, 20 bp, Artificial Sequence
  chemically synthesized
ttccgggtcactgtgagtgg

SEQ ID NO: 8457 - DNA, 20 bp, Artificial Sequence
  chemically synthesized
ccgggtcactgtgagtgggg

SEQ ID NO: 8458 - DNA, 20 bp, Artificial Sequence
  chemically synthesized
cgggtcactgtgagtggggg

SEQ ID NO: 8459 - DNA, 20 bp, Artificial Sequence
  chemically synthesized
gtcactgtgagtgggggagg

SEQ ID NO: 8460 - DNA, 20 bp, Artificial Sequence
  chemically synthesized
tcactgtgagtgggggaggc

SEQ ID NO: 8461 - DNA, 20 bp, Artificial Sequence
  chemically synthesized
cactgtgagtgggggaggca

SEQ ID NO: 8462 - DNA, 20 bp, Artificial Sequence
  chemically synthesized
tgtgagtgggggaggcaggg

SEQ ID NO: 8463 - DNA, 20 bp, Artificial Sequence
  chemically synthesized
gagtgggggaggcagggaag

SEQ ID NO: 8464 - DNA, 20 bp, Artificial Sequence
  chemically synthesized
agtgggggaggcagggaaga

SEQ ID NO: 8465 - DNA, 20 bp, Artificial Sequence
  chemically synthesized
gtgggggaggcagggaagaa

SEQ ID NO: 8466 - DNA, 20 bp, Artificial Sequence
  chemically synthesized
aggcagggaagaagggctca

SEQ ID NO: 8467 - DNA, 20 bp, Artificial Sequence
  chemically synthesized
ggcagggaagaagggctcac

SEQ ID NO: 8468 - DNA, 20 bp, Artificial Sequence
  chemically synthesized
gggaagaagggctcacagga

SEQ ID NO: 8469 - DNA, 20 bp, Artificial Sequence
  chemically synthesized
acccctgtttttccttcttc

SEQ ID NO: 8470 - DNA, 20 bp, Artificial Sequence
  chemically synthesized
cctgtttttccttcttcaag

SEQ ID NO: 8471 - DNA, 20 bp, Artificial Sequence
  chemically synthesized
ttcttcaagtagacctctat

SEQ ID NO: 8472 - DNA, 20 bp, Artificial Sequence
  chemically synthesized
agtagacctctataagacaa

SEQ ID NO: 8473 - DNA, 20 bp, Artificial Sequence
  chemically synthesized
tagacctctataagacaaca

SEQ ID NO: 8474 - DNA, 20 bp, Artificial Sequence
  chemically synthesized
ataagacaacagagacaact

SEQ ID NO: 8475 - DNA, 20 bp, Artificial Sequence
  chemically synthesized
taagacaacagagacaacta

SEQ ID NO: 8476 - DNA, 20 bp, Artificial Sequence
  chemically synthesized
caacagagacaactaaggct

SEQ ID NO: 8477 - DNA, 20 bp, Artificial Sequence
  chemically synthesized
cagagacaactaaggctgag

SEQ ID NO: 8478 - DNA, 20 bp, Artificial Sequence
  chemically synthesized
gacaactaaggctgagtggc

SEQ ID NO: 8479 - DNA, 20 bp, Artificial Sequence
  chemically synthesized
acaactaaggctgagtggcc

SEQ ID NO: 8480 - DNA, 20 bp, Artificial Sequence
  chemically synthesized
ctaaggctgagtggccaggc

SEQ ID NO: 8481 - DNA, 20 bp, Artificial Sequence
  chemically synthesized
taaggctgagtggccaggcg

SEQ ID NO: 8482 - DNA, 20 bp, Artificial Sequence
  chemically synthesized
aggctgagtggccaggcgag

SEQ ID NO: 8483 - DNA, 20 bp, Artificial Sequence
  chemically synthesized
aaccatctcgccgtaaaaca

SEQ ID NO: 8484 - DNA, 20 bp, Artificial Sequence
  chemically synthesized
catctcgccgtaaaacatgg

SEQ ID NO: 8485 - DNA, 20 bp, Artificial Sequence
  chemically synthesized
atctcgccgtaaaacatgga

SEQ ID NO: 8486 - DNA, 20 bp, Artificial Sequence
  chemically synthesized
aaaacatggaaggaacactt

SEQ ID NO: 8487 - DNA, 20 bp, Artificial Sequence
  chemically synthesized
aaacatggaaggaacacttc

SEQ ID NO: 8488 - DNA, 20 bp, Artificial Sequence
  chemically synthesized
aacatggaaggaacacttca

SEQ ID NO: 8489 - DNA, 20 bp, Artificial Sequence
  chemically synthesized
acatggaaggaacacttcag

SEQ ID NO: 8490 - DNA, 20 bp, Artificial Sequence
  chemically synthesized
ggaaggaacacttcagggga

SEQ ID NO: 8491 - DNA, 20 bp, Artificial Sequence
  chemically synthesized
gaaggaacacttcaggggaa

SEQ ID NO: 8492 - DNA, 20 bp, Artificial Sequence
  chemically synthesized
ggaacacttcaggggaaagg

SEQ ID NO: 8493 - DNA, 20 bp, Artificial Sequence
  chemically synthesized
aggggaaaggtggtatctct

SEQ ID NO: 8494 - DNA, 20 bp, Artificial Sequence
  chemically synthesized
gaaaggtggtatctctaagc

SEQ ID NO: 8495 - DNA, 20 bp, Artificial Sequence
  chemically synthesized
aaggtggtatctctaagcaa

SEQ ID NO: 8496 - DNA, 20 bp, Artificial Sequence
  chemically synthesized
tatctctaagcaagagaact

SEQ ID NO: 8497 - DNA, 20 bp, Artificial Sequence
  chemically synthesized
ctctaagcaagagaactgag

SEQ ID NO: 8498 - DNA, 20 bp, Artificial Sequence
  chemically synthesized
ctaagcaagagaactgagtg

SEQ ID NO: 8499 - DNA, 20 bp, Artificial Sequence
  chemically synthesized
caagagaactgagtggagtc

SEQ ID NO: 8500 - DNA, 20 bp, Artificial Sequence
  chemically synthesized
aagagaactgagtggagtca

SEQ ID NO: 8501 - DNA, 20 bp, Artificial Sequence
  chemically synthesized
aactgagtggagtcaaggct

SEQ ID NO: 8502 - DNA, 20 bp, Artificial Sequence
  chemically synthesized
ctgagtggagtcaaggctga

SEQ ID NO: 8503 - DNA, 20 bp, Artificial Sequence
  chemically synthesized
ggagtcaaggctgagagatg

SEQ ID NO: 8504 - DNA, 20 bp, Artificial Sequence
  chemically synthesized
gagtcaaggctgagagatgc

SEQ ID NO: 8505 - DNA, 20 bp, Artificial Sequence
  chemically synthesized
aaggctgagagatgcaggat

SEQ ID NO: 8506 - DNA, 20 bp, Artificial Sequence
  chemically synthesized
agagatgcaggataagcaaa

SEQ ID NO: 8507 - DNA, 20 bp, Artificial Sequence
  chemically synthesized
gagatgcaggataagcaaat

SEQ ID NO: 8508 - DNA, 20 bp, Artificial Sequence
  chemically synthesized
atgcaggataagcaaatggg

SEQ ID NO: 8509 - DNA, 20 bp, Artificial Sequence
  chemically synthesized
ataagcaaatgggtagtgaa

SEQ ID NO: 8510 - DNA, 20 bp, Artificial Sequence
  chemically synthesized
ggtagtgaaaagacattcat

SEQ ID NO: 8511 - DNA, 20 bp, Artificial Sequence
  chemically synthesized
gtagtgaaaagacattcatg

SEQ ID NO: 8512 - DNA, 20 bp, Artificial Sequence
  chemically synthesized
tgaaaagacattcatgagga

SEQ ID NO: 8513 - DNA, 20 bp, Artificial Sequence
  chemically synthesized
atgaggacagctaaaacaat

SEQ ID NO: 8514 - DNA, 20 bp, Artificial Sequence
  chemically synthesized
acaataagtaatgtaaaata

SEQ ID NO: 8515 - DNA, 20 bp, Artificial Sequence
  chemically synthesized
aagtaatgtaaaatacagca

SEQ ID NO: 8516 - DNA, 20 bp, Artificial Sequence
  chemically synthesized
aaaactttaacctccaaatc

SEQ ID NO: 8517 - DNA, 20 bp, Artificial Sequence
  chemically synthesized
ctctacttgaatccttttct

SEQ ID NO: 8518 - DNA, 20 bp, Artificial Sequence
  chemically synthesized
tctacttgaatccttttctg

SEQ ID NO: 8519 - DNA, 20 bp, Artificial Sequence
  chemically synthesized
ctacttgaatccttttctga

SEQ ID NO: 8520 - DNA, 20 bp, Artificial Sequence
  chemically synthesized
tccttttctgagggatgaat

SEQ ID NO: 8521 - DNA, 20 bp, Artificial Sequence
  chemically synthesized
ccttttctgagggatgaata

SEQ ID NO: 8522 - DNA, 20 bp, Artificial Sequence
  chemically synthesized
gatgaataaggcatatgcat

SEQ ID NO: 8523 - DNA, 20 bp, Artificial Sequence
  chemically synthesized
atgaataaggcatatgcatc

SEQ ID NO: 8524 - DNA, 20 bp, Artificial Sequence
  chemically synthesized
tgaataaggcatatgcatca

SEQ ID NO: 8525 - DNA, 20 bp, Artificial Sequence
  chemically synthesized
gaataaggcatatgcatcag

SEQ ID NO: 8526 - DNA, 20 bp, Artificial Sequence
  chemically synthesized
gggctgttgccaatgtgcat

SEQ ID NO: 8527 - DNA, 20 bp, Artificial Sequence
  chemically synthesized
caatgtgcattagctgtttg

SEQ ID NO: 8528 - DNA, 20 bp, Artificial Sequence
  chemically synthesized
tgcagcctcaccttctttca

SEQ ID NO: 8529 - DNA, 20 bp, Artificial Sequence
  chemically synthesized
cagcctcaccttctttcatg

SEQ ID NO: 8530 - DNA, 20 bp, Artificial Sequence
  chemically synthesized
caccttctttcatggagttt

SEQ ID NO: 8531 - DNA, 20 bp, Artificial Sequence
  chemically synthesized
ctttcatggagtttaagata

SEQ ID NO: 8532 - DNA, 20 bp, Artificial Sequence
  chemically synthesized
aagatatagtgtattttccc

SEQ ID NO: 8533 - DNA, 20 bp, Artificial Sequence
  chemically synthesized
agatatagtgtattttccca

SEQ ID NO: 8534 - DNA, 20 bp, Artificial Sequence
  chemically synthesized
tattttcccaaggtttgaac

SEQ ID NO: 8535 - DNA, 20 bp, Artificial Sequence
  chemically synthesized
gacctcccacattccctttt

SEQ ID NO: 8536 - DNA, 20 bp, Artificial Sequence
  chemically synthesized
tccctttttagtaaaatatt

SEQ ID NO: 8537 - DNA, 20 bp, Artificial Sequence
  chemically synthesized
tgaaaataaatgttttttat

SEQ ID NO: 8538 - DNA, 20 bp, Artificial Sequence
  chemically synthesized
gaaaataaatgttttttatt

SEQ ID NO: 8539 - DNA, 20 bp, Artificial Sequence
  chemically synthesized
aataaatgttttttattagg

SEQ ID NO: 8540 - DNA, 20 bp, Artificial Sequence
  chemically synthesized
gttttttattaggcagaatc

SEQ ID NO: 8541 - DNA, 20 bp, Artificial Sequence
  chemically synthesized
taggcagaatccagatgctc

SEQ ID NO: 8542 - DNA, 20 bp, Artificial Sequence
  chemically synthesized
aggcagaatccagatgctca

SEQ ID NO: 8543 - DNA, 20 bp, Artificial Sequence
  chemically synthesized
aggcccttcataatatcccc

SEQ ID NO: 8544 - DNA, 20 bp, Artificial Sequence
  chemically synthesized
cttcataatatcccccagtt

SEQ ID NO: 8545 - DNA, 20 bp, Artificial Sequence
  chemically synthesized
cataatatcccccagtttag

SEQ ID NO: 8546 - DNA, 20 bp, Artificial Sequence
  chemically synthesized
atatcccccagtttagtagt

SEQ ID NO: 8547 - DNA, 20 bp, Artificial Sequence
  chemically synthesized
cccagtttagtagttggact

SEQ ID NO: 8548 - DNA, 20 bp, Artificial Sequence
  chemically synthesized
ccagtttagtagttggactt

SEQ ID NO: 8549 - DNA, 20 bp, Artificial Sequence
  chemically synthesized
cagtttagtagttggactta

SEQ ID NO: 8550 - DNA, 20 bp, Artificial Sequence
  chemically synthesized
gtagttggacttagggaaca

SEQ ID NO: 8551 - DNA, 20 bp, Artificial Sequence
  chemically synthesized
tagttggacttagggaacaa

SEQ ID NO: 8552 - DNA, 20 bp, Artificial Sequence
  chemically synthesized
gggaacaaaggaacctttaa

SEQ ID NO: 8553 - DNA, 20 bp, Artificial Sequence
  chemically synthesized
aaggaacctttaatagaaat

SEQ ID NO: 8554 - DNA, 20 bp, Artificial Sequence
  chemically synthesized
aacctttaatagaaattgga

SEQ ID NO: 8555 - DNA, 20 bp, Artificial Sequence
  chemically synthesized
tttaatagaaattggacagc

SEQ ID NO: 8556 - DNA, 20 bp, Artificial Sequence
  chemically synthesized
atagaaattggacagcaaga

SEQ ID NO: 8557 - DNA, 20 bp, Artificial Sequence
  chemically synthesized
aaattggacagcaagaaagc

SEQ ID NO: 8558 - DNA, 20 bp, Artificial Sequence
  chemically synthesized
ggacagcaagaaagcgagct

SEQ ID NO: 8559 - DNA, 20 bp, Artificial Sequence
  chemically synthesized
agcgagcttagtgatacttg

SEQ ID NO: 8560 - DNA, 20 bp, Artificial Sequence
  chemically synthesized
gcgagcttagtgatacttgt

SEQ ID NO: 8561 - DNA, 20 bp, Artificial Sequence
  chemically synthesized
gcttagtgatacttgtgggc

SEQ ID NO: 8562 - DNA, 20 bp, Artificial Sequence
  chemically synthesized
cttagtgatacttgtgggcc

SEQ ID NO: 8563 - DNA, 20 bp, Artificial Sequence
  chemically synthesized
ttagtgatacttgtgggcca

SEQ ID NO: 8564 - DNA, 20 bp, Artificial Sequence
  chemically synthesized
atacttgtgggccagggcat

SEQ ID NO: 8565 - DNA, 20 bp, Artificial Sequence
  chemically synthesized
ggccagggcattagccacac

SEQ ID NO: 8566 - DNA, 20 bp, Artificial Sequence
  chemically synthesized
caccagccaccactttctga

SEQ ID NO: 8567 - DNA, 20 bp, Artificial Sequence
  chemically synthesized
accagccaccactttctgat

SEQ ID NO: 8568 - DNA, 20 bp, Artificial Sequence
  chemically synthesized
agccaccactttctgatagg

SEQ ID NO: 8569 - DNA, 20 bp, Artificial Sequence
  chemically synthesized
ttctgataggcagcctgcac

SEQ ID NO: 8570 - DNA, 20 bp, Artificial Sequence
  chemically synthesized
tgataggcagcctgcactgg

SEQ ID NO: 8571 - DNA, 20 bp, Artificial Sequence
  chemically synthesized
gataggcagcctgcactggt

SEQ ID NO: 8572 - DNA, 20 bp, Artificial Sequence
  chemically synthesized
ataggcagcctgcactggtg

SEQ ID NO: 8573 - DNA, 20 bp, Artificial Sequence
  chemically synthesized
gtggggtgaattctttgcca

SEQ ID NO: 8574 - DNA, 20 bp, Artificial Sequence
  chemically synthesized
tgaattctttgccaaagtga

SEQ ID NO: 8575 - DNA, 20 bp, Artificial Sequence
  chemically synthesized
gaattctttgccaaagtgat

SEQ ID NO: 8576 - DNA, 20 bp, Artificial Sequence
  chemically synthesized
tctttgccaaagtgatgggc

SEQ ID NO: 8577 - DNA, 20 bp, Artificial Sequence
  chemically synthesized
caaagtgatgggccagcaca

SEQ ID NO: 8578 - DNA, 20 bp, Artificial Sequence
  chemically synthesized
tgatgggccagcacacagac

SEQ ID NO: 8579 - DNA, 20 bp, Artificial Sequence
  chemically synthesized
acacagaccagcacgttgcc

SEQ ID NO: 8580 - DNA, 20 bp, Artificial Sequence
  chemically synthesized
cacagaccagcacgttgccc

SEQ ID NO: 8581 - DNA, 20 bp, Artificial Sequence
  chemically synthesized
cagaccagcacgttgcccag

SEQ ID NO: 8582 - DNA, 20 bp, Artificial Sequence
  chemically synthesized
agcacgttgcccaggagctg

SEQ ID NO: 8583 - DNA, 20 bp, Artificial Sequence
  chemically synthesized
gcacgttgcccaggagctgt

SEQ ID NO: 8584 - DNA, 20 bp, Artificial Sequence
  chemically synthesized
acgttgcccaggagctgtgg

SEQ ID NO: 8585 - DNA, 20 bp, Artificial Sequence
  chemically synthesized
cgttgcccaggagctgtggg

SEQ ID NO: 8586 - DNA, 20 bp, Artificial Sequence
  chemically synthesized
tgcccaggagctgtgggagg

SEQ ID NO: 8587 - DNA, 20 bp, Artificial Sequence
  chemically synthesized
aggagctgtgggaggaagat

SEQ ID NO: 8588 - DNA, 20 bp, Artificial Sequence
  chemically synthesized
gagctgtgggaggaagataa

SEQ ID NO: 8589 - DNA, 20 bp, Artificial Sequence
  chemically synthesized
agctgtgggaggaagataag

SEQ ID NO: 8590 - DNA, 20 bp, Artificial Sequence
  chemically synthesized
ataagaggtatgaacatgat

SEQ ID NO: 8591 - DNA, 20 bp, Artificial Sequence
  chemically synthesized
ggtatgaacatgattagcaa

SEQ ID NO: 8592 - DNA, 20 bp, Artificial Sequence
  chemically synthesized
gtatgaacatgattagcaaa

SEQ ID NO: 8593 - DNA, 20 bp, Artificial Sequence
  chemically synthesized
tatgaacatgattagcaaaa

SEQ ID NO: 8594 - DNA, 20 bp, Artificial Sequence
  chemically synthesized
acatgattagcaaaagggcc

SEQ ID NO: 8595 - DNA, 20 bp, Artificial Sequence
  chemically synthesized
attagcaaaagggcctagct

SEQ ID NO: 8596 - DNA, 20 bp, Artificial Sequence
  chemically synthesized
aaaagggcctagcttggact

SEQ ID NO: 8597 - DNA, 20 bp, Artificial Sequence
  chemically synthesized
agcttggactcagaataatc

SEQ ID NO: 8598 - DNA, 20 bp, Artificial Sequence
  chemically synthesized
ttatcccaaccataaaataa

SEQ ID NO: 8599 - DNA, 20 bp, Artificial Sequence
  chemically synthesized
tcccaaccataaaataaaag

SEQ ID NO: 8600 - DNA, 20 bp, Artificial Sequence
  chemically synthesized
accataaaataaaagcagaa

SEQ ID NO: 8601 - DNA, 20 bp, Artificial Sequence
  chemically synthesized
ataaaataaaagcagaatgg

SEQ ID NO: 8602 - DNA, 20 bp, Artificial Sequence
  chemically synthesized
aataaaagcagaatggtagc

SEQ ID NO: 8603 - DNA, 20 bp, Artificial Sequence
  chemically synthesized
gcagaatggtagctggattg

SEQ ID NO: 8604 - DNA, 20 bp, Artificial Sequence
  chemically synthesized
agctggattgtagctgctat

SEQ ID NO: 8605 - DNA, 20 bp, Artificial Sequence
  chemically synthesized
caatatgaaacctcttacat

SEQ ID NO: 8606 - DNA, 20 bp, Artificial Sequence
  chemically synthesized
catcagttacaatttatatg

SEQ ID NO: 8607 - DNA, 20 bp, Artificial Sequence
  chemically synthesized
tatgcagaaatatttatatg

SEQ ID NO: 8608 - DNA, 20 bp, Artificial Sequence
  chemically synthesized
tgcagaaatatttatatgca

SEQ ID NO: 8609 - DNA, 20 bp, Artificial Sequence
  chemically synthesized
atattgctattgccttaacc

SEQ ID NO: 8610 - DNA, 20 bp, Artificial Sequence
  chemically synthesized
aaattatcactgttattctt

SEQ ID NO: 8611 - DNA, 20 bp, Artificial Sequence
  chemically synthesized
atcactgttattctttagaa

SEQ ID NO: 8612 - DNA, 20 bp, Artificial Sequence
  chemically synthesized
ttattctttagaatggtgca

SEQ ID NO: 8613 - DNA, 20 bp, Artificial Sequence
  chemically synthesized
attctttagaatggtgcaaa

SEQ ID NO: 8614 - DNA, 20 bp, Artificial Sequence
  chemically synthesized
ttctttagaatggtgcaaag

SEQ ID NO: 8615 - DNA, 20 bp, Artificial Sequence
  chemically synthesized
ttgtatcattattgccctga

SEQ ID NO: 8616 - DNA, 20 bp, Artificial Sequence
  chemically synthesized
atcattattgccctgaaaga

SEQ ID NO: 8617 - DNA, 20 bp, Artificial Sequence
  chemically synthesized
cattattgccctgaaagaaa

SEQ ID NO: 8618 - DNA, 20 bp, Artificial Sequence
  chemically synthesized
ttgccctgaaagaaagagat

SEQ ID NO: 8619 - DNA, 20 bp, Artificial Sequence
  chemically synthesized
tgccctgaaagaaagagatt

SEQ ID NO: 8620 - DNA, 20 bp, Artificial Sequence
  chemically synthesized
gccctgaaagaaagagatta

SEQ ID NO: 8621 - DNA, 20 bp, Artificial Sequence
  chemically synthesized
tgaaagaaagagattaggga

SEQ ID NO: 8622 - DNA, 20 bp, Artificial Sequence
  chemically synthesized
aaagagattagggaaagtat

SEQ ID NO: 8623 - DNA, 20 bp, Artificial Sequence
  chemically synthesized
ttagggaaagtattagaaat

SEQ ID NO: 8624 - DNA, 20 bp, Artificial Sequence
  chemically synthesized
tagaaataagataaacaaaa

SEQ ID NO: 8625 - DNA, 20 bp, Artificial Sequence
  chemically synthesized
taaacaaaaaagtatattaa

SEQ ID NO: 8626 - DNA, 20 bp, Artificial Sequence
  chemically synthesized
acaaaaaagtatattaaaag

SEQ ID NO: 8627 - DNA, 20 bp, Artificial Sequence
  chemically synthesized
aaaagtatattaaaagaaga

SEQ ID NO: 8628 - DNA, 20 bp, Artificial Sequence
  chemically synthesized
aatgcaaaattaccctgatt

SEQ ID NO: 8629 - DNA, 20 bp, Artificial Sequence
  chemically synthesized
tatgtatcaattaaaaataa

SEQ ID NO: 8630 - DNA, 20 bp, Artificial Sequence
  chemically synthesized
attaaaaataaaagaaaata

SEQ ID NO: 8631 - DNA, 20 bp, Artificial Sequence
  chemically synthesized
aaaaataaaagaaaataaag

SEQ ID NO: 8632 - DNA, 20 bp, Artificial Sequence
  chemically synthesized
aaaataaaagaaaataaagt

SEQ ID NO: 8633 - DNA, 20 bp, Artificial Sequence
  chemically synthesized
aaataaaagaaaataaagta

SEQ ID NO: 8634 - DNA, 20 bp, Artificial Sequence
  chemically synthesized
ataaaagaaaataaagtagg

SEQ ID NO: 8635 - DNA, 20 bp, Artificial Sequence
  chemically synthesized
gagattatgaatatgcaaat

SEQ ID NO: 8636 - DNA, 20 bp, Artificial Sequence
  chemically synthesized
aagcacacatatattccaaa

SEQ ID NO: 8637 - DNA, 20 bp, Artificial Sequence
  chemically synthesized
tattccaaatagtaatgtac

SEQ ID NO: 8638 - DNA, 20 bp, Artificial Sequence
  chemically synthesized
attccaaatagtaatgtact

SEQ ID NO: 8639 - DNA, 20 bp, Artificial Sequence
  chemically synthesized
ccaaatagtaatgtactagg

SEQ ID NO: 8640 - DNA, 20 bp, Artificial Sequence
  chemically synthesized
tgtactaggcagactgtgta

SEQ ID NO: 8641 - DNA, 20 bp, Artificial Sequence
  chemically synthesized
actgtgtaaagttttttttt

SEQ ID NO: 8642 - DNA, 20 bp, Artificial Sequence
  chemically synthesized
ttaagttacttaatgtatct

SEQ ID NO: 8643 - DNA, 20 bp, Artificial Sequence
  chemically synthesized
aagttacttaatgtatctca

SEQ ID NO: 8644 - DNA, 20 bp, Artificial Sequence
  chemically synthesized
cttttgttatacacaatgtt

SEQ ID NO: 8645 - DNA, 20 bp, Artificial Sequence
  chemically synthesized
ttttgttatacacaatgtta

SEQ ID NO: 8646 - DNA, 20 bp, Artificial Sequence
  chemically synthesized
atacacaatgttaaggcatt

SEQ ID NO: 8647 - DNA, 20 bp, Artificial Sequence
  chemically synthesized
tgttaaggcattaagtataa

SEQ ID NO: 8648 - DNA, 20 bp, Artificial Sequence
  chemically synthesized
aagtataatagtaaaaattg

SEQ ID NO: 8649 - DNA, 20 bp, Artificial Sequence
  chemically synthesized
gtataatagtaaaaattgcg

SEQ ID NO: 8650 - DNA, 20 bp, Artificial Sequence
  chemically synthesized
taatagtaaaaattgcggag

SEQ ID NO: 8651 - DNA, 20 bp, Artificial Sequence
  chemically synthesized
aattgcggagaagaaaaaaa

SEQ ID NO: 8652 - DNA, 20 bp, Artificial Sequence
  chemically synthesized
gcggagaagaaaaaaaaaga

SEQ ID NO: 8653 - DNA, 20 bp, Artificial Sequence
  chemically synthesized
agaagaaaaaaaaagaaagc

SEQ ID NO: 8654 - DNA, 20 bp, Artificial Sequence
  chemically synthesized
agaaagcaagaattaaacaa

SEQ ID NO: 8655 - DNA, 20 bp, Artificial Sequence
  chemically synthesized
aagaaaacaattgttatgaa

SEQ ID NO: 8656 - DNA, 20 bp, Artificial Sequence
  chemically synthesized
ttgttatgaacagcaaataa

SEQ ID NO: 8657 - DNA, 20 bp, Artificial Sequence
  chemically synthesized
aaagaaactaaaacgatcct

SEQ ID NO: 8658 - DNA, 20 bp, Artificial Sequence
  chemically synthesized
ctatgacatgaacttaacca

SEQ ID NO: 8659 - DNA, 20 bp, Artificial Sequence
  chemically synthesized
acatgaacttaaccatagaa

SEQ ID NO: 8660 - DNA, 20 bp, Artificial Sequence
  chemically synthesized
tgaacttaaccatagaaaag

SEQ ID NO: 8661 - DNA, 20 bp, Artificial Sequence
  chemically synthesized
gaacttaaccatagaaaaga

SEQ ID NO: 8662 - DNA, 20 bp, Artificial Sequence
  chemically synthesized
aacttaaccatagaaaagaa

SEQ ID NO: 8663 - DNA, 20 bp, Artificial Sequence
  chemically synthesized
acttaaccatagaaaagaag

SEQ ID NO: 8664 - DNA, 20 bp, Artificial Sequence
  chemically synthesized
aaccatagaaaagaagggga

SEQ ID NO: 8665 - DNA, 20 bp, Artificial Sequence
  chemically synthesized
agaaggggaaagaaaacatc

SEQ ID NO: 8666 - DNA, 20 bp, Artificial Sequence
  chemically synthesized
agaaaacatcaagcgtccca

SEQ ID NO: 8667 - DNA, 20 bp, Artificial Sequence
  chemically synthesized
cgtcccatagactcaccctg

SEQ ID NO: 8668 - DNA, 20 bp, Artificial Sequence
  chemically synthesized
tagactcaccctgaagttct

SEQ ID NO: 8669 - DNA, 20 bp, Artificial Sequence
  chemically synthesized
agactcaccctgaagttctc

SEQ ID NO: 8670 - DNA, 20 bp, Artificial Sequence
  chemically synthesized
aagttctcaggatccacgtg

SEQ ID NO: 8671 - DNA, 20 bp, Artificial Sequence
  chemically synthesized
gatccacgtgcagcttgtca

SEQ ID NO: 8672 - DNA, 20 bp, Artificial Sequence
  chemically synthesized
acgtgcagcttgtcacagtg

SEQ ID NO: 8673 - DNA, 20 bp, Artificial Sequence
  chemically synthesized
ttgtcacagtgcagctcact

SEQ ID NO: 8674 - DNA, 20 bp, Artificial Sequence
  chemically synthesized
acagtgcagctcactcagtg

SEQ ID NO: 8675 - DNA, 20 bp, Artificial Sequence
  chemically synthesized
gcagctcactcagtgtggca

SEQ ID NO: 8676 - DNA, 20 bp, Artificial Sequence
  chemically synthesized
cagctcactcagtgtggcaa

SEQ ID NO: 8677 - DNA, 20 bp, Artificial Sequence
  chemically synthesized
agtgtggcaaaggtgccctt

SEQ ID NO: 8678 - DNA, 20 bp, Artificial Sequence
  chemically synthesized
gtgtggcaaaggtgcccttg

SEQ ID NO: 8679 - DNA, 20 bp, Artificial Sequence
  chemically synthesized
aaggtgcccttgaggttgtc

SEQ ID NO: 8680 - DNA, 20 bp, Artificial Sequence
  chemically synthesized
aggtgcccttgaggttgtcc

SEQ ID NO: 8681 - DNA, 20 bp, Artificial Sequence
  chemically synthesized
gcccttgaggttgtccaggt

SEQ ID NO: 8682 - DNA, 20 bp, Artificial Sequence
  chemically synthesized
ttgaggttgtccaggtgagc

SEQ ID NO: 8683 - DNA, 20 bp, Artificial Sequence
  chemically synthesized
tgaggttgtccaggtgagcc

SEQ ID NO: 8684 - DNA, 20 bp, Artificial Sequence
  chemically synthesized
ggtgagccaggccatcacta

SEQ ID NO: 8685 - DNA, 20 bp, Artificial Sequence
  chemically synthesized
gtgagccaggccatcactaa

SEQ ID NO: 8686 - DNA, 20 bp, Artificial Sequence
  chemically synthesized
aggccatcactaaaggcacc

SEQ ID NO: 8687 - DNA, 20 bp, Artificial Sequence
  chemically synthesized
accgagcactttcttgccat

SEQ ID NO: 8688 - DNA, 20 bp, Artificial Sequence
  chemically synthesized
cttgccatgagccttcacct

SEQ ID NO: 8689 - DNA, 20 bp, Artificial Sequence
  chemically synthesized
ttgccatgagccttcacctt

SEQ ID NO: 8690 - DNA, 20 bp, Artificial Sequence
  chemically synthesized
tgccatgagccttcacctta

SEQ ID NO: 8691 - DNA, 20 bp, Artificial Sequence
  chemically synthesized
caccttagggttgcccataa

SEQ ID NO: 8692 - DNA, 20 bp, Artificial Sequence
  chemically synthesized
agggttgcccataacagcat

SEQ ID NO: 8693 - DNA, 20 bp, Artificial Sequence
  chemically synthesized
gggttgcccataacagcatc

SEQ ID NO: 8694 - DNA, 20 bp, Artificial Sequence
  chemically synthesized
gttgcccataacagcatcag

SEQ ID NO: 8695 - DNA, 20 bp, Artificial Sequence
  chemically synthesized
gcccataacagcatcaggag

SEQ ID NO: 8696 - DNA, 20 bp, Artificial Sequence
  chemically synthesized
ataacagcatcaggagtgga

SEQ ID NO: 8697 - DNA, 20 bp, Artificial Sequence
  chemically synthesized
caggagtggacagatcccca

SEQ ID NO: 8698 - DNA, 20 bp, Artificial Sequence
  chemically synthesized
aggagtggacagatccccaa

SEQ ID NO: 8699 - DNA, 20 bp, Artificial Sequence
  chemically synthesized
acagatccccaaaggactca

SEQ ID NO: 8700 - DNA, 20 bp, Artificial Sequence
  chemically synthesized
caaaggactcaaagaacctc

SEQ ID NO: 8701 - DNA, 20 bp, Artificial Sequence
  chemically synthesized
aaaggactcaaagaacctct

SEQ ID NO: 8702 - DNA, 20 bp, Artificial Sequence
  chemically synthesized
ctcaaagaacctctgggtcc

SEQ ID NO: 8703 - DNA, 20 bp, Artificial Sequence
  chemically synthesized
tcaaagaacctctgggtcca

SEQ ID NO: 8704 - DNA, 20 bp, Artificial Sequence
  chemically synthesized
caaagaacctctgggtccaa

SEQ ID NO: 8705 - DNA, 20 bp, Artificial Sequence
  chemically synthesized
agaacctctgggtccaaggg

SEQ ID NO: 8706 - DNA, 20 bp, Artificial Sequence
  chemically synthesized
tgggtccaagggtagaccac

SEQ ID NO: 8707 - DNA, 20 bp, Artificial Sequence
  chemically synthesized
gtccaagggtagaccaccag

SEQ ID NO: 8708 - DNA, 20 bp, Artificial Sequence
  chemically synthesized
gggtagaccaccagcagcct

SEQ ID NO: 8709 - DNA, 20 bp, Artificial Sequence
  chemically synthesized
ggtagaccaccagcagccta

SEQ ID NO: 8710 - DNA, 20 bp, Artificial Sequence
  chemically synthesized
gtagaccaccagcagcctaa

SEQ ID NO: 8711 - DNA, 20 bp, Artificial Sequence
  chemically synthesized
gaccaccagcagcctaaggg

SEQ ID NO: 8712 - DNA, 20 bp, Artificial Sequence
  chemically synthesized
accaccagcagcctaagggt

SEQ ID NO: 8713 - DNA, 20 bp, Artificial Sequence
  chemically synthesized
gcagcctaagggtgggaaaa

SEQ ID NO: 8714 - DNA, 20 bp, Artificial Sequence
  chemically synthesized
agggtgggaaaatagaccaa

SEQ ID NO: 8715 - DNA, 20 bp, Artificial Sequence
  chemically synthesized
gggtgggaaaatagaccaat

SEQ ID NO: 8716 - DNA, 20 bp, Artificial Sequence
  chemically synthesized
tgggaaaatagaccaatagg

SEQ ID NO: 8717 - DNA, 20 bp, Artificial Sequence
  chemically synthesized
ggaaaatagaccaataggca

SEQ ID NO: 8718 - DNA, 20 bp, Artificial Sequence
  chemically synthesized
aaaatagaccaataggcaga

SEQ ID NO: 8719 - DNA, 20 bp, Artificial Sequence
  chemically synthesized
aatagaccaataggcagaga

SEQ ID NO: 8720 - DNA, 20 bp, Artificial Sequence
  chemically synthesized
gaccaataggcagagagagt

SEQ ID NO: 8721 - DNA, 20 bp, Artificial Sequence
  chemically synthesized
cagagagagtcagtgcctat

SEQ ID NO: 8722 - DNA, 20 bp, Artificial Sequence
  chemically synthesized
tcagtgcctatcagaaaccc

SEQ ID NO: 8723 - DNA, 20 bp, Artificial Sequence
  chemically synthesized
agtgcctatcagaaacccaa

SEQ ID NO: 8724 - DNA, 20 bp, Artificial Sequence
  chemically synthesized
cttctctgtctccacatgcc

SEQ ID NO: 8725 - DNA, 20 bp, Artificial Sequence
  chemically synthesized
tccacatgcccagtttctat

SEQ ID NO: 8726 - DNA, 20 bp, Artificial Sequence
  chemically synthesized
aaccttgataccaacctgcc

SEQ ID NO: 8727 - DNA, 20 bp, Artificial Sequence
  chemically synthesized
accttgataccaacctgccc

SEQ ID NO: 8728 - DNA, 20 bp, Artificial Sequence
  chemically synthesized
ccttgataccaacctgccca

SEQ ID NO: 8729 - DNA, 20 bp, Artificial Sequence
  chemically synthesized
tccacgttcaccttgcccca

SEQ ID NO: 8730 - DNA, 20 bp, Artificial Sequence
  chemically synthesized
ccacgttcaccttgccccac

SEQ ID NO: 8731 - DNA, 20 bp, Artificial Sequence
  chemically synthesized
cacgttcaccttgccccaca

SEQ ID NO: 8732 - DNA, 20 bp, Artificial Sequence
  chemically synthesized
gttcaccttgccccacaggg

SEQ ID NO: 8733 - DNA, 20 bp, Artificial Sequence
  chemically synthesized
cttgccccacagggcagtaa

SEQ ID NO: 8734 - DNA, 20 bp, Artificial Sequence
  chemically synthesized
gccccacagggcagtaacgg

SEQ ID NO: 8735 - DNA, 20 bp, Artificial Sequence
  chemically synthesized
agtaacggcagacttctcct

SEQ ID NO: 8736 - DNA, 20 bp, Artificial Sequence
  chemically synthesized
gtaacggcagacttctcctc

SEQ ID NO: 8737 - DNA, 20 bp, Artificial Sequence
  chemically synthesized
aacggcagacttctcctcag

SEQ ID NO: 8738 - DNA, 20 bp, Artificial Sequence
  chemically synthesized
gcagacttctcctcaggagt

SEQ ID NO: 8739 - DNA, 20 bp, Artificial Sequence
  chemically synthesized
ctcaggagtcagatgcacca

SEQ ID NO: 8740 - DNA, 20 bp, Artificial Sequence
  chemically synthesized
atgcaccatggtgtctgttt

SEQ ID NO: 8741 - DNA, 20 bp, Artificial Sequence
  chemically synthesized
tgcaccatggtgtctgtttg

SEQ ID NO: 8742 - DNA, 20 bp, Artificial Sequence
  chemically synthesized
tggtgtctgtttgaggttgc

SEQ ID NO: 8743 - DNA, 20 bp, Artificial Sequence
  chemically synthesized
tttgaggttgctagtgaaca

SEQ ID NO: 8744 - DNA, 20 bp, Artificial Sequence
  chemically synthesized
gctagtgaacacagttgtgt

SEQ ID NO: 8745 - DNA, 20 bp, Artificial Sequence
  chemically synthesized
agtgaacacagttgtgtcag

SEQ ID NO: 8746 - DNA, 20 bp, Artificial Sequence
  chemically synthesized
gttgtgtcagaagcaaatgt

SEQ ID NO: 8747 - DNA, 20 bp, Artificial Sequence
  chemically synthesized
tcagaagcaaatgtaagcaa

SEQ ID NO: 8748 - DNA, 20 bp, Artificial Sequence
  chemically synthesized
aagcaaatgtaagcaataga

SEQ ID NO: 8749 - DNA, 20 bp, Artificial Sequence
  chemically synthesized
tctgccctgacttttatgcc

SEQ ID NO: 8750 - DNA, 20 bp, Artificial Sequence
  chemically synthesized
ctgacttttatgcccagccc

SEQ ID NO: 8751 - DNA, 20 bp, Artificial Sequence
  chemically synthesized
gctcctgccctccctgctcc

SEQ ID NO: 8752 - DNA, 20 bp, Artificial Sequence
  chemically synthesized
ctcctgccctccctgctcct

SEQ ID NO: 8753 - DNA, 20 bp, Artificial Sequence
  chemically synthesized
cctgccctccctgctcctgg

SEQ ID NO: 8754 - DNA, 20 bp, Artificial Sequence
  chemically synthesized
gccctccctgctcctgggag

SEQ ID NO: 8755 - DNA, 20 bp, Artificial Sequence
  chemically synthesized
ccctgctcctgggagtagat

SEQ ID NO: 8756 - DNA, 20 bp, Artificial Sequence
  chemically synthesized
gggagtagattggccaaccc

SEQ ID NO: 8757 - DNA, 20 bp, Artificial Sequence
  chemically synthesized
ggagtagattggccaaccct

SEQ ID NO: 8758 - DNA, 20 bp, Artificial Sequence
  chemically synthesized
gagtagattggccaacccta

SEQ ID NO: 8759 - DNA, 20 bp, Artificial Sequence
  chemically synthesized
gattggccaaccctagggtg

SEQ ID NO: 8760 - DNA, 20 bp, Artificial Sequence
  chemically synthesized
aaccctagggtgtggctcca

SEQ ID NO: 8761 - DNA, 20 bp, Artificial Sequence
  chemically synthesized
accctagggtgtggctccac

SEQ ID NO: 8762 - DNA, 20 bp, Artificial Sequence
  chemically synthesized
ccctagggtgtggctccaca

SEQ ID NO: 8763 - DNA, 20 bp, Artificial Sequence
  chemically synthesized
agggtgtggctccacagggt

SEQ ID NO: 8764 - DNA, 20 bp, Artificial Sequence
  chemically synthesized
gggtgtggctccacagggtg

SEQ ID NO: 8765 - DNA, 20 bp, Artificial Sequence
  chemically synthesized
ggctccacagggtgaggtct

SEQ ID NO: 8766 - DNA, 20 bp, Artificial Sequence
  chemically synthesized
gggtgaggtctaagtgatga

SEQ ID NO: 8767 - DNA, 20 bp, Artificial Sequence
  chemically synthesized
atgacagccgtacctgtcct

SEQ ID NO: 8768 - DNA, 20 bp, Artificial Sequence
  chemically synthesized
gtacctgtccttggctcttc

SEQ ID NO: 8769 - DNA, 20 bp, Artificial Sequence
  chemically synthesized
gtccttggctcttctggcac

SEQ ID NO: 8770 - DNA, 20 bp, Artificial Sequence
  chemically synthesized
tggctcttctggcactggct

SEQ ID NO: 8771 - DNA, 20 bp, Artificial Sequence
  chemically synthesized
ggctcttctggcactggctt

SEQ ID NO: 8772 - DNA, 20 bp, Artificial Sequence
  chemically synthesized
ctcttctggcactggcttag

SEQ ID NO: 8773 - DNA, 20 bp, Artificial Sequence
  chemically synthesized
tctggcactggcttaggagt

SEQ ID NO: 8774 - DNA, 20 bp, Artificial Sequence
  chemically synthesized
ggagttggacttcaaaccct

SEQ ID NO: 8775 - DNA, 20 bp, Artificial Sequence
  chemically synthesized
aaaccctcagccctccctct

SEQ ID NO: 8776 - DNA, 20 bp, Artificial Sequence
  chemically synthesized
tccctctaagatatatctct

SEQ ID NO: 8777 - DNA, 20 bp, Artificial Sequence
  chemically synthesized
atctcttggccccataccat

SEQ ID NO: 8778 - DNA, 20 bp, Artificial Sequence
  chemically synthesized
ctaaaaacatcctcctttgc

SEQ ID NO: 8779 - DNA, 20 bp, Artificial Sequence
  chemically synthesized
aagtgtatttacgtaatatt

SEQ ID NO: 8780 - DNA, 20 bp, Artificial Sequence
  chemically synthesized
ttacgtaatatttggaatca

SEQ ID NO: 8781 - DNA, 20 bp, Artificial Sequence
  chemically synthesized
taatatttggaatcacagct

SEQ ID NO: 8782 - DNA, 20 bp, Artificial Sequence
  chemically synthesized
atttggaatcacagcttggt

SEQ ID NO: 8783 - DNA, 20 bp, Artificial Sequence
  chemically synthesized
acagcttggtaagcatattg

SEQ ID NO: 8784 - DNA, 20 bp, Artificial Sequence
  chemically synthesized
aattttcttattacacaaat

SEQ ID NO: 8785 - DNA, 20 bp, Artificial Sequence
  chemically synthesized
tttcttattacacaaataag

SEQ ID NO: 8786 - DNA, 20 bp, Artificial Sequence
  chemically synthesized
ataagaagttgatgcactaa

SEQ ID NO: 8787 - DNA, 20 bp, Artificial Sequence
  chemically synthesized
agaagttgatgcactaaaag

SEQ ID NO: 8788 - DNA, 20 bp, Artificial Sequence
  chemically synthesized
agttgatgcactaaaagtgg

SEQ ID NO: 8789 - DNA, 20 bp, Artificial Sequence
  chemically synthesized
ttgatgcactaaaagtggaa

SEQ ID NO: 8790 - DNA, 20 bp, Artificial Sequence
  chemically synthesized
gagttttgtctaccataatt

SEQ ID NO: 8791 - DNA, 20 bp, Artificial Sequence
  chemically synthesized
tgtctaccataattcagctt

SEQ ID NO: 8792 - DNA, 20 bp, Artificial Sequence
  chemically synthesized
gtctaccataattcagcttt

SEQ ID NO: 8793 - DNA, 20 bp, Artificial Sequence
  chemically synthesized
taattcagctttgggatatg

SEQ ID NO: 8794 - DNA, 20 bp, Artificial Sequence
  chemically synthesized
tcagctttgggatatgtaga

SEQ ID NO: 8795 - DNA, 20 bp, Artificial Sequence
  chemically synthesized
tggatctcttcctgcgtctc

SEQ ID NO: 8796 - DNA, 20 bp, Artificial Sequence
  chemically synthesized
cagaatatgcaaaatactta

SEQ ID NO: 8797 - DNA, 20 bp, Artificial Sequence
  chemically synthesized
agaatatgcaaaatacttac

SEQ ID NO: 8798 - DNA, 20 bp, Artificial Sequence
  chemically synthesized
tatgcaaaatacttacagga

SEQ ID NO: 8799 - DNA, 20 bp, Artificial Sequence
  chemically synthesized
aaaatacttacaggacagaa

SEQ ID NO: 8800 - DNA, 20 bp, Artificial Sequence
  chemically synthesized
aatggatgaaaactctacct

SEQ ID NO: 8801 - DNA, 20 bp, Artificial Sequence
  chemically synthesized
gaaaactctacctcggttct

SEQ ID NO: 8802 - DNA, 20 bp, Artificial Sequence
  chemically synthesized
aagcatatcttctccttatt

SEQ ID NO: 8803 - DNA, 20 bp, Artificial Sequence
  chemically synthesized
ttatttggattaaaaccttc

SEQ ID NO: 8804 - DNA, 20 bp, Artificial Sequence
  chemically synthesized
ttggattaaaaccttctggt

SEQ ID NO: 8805 - DNA, 20 bp, Artificial Sequence
  chemically synthesized
ttaaaaccttctggtaagaa

SEQ ID NO: 8806 - DNA, 20 bp, Artificial Sequence
  chemically synthesized
taataaattatgtctaaaaa

SEQ ID NO: 8807 - DNA, 20 bp, Artificial Sequence
  chemically synthesized
aatcaatgtgctctgtgcat

SEQ ID NO: 8808 - DNA, 20 bp, Artificial Sequence
  chemically synthesized
tctgtgcattagttacttat

SEQ ID NO: 8809 - DNA, 20 bp, Artificial Sequence
  chemically synthesized
ctgtgcattagttacttatt

SEQ ID NO: 8810 - DNA, 20 bp, Artificial Sequence
  chemically synthesized
attagttacttattaggttt

SEQ ID NO: 8811 - DNA, 20 bp, Artificial Sequence
  chemically synthesized
ttagttacttattaggtttt

SEQ ID NO: 8812 - DNA, 20 bp, Artificial Sequence
  chemically synthesized
cttattaggttttgggaaac

SEQ ID NO: 8813 - DNA, 20 bp, Artificial Sequence
  chemically synthesized
tattaggttttgggaaacaa

SEQ ID NO: 8814 - DNA, 20 bp, Artificial Sequence
  chemically synthesized
ggaaacaagagataaaaaac

SEQ ID NO: 8815 - DNA, 20 bp, Artificial Sequence
  chemically synthesized
aaacaagagataaaaaacta

SEQ ID NO: 8816 - DNA, 20 bp, Artificial Sequence
  chemically synthesized
aaactagagacctcttaatg

SEQ ID NO: 8817 - DNA, 20 bp, Artificial Sequence
  chemically synthesized
caaaaatacaaataaataaa

SEQ ID NO: 8818 - DNA, 20 bp, Artificial Sequence
  chemically synthesized
aaaaagtcacttacaaccca

SEQ ID NO: 8819 - DNA, 20 bp, Artificial Sequence
  chemically synthesized
acccaaagtgtgactatcaa

SEQ ID NO: 8820 - DNA, 20 bp, Artificial Sequence
  chemically synthesized
cccaaagtgtgactatcaat

SEQ ID NO: 8821 - DNA, 20 bp, Artificial Sequence
  chemically synthesized
ccaaagtgtgactatcaatg

SEQ ID NO: 8822 - DNA, 20 bp, Artificial Sequence
  chemically synthesized
gtgactatcaatggggtaat

SEQ ID NO: 8823 - DNA, 20 bp, Artificial Sequence
  chemically synthesized
actatcaatggggtaatcag

SEQ ID NO: 8824 - DNA, 20 bp, Artificial Sequence
  chemically synthesized
gggtaatcagtggtgtcaaa

SEQ ID NO: 8825 - DNA, 20 bp, Artificial Sequence
  chemically synthesized
ggtaatcagtggtgtcaaat

SEQ ID NO: 8826 - DNA, 20 bp, Artificial Sequence
  chemically synthesized
taatcagtggtgtcaaatag

SEQ ID NO: 8827 - DNA, 20 bp, Artificial Sequence
  chemically synthesized
aatcagtggtgtcaaatagg

SEQ ID NO: 8828 - DNA, 20 bp, Artificial Sequence
  chemically synthesized
gtgtcaaataggaggttaac

SEQ ID NO: 8829 - DNA, 20 bp, Artificial Sequence
  chemically synthesized
tgtcaaataggaggttaact

SEQ ID NO: 8830 - DNA, 20 bp, Artificial Sequence
  chemically synthesized
gtcaaataggaggttaactg

SEQ ID NO: 8831 - DNA, 20 bp, Artificial Sequence
  chemically synthesized
gacatctaactgtttctgcc

SEQ ID NO: 8832 - DNA, 20 bp, Artificial Sequence
  chemically synthesized
ttctgcctggactaatctgc

SEQ ID NO: 8833 - DNA, 20 bp, Artificial Sequence
  chemically synthesized
ctgcctggactaatctgcaa

SEQ ID NO: 8834 - DNA, 20 bp, Artificial Sequence
  chemically synthesized
gactaatctgcaagagtgtc

SEQ ID NO: 8835 - DNA, 20 bp, Artificial Sequence
  chemically synthesized
actaatctgcaagagtgtct

SEQ ID NO: 8836 - DNA, 20 bp, Artificial Sequence
  chemically synthesized
ctaatctgcaagagtgtctg

SEQ ID NO: 8837 - DNA, 20 bp, Artificial Sequence
  chemically synthesized
taatctgcaagagtgtctgg

SEQ ID NO: 8838 - DNA, 20 bp, Artificial Sequence
  chemically synthesized
agagtgtctgggggaacaaa

SEQ ID NO: 8839 - DNA, 20 bp, Artificial Sequence
  chemically synthesized
aacaaaaagcctctgtgact

SEQ ID NO: 8840 - DNA, 20 bp, Artificial Sequence
  chemically synthesized
aaaagcctctgtgacttaga

SEQ ID NO: 8841 - DNA, 20 bp, Artificial Sequence
  chemically synthesized
agcctctgtgacttagaaag

SEQ ID NO: 8842 - DNA, 20 bp, Artificial Sequence
  chemically synthesized
gcctctgtgacttagaaagt

SEQ ID NO: 8843 - DNA, 20 bp, Artificial Sequence
  chemically synthesized
cctctgtgacttagaaagta

SEQ ID NO: 8844 - DNA, 20 bp, Artificial Sequence
  chemically synthesized
ctctgtgacttagaaagtag

SEQ ID NO: 8845 - DNA, 20 bp, Artificial Sequence
  chemically synthesized
tgtgacttagaaagtagggg

SEQ ID NO: 8846 - DNA, 20 bp, Artificial Sequence
  chemically synthesized
gtgacttagaaagtaggggt

SEQ ID NO: 8847 - DNA, 20 bp, Artificial Sequence
  chemically synthesized
gacttagaaagtaggggtag

SEQ ID NO: 8848 - DNA, 20 bp, Artificial Sequence
  chemically synthesized
acttagaaagtaggggtagg

SEQ ID NO: 8849 - DNA, 20 bp, Artificial Sequence
  chemically synthesized
cttagaaagtaggggtagga

SEQ ID NO: 8850 - DNA, 20 bp, Artificial Sequence
  chemically synthesized
ttagaaagtaggggtaggag

SEQ ID NO: 8851 - DNA, 20 bp, Artificial Sequence
  chemically synthesized
aagtaggggtaggaggggaa

SEQ ID NO: 8852 - DNA, 20 bp, Artificial Sequence
  chemically synthesized
agtaggggtaggaggggaaa

SEQ ID NO: 8853 - DNA, 20 bp, Artificial Sequence
  chemically synthesized
aggggaaaaggtcttctact

SEQ ID NO: 8854 - DNA, 20 bp, Artificial Sequence
  chemically synthesized
aaaaggtcttctacttggct

SEQ ID NO: 8855 - DNA, 20 bp, Artificial Sequence
  chemically synthesized
ctcagattatttttttcctc

SEQ ID NO: 8856 - DNA, 20 bp, Artificial Sequence
  chemically synthesized
tttttttcctctagtccact

SEQ ID NO: 8857 - DNA, 20 bp, Artificial Sequence
  chemically synthesized
taaaatcatttccttgattc

SEQ ID NO: 8858 - DNA, 20 bp, Artificial Sequence
  chemically synthesized
aatttactcttctttctcta

SEQ ID NO: 8859 - DNA, 20 bp, Artificial Sequence
  chemically synthesized
cttgtactaaattaactcct

SEQ ID NO: 8860 - DNA, 20 bp, Artificial Sequence
  chemically synthesized
ttgtactaaattaactcctc

SEQ ID NO: 8861 - DNA, 20 bp, Artificial Sequence
  chemically synthesized
actaaattaactcctcaggt

SEQ ID NO: 8862 - DNA, 20 bp, Artificial Sequence
  chemically synthesized
ctaaattaactcctcaggtg

SEQ ID NO: 8863 - DNA, 20 bp, Artificial Sequence
  chemically synthesized
caggtgaggaaaaacttttg

SEQ ID NO: 8864 - DNA, 20 bp, Artificial Sequence
  chemically synthesized
gaggaaaaacttttgaagtg

SEQ ID NO: 8865 - DNA, 20 bp, Artificial Sequence
  chemically synthesized
ggaaaaacttttgaagtgca

SEQ ID NO: 8866 - DNA, 20 bp, Artificial Sequence
  chemically synthesized
gttctgcttcctgctattaa

SEQ ID NO: 8867 - DNA, 20 bp, Artificial Sequence
  chemically synthesized
attaaaagatgtaattaaaa

SEQ ID NO: 8868 - DNA, 20 bp, Artificial Sequence
  chemically synthesized
aagatgtaattaaaacagca

SEQ ID NO: 8869 - DNA, 20 bp, Artificial Sequence
  chemically synthesized
agatgtaattaaaacagcaa

SEQ ID NO: 8870 - DNA, 20 bp, Artificial Sequence
  chemically synthesized
tgtaattaaaacagcaaagg

SEQ ID NO: 8871 - DNA, 20 bp, Artificial Sequence
  chemically synthesized
attaaaacagcaaaggtagc

SEQ ID NO: 8872 - DNA, 20 bp, Artificial Sequence
  chemically synthesized
caaaggtagcaagcatttat

SEQ ID NO: 8873 - DNA, 20 bp, Artificial Sequence
  chemically synthesized
aaaggtagcaagcatttatg

SEQ ID NO: 8874 - DNA, 20 bp, Artificial Sequence
  chemically synthesized
gtagcaagcatttatgaggt

SEQ ID NO: 8875 - DNA, 20 bp, Artificial Sequence
  chemically synthesized
aagcatttatgaggtcagcg

SEQ ID NO: 8876 - DNA, 20 bp, Artificial Sequence
  chemically synthesized
agcatttatgaggtcagcgt

SEQ ID NO: 8877 - DNA, 20 bp, Artificial Sequence
  chemically synthesized
gcatttatgaggtcagcgta

SEQ ID NO: 8878 - DNA, 20 bp, Artificial Sequence
  chemically synthesized
atgaggtcagcgtagggtct

SEQ ID NO: 8879 - DNA, 20 bp, Artificial Sequence
  chemically synthesized
gtagggtctcagtgttccct

SEQ ID NO: 8880 - DNA, 20 bp, Artificial Sequence
  chemically synthesized
tagggtctcagtgttcccta

SEQ ID NO: 8881 - DNA, 20 bp, Artificial Sequence
  chemically synthesized
agggtctcagtgttccctaa

SEQ ID NO: 8882 - DNA, 20 bp, Artificial Sequence
  chemically synthesized
gtgttccctaagggccctgt

SEQ ID NO: 8883 - DNA, 20 bp, Artificial Sequence
  chemically synthesized
tcctgaatcctgcccctacc

SEQ ID NO: 8884 - DNA, 20 bp, Artificial Sequence
  chemically synthesized
ccctacctggaaacccatgt

SEQ ID NO: 8885 - DNA, 20 bp, Artificial Sequence
  chemically synthesized
cctggaaacccatgtcggtt

SEQ ID NO: 8886 - DNA, 20 bp, Artificial Sequence
  chemically synthesized
gaaacccatgtcggtttagt

SEQ ID NO: 8887 - DNA, 20 bp, Artificial Sequence
  chemically synthesized
aaacccatgtcggtttagta

SEQ ID NO: 8888 - DNA, 20 bp, Artificial Sequence
  chemically synthesized
ccatgtcggtttagtaagga

SEQ ID NO: 8889 - DNA, 20 bp, Artificial Sequence
  chemically synthesized
tttctcctacttcttccttt

SEQ ID NO: 8890 - DNA, 20 bp, Artificial Sequence
  chemically synthesized
caataaaatgaaataaaatt

SEQ ID NO: 8891 - DNA, 20 bp, Artificial Sequence
  chemically synthesized
aataaaatgaaataaaattt

SEQ ID NO: 8892 - DNA, 20 bp, Artificial Sequence
  chemically synthesized
ataaaatttaggttaaccaa

SEQ ID NO: 8893 - DNA, 20 bp, Artificial Sequence
  chemically synthesized
ttaggttaaccaaaagaaac

SEQ ID NO: 8894 - DNA, 20 bp, Artificial Sequence
  chemically synthesized
gaaactggatcctctatttc

SEQ ID NO: 8895 - DNA, 20 bp, Artificial Sequence
  chemically synthesized
gatcctctatttctagttat

SEQ ID NO: 8896 - DNA, 20 bp, Artificial Sequence
  chemically synthesized
cctctatttctagttatcag

SEQ ID NO: 8897 - DNA, 20 bp, Artificial Sequence
  chemically synthesized
ctctatttctagttatcaga

SEQ ID NO: 8898 - DNA, 20 bp, Artificial Sequence
  chemically synthesized
ctctattattgctaaataaa

SEQ ID NO: 8899 - DNA, 20 bp, Artificial Sequence
  chemically synthesized
ctattattgctaaataaata

SEQ ID NO: 8900 - DNA, 20 bp, Artificial Sequence
  chemically synthesized
ctacctgtctcaaccctcat

SEQ ID NO: 8901 - DNA, 20 bp, Artificial Sequence
  chemically synthesized
tacctgtctcaaccctcatc

SEQ ID NO: 8902 - DNA, 20 bp, Artificial Sequence
  chemically synthesized
tctgattattctcacacacg

SEQ ID NO: 8903 - DNA, 20 bp, Artificial Sequence
  chemically synthesized
attattctcacacacgcaga

SEQ ID NO: 8904 - DNA, 20 bp, Artificial Sequence
  chemically synthesized
tcacacacgcagaaagtgtt

SEQ ID NO: 8905 - DNA, 20 bp, Artificial Sequence
  chemically synthesized
gaaagtgtttggttcttcta

SEQ ID NO: 8906 - DNA, 20 bp, Artificial Sequence
  chemically synthesized
ttggttcttctatggctatc

SEQ ID NO: 8907 - DNA, 20 bp, Artificial Sequence
  chemically synthesized
ggttcttctatggctatctg

SEQ ID NO: 8908 - DNA, 20 bp, Artificial Sequence
  chemically synthesized
ttctatggctatctggagcc

SEQ ID NO: 8909 - DNA, 20 bp, Artificial Sequence
  chemically synthesized
tctatggctatctggagcct

SEQ ID NO: 8910 - DNA, 20 bp, Artificial Sequence
  chemically synthesized
attatgcctatgtatgatta

SEQ ID NO: 8911 - DNA, 20 bp, Artificial Sequence
  chemically synthesized
tatgcctatgtatgattata

SEQ ID NO: 8912 - DNA, 20 bp, Artificial Sequence
  chemically synthesized
atgcctatgtatgattatag

SEQ ID NO: 8913 - DNA, 20 bp, Artificial Sequence
  chemically synthesized
ctatgtatgattatagaggt

SEQ ID NO: 8914 - DNA, 20 bp, Artificial Sequence
  chemically synthesized
atgtatgattatagaggtaa

SEQ ID NO: 8915 - DNA, 20 bp, Artificial Sequence
  chemically synthesized
tgtatgattatagaggtaag

SEQ ID NO: 8916 - DNA, 20 bp, Artificial Sequence
  chemically synthesized
gtatgattatagaggtaaga

SEQ ID NO: 8917 - DNA, 20 bp, Artificial Sequence
  chemically synthesized
aggtaagagggataaaattt

SEQ ID NO: 8918 - DNA, 20 bp, Artificial Sequence
  chemically synthesized
cattcctctgtaaaaaacta

SEQ ID NO: 8919 - DNA, 20 bp, Artificial Sequence
  chemically synthesized
ctgtaaaaaactaaagcaat

SEQ ID NO: 8920 - DNA, 20 bp, Artificial Sequence
  chemically synthesized
tgtaaaaaactaaagcaatg

SEQ ID NO: 8921 - DNA, 20 bp, Artificial Sequence
  chemically synthesized
aaactaaagcaatgaggatc

SEQ ID NO: 8922 - DNA, 20 bp, Artificial Sequence
  chemically synthesized
aactaaagcaatgaggatct

SEQ ID NO: 8923 - DNA, 20 bp, Artificial Sequence
  chemically synthesized
ctaggcacacgtgtatccct

SEQ ID NO: 8924 - DNA, 20 bp, Artificial Sequence
  chemically synthesized
cacacgtgtatccctgagaa

SEQ ID NO: 8925 - DNA, 20 bp, Artificial Sequence
  chemically synthesized
agatttcacatgttgaatcc

SEQ ID NO: 8926 - DNA, 20 bp, Artificial Sequence
  chemically synthesized
gatttcacatgttgaatcct

SEQ ID NO: 8927 - DNA, 20 bp, Artificial Sequence
  chemically synthesized
cacatgttgaatcctgggaa

SEQ ID NO: 8928 - DNA, 20 bp, Artificial Sequence
  chemically synthesized
attttaaatgttaaaacatg

SEQ ID NO: 8929 - DNA, 20 bp, Artificial Sequence
  chemically synthesized
taaaacatgcagatttgact

SEQ ID NO: 8930 - DNA, 20 bp, Artificial Sequence
  chemically synthesized
tgcagatttgacttggctgt

SEQ ID NO: 8931 - DNA, 20 bp, Artificial Sequence
  chemically synthesized
ttgacttggctgttagattt

SEQ ID NO: 8932 - DNA, 20 bp, Artificial Sequence
  chemically synthesized
tattaaatttaaacctgcat

SEQ ID NO: 8933 - DNA, 20 bp, Artificial Sequence
  chemically synthesized
aacctgcattagcattgttt

SEQ ID NO: 8934 - DNA, 20 bp, Artificial Sequence
  chemically synthesized
cattagcattgttttagatt

SEQ ID NO: 8935 - DNA, 20 bp, Artificial Sequence
  chemically synthesized
agcattgttttagatttaga

SEQ ID NO: 8936 - DNA, 20 bp, Artificial Sequence
  chemically synthesized
tttagatttagacagttttc

SEQ ID NO: 8937 - DNA, 20 bp, Artificial Sequence
  chemically synthesized
ctgtttcacatccctgatat

SEQ ID NO: 8938 - DNA, 20 bp, Artificial Sequence
  chemically synthesized
gtttcacatccctgatataa

SEQ ID NO: 8939 - DNA, 20 bp, Artificial Sequence
  chemically synthesized
tttcacatccctgatataag

SEQ ID NO: 8940 - DNA, 20 bp, Artificial Sequence
  chemically synthesized
aggcatgtatatgtgaaata

SEQ ID NO: 8941 - DNA, 20 bp, Artificial Sequence
  chemically synthesized
atgtgaaataaagtgttctg

SEQ ID NO: 8942 - DNA, 20 bp, Artificial Sequence
  chemically synthesized
tgaaataaagtgttctgcgg

SEQ ID NO: 8943 - DNA, 20 bp, Artificial Sequence
  chemically synthesized
tatgtcttttgcaaatatcc

SEQ ID NO: 8944 - DNA, 20 bp, Artificial Sequence
  chemically synthesized
atgtcttttgcaaatatcct

SEQ ID NO: 8945 - DNA, 20 bp, Artificial Sequence
  chemically synthesized
tttgcaaatatcctgggtca

SEQ ID NO: 8946 - DNA, 20 bp, Artificial Sequence
  chemically synthesized
cctgggtcaaagaaaatgca

SEQ ID NO: 8947 - DNA, 20 bp, Artificial Sequence
  chemically synthesized
gactttatgaaattataata

SEQ ID NO: 8948 - DNA, 20 bp, Artificial Sequence
  chemically synthesized
actttatgaaattataatat

SEQ ID NO: 8949 - DNA, 20 bp, Artificial Sequence
  chemically synthesized
tataatataggttatattta

SEQ ID NO: 8950 - DNA, 20 bp, Artificial Sequence
  chemically synthesized
ttatatttatagtattctga

SEQ ID NO: 8951 - DNA, 20 bp, Artificial Sequence
  chemically synthesized
ctgaaagaccaaaattgtca

SEQ ID NO: 8952 - DNA, 20 bp, Artificial Sequence
  chemically synthesized
aagaccaaaattgtcaaagc

SEQ ID NO: 8953 - DNA, 20 bp, Artificial Sequence
  chemically synthesized
gaccaaaattgtcaaagcaa

SEQ ID NO: 8954 - DNA, 20 bp, Artificial Sequence
  chemically synthesized
aagagctttgaaatcctgat

SEQ ID NO: 8955 - DNA, 20 bp, Artificial Sequence
  chemically synthesized
agctttgaaatcctgattgg

SEQ ID NO: 8956 - DNA, 20 bp, Artificial Sequence
  chemically synthesized
cagaaattgtcaccttctta

SEQ ID NO: 8957 - DNA, 20 bp, Artificial Sequence
  chemically synthesized
accctacaacttcttatgct

SEQ ID NO: 8958 - DNA, 20 bp, Artificial Sequence
  chemically synthesized
caacttcttatgctcagaaa

SEQ ID NO: 8959 - DNA, 20 bp, Artificial Sequence
  chemically synthesized
cttttttaaatgatgaacta

SEQ ID NO: 8960 - DNA, 20 bp, Artificial Sequence
  chemically synthesized
tatggatccttctcttgtgt

SEQ ID NO: 8961 - DNA, 20 bp, Artificial Sequence
  chemically synthesized
tcttgtgttggcaactgctg

SEQ ID NO: 8962 - DNA, 20 bp, Artificial Sequence
  chemically synthesized
tgctgcagataccatcatcc

SEQ ID NO: 8963 - DNA, 20 bp, Artificial Sequence
  chemically synthesized
gataccatcatcctggcttc

SEQ ID NO: 8964 - DNA, 20 bp, Artificial Sequence
  chemically synthesized
ataccatcatcctggcttca

SEQ ID NO: 8965 - DNA, 20 bp, Artificial Sequence
  chemically synthesized
ccatcatcctggcttcaagg

SEQ ID NO: 8966 - DNA, 20 bp, Artificial Sequence
  chemically synthesized
catcatcctggcttcaaggc

SEQ ID NO: 8967 - DNA, 20 bp, Artificial Sequence
  chemically synthesized
atcatcctggcttcaaggca

SEQ ID NO: 8968 - DNA, 20 bp, Artificial Sequence
  chemically synthesized
tcatcctggcttcaaggcag

SEQ ID NO: 8969 - DNA, 20 bp, Artificial Sequence
  chemically synthesized
ggcaggggttgcttttccaa

SEQ ID NO: 8970 - DNA, 20 bp, Artificial Sequence
  chemically synthesized
aggggttgcttttccaatgg

SEQ ID NO: 8971 - DNA, 20 bp, Artificial Sequence
  chemically synthesized
cttttccaatggtagttact

SEQ ID NO: 8972 - DNA, 20 bp, Artificial Sequence
  chemically synthesized
tggtagttacttagtgtgac

SEQ ID NO: 8973 - DNA, 20 bp, Artificial Sequence
  chemically synthesized
gtagttacttagtgtgacta

SEQ ID NO: 8974 - DNA, 20 bp, Artificial Sequence
  chemically synthesized
agtgtgactagagtgtaacg

SEQ ID NO: 8975 - DNA, 20 bp, Artificial Sequence
  chemically synthesized
ctattacccataataccctg

SEQ ID NO: 8976 - DNA, 20 bp, Artificial Sequence
  chemically synthesized
tattacccataataccctgc

SEQ ID NO: 8977 - DNA, 20 bp, Artificial Sequence
  chemically synthesized
attacccataataccctgca

SEQ ID NO: 8978 - DNA, 20 bp, Artificial Sequence
  chemically synthesized
ccataataccctgcagggac

SEQ ID NO: 8979 - DNA, 20 bp, Artificial Sequence
  chemically synthesized
cataataccctgcagggaca

SEQ ID NO: 8980 - DNA, 20 bp, Artificial Sequence
  chemically synthesized
ccctgcagggacaaggctgc

SEQ ID NO: 8981 - DNA, 20 bp, Artificial Sequence
  chemically synthesized
acaaggctgcaagctatact

SEQ ID NO: 8982 - DNA, 20 bp, Artificial Sequence
  chemically synthesized
agctatactaagaccatcaa

SEQ ID NO: 8983 - DNA, 20 bp, Artificial Sequence
  chemically synthesized
tactaagaccatcaaaagcc

SEQ ID NO: 8984 - DNA, 20 bp, Artificial Sequence
  chemically synthesized
actaagaccatcaaaagccc

SEQ ID NO: 8985 - DNA, 20 bp, Artificial Sequence
  chemically synthesized
catcaaaagcccaggcatac

SEQ ID NO: 8986 - DNA, 20 bp, Artificial Sequence
  chemically synthesized
atcaaaagcccaggcatacc

SEQ ID NO: 8987 - DNA, 20 bp, Artificial Sequence
  chemically synthesized
cccaggcataccaggcaaat

SEQ ID NO: 8988 - DNA, 20 bp, Artificial Sequence
  chemically synthesized
ataccaggcaaataagtttc

SEQ ID NO: 8989 - DNA, 20 bp, Artificial Sequence
  chemically synthesized
ccaggcaaataagtttcaag

SEQ ID NO: 8990 - DNA, 20 bp, Artificial Sequence
  chemically synthesized
aagtttcaagaagcaataaa

SEQ ID NO: 8991 - DNA, 20 bp, Artificial Sequence
  chemically synthesized
agcaataaatagtgcaaatt

SEQ ID NO: 8992 - DNA, 20 bp, Artificial Sequence
  chemically synthesized
aaatagtgcaaatttggtta

SEQ ID NO: 8993 - DNA, 20 bp, Artificial Sequence
  chemically synthesized
agtgcaaatttggttatggt

SEQ ID NO: 8994 - DNA, 20 bp, Artificial Sequence
  chemically synthesized
tgcaaatttggttatggtca

SEQ ID NO: 8995 - DNA, 20 bp, Artificial Sequence
  chemically synthesized
tttggttatggtcagagcct

SEQ ID NO: 8996 - DNA, 20 bp, Artificial Sequence
  chemically synthesized
cctcagtttcaaatctaaat

SEQ ID NO: 8997 - DNA, 20 bp, Artificial Sequence
  chemically synthesized
caaatctaaatcagcattca

SEQ ID NO: 8998 - DNA, 20 bp, Artificial Sequence
  chemically synthesized
aagttcctgaaaaactattc

SEQ ID NO: 8999 - DNA, 20 bp, Artificial Sequence
  chemically synthesized
actgacatcttcactattgt

SEQ ID NO: 9000 - DNA, 20 bp, Artificial Sequence
  chemically synthesized
gcttgcttctactctgtgaa

SEQ ID NO: 9001 - DNA, 20 bp, Artificial Sequence
  chemically synthesized
tactctgtgaatggatgcca

SEQ ID NO: 9002 - DNA, 20 bp, Artificial Sequence
  chemically synthesized
tctgtgaatggatgccacag

SEQ ID NO: 9003 - DNA, 20 bp, Artificial Sequence
  chemically synthesized
ctgtgaatggatgccacagc

SEQ ID NO: 9004 - DNA, 20 bp, Artificial Sequence
  chemically synthesized
aatggatgccacagcaggtg

SEQ ID NO: 9005 - DNA, 20 bp, Artificial Sequence
  chemically synthesized
atggatgccacagcaggtgc

SEQ ID NO: 9006 - DNA, 20 bp, Artificial Sequence
  chemically synthesized
ggtctattctacttttattc

SEQ ID NO: 9007 - DNA, 20 bp, Artificial Sequence
  chemically synthesized
acacacacacacacacacac

SEQ ID NO: 9008 - DNA, 20 bp, Artificial Sequence
  chemically synthesized
acacacacaagtcctcaaaa

SEQ ID NO: 9009 - DNA, 20 bp, Artificial Sequence
  chemically synthesized
acacacaagtcctcaaaaaa

SEQ ID NO: 9010 - DNA, 20 bp, Artificial Sequence
  chemically synthesized
acaagtcctcaaaaaagaga

SEQ ID NO: 9011 - DNA, 20 bp, Artificial Sequence
  chemically synthesized
gtcctcaaaaaagagacagc

SEQ ID NO: 9012 - DNA, 20 bp, Artificial Sequence
  chemically synthesized
cctcaaaaaagagacagcga

SEQ ID NO: 9013 - DNA, 20 bp, Artificial Sequence
  chemically synthesized
tcaaaaaagagacagcgaga

SEQ ID NO: 9014 - DNA, 20 bp, Artificial Sequence
  chemically synthesized
aaaagagacagcgagagaga

SEQ ID NO: 9015 - DNA, 20 bp, Artificial Sequence
  chemically synthesized
aagagacagcgagagagaca

SEQ ID NO: 9016 - DNA, 20 bp, Artificial Sequence
  chemically synthesized
agagacagcgagagagacag

SEQ ID NO: 9017 - DNA, 20 bp, Artificial Sequence
  chemically synthesized
gaggtccatttcctttactc

SEQ ID NO: 9018 - DNA, 20 bp, Artificial Sequence
  chemically synthesized
ccagtctattaatctttctt

SEQ ID NO: 9019 - DNA, 20 bp, Artificial Sequence
  chemically synthesized
taagtcctaatgttttatat

SEQ ID NO: 9020 - DNA, 20 bp, Artificial Sequence
  chemically synthesized
cctaatgttttatatcagaa

SEQ ID NO: 9021 - DNA, 20 bp, Artificial Sequence
  chemically synthesized
gttttatatcagaatggccc

SEQ ID NO: 9022 - DNA, 20 bp, Artificial Sequence
  chemically synthesized
atatcagaatggccctagtc

SEQ ID NO: 9023 - DNA, 20 bp, Artificial Sequence
  chemically synthesized
tatcagaatggccctagtct

SEQ ID NO: 9024 - DNA, 20 bp, Artificial Sequence
  chemically synthesized
ggccctagtctgggtatact

SEQ ID NO: 9025 - DNA, 20 bp, Artificial Sequence
  chemically synthesized
ccctagtctgggtatactta

SEQ ID NO: 9026 - DNA, 20 bp, Artificial Sequence
  chemically synthesized
cctagtctgggtatacttag

SEQ ID NO: 9027 - DNA, 20 bp, Artificial Sequence
  chemically synthesized
aaaatcatgacactcatcta

SEQ ID NO: 9028 - DNA, 20 bp, Artificial Sequence
  chemically synthesized
aaatcatgacactcatctat

SEQ ID NO: 9029 - DNA, 20 bp, Artificial Sequence
  chemically synthesized
atcatgacactcatctatgg

SEQ ID NO: 9030 - DNA, 20 bp, Artificial Sequence
  chemically synthesized
gacactcatctatgggagtg

SEQ ID NO: 9031 - DNA, 20 bp, Artificial Sequence
  chemically synthesized
ggttttatcatttgtttcaa

SEQ ID NO: 9032 - DNA, 20 bp, Artificial Sequence
  chemically synthesized
tttatcatttgtttcaaaag

SEQ ID NO: 9033 - DNA, 20 bp, Artificial Sequence
  chemically synthesized
tttcaaaagcagcacttgac

SEQ ID NO: 9034 - DNA, 20 bp, Artificial Sequence
  chemically synthesized
tcaaaagcagcacttgacta

SEQ ID NO: 9035 - DNA, 20 bp, Artificial Sequence
  chemically synthesized
tttatacatgctctactgtt

SEQ ID NO: 9036 - DNA, 20 bp, Artificial Sequence
  chemically synthesized
tgtttagtctaaaattcccc

SEQ ID NO: 9037 - DNA, 20 bp, Artificial Sequence
  chemically synthesized
tagtctaaaattccccaagt

SEQ ID NO: 9038 - DNA, 20 bp, Artificial Sequence
  chemically synthesized
attccccaagtgagacattt

SEQ ID NO: 9039 - DNA, 20 bp, Artificial Sequence
  chemically synthesized
caatctactgtatatgttcc

SEQ ID NO: 9040 - DNA, 20 bp, Artificial Sequence
  chemically synthesized
aatctactgtatatgttcct

SEQ ID NO: 9041 - DNA, 20 bp, Artificial Sequence
  chemically synthesized
actgtatatgttcctaggtc

SEQ ID NO: 9042 - DNA, 20 bp, Artificial Sequence
  chemically synthesized
atatgttcctaggtcaagca

SEQ ID NO: 9043 - DNA, 20 bp, Artificial Sequence
  chemically synthesized
ttcctaggtcaagcacagtc

SEQ ID NO: 9044 - DNA, 20 bp, Artificial Sequence
  chemically synthesized
cacagtctagctacttgcta

SEQ ID NO: 9045 - DNA, 20 bp, Artificial Sequence
  chemically synthesized
cttgctacagacttctctcg

SEQ ID NO: 9046 - DNA, 20 bp, Artificial Sequence
  chemically synthesized
ctcgcagatacacaatctct

SEQ ID NO: 9047 - DNA, 20 bp, Artificial Sequence
  chemically synthesized
atctctcagtaaacacaact

SEQ ID NO: 9048 - DNA, 20 bp, Artificial Sequence
  chemically synthesized
tctcagtaaacacaactcag

SEQ ID NO: 9049 - DNA, 20 bp, Artificial Sequence
  chemically synthesized
aaacacaactcagcagctct

SEQ ID NO: 9050 - DNA, 20 bp, Artificial Sequence
  chemically synthesized
aaatgaaataaaaatgctcc

SEQ ID NO: 9051 - DNA, 20 bp, Artificial Sequence
  chemically synthesized
taaaaatgctccaagaaaac

SEQ ID NO: 9052 - DNA, 20 bp, Artificial Sequence
  chemically synthesized
tccaagaaaaccagaaccca

SEQ ID NO: 9053 - DNA, 20 bp, Artificial Sequence
  chemically synthesized
caaaccgcacacacacaaaa

SEQ ID NO: 9054 - DNA, 20 bp, Artificial Sequence
  chemically synthesized
cgcacacacacaaaatagtt

SEQ ID NO: 9055 - DNA, 20 bp, Artificial Sequence
  chemically synthesized
cacacaaaatagtttggaaa

SEQ ID NO: 9056 - DNA, 20 bp, Artificial Sequence
  chemically synthesized
acacaaaatagtttggaaat

SEQ ID NO: 9057 - DNA, 20 bp, Artificial Sequence
  chemically synthesized
aaaatagtttggaaatagga

SEQ ID NO: 9058 - DNA, 20 bp, Artificial Sequence
  chemically synthesized
agtttggaaataggatagtt

SEQ ID NO: 9059 - DNA, 20 bp, Artificial Sequence
  chemically synthesized
atagtttagttcactttaaa

SEQ ID NO: 9060 - DNA, 20 bp, Artificial Sequence
  chemically synthesized
aagttgtatttcttaccaaa

SEQ ID NO: 9061 - DNA, 20 bp, Artificial Sequence
  chemically synthesized
tttcttaccaaaaagcaata

SEQ ID NO: 9062 - DNA, 20 bp, Artificial Sequence
  chemically synthesized
aaaaagcaataaagtcaaca

SEQ ID NO: 9063 - DNA, 20 bp, Artificial Sequence
  chemically synthesized
agcaataaagtcaacataga

SEQ ID NO: 9064 - DNA, 20 bp, Artificial Sequence
  chemically synthesized
acatagacagaactttgcta

SEQ ID NO: 9065 - DNA, 20 bp, Artificial Sequence
  chemically synthesized
aagtatatgcataattatta

SEQ ID NO: 9066 - DNA, 20 bp, Artificial Sequence
  chemically synthesized
ttacagaaaaatttatattt

SEQ ID NO: 9067 - DNA, 20 bp, Artificial Sequence
  chemically synthesized
ttcattaatatttcctccac

SEQ ID NO: 9068 - DNA, 20 bp, Artificial Sequence
  chemically synthesized
tcattaatatttcctccact

SEQ ID NO: 9069 - DNA, 20 bp, Artificial Sequence
  chemically synthesized
aatatttcctccactgggct

SEQ ID NO: 9070 - DNA, 20 bp, Artificial Sequence
  chemically synthesized
actgggctcagattttcatt

SEQ ID NO: 9071 - DNA, 20 bp, Artificial Sequence
  chemically synthesized
ctcagattttcattcagaat

SEQ ID NO: 9072 - DNA, 20 bp, Artificial Sequence
  chemically synthesized
agcttttttttaacctcatt

SEQ ID NO: 9073 - DNA, 20 bp, Artificial Sequence
  chemically synthesized
ttttttttaacctcattaag

SEQ ID NO: 9074 - DNA, 20 bp, Artificial Sequence
  chemically synthesized
tttttttaacctcattaagt

SEQ ID NO: 9075 - DNA, 20 bp, Artificial Sequence
  chemically synthesized
taacctcattaagtgggcca

SEQ ID NO: 9076 - DNA, 20 bp, Artificial Sequence
  chemically synthesized
tgggccatggtgtcaattta

SEQ ID NO: 9077 - DNA, 20 bp, Artificial Sequence
  chemically synthesized
ggccatggtgtcaatttatg

SEQ ID NO: 9078 - DNA, 20 bp, Artificial Sequence
  chemically synthesized
ccatggtgtcaatttatgga

SEQ ID NO: 9079 - DNA, 20 bp, Artificial Sequence
  chemically synthesized
tggtgtcaatttatggagag

SEQ ID NO: 9080 - DNA, 20 bp, Artificial Sequence
  chemically synthesized
gtgtcaatttatggagagca

SEQ ID NO: 9081 - DNA, 20 bp, Artificial Sequence
  chemically synthesized
tgtcaatttatggagagcag

SEQ ID NO: 9082 - DNA, 20 bp, Artificial Sequence
  chemically synthesized
atttatggagagcagaggta

SEQ ID NO: 9083 - DNA, 20 bp, Artificial Sequence
  chemically synthesized
gagagcagaggtacagtctt

SEQ ID NO: 9084 - DNA, 20 bp, Artificial Sequence
  chemically synthesized
tacagtcttcagataaattt

SEQ ID NO: 9085 - DNA, 20 bp, Artificial Sequence
  chemically synthesized
aatttgagattgcatctctt

SEQ ID NO: 9086 - DNA, 20 bp, Artificial Sequence
  chemically synthesized
tttgagattgcatctcttta

SEQ ID NO: 9087 - DNA, 20 bp, Artificial Sequence
  chemically synthesized
ttgagattgcatctctttag

SEQ ID NO: 9088 - DNA, 20 bp, Artificial Sequence
  chemically synthesized
agattgcatctctttagagg

SEQ ID NO: 9089 - DNA, 20 bp, Artificial Sequence
  chemically synthesized
tctctttagaggtagaatct

SEQ ID NO: 9090 - DNA, 20 bp, Artificial Sequence
  chemically synthesized
tagaggtagaatcttggctt

SEQ ID NO: 9091 - DNA, 20 bp, Artificial Sequence
  chemically synthesized
gaacaccctttacaaacatg

SEQ ID NO: 9092 - DNA, 20 bp, Artificial Sequence
  chemically synthesized
aacaccctttacaaacatgt

SEQ ID NO: 9093 - DNA, 20 bp, Artificial Sequence
  chemically synthesized
caaacatgtaggcattaatt

SEQ ID NO: 9094 - DNA, 20 bp, Artificial Sequence
  chemically synthesized
aacatgtaggcattaattca

SEQ ID NO: 9095 - DNA, 20 bp, Artificial Sequence
  chemically synthesized
acatgtaggcattaattcag

SEQ ID NO: 9096 - DNA, 20 bp, Artificial Sequence
  chemically synthesized
taattcagaggactgctctg

SEQ ID NO: 9097 - DNA, 20 bp, Artificial Sequence
  chemically synthesized
agaggactgctctgaagctc

SEQ ID NO: 9098 - DNA, 20 bp, Artificial Sequence
  chemically synthesized
aggactgctctgaagctcaa

SEQ ID NO: 9099 - DNA, 20 bp, Artificial Sequence
  chemically synthesized
ctgctctgaagctcaagaga

SEQ ID NO: 9100 - DNA, 20 bp, Artificial Sequence
  chemically synthesized
agctcaagagatggatgatt

SEQ ID NO: 9101 - DNA, 20 bp, Artificial Sequence
  chemically synthesized
gctcaagagatggatgattt

SEQ ID NO: 9102 - DNA, 20 bp, Artificial Sequence
  chemically synthesized
tcaagagatggatgatttag

SEQ ID NO: 9103 - DNA, 20 bp, Artificial Sequence
  chemically synthesized
tggatgatttaggagactat

SEQ ID NO: 9104 - DNA, 20 bp, Artificial Sequence
  chemically synthesized
ggatgatttaggagactatt

SEQ ID NO: 9105 - DNA, 20 bp, Artificial Sequence
  chemically synthesized
cacacacacaccctttcatt

SEQ ID NO: 9106 - DNA, 20 bp, Artificial Sequence
  chemically synthesized
tcattcagacatactgaaca

SEQ ID NO: 9107 - DNA, 20 bp, Artificial Sequence
  chemically synthesized
catactgaacatagtttata

SEQ ID NO: 9108 - DNA, 20 bp, Artificial Sequence
  chemically synthesized
tagtttataaagcaacgcca

SEQ ID NO: 9109 - DNA, 20 bp, Artificial Sequence
  chemically synthesized
ttataaagcaacgccatagt

SEQ ID NO: 9110 - DNA, 20 bp, Artificial Sequence
  chemically synthesized
aagcaacgccatagtgagaa

SEQ ID NO: 9111 - DNA, 20 bp, Artificial Sequence
  chemically synthesized
taaattatcaaataaaatta

SEQ ID NO: 9112 - DNA, 20 bp, Artificial Sequence
  chemically synthesized
taaaattaaagccaaatctt

SEQ ID NO: 9113 - DNA, 20 bp, Artificial Sequence
  chemically synthesized
aaaattaaagccaaatcttg

SEQ ID NO: 9114 - DNA, 20 bp, Artificial Sequence
  chemically synthesized
tttaactttcattttaaatt

SEQ ID NO: 9115 - DNA, 20 bp, Artificial Sequence
  chemically synthesized
ttaactttcattttaaattt

SEQ ID NO: 9116 - DNA, 20 bp, Artificial Sequence
  chemically synthesized
taactttcattttaaatttg

SEQ ID NO: 9117 - DNA, 20 bp, Artificial Sequence
  chemically synthesized
aactttcattttaaatttgg

SEQ ID NO: 9118 - DNA, 20 bp, Artificial Sequence
  chemically synthesized
aaatttgggggtacatgtac

SEQ ID NO: 9119 - DNA, 20 bp, Artificial Sequence
  chemically synthesized
gggtacatgtacaagttata

SEQ ID NO: 9120 - DNA, 20 bp, Artificial Sequence
  chemically synthesized
ggtacatgtacaagttatat

SEQ ID NO: 9121 - DNA, 20 bp, Artificial Sequence
  chemically synthesized
ataggtaaattgcatatcac

SEQ ID NO: 9122 - DNA, 20 bp, Artificial Sequence
  chemically synthesized
taggtaaattgcatatcact

SEQ ID NO: 9123 - DNA, 20 bp, Artificial Sequence
  chemically synthesized
tatcactgggtcttgatgta

SEQ ID NO: 9124 - DNA, 20 bp, Artificial Sequence
  chemically synthesized
gtacagattatttcatcact

SEQ ID NO: 9125 - DNA, 20 bp, Artificial Sequence
  chemically synthesized
gtgatgaacttaatacccaa

SEQ ID NO: 9126 - DNA, 20 bp, Artificial Sequence
  chemically synthesized
tgatgaacttaatacccaat

SEQ ID NO: 9127 - DNA, 20 bp, Artificial Sequence
  chemically synthesized
tcttcccaccctcaaccctc

SEQ ID NO: 9128 - DNA, 20 bp, Artificial Sequence
  chemically synthesized
tcccaccctcaaccctcaag

SEQ ID NO: 9129 - DNA, 20 bp, Artificial Sequence
  chemically synthesized
cccaccctcaaccctcaagt

SEQ ID NO: 9130 - DNA, 20 bp, Artificial Sequence
  chemically synthesized
cctcaaccctcaagtaggcc

SEQ ID NO: 9131 - DNA, 20 bp, Artificial Sequence
  chemically synthesized
ctcaaccctcaagtaggcct

SEQ ID NO: 9132 - DNA, 20 bp, Artificial Sequence
  chemically synthesized
tgtccatgtgtatcatcatt

SEQ ID NO: 9133 - DNA, 20 bp, Artificial Sequence
  chemically synthesized
tcatttagctcccacactcc

SEQ ID NO: 9134 - DNA, 20 bp, Artificial Sequence
  chemically synthesized
acactcctagactcttacaa

SEQ ID NO: 9135 - DNA, 20 bp, Artificial Sequence
  chemically synthesized
aataattttaatataacaac

SEQ ID NO: 9136 - DNA, 20 bp, Artificial Sequence
  chemically synthesized
ataattttaatataacaaca

SEQ ID NO: 9137 - DNA, 20 bp, Artificial Sequence
  chemically synthesized
taatataacaacaaggtgcc

SEQ ID NO: 9138 - DNA, 20 bp, Artificial Sequence
  chemically synthesized
acctcctcatcttcaatatg

SEQ ID NO: 9139 - DNA, 20 bp, Artificial Sequence
  chemically synthesized
cctcatcttcaatatgaaga

SEQ ID NO: 9140 - DNA, 20 bp, Artificial Sequence
  chemically synthesized
aatatgaagatagcaatgcc

SEQ ID NO: 9141 - DNA, 20 bp, Artificial Sequence
  chemically synthesized
agatagcaatgcctagcata

SEQ ID NO: 9142 - DNA, 20 bp, Artificial Sequence
  chemically synthesized
atatagtaattgtgtgtgct

SEQ ID NO: 9143 - DNA, 20 bp, Artificial Sequence
  chemically synthesized
tgctcggcacatgtcccatc

SEQ ID NO: 9144 - DNA, 20 bp, Artificial Sequence
  chemically synthesized
gctcggcacatgtcccatcc

SEQ ID NO: 9145 - DNA, 20 bp, Artificial Sequence
  chemically synthesized
tgatgttctcatgaattctc

SEQ ID NO: 9146 - DNA, 20 bp, Artificial Sequence
  chemically synthesized
ctcatgaattctctggtatt

SEQ ID NO: 9147 - DNA, 20 bp, Artificial Sequence
  chemically synthesized
ttctctggtatttggatttt

SEQ ID NO: 9148 - DNA, 20 bp, Artificial Sequence
  chemically synthesized
tctctggtatttggattttt

SEQ ID NO: 9149 - DNA, 20 bp, Artificial Sequence
  chemically synthesized
ctctggtatttggattttta

SEQ ID NO: 9150 - DNA, 20 bp, Artificial Sequence
  chemically synthesized
tttagggccaacatcttgcc

SEQ ID NO: 9151 - DNA, 20 bp, Artificial Sequence
  chemically synthesized
gactcactgactacttctaa

SEQ ID NO: 9152 - DNA, 20 bp, Artificial Sequence
  chemically synthesized
actgactacttctaatggtg

SEQ ID NO: 9153 - DNA, 20 bp, Artificial Sequence
  chemically synthesized
ctgactacttctaatggtgt

SEQ ID NO: 9154 - DNA, 20 bp, Artificial Sequence
  chemically synthesized
tacttctaatggtgtaggaa

SEQ ID NO: 9155 - DNA, 20 bp, Artificial Sequence
  chemically synthesized
ttctaatggtgtaggaatag

SEQ ID NO: 9156 - DNA, 20 bp, Artificial Sequence
  chemically synthesized
tctaatggtgtaggaataga

SEQ ID NO: 9157 - DNA, 20 bp, Artificial Sequence
  chemically synthesized
tggtgtaggaatagaaggta

SEQ ID NO: 9158 - DNA, 20 bp, Artificial Sequence
  chemically synthesized
gtaggaatagaaggtatagt

SEQ ID NO: 9159 - DNA, 20 bp, Artificial Sequence
  chemically synthesized
tgctctttttttttgacttt

SEQ ID NO: 9160 - DNA, 20 bp, Artificial Sequence
  chemically synthesized
ctctttttttttgacttttg

SEQ ID NO: 9161 - DNA, 20 bp, Artificial Sequence
  chemically synthesized
ttttttttgacttttggaga

SEQ ID NO: 9162 - DNA, 20 bp, Artificial Sequence
  chemically synthesized
tttttttgacttttggagaa

SEQ ID NO: 9163 - DNA, 20 bp, Artificial Sequence
  chemically synthesized
gacttttggagaaaggaatg

SEQ ID NO: 9164 - DNA, 20 bp, Artificial Sequence
  chemically synthesized
tgtagtttgttttccctatc

SEQ ID NO: 9165 - DNA, 20 bp, Artificial Sequence
  chemically synthesized
gttttccctatcaagatcat

SEQ ID NO: 9166 - DNA, 20 bp, Artificial Sequence
  chemically synthesized
ttttccctatcaagatcata

SEQ ID NO: 9167 - DNA, 20 bp, Artificial Sequence
  chemically synthesized
ctgtctttcgaataccacac

SEQ ID NO: 9168 - DNA, 20 bp, Artificial Sequence
  chemically synthesized
ttttaatatcttactcttat

SEQ ID NO: 9169 - DNA, 20 bp, Artificial Sequence
  chemically synthesized
tatgagaacttccctatgct

SEQ ID NO: 9170 - DNA, 20 bp, Artificial Sequence
  chemically synthesized
atgagaacttccctatgctc

SEQ ID NO: 9171 - DNA, 20 bp, Artificial Sequence
  chemically synthesized
ccctatgctcaggaatgtga

SEQ ID NO: 9172 - DNA, 20 bp, Artificial Sequence
  chemically synthesized
gatcttccccaaaatgccct

SEQ ID NO: 9173 - DNA, 20 bp, Artificial Sequence
  chemically synthesized
cttccccaaaatgccctgag

SEQ ID NO: 9174 - DNA, 20 bp, Artificial Sequence
  chemically synthesized
tctgcttctgatatgtaaac

SEQ ID NO: 9175 - DNA, 20 bp, Artificial Sequence
  chemically synthesized
gcttctgatatgtaaaccag

SEQ ID NO: 9176 - DNA, 20 bp, Artificial Sequence
  chemically synthesized
tggttcctaaatatcttatt

SEQ ID NO: 9177 - DNA, 20 bp, Artificial Sequence
  chemically synthesized
aaatatcttattcagatata

SEQ ID NO: 9178 - DNA, 20 bp, Artificial Sequence
  chemically synthesized
atatcttattcagatataaa

SEQ ID NO: 9179 - DNA, 20 bp, Artificial Sequence
  chemically synthesized
attcagatataaagagttct

SEQ ID NO: 9180 - DNA, 20 bp, Artificial Sequence
  chemically synthesized
cctactatgtataatgactt

SEQ ID NO: 9181 - DNA, 20 bp, Artificial Sequence
  chemically synthesized
ctactatgtataatgactta

SEQ ID NO: 9182 - DNA, 20 bp, Artificial Sequence
  chemically synthesized
aatgacttaaggaaaacaca

SEQ ID NO: 9183 - DNA, 20 bp, Artificial Sequence
  chemically synthesized
aggaaaacacatggatataa

SEQ ID NO: 9184 - DNA, 20 bp, Artificial Sequence
  chemically synthesized
gaaaacacatggatataaaa

SEQ ID NO: 9185 - DNA, 20 bp, Artificial Sequence
  chemically synthesized
tataaaagagcttctgctgc

SEQ ID NO: 9186 - DNA, 20 bp, Artificial Sequence
  chemically synthesized
tcaaaatgttgtgatcaaaa

SEQ ID NO: 9187 - DNA, 20 bp, Artificial Sequence
  chemically synthesized
agttaactataacacattgt

SEQ ID NO: 9188 - DNA, 20 bp, Artificial Sequence
  chemically synthesized
aacacattgtcagtatattc

SEQ ID NO: 9189 - DNA, 20 bp, Artificial Sequence
  chemically synthesized
acattgtcagtatattctgg

SEQ ID NO: 9190 - DNA, 20 bp, Artificial Sequence
  chemically synthesized
gtcagtatattctggcagta

SEQ ID NO: 9191 - DNA, 20 bp, Artificial Sequence
  chemically synthesized
gtatattctggcagtacaga

SEQ ID NO: 9192 - DNA, 20 bp, Artificial Sequence
  chemically synthesized
atattctggcagtacagaca

SEQ ID NO: 9193 - DNA, 20 bp, Artificial Sequence
  chemically synthesized
tacagacagagttactgtga

SEQ ID NO: 9194 - DNA, 20 bp, Artificial Sequence
  chemically synthesized
gtgaaagcactttcaaacac

SEQ ID NO: 9195 - DNA, 20 bp, Artificial Sequence
  chemically synthesized
tgaaagcactttcaaacaca

SEQ ID NO: 9196 - DNA, 20 bp, Artificial Sequence
  chemically synthesized
tttcaaacacaaggaaacaa

SEQ ID NO: 9197 - DNA, 20 bp, Artificial Sequence
  chemically synthesized
aggaaacaacagattctgtt

SEQ ID NO: 9198 - DNA, 20 bp, Artificial Sequence
  chemically synthesized
ggaaacaacagattctgttt

SEQ ID NO: 9199 - DNA, 20 bp, Artificial Sequence
  chemically synthesized
cagattctgtttaggtattc

SEQ ID NO: 9200 - DNA, 20 bp, Artificial Sequence
  chemically synthesized
ttctgtttaggtattcaagt

SEQ ID NO: 9201 - DNA, 20 bp, Artificial Sequence
  chemically synthesized
taatcaacatgcatataata

SEQ ID NO: 9202 - DNA, 20 bp, Artificial Sequence
  chemically synthesized
ttttaaaaatgtatacaact

SEQ ID NO: 9203 - DNA, 20 bp, Artificial Sequence
  chemically synthesized
aaaaatgtatacaactgaga

SEQ ID NO: 9204 - DNA, 20 bp, Artificial Sequence
  chemically synthesized
aatccttctaattttaccta

SEQ ID NO: 9205 - DNA, 20 bp, Artificial Sequence
  chemically synthesized
aattttacctatggcaaaaa

SEQ ID NO: 9206 - DNA, 20 bp, Artificial Sequence
  chemically synthesized
ctatggcaaaaatggtgctc

SEQ ID NO: 9207 - DNA, 20 bp, Artificial Sequence
  chemically synthesized
tatggcaaaaatggtgctca

SEQ ID NO: 9208 - DNA, 20 bp, Artificial Sequence
  chemically synthesized
aaaaatattactcctatgat

SEQ ID NO: 9209 - DNA, 20 bp, Artificial Sequence
  chemically synthesized
atattactcctatgatcaga

SEQ ID NO: 9210 - DNA, 20 bp, Artificial Sequence
  chemically synthesized
tattactcctatgatcagaa

SEQ ID NO: 9211 - DNA, 20 bp, Artificial Sequence
  chemically synthesized
tcagaaaggaaataactgtt

SEQ ID NO: 9212 - DNA, 20 bp, Artificial Sequence
  chemically synthesized
tgcttcctctttgtatgttg

SEQ ID NO: 9213 - DNA, 20 bp, Artificial Sequence
  chemically synthesized
atgttgtagcattaacaaca

SEQ ID NO: 9214 - DNA, 20 bp, Artificial Sequence
  chemically synthesized
aacaaagaaacactgtgcga

SEQ ID NO: 9215 - DNA, 20 bp, Artificial Sequence
  chemically synthesized
ttaatattgtcctctaattc

SEQ ID NO: 9216 - DNA, 20 bp, Artificial Sequence
  chemically synthesized
atattgtcctctaattccag

SEQ ID NO: 9217 - DNA, 20 bp, Artificial Sequence
  chemically synthesized
ctctaattccagaagttcta

SEQ ID NO: 9218 - DNA, 20 bp, Artificial Sequence
  chemically synthesized
aattccagaagttctaaagc

SEQ ID NO: 9219 - DNA, 20 bp, Artificial Sequence
  chemically synthesized
attccagaagttctaaagca

SEQ ID NO: 9220 - DNA, 20 bp, Artificial Sequence
  chemically synthesized
cccattgatgaatttaatat

SEQ ID NO: 9221 - DNA, 20 bp, Artificial Sequence
  chemically synthesized
ccattgatgaatttaatatg

SEQ ID NO: 9222 - DNA, 20 bp, Artificial Sequence
  chemically synthesized
gatgaatttaatatgaggca

SEQ ID NO: 9223 - DNA, 20 bp, Artificial Sequence
  chemically synthesized
gaatttaatatgaggcacag

SEQ ID NO: 9224 - DNA, 20 bp, Artificial Sequence
  chemically synthesized
aatttaatatgaggcacagt

SEQ ID NO: 9225 - DNA, 20 bp, Artificial Sequence
  chemically synthesized
atgaggcacagtaggcatgt

SEQ ID NO: 9226 - DNA, 20 bp, Artificial Sequence
  chemically synthesized
aggcacagtaggcatgtaag

SEQ ID NO: 9227 - DNA, 20 bp, Artificial Sequence
  chemically synthesized
ggcacagtaggcatgtaaga

SEQ ID NO: 9228 - DNA, 20 bp, Artificial Sequence
  chemically synthesized
acagtaggcatgtaagaagg

SEQ ID NO: 9229 - DNA, 20 bp, Artificial Sequence
  chemically synthesized
agtaggcatgtaagaaggta

SEQ ID NO: 9230 - DNA, 20 bp, Artificial Sequence
  chemically synthesized
gcatgtaagaaggtagagaa

SEQ ID NO: 9231 - DNA, 20 bp, Artificial Sequence
  chemically synthesized
catgtaagaaggtagagaat

SEQ ID NO: 9232 - DNA, 20 bp, Artificial Sequence
  chemically synthesized
gtaagaaggtagagaatagg

SEQ ID NO: 9233 - DNA, 20 bp, Artificial Sequence
  chemically synthesized
aataggcagaattgcttata

SEQ ID NO: 9234 - DNA, 20 bp, Artificial Sequence
  chemically synthesized
gcagaattgcttataaagca

SEQ ID NO: 9235 - DNA, 20 bp, Artificial Sequence
  chemically synthesized
agaattgcttataaagcacg

SEQ ID NO: 9236 - DNA, 20 bp, Artificial Sequence
  chemically synthesized
tgtgtgtgcatgaaataaat

SEQ ID NO: 9237 - DNA, 20 bp, Artificial Sequence
  chemically synthesized
aaatataaaaatataaaaaa

SEQ ID NO: 9238 - DNA, 20 bp, Artificial Sequence
  chemically synthesized
taaaaatataaaaaatggtg

SEQ ID NO: 9239 - DNA, 20 bp, Artificial Sequence
  chemically synthesized
aaaaatataaaaaatggtgt

SEQ ID NO: 9240 - DNA, 20 bp, Artificial Sequence
  chemically synthesized
aaaatataaaaaatggtgtg

SEQ ID NO: 9241 - DNA, 20 bp, Artificial Sequence
  chemically synthesized
aaatataaaaaatggtgtgg

SEQ ID NO: 9242 - DNA, 20 bp, Artificial Sequence
  chemically synthesized
atataaaaaatggtgtgggg

SEQ ID NO: 9243 - DNA, 20 bp, Artificial Sequence
  chemically synthesized
tataaaaaatggtgtggggg

SEQ ID NO: 9244 - DNA, 20 bp, Artificial Sequence
  chemically synthesized
ataaaaaatggtgtggggga

SEQ ID NO: 9245 - DNA, 20 bp, Artificial Sequence
  chemically synthesized
aaatggtgtgggggagggtt

SEQ ID NO: 9246 - DNA, 20 bp, Artificial Sequence
  chemically synthesized
ggtgtgggggagggtttgga

SEQ ID NO: 9247 - DNA, 20 bp, Artificial Sequence
  chemically synthesized
gagggtttggaaagattttt

SEQ ID NO: 9248 - DNA, 20 bp, Artificial Sequence
  chemically synthesized
agggtttggaaagatttttt

SEQ ID NO: 9249 - DNA, 20 bp, Artificial Sequence
  chemically synthesized
gtttggaaagattttttggg

SEQ ID NO: 9250 - DNA, 20 bp, Artificial Sequence
  chemically synthesized
gaaagattttttgggtagta

SEQ ID NO: 9251 - DNA, 20 bp, Artificial Sequence
  chemically synthesized
aagattttttgggtagtata

SEQ ID NO: 9252 - DNA, 20 bp, Artificial Sequence
  chemically synthesized
attttttgggtagtatagag

SEQ ID NO: 9253 - DNA, 20 bp, Artificial Sequence
  chemically synthesized
tagtatagagaagtttattg

SEQ ID NO: 9254 - DNA, 20 bp, Artificial Sequence
  chemically synthesized
atagagaagtttattgtggc

SEQ ID NO: 9255 - DNA, 20 bp, Artificial Sequence
  chemically synthesized
tagagaagtttattgtggct

SEQ ID NO: 9256 - DNA, 20 bp, Artificial Sequence
  chemically synthesized
agagaagtttattgtggctg

SEQ ID NO: 9257 - DNA, 20 bp, Artificial Sequence
  chemically synthesized
agtttattgtggctggggtc

SEQ ID NO: 9258 - DNA, 20 bp, Artificial Sequence
  chemically synthesized
tttattgtggctggggtcaa

SEQ ID NO: 9259 - DNA, 20 bp, Artificial Sequence
  chemically synthesized
tattgtggctggggtcaaga

SEQ ID NO: 9260 - DNA, 20 bp, Artificial Sequence
  chemically synthesized
attgtggctggggtcaagag

SEQ ID NO: 9261 - DNA, 20 bp, Artificial Sequence
  chemically synthesized
ctggggtcaagagaggtcac

SEQ ID NO: 9262 - DNA, 20 bp, Artificial Sequence
  chemically synthesized
agaggtcacaagtaatacgt

SEQ ID NO: 9263 - DNA, 20 bp, Artificial Sequence
  chemically synthesized
aatgaatcttgactgaaata

SEQ ID NO: 9264 - DNA, 20 bp, Artificial Sequence
  chemically synthesized
atgaatcttgactgaaatat

SEQ ID NO: 9265 - DNA, 20 bp, Artificial Sequence
  chemically synthesized
aatcttgactgaaatatggg

SEQ ID NO: 9266 - DNA, 20 bp, Artificial Sequence
  chemically synthesized
tgactgaaatatgggaagat

SEQ ID NO: 9267 - DNA, 20 bp, Artificial Sequence
  chemically synthesized
actgaaatatgggaagataa

SEQ ID NO: 9268 - DNA, 20 bp, Artificial Sequence
  chemically synthesized
ctgaaatatgggaagataag

SEQ ID NO: 9269 - DNA, 20 bp, Artificial Sequence
  chemically synthesized
agataagaggaaattcttta

SEQ ID NO: 9270 - DNA, 20 bp, Artificial Sequence
  chemically synthesized
ataagaggaaattctttaca

SEQ ID NO: 9271 - DNA, 20 bp, Artificial Sequence
  chemically synthesized
aattctttacagagatgttc

SEQ ID NO: 9272 - DNA, 20 bp, Artificial Sequence
  chemically synthesized
attctttacagagatgttct

SEQ ID NO: 9273 - DNA, 20 bp, Artificial Sequence
  chemically synthesized
ttctttacagagatgttctg

SEQ ID NO: 9274 - DNA, 20 bp, Artificial Sequence
  chemically synthesized
ttacagagatgttctggggc

SEQ ID NO: 9275 - DNA, 20 bp, Artificial Sequence
  chemically synthesized
agagatgttctggggcaagt

SEQ ID NO: 9276 - DNA, 20 bp, Artificial Sequence
  chemically synthesized
agatgttctggggcaagtaa

SEQ ID NO: 9277 - DNA, 20 bp, Artificial Sequence
  chemically synthesized
gatgttctggggcaagtaag

SEQ ID NO: 9278 - DNA, 20 bp, Artificial Sequence
  chemically synthesized
tgttctggggcaagtaagag

SEQ ID NO: 9279 - DNA, 20 bp, Artificial Sequence
  chemically synthesized
gttctggggcaagtaagagg

SEQ ID NO: 9280 - DNA, 20 bp, Artificial Sequence
  chemically synthesized
ctggggcaagtaagaggagg

SEQ ID NO: 9281 - DNA, 20 bp, Artificial Sequence
  chemically synthesized
aagaggaggaagctatttct

SEQ ID NO: 9282 - DNA, 20 bp, Artificial Sequence
  chemically synthesized
gaggaggaagctatttcttg

SEQ ID NO: 9283 - DNA, 20 bp, Artificial Sequence
  chemically synthesized
gaggaagctatttcttggag

SEQ ID NO: 9284 - DNA, 20 bp, Artificial Sequence
  chemically synthesized
aggaagctatttcttggagc

SEQ ID NO: 9285 - DNA, 20 bp, Artificial Sequence
  chemically synthesized
cttggagcaggaacacttga

SEQ ID NO: 9286 - DNA, 20 bp, Artificial Sequence
  chemically synthesized
ttggagcaggaacacttgat

SEQ ID NO: 9287 - DNA, 20 bp, Artificial Sequence
  chemically synthesized
tggagcaggaacacttgatg

SEQ ID NO: 9288 - DNA, 20 bp, Artificial Sequence
  chemically synthesized
caggaacacttgatggggta

SEQ ID NO: 9289 - DNA, 20 bp, Artificial Sequence
  chemically synthesized
cttgatggggtatagtatta

SEQ ID NO: 9290 - DNA, 20 bp, Artificial Sequence
  chemically synthesized
ttgatggggtatagtattat

SEQ ID NO: 9291 - DNA, 20 bp, Artificial Sequence
  chemically synthesized
gtattatgggctacaatgtg

SEQ ID NO: 9292 - DNA, 20 bp, Artificial Sequence
  chemically synthesized
tattatgggctacaatgtgc

SEQ ID NO: 9293 - DNA, 20 bp, Artificial Sequence
  chemically synthesized
tgggctacaatgtgcaggca

SEQ ID NO: 9294 - DNA, 20 bp, Artificial Sequence
  chemically synthesized
gggctacaatgtgcaggcaa

SEQ ID NO: 9295 - DNA, 20 bp, Artificial Sequence
  chemically synthesized
ctacaatgtgcaggcaaagg

SEQ ID NO: 9296 - DNA, 20 bp, Artificial Sequence
  chemically synthesized
tacaatgtgcaggcaaagga

SEQ ID NO: 9297 - DNA, 20 bp, Artificial Sequence
  chemically synthesized
caatgtgcaggcaaaggaag

SEQ ID NO: 9298 - DNA, 20 bp, Artificial Sequence
  chemically synthesized
aatgtgcaggcaaaggaagg

SEQ ID NO: 9299 - DNA, 20 bp, Artificial Sequence
  chemically synthesized
gtgcaggcaaaggaaggagg

SEQ ID NO: 9300 - DNA, 20 bp, Artificial Sequence
  chemically synthesized
aggcaaaggaaggaggaaga

SEQ ID NO: 9301 - DNA, 20 bp, Artificial Sequence
  chemically synthesized
agacaacataacattgtctt

SEQ ID NO: 9302 - DNA, 20 bp, Artificial Sequence
  chemically synthesized
taatcattatgcctttaatt

SEQ ID NO: 9303 - DNA, 20 bp, Artificial Sequence
  chemically synthesized
aattgagcacattattttct

SEQ ID NO: 9304 - DNA, 20 bp, Artificial Sequence
  chemically synthesized
attattttctcagtaattgt

SEQ ID NO: 9305 - DNA, 20 bp, Artificial Sequence
  chemically synthesized
tattttctcagtaattgttg

SEQ ID NO: 9306 - DNA, 20 bp, Artificial Sequence
  chemically synthesized
taattgttggagtttaatcg

SEQ ID NO: 9307 - DNA, 20 bp, Artificial Sequence
  chemically synthesized
ttaatcgtagcattaccctt

SEQ ID NO: 9308 - DNA, 20 bp, Artificial Sequence
  chemically synthesized
taatcgtagcattacccttg

SEQ ID NO: 9309 - DNA, 20 bp, Artificial Sequence
  chemically synthesized
ttacccttgaggctatgtct

SEQ ID NO: 9310 - DNA, 20 bp, Artificial Sequence
  chemically synthesized
tacccttgaggctatgtctt

SEQ ID NO: 9311 - DNA, 20 bp, Artificial Sequence
  chemically synthesized
acccttgaggctatgtctta

SEQ ID NO: 9312 - DNA, 20 bp, Artificial Sequence
  chemically synthesized
tgaggctatgtcttagggtt

SEQ ID NO: 9313 - DNA, 20 bp, Artificial Sequence
  chemically synthesized
gaggctatgtcttagggttg

SEQ ID NO: 9314 - DNA, 20 bp, Artificial Sequence
  chemically synthesized
cttagggttgaggtcttccc

SEQ ID NO: 9315 - DNA, 20 bp, Artificial Sequence
  chemically synthesized
ggtcttccctagaacctctg

SEQ ID NO: 9316 - DNA, 20 bp, Artificial Sequence
  chemically synthesized
ccctagaacctctgcagtgc

SEQ ID NO: 9317 - DNA, 20 bp, Artificial Sequence
  chemically synthesized
gccagtattatctttgtatc

SEQ ID NO: 9318 - DNA, 20 bp, Artificial Sequence
  chemically synthesized
cagtattatctttgtatcaa

SEQ ID NO: 9319 - DNA, 20 bp, Artificial Sequence
  chemically synthesized
tcttgataatttctgctctt

SEQ ID NO: 9320 - DNA, 20 bp, Artificial Sequence
  chemically synthesized
ttgataatttctgctctttg

SEQ ID NO: 9321 - DNA, 20 bp, Artificial Sequence
  chemically synthesized
tgataatttctgctctttgg

SEQ ID NO: 9322 - DNA, 20 bp, Artificial Sequence
  chemically synthesized
taatttctgctctttggagg

SEQ ID NO: 9323 - DNA, 20 bp, Artificial Sequence
  chemically synthesized
tttctgctctttggaggtag

SEQ ID NO: 9324 - DNA, 20 bp, Artificial Sequence
  chemically synthesized
tcacccattaatgccttgta

SEQ ID NO: 9325 - DNA, 20 bp, Artificial Sequence
  chemically synthesized
gtactctttgtaaaataaac

SEQ ID NO: 9326 - DNA, 20 bp, Artificial Sequence
  chemically synthesized
aaacaagtgctccctatctg

SEQ ID NO: 9327 - DNA, 20 bp, Artificial Sequence
  chemically synthesized
acaagtgctccctatctgta

SEQ ID NO: 9328 - DNA, 20 bp, Artificial Sequence
  chemically synthesized
gctccctatctgtagagcct

SEQ ID NO: 9329 - DNA, 20 bp, Artificial Sequence
  chemically synthesized
ctccctatctgtagagcctc

SEQ ID NO: 9330 - DNA, 20 bp, Artificial Sequence
  chemically synthesized
caggaaccttcttacacacc

SEQ ID NO: 9331 - DNA, 20 bp, Artificial Sequence
  chemically synthesized
cctggacaaaaaaatgaaat

SEQ ID NO: 9332 - DNA, 20 bp, Artificial Sequence
  chemically synthesized
atgaaataagtgaaattaat

SEQ ID NO: 9333 - DNA, 20 bp, Artificial Sequence
  chemically synthesized
tgaaataagtgaaattaatc

SEQ ID NO: 9334 - DNA, 20 bp, Artificial Sequence
  chemically synthesized
aataagtgaaattaatcagg

SEQ ID NO: 9335 - DNA, 20 bp, Artificial Sequence
  chemically synthesized
gtgaaattaatcaggaagtt

SEQ ID NO: 9336 - DNA, 20 bp, Artificial Sequence
  chemically synthesized
ttgagctgaacattctttat

SEQ ID NO: 9337 - DNA, 20 bp, Artificial Sequence
  chemically synthesized
tgagctgaacattctttatt

SEQ ID NO: 9338 - DNA, 20 bp, Artificial Sequence
  chemically synthesized
gctgaacattctttattagg

SEQ ID NO: 9339 - DNA, 20 bp, Artificial Sequence
  chemically synthesized
gaacattctttattaggcag

SEQ ID NO: 9340 - DNA, 20 bp, Artificial Sequence
  chemically synthesized
aggcagaagccatacccttg

SEQ ID NO: 9341 - DNA, 20 bp, Artificial Sequence
  chemically synthesized
cagaagccatacccttgaag

SEQ ID NO: 9342 - DNA, 20 bp, Artificial Sequence
  chemically synthesized
agaagccatacccttgaagt

SEQ ID NO: 9343 - DNA, 20 bp, Artificial Sequence
  chemically synthesized
gaagtaggcattgtgttccc

SEQ ID NO: 9344 - DNA, 20 bp, Artificial Sequence
  chemically synthesized
aggcattgtgttcccaagtt

SEQ ID NO: 9345 - DNA, 20 bp, Artificial Sequence
  chemically synthesized
gtgttcccaagttcagaaaa

SEQ ID NO: 9346 - DNA, 20 bp, Artificial Sequence
  chemically synthesized
caagttcagaaaatagaatc

SEQ ID NO: 9347 - DNA, 20 bp, Artificial Sequence
  chemically synthesized
aagttcagaaaatagaatct

SEQ ID NO: 9348 - DNA, 20 bp, Artificial Sequence
  chemically synthesized
agttcagaaaatagaatcta

SEQ ID NO: 9349 - DNA, 20 bp, Artificial Sequence
  chemically synthesized
gaaaatagaatctagggaaa

SEQ ID NO: 9350 - DNA, 20 bp, Artificial Sequence
  chemically synthesized
aaaatagaatctagggaaat

SEQ ID NO: 9351 - DNA, 20 bp, Artificial Sequence
  chemically synthesized
aaatagaatctagggaaata

SEQ ID NO: 9352 - DNA, 20 bp, Artificial Sequence
  chemically synthesized
agggaaatagggtcttctta

SEQ ID NO: 9353 - DNA, 20 bp, Artificial Sequence
  chemically synthesized
tagggtcttcttatggttat

SEQ ID NO: 9354 - DNA, 20 bp, Artificial Sequence
  chemically synthesized
agggtcttcttatggttatc

SEQ ID NO: 9355 - DNA, 20 bp, Artificial Sequence
  chemically synthesized
ttcttatggttatcaggaaa

SEQ ID NO: 9356 - DNA, 20 bp, Artificial Sequence
  chemically synthesized
atggttatcaggaaacagtc

SEQ ID NO: 9357 - DNA, 20 bp, Artificial Sequence
  chemically synthesized
tggttatcaggaaacagtcc

SEQ ID NO: 9358 - DNA, 20 bp, Artificial Sequence
  chemically synthesized
gaaacagtccaggatctcaa

SEQ ID NO: 9359 - DNA, 20 bp, Artificial Sequence
  chemically synthesized
aggatctcaatggtacttgt

SEQ ID NO: 9360 - DNA, 20 bp, Artificial Sequence
  chemically synthesized
tctcaatggtacttgtgagc

SEQ ID NO: 9361 - DNA, 20 bp, Artificial Sequence
  chemically synthesized
ctcaatggtacttgtgagcc

SEQ ID NO: 9362 - DNA, 20 bp, Artificial Sequence
  chemically synthesized
tcaatggtacttgtgagcca

SEQ ID NO: 9363 - DNA, 20 bp, Artificial Sequence
  chemically synthesized
gtacttgtgagccagggcat

SEQ ID NO: 9364 - DNA, 20 bp, Artificial Sequence
  chemically synthesized
agccagggcattagccacac

SEQ ID NO: 9365 - DNA, 20 bp, Artificial Sequence
  chemically synthesized
caccagccaccaccttctga

SEQ ID NO: 9366 - DNA, 20 bp, Artificial Sequence
  chemically synthesized
accagccaccaccttctgat

SEQ ID NO: 9367 - DNA, 20 bp, Artificial Sequence
  chemically synthesized
agccaccaccttctgatagg

SEQ ID NO: 9368 - DNA, 20 bp, Artificial Sequence
  chemically synthesized
tgataggcagcctgcatttg

SEQ ID NO: 9369 - DNA, 20 bp, Artificial Sequence
  chemically synthesized
gataggcagcctgcatttgt

SEQ ID NO: 9370 - DNA, 20 bp, Artificial Sequence
  chemically synthesized
ataggcagcctgcatttgtg

SEQ ID NO: 9371 - DNA, 20 bp, Artificial Sequence
  chemically synthesized
gtggggtgaattccttgcca

SEQ ID NO: 9372 - DNA, 20 bp, Artificial Sequence
  chemically synthesized
tgaattccttgccaaagttg

SEQ ID NO: 9373 - DNA, 20 bp, Artificial Sequence
  chemically synthesized
gaattccttgccaaagttgc

SEQ ID NO: 9374 - DNA, 20 bp, Artificial Sequence
  chemically synthesized
tccttgccaaagttgcgggc

SEQ ID NO: 9375 - DNA, 20 bp, Artificial Sequence
  chemically synthesized
ttgcgggccagcacacacac

SEQ ID NO: 9376 - DNA, 20 bp, Artificial Sequence
  chemically synthesized
cacacaccagcacattgccc

SEQ ID NO: 9377 - DNA, 20 bp, Artificial Sequence
  chemically synthesized
cacaccagcacattgcccaa

SEQ ID NO: 9378 - DNA, 20 bp, Artificial Sequence
  chemically synthesized
agcacattgcccaagagctg

SEQ ID NO: 9379 - DNA, 20 bp, Artificial Sequence
  chemically synthesized
cacattgcccaagagctgcg

SEQ ID NO: 9380 - DNA, 20 bp, Artificial Sequence
  chemically synthesized
attgcccaagagctgcggag

SEQ ID NO: 9381 - DNA, 20 bp, Artificial Sequence
  chemically synthesized
tgcccaagagctgcggagaa

SEQ ID NO: 9382 - DNA, 20 bp, Artificial Sequence
  chemically synthesized
gcccaagagctgcggagaag

SEQ ID NO: 9383 - DNA, 20 bp, Artificial Sequence
  chemically synthesized
caagagctgcggagaagagg

SEQ ID NO: 9384 - DNA, 20 bp, Artificial Sequence
  chemically synthesized
aagagctgcggagaagaggt

SEQ ID NO: 9385 - DNA, 20 bp, Artificial Sequence
  chemically synthesized
agctgcggagaagaggtagg

SEQ ID NO: 9386 - DNA, 20 bp, Artificial Sequence
  chemically synthesized
ggtaggcagatacatgcata

SEQ ID NO: 9387 - DNA, 20 bp, Artificial Sequence
  chemically synthesized
agatacatgcatatggttaa

SEQ ID NO: 9388 - DNA, 20 bp, Artificial Sequence
  chemically synthesized
atacatgcatatggttaaca

SEQ ID NO: 9389 - DNA, 20 bp, Artificial Sequence
  chemically synthesized
atatggttaacagagaaata

SEQ ID NO: 9390 - DNA, 20 bp, Artificial Sequence
  chemically synthesized
gttaacagagaaataaagac

SEQ ID NO: 9391 - DNA, 20 bp, Artificial Sequence
  chemically synthesized
agaaataaagactggcttct

SEQ ID NO: 9392 - DNA, 20 bp, Artificial Sequence
  chemically synthesized
agactggcttctgagaaact

SEQ ID NO: 9393 - DNA, 20 bp, Artificial Sequence
  chemically synthesized
atttttttctgcccaaatct

SEQ ID NO: 9394 - DNA, 20 bp, Artificial Sequence
  chemically synthesized
tcttagacaaaactgatccc

SEQ ID NO: 9395 - DNA, 20 bp, Artificial Sequence
  chemically synthesized
cttagacaaaactgatcccc

SEQ ID NO: 9396 - DNA, 20 bp, Artificial Sequence
  chemically synthesized
gatccccaggttattcccat

SEQ ID NO: 9397 - DNA, 20 bp, Artificial Sequence
  chemically synthesized
ttattcccatcagcataaat

SEQ ID NO: 9398 - DNA, 20 bp, Artificial Sequence
  chemically synthesized
acatcctctatgtacttaac

SEQ ID NO: 9399 - DNA, 20 bp, Artificial Sequence
  chemically synthesized
ctatgtacttaactagcatg

SEQ ID NO: 9400 - DNA, 20 bp, Artificial Sequence
  chemically synthesized
tatacaaattaattccaaat

SEQ ID NO: 9401 - DNA, 20 bp, Artificial Sequence
  chemically synthesized
tttaattttgtatgtgtata

SEQ ID NO: 9402 - DNA, 20 bp, Artificial Sequence
  chemically synthesized
tacaaattaattactataaa

SEQ ID NO: 9403 - DNA, 20 bp, Artificial Sequence
  chemically synthesized
aattactataaacagattaa

SEQ ID NO: 9404 - DNA, 20 bp, Artificial Sequence
  chemically synthesized
atacaaattaattgattaat

SEQ ID NO: 9405 - DNA, 20 bp, Artificial Sequence
  chemically synthesized
ttgattaatcagtgtgatga

SEQ ID NO: 9406 - DNA, 20 bp, Artificial Sequence
  chemically synthesized
tgattaatcagtgtgatgat

SEQ ID NO: 9407 - DNA, 20 bp, Artificial Sequence
  chemically synthesized
tgtgatgatgggctgtctcc

SEQ ID NO: 9408 - DNA, 20 bp, Artificial Sequence
  chemically synthesized
aacgacttctgccccacctc

SEQ ID NO: 9409 - DNA, 20 bp, Artificial Sequence
  chemically synthesized
ccacctccagtgtaactgcc

SEQ ID NO: 9410 - DNA, 20 bp, Artificial Sequence
  chemically synthesized
cctttccattccatttacta

SEQ ID NO: 9411 - DNA, 20 bp, Artificial Sequence
  chemically synthesized
ccttattgtaaaatgattta

SEQ ID NO: 9412 - DNA, 20 bp, Artificial Sequence
  chemically synthesized
atgatttatagcctctaaaa

SEQ ID NO: 9413 - DNA, 20 bp, Artificial Sequence
  chemically synthesized
attctatgcctctcatcttt

SEQ ID NO: 9414 - DNA, 20 bp, Artificial Sequence
  chemically synthesized
tatgcctctcatctttgagt

SEQ ID NO: 9415 - DNA, 20 bp, Artificial Sequence
  chemically synthesized
tgcctctcatctttgagttg

SEQ ID NO: 9416 - DNA, 20 bp, Artificial Sequence
  chemically synthesized
gagcctctcccatacccatg

SEQ ID NO: 9417 - DNA, 20 bp, Artificial Sequence
  chemically synthesized
gcctctcccatacccatgtg

SEQ ID NO: 9418 - DNA, 20 bp, Artificial Sequence
  chemically synthesized
ctctcccatacccatgtgga

SEQ ID NO: 9419 - DNA, 20 bp, Artificial Sequence
  chemically synthesized
atacccatgtggagagacaa

SEQ ID NO: 9420 - DNA, 20 bp, Artificial Sequence
  chemically synthesized
tacccatgtggagagacaaa

SEQ ID NO: 9421 - DNA, 20 bp, Artificial Sequence
  chemically synthesized
agagacaaaaggattattct

SEQ ID NO: 9422 - DNA, 20 bp, Artificial Sequence
  chemically synthesized
caaaaggattattctaagtg

SEQ ID NO: 9423 - DNA, 20 bp, Artificial Sequence
  chemically synthesized
gattattctaagtgcagaat

SEQ ID NO: 9424 - DNA, 20 bp, Artificial Sequence
  chemically synthesized
tattctaagtgcagaattag

SEQ ID NO: 9425 - DNA, 20 bp, Artificial Sequence
  chemically synthesized
attctaagtgcagaattagc

SEQ ID NO: 9426 - DNA, 20 bp, Artificial Sequence
  chemically synthesized
taagtgcagaattagcaggt

SEQ ID NO: 9427 - DNA, 20 bp, Artificial Sequence
  chemically synthesized
agtgcagaattagcaggtga

SEQ ID NO: 9428 - DNA, 20 bp, Artificial Sequence
  chemically synthesized
cagaattagcaggtgagagc

SEQ ID NO: 9429 - DNA, 20 bp, Artificial Sequence
  chemically synthesized
agagctggtatgcataattt

SEQ ID NO: 9430 - DNA, 20 bp, Artificial Sequence
  chemically synthesized
tgcataatttgagttgttgt

SEQ ID NO: 9431 - DNA, 20 bp, Artificial Sequence
  chemically synthesized
cataatttgagttgttgtta

SEQ ID NO: 9432 - DNA, 20 bp, Artificial Sequence
  chemically synthesized
aatttgagttgttgttagag

SEQ ID NO: 9433 - DNA, 20 bp, Artificial Sequence
  chemically synthesized
atttgagttgttgttagaga

SEQ ID NO: 9434 - DNA, 20 bp, Artificial Sequence
  chemically synthesized
ttgttagagaaggaaaaatg

SEQ ID NO: 9435 - DNA, 20 bp, Artificial Sequence
  chemically synthesized
tgttagagaaggaaaaatga

SEQ ID NO: 9436 - DNA, 20 bp, Artificial Sequence
  chemically synthesized
gttagagaaggaaaaatgaa

SEQ ID NO: 9437 - DNA, 20 bp, Artificial Sequence
  chemically synthesized
tagagaaggaaaaatgaagg

SEQ ID NO: 9438 - DNA, 20 bp, Artificial Sequence
  chemically synthesized
agagaaggaaaaatgaaggg

SEQ ID NO: 9439 - DNA, 20 bp, Artificial Sequence
  chemically synthesized
gagaaggaaaaatgaaggga

SEQ ID NO: 9440 - DNA, 20 bp, Artificial Sequence
  chemically synthesized
agaaggaaaaatgaagggag

SEQ ID NO: 9441 - DNA, 20 bp, Artificial Sequence
  chemically synthesized
gaaggaaaaatgaagggagg

SEQ ID NO: 9442 - DNA, 20 bp, Artificial Sequence
  chemically synthesized
gaaaaatgaagggagggggt

SEQ ID NO: 9443 - DNA, 20 bp, Artificial Sequence
  chemically synthesized
aaaaatgaagggagggggtt

SEQ ID NO: 9444 - DNA, 20 bp, Artificial Sequence
  chemically synthesized
aaatgaagggagggggttgg

SEQ ID NO: 9445 - DNA, 20 bp, Artificial Sequence
  chemically synthesized
atgaagggagggggttggga

SEQ ID NO: 9446 - DNA, 20 bp, Artificial Sequence
  chemically synthesized
agggagggggttgggagaga

SEQ ID NO: 9447 - DNA, 20 bp, Artificial Sequence
  chemically synthesized
agggggttgggagagaaaga

SEQ ID NO: 9448 - DNA, 20 bp, Artificial Sequence
  chemically synthesized
gggggttgggagagaaagac

SEQ ID NO: 9449 - DNA, 20 bp, Artificial Sequence
  chemically synthesized
ggatattaaataatttaaaa

SEQ ID NO: 9450 - DNA, 20 bp, Artificial Sequence
  chemically synthesized
attaaataatttaaaatagc

SEQ ID NO: 9451 - DNA, 20 bp, Artificial Sequence
  chemically synthesized
atttaaaatagcaagattgt

SEQ ID NO: 9452 - DNA, 20 bp, Artificial Sequence
  chemically synthesized
tttaaaatagcaagattgtg

SEQ ID NO: 9453 - DNA, 20 bp, Artificial Sequence
  chemically synthesized
aaaatagcaagattgtgagg

SEQ ID NO: 9454 - DNA, 20 bp, Artificial Sequence
  chemically synthesized
aaatagcaagattgtgagga

SEQ ID NO: 9455 - DNA, 20 bp, Artificial Sequence
  chemically synthesized
ttgtgaggaaggaaaaaatg

SEQ ID NO: 9456 - DNA, 20 bp, Artificial Sequence
  chemically synthesized
ataaaaaattaacaaaattt

SEQ ID NO: 9457 - DNA, 20 bp, Artificial Sequence
  chemically synthesized
aaaaattaacaaaattttag

SEQ ID NO: 9458 - DNA, 20 bp, Artificial Sequence
  chemically synthesized
aagcattaaatgataaaata

SEQ ID NO: 9459 - DNA, 20 bp, Artificial Sequence
  chemically synthesized
atagtaaaatgacaaaaatg

SEQ ID NO: 9460 - DNA, 20 bp, Artificial Sequence
  chemically synthesized
tagtaaaatgacaaaaatgt

SEQ ID NO: 9461 - DNA, 20 bp, Artificial Sequence
  chemically synthesized
gtaaaatgacaaaaatgtgg

SEQ ID NO: 9462 - DNA, 20 bp, Artificial Sequence
  chemically synthesized
aaatgacaaaaatgtgggag

SEQ ID NO: 9463 - DNA, 20 bp, Artificial Sequence
  chemically synthesized
atgacaaaaatgtgggagaa

SEQ ID NO: 9464 - DNA, 20 bp, Artificial Sequence
  chemically synthesized
acaaaaatgtgggagaagag

SEQ ID NO: 9465 - DNA, 20 bp, Artificial Sequence
  chemically synthesized
caaaaatgtgggagaagagc

SEQ ID NO: 9466 - DNA, 20 bp, Artificial Sequence
  chemically synthesized
aaatgtgggagaagagcagg

SEQ ID NO: 9467 - DNA, 20 bp, Artificial Sequence
  chemically synthesized
aatgtgggagaagagcaggt

SEQ ID NO: 9468 - DNA, 20 bp, Artificial Sequence
  chemically synthesized
ggagaagagcaggtaggtaa

SEQ ID NO: 9469 - DNA, 20 bp, Artificial Sequence
  chemically synthesized
aggtaaaagaaccaaaatgt

SEQ ID NO: 9470 - DNA, 20 bp, Artificial Sequence
  chemically synthesized
aaagaaccaaaatgtaagat

SEQ ID NO: 9471 - DNA, 20 bp, Artificial Sequence
  chemically synthesized
aaccaaaatgtaagattaga

SEQ ID NO: 9472 - DNA, 20 bp, Artificial Sequence
  chemically synthesized
atgtaagattagaaagtaaa

SEQ ID NO: 9473 - DNA, 20 bp, Artificial Sequence
  chemically synthesized
gtaagattagaaagtaaaaa

SEQ ID NO: 9474 - DNA, 20 bp, Artificial Sequence
  chemically synthesized
attagaaagtaaaaagagaa

SEQ ID NO: 9475 - DNA, 20 bp, Artificial Sequence
  chemically synthesized
aaagtaaaaagagaaaagtg

SEQ ID NO: 9476 - DNA, 20 bp, Artificial Sequence
  chemically synthesized
gagaaaagtgaagcatctcc

SEQ ID NO: 9477 - DNA, 20 bp, Artificial Sequence
  chemically synthesized
catctcctggactcaccctg

SEQ ID NO: 9478 - DNA, 20 bp, Artificial Sequence
  chemically synthesized
tggactcaccctgaagttct

SEQ ID NO: 9479 - DNA, 20 bp, Artificial Sequence
  chemically synthesized
ggactcaccctgaagttctc

SEQ ID NO: 9480 - DNA, 20 bp, Artificial Sequence
  chemically synthesized
aagttctcaggatccacgtg

SEQ ID NO: 9481 - DNA, 20 bp, Artificial Sequence
  chemically synthesized
gatccacgtgcagcttgtca

SEQ ID NO: 9482 - DNA, 20 bp, Artificial Sequence
  chemically synthesized
acgtgcagcttgtcacagtg

SEQ ID NO: 9483 - DNA, 20 bp, Artificial Sequence
  chemically synthesized
ttgtcacagtgcagctcact

SEQ ID NO: 9484 - DNA, 20 bp, Artificial Sequence
  chemically synthesized
acagtgcagctcactcagct

SEQ ID NO: 9485 - DNA, 20 bp, Artificial Sequence
  chemically synthesized
cagctcactcagctgagaaa

SEQ ID NO: 9486 - DNA, 20 bp, Artificial Sequence
  chemically synthesized
agctgagaaaaagtgccctt

SEQ ID NO: 9487 - DNA, 20 bp, Artificial Sequence
  chemically synthesized
gctgagaaaaagtgcccttg

SEQ ID NO: 9488 - DNA, 20 bp, Artificial Sequence
  chemically synthesized
aaagtgcccttgaggttgtc

SEQ ID NO: 9489 - DNA, 20 bp, Artificial Sequence
  chemically synthesized
aagtgcccttgaggttgtcc

SEQ ID NO: 9490 - DNA, 20 bp, Artificial Sequence
  chemically synthesized
gcccttgaggttgtccaggt

SEQ ID NO: 9491 - DNA, 20 bp, Artificial Sequence
  chemically synthesized
ttgaggttgtccaggtgagc

SEQ ID NO: 9492 - DNA, 20 bp, Artificial Sequence
  chemically synthesized
tgaggttgtccaggtgagcc

SEQ ID NO: 9493 - DNA, 20 bp, Artificial Sequence
  chemically synthesized
ggtgagccaggccatcacta

SEQ ID NO: 9494 - DNA, 20 bp, Artificial Sequence
  chemically synthesized
gtgagccaggccatcactaa

SEQ ID NO: 9495 - DNA, 20 bp, Artificial Sequence
  chemically synthesized
aggccatcactaaaggcacc

SEQ ID NO: 9496 - DNA, 20 bp, Artificial Sequence
  chemically synthesized
acctagcaccttcttgccat

SEQ ID NO: 9497 - DNA, 20 bp, Artificial Sequence
  chemically synthesized
cttgccatgagccttcacct

SEQ ID NO: 9498 - DNA, 20 bp, Artificial Sequence
  chemically synthesized
ttgccatgagccttcacctt

SEQ ID NO: 9499 - DNA, 20 bp, Artificial Sequence
  chemically synthesized
tgccatgagccttcacctta

SEQ ID NO: 9500 - DNA, 20 bp, Artificial Sequence
  chemically synthesized
caccttagggttgcccataa

SEQ ID NO: 9501 - DNA, 20 bp, Artificial Sequence
  chemically synthesized
agggttgcccataacagcat

SEQ ID NO: 9502 - DNA, 20 bp, Artificial Sequence
  chemically synthesized
gggttgcccataacagcatc

SEQ ID NO: 9503 - DNA, 20 bp, Artificial Sequence
  chemically synthesized
gttgcccataacagcatcag

SEQ ID NO: 9504 - DNA, 20 bp, Artificial Sequence
  chemically synthesized
tgcccataacagcatcagga

SEQ ID NO: 9505 - DNA, 20 bp, Artificial Sequence
  chemically synthesized
gcccataacagcatcaggag

SEQ ID NO: 9506 - DNA, 20 bp, Artificial Sequence
  chemically synthesized
ataacagcatcaggagagga

SEQ ID NO: 9507 - DNA, 20 bp, Artificial Sequence
  chemically synthesized
caggagaggacagatcccca

SEQ ID NO: 9508 - DNA, 20 bp, Artificial Sequence
  chemically synthesized
aggagaggacagatccccaa

SEQ ID NO: 9509 - DNA, 20 bp, Artificial Sequence
  chemically synthesized
acagatccccaaaggactca

SEQ ID NO: 9510 - DNA, 20 bp, Artificial Sequence
  chemically synthesized
caaaggactcaaagaacctc

SEQ ID NO: 9511 - DNA, 20 bp, Artificial Sequence
  chemically synthesized
aaaggactcaaagaacctct

SEQ ID NO: 9512 - DNA, 20 bp, Artificial Sequence
  chemically synthesized
ctcaaagaacctctgggtcc

SEQ ID NO: 9513 - DNA, 20 bp, Artificial Sequence
  chemically synthesized
tcaaagaacctctgggtcca

SEQ ID NO: 9514 - DNA, 20 bp, Artificial Sequence
  chemically synthesized
caaagaacctctgggtccaa

SEQ ID NO: 9515 - DNA, 20 bp, Artificial Sequence
  chemically synthesized
agaacctctgggtccaaggg

SEQ ID NO: 9516 - DNA, 20 bp, Artificial Sequence
  chemically synthesized
tgggtccaagggtagaccac

SEQ ID NO: 9517 - DNA, 20 bp, Artificial Sequence
  chemically synthesized
gggtagaccaccagtaatct

SEQ ID NO: 9518 - DNA, 20 bp, Artificial Sequence
  chemically synthesized
ggtagaccaccagtaatctg

SEQ ID NO: 9519 - DNA, 20 bp, Artificial Sequence
  chemically synthesized
gtagaccaccagtaatctga

SEQ ID NO: 9520 - DNA, 20 bp, Artificial Sequence
  chemically synthesized
gaccaccagtaatctgaggg

SEQ ID NO: 9521 - DNA, 20 bp, Artificial Sequence
  chemically synthesized
accaccagtaatctgagggt

SEQ ID NO: 9522 - DNA, 20 bp, Artificial Sequence
  chemically synthesized
gtaatctgagggtaggaaaa

SEQ ID NO: 9523 - DNA, 20 bp, Artificial Sequence
  chemically synthesized
tgagggtaggaaaacagccc

SEQ ID NO: 9524 - DNA, 20 bp, Artificial Sequence
  chemically synthesized
gagggtaggaaaacagccca

SEQ ID NO: 9525 - DNA, 20 bp, Artificial Sequence
  chemically synthesized
agggtaggaaaacagcccaa

SEQ ID NO: 9526 - DNA, 20 bp, Artificial Sequence
  chemically synthesized
taggaaaacagcccaaggga

SEQ ID NO: 9527 - DNA, 20 bp, Artificial Sequence
  chemically synthesized
ggaaaacagcccaagggaca

SEQ ID NO: 9528 - DNA, 20 bp, Artificial Sequence
  chemically synthesized
aaaacagcccaagggacaga

SEQ ID NO: 9529 - DNA, 20 bp, Artificial Sequence
  chemically synthesized
cagcccaagggacagagagt

SEQ ID NO: 9530 - DNA, 20 bp, Artificial Sequence
  chemically synthesized
gacagagagtcagtgcctat

SEQ ID NO: 9531 - DNA, 20 bp, Artificial Sequence
  chemically synthesized
tcagtgcctatcagaaaccc

SEQ ID NO: 9532 - DNA, 20 bp, Artificial Sequence
  chemically synthesized
agtgcctatcagaaacccaa

SEQ ID NO: 9533 - DNA, 20 bp, Artificial Sequence
  chemically synthesized
cttctctgtctacacatgcc

SEQ ID NO: 9534 - DNA, 20 bp, Artificial Sequence
  chemically synthesized
cagtttccatttgcctcctt

SEQ ID NO: 9535 - DNA, 20 bp, Artificial Sequence
  chemically synthesized
aaccttgataccaacctgcc

SEQ ID NO: 9536 - DNA, 20 bp, Artificial Sequence
  chemically synthesized
accttgataccaacctgccc

SEQ ID NO: 9537 - DNA, 20 bp, Artificial Sequence
  chemically synthesized
ccttgataccaacctgccca

SEQ ID NO: 9538 - DNA, 20 bp, Artificial Sequence
  chemically synthesized
tccacgttcactttgcccca

SEQ ID NO: 9539 - DNA, 20 bp, Artificial Sequence
  chemically synthesized
ccacgttcactttgccccac

SEQ ID NO: 9540 - DNA, 20 bp, Artificial Sequence
  chemically synthesized
cacgttcactttgccccaca

SEQ ID NO: 9541 - DNA, 20 bp, Artificial Sequence
  chemically synthesized
tttgccccacagggcattga

SEQ ID NO: 9542 - DNA, 20 bp, Artificial Sequence
  chemically synthesized
gccccacagggcattgacag

SEQ ID NO: 9543 - DNA, 20 bp, Artificial Sequence
  chemically synthesized
attgacagcagtcttctcct

SEQ ID NO: 9544 - DNA, 20 bp, Artificial Sequence
  chemically synthesized
ttgacagcagtcttctcctc

SEQ ID NO: 9545 - DNA, 20 bp, Artificial Sequence
  chemically synthesized
gacagcagtcttctcctcag

SEQ ID NO: 9546 - DNA, 20 bp, Artificial Sequence
  chemically synthesized
gcagtcttctcctcaggagt

SEQ ID NO: 9547 - DNA, 20 bp, Artificial Sequence
  chemically synthesized
ctcaggagtcagatgcacca

SEQ ID NO: 9548 - DNA, 20 bp, Artificial Sequence
  chemically synthesized
atgcaccatggtgtctgttt

SEQ ID NO: 9549 - DNA, 20 bp, Artificial Sequence
  chemically synthesized
tgcaccatggtgtctgtttg

SEQ ID NO: 9550 - DNA, 20 bp, Artificial Sequence
  chemically synthesized
tggtgtctgtttgaggttgc

SEQ ID NO: 9551 - DNA, 20 bp, Artificial Sequence
  chemically synthesized
gctagtgaacactgttatgt

SEQ ID NO: 9552 - DNA, 20 bp, Artificial Sequence
  chemically synthesized
agtgaacactgttatgtcag

SEQ ID NO: 9553 - DNA, 20 bp, Artificial Sequence
  chemically synthesized
aacactgttatgtcagaaga

SEQ ID NO: 9554 - DNA, 20 bp, Artificial Sequence
  chemically synthesized
gttatgtcagaagaaagtgt

SEQ ID NO: 9555 - DNA, 20 bp, Artificial Sequence
  chemically synthesized
tcagaagaaagtgtaagcaa

SEQ ID NO: 9556 - DNA, 20 bp, Artificial Sequence
  chemically synthesized
ctctgccctgccttttatgc

SEQ ID NO: 9557 - DNA, 20 bp, Artificial Sequence
  chemically synthesized
tggtcctgtcctccctgctc

SEQ ID NO: 9558 - DNA, 20 bp, Artificial Sequence
  chemically synthesized
cctgtcctccctgctccagt

SEQ ID NO: 9559 - DNA, 20 bp, Artificial Sequence
  chemically synthesized
gtcctccctgctccagtgag

SEQ ID NO: 9560 - DNA, 20 bp, Artificial Sequence
  chemically synthesized
tcctccctgctccagtgagc

SEQ ID NO: 9561 - DNA, 20 bp, Artificial Sequence
  chemically synthesized
ccctgctccagtgagcaggt

SEQ ID NO: 9562 - DNA, 20 bp, Artificial Sequence
  chemically synthesized
tccagtgagcaggttggttt

SEQ ID NO: 9563 - DNA, 20 bp, Artificial Sequence
  chemically synthesized
tgagcaggttggtttaagat

SEQ ID NO: 9564 - DNA, 20 bp, Artificial Sequence
  chemically synthesized
gcaggttggtttaagataag

SEQ ID NO: 9565 - DNA, 20 bp, Artificial Sequence
  chemically synthesized
caggttggtttaagataagc

SEQ ID NO: 9566 - DNA, 20 bp, Artificial Sequence
  chemically synthesized
aggttggtttaagataagca

SEQ ID NO: 9567 - DNA, 20 bp, Artificial Sequence
  chemically synthesized
taagataagcagggtttcat

SEQ ID NO: 9568 - DNA, 20 bp, Artificial Sequence
  chemically synthesized
gcagggtttcattagtttgt

SEQ ID NO: 9569 - DNA, 20 bp, Artificial Sequence
  chemically synthesized
ctattcccttaacttgccct

SEQ ID NO: 9570 - DNA, 20 bp, Artificial Sequence
  chemically synthesized
cccttaacttgccctgagat

SEQ ID NO: 9571 - DNA, 20 bp, Artificial Sequence
  chemically synthesized
ctgtcatgtgtgtcttgact

SEQ ID NO: 9572 - DNA, 20 bp, Artificial Sequence
  chemically synthesized
tctccccaccgcatctcttt

SEQ ID NO: 9573 - DNA, 20 bp, Artificial Sequence
  chemically synthesized
ccccaccgcatctctttcag

SEQ ID NO: 9574 - DNA, 20 bp, Artificial Sequence
  chemically synthesized
tgtttctaaaaatatcctcc

SEQ ID NO: 9575 - DNA, 20 bp, Artificial Sequence
  chemically synthesized
tcctcctagtttcatttttg

SEQ ID NO: 9576 - DNA, 20 bp, Artificial Sequence
  chemically synthesized
tcctagtttcatttttgcag

SEQ ID NO: 9577 - DNA, 20 bp, Artificial Sequence
  chemically synthesized
tcatttttgcagaagtgttt

SEQ ID NO: 9578 - DNA, 20 bp, Artificial Sequence
  chemically synthesized
catttttgcagaagtgtttt

SEQ ID NO: 9579 - DNA, 20 bp, Artificial Sequence
  chemically synthesized
agaagtgttttaggctaata

SEQ ID NO: 9580 - DNA, 20 bp, Artificial Sequence
  chemically synthesized
agtgttttaggctaatatag

SEQ ID NO: 9581 - DNA, 20 bp, Artificial Sequence
  chemically synthesized
taatatagtggaatgtatct

SEQ ID NO: 9582 - DNA, 20 bp, Artificial Sequence
  chemically synthesized
atatagtggaatgtatctta

SEQ ID NO: 9583 - DNA, 20 bp, Artificial Sequence
  chemically synthesized
tgtttctgtcactttatact

SEQ ID NO: 9584 - DNA, 20 bp, Artificial Sequence
  chemically synthesized
tactaagaaaacttatctaa

SEQ ID NO: 9585 - DNA, 20 bp, Artificial Sequence
  chemically synthesized
taagaaaacttatctaaaag

SEQ ID NO: 9586 - DNA, 20 bp, Artificial Sequence
  chemically synthesized
ctaaaagcagatgttttaac

SEQ ID NO: 9587 - DNA, 20 bp, Artificial Sequence
  chemically synthesized
taacaagttgactcaatata

SEQ ID NO: 9588 - DNA, 20 bp, Artificial Sequence
  chemically synthesized
ataaagttcttctttgcctc

SEQ ID NO: 9589 - DNA, 20 bp, Artificial Sequence
  chemically synthesized
aaagttcttctttgcctcta

SEQ ID NO: 9590 - DNA, 20 bp, Artificial Sequence
  chemically synthesized
ctctagagatttttgtctcc

SEQ ID NO: 9591 - DNA, 20 bp, Artificial Sequence
  chemically synthesized
tctagagatttttgtctcca

SEQ ID NO: 9592 - DNA, 20 bp, Artificial Sequence
  chemically synthesized
ctagagatttttgtctccaa

SEQ ID NO: 9593 - DNA, 20 bp, Artificial Sequence
  chemically synthesized
tttgtctccaagggaatttt

SEQ ID NO: 9594 - DNA, 20 bp, Artificial Sequence
  chemically synthesized
tgtctccaagggaattttga

SEQ ID NO: 9595 - DNA, 20 bp, Artificial Sequence
  chemically synthesized
gtctccaagggaattttgag

SEQ ID NO: 9596 - DNA, 20 bp, Artificial Sequence
  chemically synthesized
ccaagggaattttgagaggt

SEQ ID NO: 9597 - DNA, 20 bp, Artificial Sequence
  chemically synthesized
ggaattttgagaggttggaa

SEQ ID NO: 9598 - DNA, 20 bp, Artificial Sequence
  chemically synthesized
aatggacaaatctattgctg

SEQ ID NO: 9599 - DNA, 20 bp, Artificial Sequence
  chemically synthesized
tgcttgcttcctccttcttt

SEQ ID NO: 9600 - DNA, 20 bp, Artificial Sequence
  chemically synthesized
ttgaaataaatatccattaa

SEQ ID NO: 9601 - DNA, 20 bp, Artificial Sequence
  chemically synthesized
aagaatatttaaaaaatgaa

SEQ ID NO: 9602 - DNA, 20 bp, Artificial Sequence
  chemically synthesized
aatgaatagtgtttatttac

SEQ ID NO: 9603 - DNA, 20 bp, Artificial Sequence
  chemically synthesized
ttatttaccagttattgaaa

SEQ ID NO: 9604 - DNA, 20 bp, Artificial Sequence
  chemically synthesized
tatttaccagttattgaaat

SEQ ID NO: 9605 - DNA, 20 bp, Artificial Sequence
  chemically synthesized
ccagttattgaaataggttc

SEQ ID NO: 9606 - DNA, 20 bp, Artificial Sequence
  chemically synthesized
gttctggaaacatgaatttt

SEQ ID NO: 9607 - DNA, 20 bp, Artificial Sequence
  chemically synthesized
ttctggaaacatgaatttta

SEQ ID NO: 9608 - DNA, 20 bp, Artificial Sequence
  chemically synthesized
taaggttaacattttaatga

SEQ ID NO: 9609 - DNA, 20 bp, Artificial Sequence
  chemically synthesized
attttgaatgtttaaaatta

SEQ ID NO: 9610 - DNA, 20 bp, Artificial Sequence
  chemically synthesized
ttaaaattatggtatgacta

SEQ ID NO: 9611 - DNA, 20 bp, Artificial Sequence
  chemically synthesized
aattatggtatgactaaaga

SEQ ID NO: 9612 - DNA, 20 bp, Artificial Sequence
  chemically synthesized
atgactaaagaaagaatgca

SEQ ID NO: 9613 - DNA, 20 bp, Artificial Sequence
  chemically synthesized
aagaaagaatgcaaagtgaa

SEQ ID NO: 9614 - DNA, 20 bp, Artificial Sequence
  chemically synthesized
aaagaatgcaaagtgaaaag

SEQ ID NO: 9615 - DNA, 20 bp, Artificial Sequence
  chemically synthesized
aaaagtagatttaccatatt

SEQ ID NO: 9616 - DNA, 20 bp, Artificial Sequence
  chemically synthesized
gtagatttaccatattcagc

SEQ ID NO: 9617 - DNA, 20 bp, Artificial Sequence
  chemically synthesized
cagccagattaaatttaacg

SEQ ID NO: 9618 - DNA, 20 bp, Artificial Sequence
  chemically synthesized
attaaatttaacgaagttcc

SEQ ID NO: 9619 - DNA, 20 bp, Artificial Sequence
  chemically synthesized
ttaaatttaacgaagttcct

SEQ ID NO: 9620 - DNA, 20 bp, Artificial Sequence
  chemically synthesized
cgaagttcctgggaatatgc

SEQ ID NO: 9621 - DNA, 20 bp, Artificial Sequence
  chemically synthesized
ttcctgggaatatgctagta

SEQ ID NO: 9622 - DNA, 20 bp, Artificial Sequence
  chemically synthesized
gctagtacagaacattttta

SEQ ID NO: 9623 - DNA, 20 bp, Artificial Sequence
  chemically synthesized
tgtgttcttaaaaaaaaatg

SEQ ID NO: 9624 - DNA, 20 bp, Artificial Sequence
  chemically synthesized
cttaaaaaaaaatgtggaat

SEQ ID NO: 9625 - DNA, 20 bp, Artificial Sequence
  chemically synthesized
aaaaaatgtggaattagacc

SEQ ID NO: 9626 - DNA, 20 bp, Artificial Sequence
  chemically synthesized
aaaaatgtggaattagaccc

SEQ ID NO: 9627 - DNA, 20 bp, Artificial Sequence
  chemically synthesized
tggaattagacccaggaatg

SEQ ID NO: 9628 - DNA, 20 bp, Artificial Sequence
  chemically synthesized
agacccaggaatgaagatcc

SEQ ID NO: 9629 - DNA, 20 bp, Artificial Sequence
  chemically synthesized
cccaggaatgaagatcccag

SEQ ID NO: 9630 - DNA, 20 bp, Artificial Sequence
  chemically synthesized
gaattcaaataatgccacaa

SEQ ID NO: 9631 - DNA, 20 bp, Artificial Sequence
  chemically synthesized
ttcaaataatgccacaatgg

SEQ ID NO: 9632 - DNA, 20 bp, Artificial Sequence
  chemically synthesized
gcagacaaatacacacccat

SEQ ID NO: 9633 - DNA, 20 bp, Artificial Sequence
  chemically synthesized
acacccatgagcatatccaa

SEQ ID NO: 9634 - DNA, 20 bp, Artificial Sequence
  chemically synthesized
cacccatgagcatatccaaa

SEQ ID NO: 9635 - DNA, 20 bp, Artificial Sequence
  chemically synthesized
ccatgagcatatccaaaagg

SEQ ID NO: 9636 - DNA, 20 bp, Artificial Sequence
  chemically synthesized
catgagcatatccaaaagga

SEQ ID NO: 9637 - DNA, 20 bp, Artificial Sequence
  chemically synthesized
atatccaaaaggaaggattg

SEQ ID NO: 9638 - DNA, 20 bp, Artificial Sequence
  chemically synthesized
tatccaaaaggaaggattga

SEQ ID NO: 9639 - DNA, 20 bp, Artificial Sequence
  chemically synthesized
caaaaggaaggattgaagga

SEQ ID NO: 9640 - DNA, 20 bp, Artificial Sequence
  chemically synthesized
aaaggaaggattgaaggaaa

SEQ ID NO: 9641 - DNA, 20 bp, Artificial Sequence
  chemically synthesized
aaggaaggattgaaggaaag

SEQ ID NO: 9642 - DNA, 20 bp, Artificial Sequence
  chemically synthesized
ggaaggattgaaggaaagag

SEQ ID NO: 9643 - DNA, 20 bp, Artificial Sequence
  chemically synthesized
gaaggattgaaggaaagagg

SEQ ID NO: 9644 - DNA, 20 bp, Artificial Sequence
  chemically synthesized
ggattgaaggaaagaggagg

SEQ ID NO: 9645 - DNA, 20 bp, Artificial Sequence
  chemically synthesized
aaggaaagaggaggaagaaa

SEQ ID NO: 9646 - DNA, 20 bp, Artificial Sequence
  chemically synthesized
ggaaagaggaggaagaaatg

SEQ ID NO: 9647 - DNA, 20 bp, Artificial Sequence
  chemically synthesized
agaggaggaagaaatggaga

SEQ ID NO: 9648 - DNA, 20 bp, Artificial Sequence
  chemically synthesized
gaggaggaagaaatggagaa

SEQ ID NO: 9649 - DNA, 20 bp, Artificial Sequence
  chemically synthesized
gaggaagaaatggagaaagg

SEQ ID NO: 9650 - DNA, 20 bp, Artificial Sequence
  chemically synthesized
aggaagaaatggagaaagga

SEQ ID NO: 9651 - DNA, 20 bp, Artificial Sequence
  chemically synthesized
aagaaatggagaaaggaagg

SEQ ID NO: 9652 - DNA, 20 bp, Artificial Sequence
  chemically synthesized
agaaatggagaaaggaagga

SEQ ID NO: 9653 - DNA, 20 bp, Artificial Sequence
  chemically synthesized
aatggagaaaggaaggaagg

SEQ ID NO: 9654 - DNA, 20 bp, Artificial Sequence
  chemically synthesized
tggagaaaggaaggaaggaa

SEQ ID NO: 9655 - DNA, 20 bp, Artificial Sequence
  chemically synthesized
ggagaaaggaaggaaggaag

SEQ ID NO: 9656 - DNA, 20 bp, Artificial Sequence
  chemically synthesized
gagaaaggaaggaaggaaga

SEQ ID NO: 9657 - DNA, 20 bp, Artificial Sequence
  chemically synthesized
agaaaggaaggaaggaagag

SEQ ID NO: 9658 - DNA, 20 bp, Artificial Sequence
  chemically synthesized
aaggaaggaaggaagagggg

SEQ ID NO: 9659 - DNA, 20 bp, Artificial Sequence
  chemically synthesized
ggaaggaaggaagaggggaa

SEQ ID NO: 9660 - DNA, 20 bp, Artificial Sequence
  chemically synthesized
aaggaaggaagaggggaaga

SEQ ID NO: 9661 - DNA, 20 bp, Artificial Sequence
  chemically synthesized
ggaaggaagaggggaagaga

SEQ ID NO: 9662 - DNA, 20 bp, Artificial Sequence
  chemically synthesized
gaaggaagaggggaagagag

SEQ ID NO: 9663 - DNA, 20 bp, Artificial Sequence
  chemically synthesized
gaagaggggaagagagagga

SEQ ID NO: 9664 - DNA, 20 bp, Artificial Sequence
  chemically synthesized
gaggggaagagagaggatgg

SEQ ID NO: 9665 - DNA, 20 bp, Artificial Sequence
  chemically synthesized
aggggaagagagaggatgga

SEQ ID NO: 9666 - DNA, 20 bp, Artificial Sequence
  chemically synthesized
ggggaagagagaggatggaa

SEQ ID NO: 9667 - DNA, 20 bp, Artificial Sequence
  chemically synthesized
aagagagaggatggaaggga

SEQ ID NO: 9668 - DNA, 20 bp, Artificial Sequence
  chemically synthesized
gagagaggatggaagggatg

SEQ ID NO: 9669 - DNA, 20 bp, Artificial Sequence
  chemically synthesized
agagaggatggaagggatgg

SEQ ID NO: 9670 - DNA, 20 bp, Artificial Sequence
  chemically synthesized
agaggatggaagggatggag

SEQ ID NO: 9671 - DNA, 20 bp, Artificial Sequence
  chemically synthesized
ggatggaagggatggaggag

SEQ ID NO: 9672 - DNA, 20 bp, Artificial Sequence
  chemically synthesized
tggaagggatggaggagaag

SEQ ID NO: 9673 - DNA, 20 bp, Artificial Sequence
  chemically synthesized
ggaagggatggaggagaaga

SEQ ID NO: 9674 - DNA, 20 bp, Artificial Sequence
  chemically synthesized
gaagaaggaaaaataaataa

SEQ ID NO: 9675 - DNA, 20 bp, Artificial Sequence
  chemically synthesized
agaaggaaaaataaataatg

SEQ ID NO: 9676 - DNA, 20 bp, Artificial Sequence
  chemically synthesized
aaggaaaaataaataatgga

SEQ ID NO: 9677 - DNA, 20 bp, Artificial Sequence
  chemically synthesized
aggaaaaataaataatggag

SEQ ID NO: 9678 - DNA, 20 bp, Artificial Sequence
  chemically synthesized
gaaaaataaataatggagag

SEQ ID NO: 9679 - DNA, 20 bp, Artificial Sequence
  chemically synthesized
aaaataaataatggagagga

SEQ ID NO: 9680 - DNA, 20 bp, Artificial Sequence
  chemically synthesized
aaataaataatggagaggag

SEQ ID NO: 9681 - DNA, 20 bp, Artificial Sequence
  chemically synthesized
ataaataatggagaggagag

SEQ ID NO: 9682 - DNA, 20 bp, Artificial Sequence
  chemically synthesized
atggagaggagaggagaaaa

SEQ ID NO: 9683 - DNA, 20 bp, Artificial Sequence
  chemically synthesized
tggagaggagaggagaaaaa

SEQ ID NO: 9684 - DNA, 20 bp, Artificial Sequence
  chemically synthesized
gagaggagaggagaaaaaag

SEQ ID NO: 9685 - DNA, 20 bp, Artificial Sequence
  chemically synthesized
agaggagaggagaaaaaagg

SEQ ID NO: 9686 - DNA, 20 bp, Artificial Sequence
  chemically synthesized
gaggagaggagaaaaaagga

SEQ ID NO: 9687 - DNA, 20 bp, Artificial Sequence
  chemically synthesized
aggagaggagaaaaaaggag

SEQ ID NO: 9688 - DNA, 20 bp, Artificial Sequence
  chemically synthesized
gagaggagaaaaaaggaggg

SEQ ID NO: 9689 - DNA, 20 bp, Artificial Sequence
  chemically synthesized
gaggagaaaaaaggagggga

SEQ ID NO: 9690 - DNA, 20 bp, Artificial Sequence
  chemically synthesized
aggagaaaaaaggaggggag

SEQ ID NO: 9691 - DNA, 20 bp, Artificial Sequence
  chemically synthesized
gagaaaaaaggaggggagag

SEQ ID NO: 9692 - DNA, 20 bp, Artificial Sequence
  chemically synthesized
gaaaaaaggaggggagagga

SEQ ID NO: 9693 - DNA, 20 bp, Artificial Sequence
  chemically synthesized
aaaaaaggaggggagaggag

SEQ ID NO: 9694 - DNA, 20 bp, Artificial Sequence
  chemically synthesized
aaaaggaggggagaggagag

SEQ ID NO: 9695 - DNA, 20 bp, Artificial Sequence
  chemically synthesized
aggaggggagaggagaggag

SEQ ID NO: 9696 - DNA, 20 bp, Artificial Sequence
  chemically synthesized
ggaggggagaggagaggaga

SEQ ID NO: 9697 - DNA, 20 bp, Artificial Sequence
  chemically synthesized
gaggggagaggagaggagaa

SEQ ID NO: 9698 - DNA, 20 bp, Artificial Sequence
  chemically synthesized
ggagaggagaggagaaggga

SEQ ID NO: 9699 - DNA, 20 bp, Artificial Sequence
  chemically synthesized
gagaggagaggagaagggat

SEQ ID NO: 9700 - DNA, 20 bp, Artificial Sequence
  chemically synthesized
agaggagaggagaagggata

SEQ ID NO: 9701 - DNA, 20 bp, Artificial Sequence
  chemically synthesized
ggagaggagaagggataggg

SEQ ID NO: 9702 - DNA, 20 bp, Artificial Sequence
  chemically synthesized
agaggagaagggatagggaa

SEQ ID NO: 9703 - DNA, 20 bp, Artificial Sequence
  chemically synthesized
gagaagggatagggaagaga

SEQ ID NO: 9704 - DNA, 20 bp, Artificial Sequence
  chemically synthesized
gaagggatagggaagagaaa

SEQ ID NO: 9705 - DNA, 20 bp, Artificial Sequence
  chemically synthesized
ggatagggaagagaaagaga

SEQ ID NO: 9706 - DNA, 20 bp, Artificial Sequence
  chemically synthesized
gatagggaagagaaagagaa

SEQ ID NO: 9707 - DNA, 20 bp, Artificial Sequence
  chemically synthesized
atagggaagagaaagagaaa

SEQ ID NO: 9708 - DNA, 20 bp, Artificial Sequence
  chemically synthesized
gggaagagaaagagaaaggg

SEQ ID NO: 9709 - DNA, 20 bp, Artificial Sequence
  chemically synthesized
ggaagagaaagagaaaggga

SEQ ID NO: 9710 - DNA, 20 bp, Artificial Sequence
  chemically synthesized
gaagagaaagagaaagggaa

SEQ ID NO: 9711 - DNA, 20 bp, Artificial Sequence
  chemically synthesized
gagaaagagaaagggaaggg

SEQ ID NO: 9712 - DNA, 20 bp, Artificial Sequence
  chemically synthesized
gaaagagaaagggaagggaa

SEQ ID NO: 9713 - DNA, 20 bp, Artificial Sequence
  chemically synthesized
aagagaaagggaagggaaga

SEQ ID NO: 9714 - DNA, 20 bp, Artificial Sequence
  chemically synthesized
agagaaagggaagggaagag

SEQ ID NO: 9715 - DNA, 20 bp, Artificial Sequence
  chemically synthesized
aaagggaagggaagagagga

SEQ ID NO: 9716 - DNA, 20 bp, Artificial Sequence
  chemically synthesized
gggaagggaagagaggaaag

SEQ ID NO: 9717 - DNA, 20 bp, Artificial Sequence
  chemically synthesized
gaagggaagagaggaaagaa

SEQ ID NO: 9718 - DNA, 20 bp, Artificial Sequence
  chemically synthesized
gggaagagaggaaagaagag

SEQ ID NO: 9719 - DNA, 20 bp, Artificial Sequence
  chemically synthesized
gaagagaggaaagaagagaa

SEQ ID NO: 9720 - DNA, 20 bp, Artificial Sequence
  chemically synthesized
aagagaggaaagaagagaag

SEQ ID NO: 9721 - DNA, 20 bp, Artificial Sequence
  chemically synthesized
gagaggaaagaagagaagag

SEQ ID NO: 9722 - DNA, 20 bp, Artificial Sequence
  chemically synthesized
gaggaaagaagagaagagga

SEQ ID NO: 9723 - DNA, 20 bp, Artificial Sequence
  chemically synthesized
aagaagagaagaggagagaa

SEQ ID NO: 9724 - DNA, 20 bp, Artificial Sequence
  chemically synthesized
aagaggagagaaaagaaacg

SEQ ID NO: 9725 - DNA, 20 bp, Artificial Sequence
  chemically synthesized
gaggagagaaaagaaacgaa

SEQ ID NO: 9726 - DNA, 20 bp, Artificial Sequence
  chemically synthesized
ggagagaaaagaaacgaaga

SEQ ID NO: 9727 - DNA, 20 bp, Artificial Sequence
  chemically synthesized
gagagaaaagaaacgaagag

SEQ ID NO: 9728 - DNA, 20 bp, Artificial Sequence
  chemically synthesized
agagaaaagaaacgaagaga

SEQ ID NO: 9729 - DNA, 20 bp, Artificial Sequence
  chemically synthesized
gagaaaagaaacgaagagag

SEQ ID NO: 9730 - DNA, 20 bp, Artificial Sequence
  chemically synthesized
aaaagaaacgaagagagggg

SEQ ID NO: 9731 - DNA, 20 bp, Artificial Sequence
  chemically synthesized
aaagaaacgaagagagggga

SEQ ID NO: 9732 - DNA, 20 bp, Artificial Sequence
  chemically synthesized
aagaaacgaagagaggggaa

SEQ ID NO: 9733 - DNA, 20 bp, Artificial Sequence
  chemically synthesized
aaacgaagagaggggaaggg

SEQ ID NO: 9734 - DNA, 20 bp, Artificial Sequence
  chemically synthesized
aacgaagagaggggaaggga

SEQ ID NO: 9735 - DNA, 20 bp, Artificial Sequence
  chemically synthesized
aggggaagggaaggaaaaaa

SEQ ID NO: 9736 - DNA, 20 bp, Artificial Sequence
  chemically synthesized
gggaagggaaggaaaaaaaa

SEQ ID NO: 9737 - DNA, 20 bp, Artificial Sequence
  chemically synthesized
ggaagggaaggaaaaaaaag

SEQ ID NO: 9738 - DNA, 20 bp, Artificial Sequence
  chemically synthesized
aaggaaaaaaaagaggaaaa

SEQ ID NO: 9739 - DNA, 20 bp, Artificial Sequence
  chemically synthesized
ggaaaaaaaagaggaaaaaa

SEQ ID NO: 9740 - DNA, 20 bp, Artificial Sequence
  chemically synthesized
aaaaagaggaaaaaagagac

SEQ ID NO: 9741 - DNA, 20 bp, Artificial Sequence
  chemically synthesized
aaagaggaaaaaagagacaa

SEQ ID NO: 9742 - DNA, 20 bp, Artificial Sequence
  chemically synthesized
gaggaaaaaagagacaagag

SEQ ID NO: 9743 - DNA, 20 bp, Artificial Sequence
  chemically synthesized
ggaaaaaagagacaagagaa

SEQ ID NO: 9744 - DNA, 20 bp, Artificial Sequence
  chemically synthesized
aaagagacaagagaagagat

SEQ ID NO: 9745 - DNA, 20 bp, Artificial Sequence
  chemically synthesized
aagagaagagataagactga

SEQ ID NO: 9746 - DNA, 20 bp, Artificial Sequence
  chemically synthesized
aagactgacagttcaaattt

SEQ ID NO: 9747 - DNA, 20 bp, Artificial Sequence
  chemically synthesized
actgacagttcaaattttgg

SEQ ID NO: 9748 - DNA, 20 bp, Artificial Sequence
  chemically synthesized
ttcaaattttggtggtgata

SEQ ID NO: 9749 - DNA, 20 bp, Artificial Sequence
  chemically synthesized
ttggtggtgatatggatcaa

SEQ ID NO: 9750 - DNA, 20 bp, Artificial Sequence
  chemically synthesized
aatagaaactcaaactctgt

SEQ ID NO: 9751 - DNA, 20 bp, Artificial Sequence
  chemically synthesized
ctgttggtgacactgtacaa

SEQ ID NO: 9752 - DNA, 20 bp, Artificial Sequence
  chemically synthesized
gtacaatagtataacccctt

SEQ ID NO: 9753 - DNA, 20 bp, Artificial Sequence
  chemically synthesized
cccctttggaaaacctttaa

SEQ ID NO: 9754 - DNA, 20 bp, Artificial Sequence
  chemically synthesized
ttaatagtatccacaaatgc

SEQ ID NO: 9755 - DNA, 20 bp, Artificial Sequence
  chemically synthesized
acaaatgctggatgcttgat

SEQ ID NO: 9756 - DNA, 20 bp, Artificial Sequence
  chemically synthesized
tgcttgataagtctattacc

SEQ ID NO: 9757 - DNA, 20 bp, Artificial Sequence
  chemically synthesized
ttacctagcaattacatttt

SEQ ID NO: 9758 - DNA, 20 bp, Artificial Sequence
  chemically synthesized
caattacatttttagatatt

SEQ ID NO: 9759 - DNA, 20 bp, Artificial Sequence
  chemically synthesized
cacatgcatgtgtgtatcca

SEQ ID NO: 9760 - DNA, 20 bp, Artificial Sequence
  chemically synthesized
tgtgtatccaaagacatgta

SEQ ID NO: 9761 - DNA, 20 bp, Artificial Sequence
  chemically synthesized
atgtatagaaatgcttatga

SEQ ID NO: 9762 - DNA, 20 bp, Artificial Sequence
  chemically synthesized
taatcataaaaacctcaaac

SEQ ID NO: 9763 - DNA, 20 bp, Artificial Sequence
  chemically synthesized
tcataaaaacctcaaaccgg

SEQ ID NO: 9764 - DNA, 20 bp, Artificial Sequence
  chemically synthesized
gccacttaaatgcttaccaa

SEQ ID NO: 9765 - DNA, 20 bp, Artificial Sequence
  chemically synthesized
acttaaatgcttaccaacag

SEQ ID NO: 9766 - DNA, 20 bp, Artificial Sequence
  chemically synthesized
acagtagaattgataaatta

SEQ ID NO: 9767 - DNA, 20 bp, Artificial Sequence
  chemically synthesized
agaattgataaattacggta

SEQ ID NO: 9768 - DNA, 20 bp, Artificial Sequence
  chemically synthesized
gataaattacggtatagtca

SEQ ID NO: 9769 - DNA, 20 bp, Artificial Sequence
  chemically synthesized
attacggtatagtcaaagaa

SEQ ID NO: 9770 - DNA, 20 bp, Artificial Sequence
  chemically synthesized
tcaaagaatagaatattaca

SEQ ID NO: 9771 - DNA, 20 bp, Artificial Sequence
  chemically synthesized
gaatattacacagaaatgaa

SEQ ID NO: 9772 - DNA, 20 bp, Artificial Sequence
  chemically synthesized
atcaactactgcttaacacg

SEQ ID NO: 9773 - DNA, 20 bp, Artificial Sequence
  chemically synthesized
agcgatacaaatgcatttta

SEQ ID NO: 9774 - DNA, 20 bp, Artificial Sequence
  chemically synthesized
caaatgcattttacagcatt

SEQ ID NO: 9775 - DNA, 20 bp, Artificial Sequence
  chemically synthesized
tacagcatttggttgattaa

SEQ ID NO: 9776 - DNA, 20 bp, Artificial Sequence
  chemically synthesized
tttggttgattaaaagtaac

SEQ ID NO: 9777 - DNA, 20 bp, Artificial Sequence
  chemically synthesized
tggttgattaaaagtaacca

SEQ ID NO: 9778 - DNA, 20 bp, Artificial Sequence
  chemically synthesized
ggttgattaaaagtaaccag

SEQ ID NO: 9779 - DNA, 20 bp, Artificial Sequence
  chemically synthesized
gattaaaagtaaccagaggt

SEQ ID NO: 9780 - DNA, 20 bp, Artificial Sequence
  chemically synthesized
tatatgactttatttgtata

SEQ ID NO: 9781 - DNA, 20 bp, Artificial Sequence
  chemically synthesized
tgactttatttgtatataga

SEQ ID NO: 9782 - DNA, 20 bp, Artificial Sequence
  chemically synthesized
tttatttgtatatagaaaga

SEQ ID NO: 9783 - DNA, 20 bp, Artificial Sequence
  chemically synthesized
gaaagatggatgatgtgcct

SEQ ID NO: 9784 - DNA, 20 bp, Artificial Sequence
  chemically synthesized
gtgcctgagattctgatcac

SEQ ID NO: 9785 - DNA, 20 bp, Artificial Sequence
  chemically synthesized
tgcctgagattctgatcaca

SEQ ID NO: 9786 - DNA, 20 bp, Artificial Sequence
  chemically synthesized
gcctgagattctgatcacaa

SEQ ID NO: 9787 - DNA, 20 bp, Artificial Sequence
  chemically synthesized
cctgagattctgatcacaag

SEQ ID NO: 9788 - DNA, 20 bp, Artificial Sequence
  chemically synthesized
caaggggaaatgttataaaa

SEQ ID NO: 9789 - DNA, 20 bp, Artificial Sequence
  chemically synthesized
aaggggaaatgttataaaat

SEQ ID NO: 9790 - DNA, 20 bp, Artificial Sequence
  chemically synthesized
aggggaaatgttataaaata

SEQ ID NO: 9791 - DNA, 20 bp, Artificial Sequence
  chemically synthesized
ggaaatgttataaaataggg

SEQ ID NO: 9792 - DNA, 20 bp, Artificial Sequence
  chemically synthesized
aaatgttataaaatagggta

SEQ ID NO: 9793 - DNA, 20 bp, Artificial Sequence
  chemically synthesized
atgttataaaatagggtaga

SEQ ID NO: 9794 - DNA, 20 bp, Artificial Sequence
  chemically synthesized
tgttataaaatagggtagag

SEQ ID NO: 9795 - DNA, 20 bp, Artificial Sequence
  chemically synthesized
ttataaaatagggtagagag

SEQ ID NO: 9796 - DNA, 20 bp, Artificial Sequence
  chemically synthesized
tgacctttaaactttgttac

SEQ ID NO: 9797 - DNA, 20 bp, Artificial Sequence
  chemically synthesized
caagttatttttctgtaacc

SEQ ID NO: 9798 - DNA, 20 bp, Artificial Sequence
  chemically synthesized
gttatttttctgtaacctgg

SEQ ID NO: 9799 - DNA, 20 bp, Artificial Sequence
  chemically synthesized
tgtaacctggaagccaacga

SEQ ID NO: 9800 - DNA, 20 bp, Artificial Sequence
  chemically synthesized
cgaaagatattgaataattc

SEQ ID NO: 9801 - DNA, 20 bp, Artificial Sequence
  chemically synthesized
agatattgaataattcaaga

SEQ ID NO: 9802 - DNA, 20 bp, Artificial Sequence
  chemically synthesized
gatattgaataattcaagaa

SEQ ID NO: 9803 - DNA, 20 bp, Artificial Sequence
  chemically synthesized
attgaataattcaagaaagg

SEQ ID NO: 9804 - DNA, 20 bp, Artificial Sequence
  chemically synthesized
gaataattcaagaaaggtgg

SEQ ID NO: 9805 - DNA, 20 bp, Artificial Sequence
  chemically synthesized
attcaagaaaggtggtggca

SEQ ID NO: 9806 - DNA, 20 bp, Artificial Sequence
  chemically synthesized
ggtttgatttgtgtctttaa

SEQ ID NO: 9807 - DNA, 20 bp, Artificial Sequence
  chemically synthesized
tttaaaagattattctcact

SEQ ID NO: 9808 - DNA, 20 bp, Artificial Sequence
  chemically synthesized
aagattattctcacttagtg

SEQ ID NO: 9809 - DNA, 20 bp, Artificial Sequence
  chemically synthesized
cttagtgaagaaatgtattt

SEQ ID NO: 9810 - DNA, 20 bp, Artificial Sequence
  chemically synthesized
agtgaagaaatgtattttag

SEQ ID NO: 9811 - DNA, 20 bp, Artificial Sequence
  chemically synthesized
gaagaaatgtattttagaag

SEQ ID NO: 9812 - DNA, 20 bp, Artificial Sequence
  chemically synthesized
agaaatgtattttagaagta

SEQ ID NO: 9813 - DNA, 20 bp, Artificial Sequence
  chemically synthesized
tattttagaagtagagaaaa

SEQ ID NO: 9814 - DNA, 20 bp, Artificial Sequence
  chemically synthesized
attttagaagtagagaaaat

SEQ ID NO: 9815 - DNA, 20 bp, Artificial Sequence
  chemically synthesized
tttagaagtagagaaaatgg

SEQ ID NO: 9816 - DNA, 20 bp, Artificial Sequence
  chemically synthesized
tagagaaaatgggagacaaa

SEQ ID NO: 9817 - DNA, 20 bp, Artificial Sequence
  chemically synthesized
gaaaatgggagacaaatagc

SEQ ID NO: 9818 - DNA, 20 bp, Artificial Sequence
  chemically synthesized
aaaatgggagacaaatagct

SEQ ID NO: 9819 - DNA, 20 bp, Artificial Sequence
  chemically synthesized
aaatagctgggcttctgttg

SEQ ID NO: 9820 - DNA, 20 bp, Artificial Sequence
  chemically synthesized
tagctgggcttctgttgcag

SEQ ID NO: 9821 - DNA, 20 bp, Artificial Sequence
  chemically synthesized
agctgggcttctgttgcagt

SEQ ID NO: 9822 - DNA, 20 bp, Artificial Sequence
  chemically synthesized
gctgggcttctgttgcagta

SEQ ID NO: 9823 - DNA, 20 bp, Artificial Sequence
  chemically synthesized
gggcttctgttgcagtaggg

SEQ ID NO: 9824 - DNA, 20 bp, Artificial Sequence
  chemically synthesized
ttctgttgcagtagggaaga

SEQ ID NO: 9825 - DNA, 20 bp, Artificial Sequence
  chemically synthesized
gacaatgccatttctattat

SEQ ID NO: 9826 - DNA, 20 bp, Artificial Sequence
  chemically synthesized
gccatttctattatcagact

SEQ ID NO: 9827 - DNA, 20 bp, Artificial Sequence
  chemically synthesized
ttatcagacttggaccatga

SEQ ID NO: 9828 - DNA, 20 bp, Artificial Sequence
  chemically synthesized
ttggaccatgacggtgatgt

SEQ ID NO: 9829 - DNA, 20 bp, Artificial Sequence
  chemically synthesized
gtgatgtcagtcgtgaacac

SEQ ID NO: 9830 - DNA, 20 bp, Artificial Sequence
  chemically synthesized
gtcagtcgtgaacacaagaa

SEQ ID NO: 9831 - DNA, 20 bp, Artificial Sequence
  chemically synthesized
tcagtcgtgaacacaagaat

SEQ ID NO: 9832 - DNA, 20 bp, Artificial Sequence
  chemically synthesized
cagtcgtgaacacaagaata

SEQ ID NO: 9833 - DNA, 20 bp, Artificial Sequence
  chemically synthesized
aagaatagggccacatttgt

SEQ ID NO: 9834 - DNA, 20 bp, Artificial Sequence
  chemically synthesized
tagggccacatttgtgagtt

SEQ ID NO: 9835 - DNA, 20 bp, Artificial Sequence
  chemically synthesized
ggccacatttgtgagtttag

SEQ ID NO: 9836 - DNA, 20 bp, Artificial Sequence
  chemically synthesized
gtttagtggtacgataaaat

SEQ ID NO: 9837 - DNA, 20 bp, Artificial Sequence
  chemically synthesized
gtacgataaaatcagaaata

SEQ ID NO: 9838 - DNA, 20 bp, Artificial Sequence
  chemically synthesized
taaaatcagaaatacagtct

SEQ ID NO: 9839 - DNA, 20 bp, Artificial Sequence
  chemically synthesized
gcactcttgtaaaatgcaaa

SEQ ID NO: 9840 - DNA, 20 bp, Artificial Sequence
  chemically synthesized
aaaatgcaaaaagatgtact

SEQ ID NO: 9841 - DNA, 20 bp, Artificial Sequence
  chemically synthesized
aaaagatgtacttagatatg

SEQ ID NO: 9842 - DNA, 20 bp, Artificial Sequence
  chemically synthesized
tgtacttagatatgtggatc

SEQ ID NO: 9843 - DNA, 20 bp, Artificial Sequence
  chemically synthesized
tacttagatatgtggatctg

SEQ ID NO: 9844 - DNA, 20 bp, Artificial Sequence
  chemically synthesized
agatatgtggatctggagct

SEQ ID NO: 9845 - DNA, 20 bp, Artificial Sequence
  chemically synthesized
atgtggatctggagctcaga

SEQ ID NO: 9846 - DNA, 20 bp, Artificial Sequence
  chemically synthesized
gagctcagaaagaatacaac

SEQ ID NO: 9847 - DNA, 20 bp, Artificial Sequence
  chemically synthesized
agctcagaaagaatacaacc

SEQ ID NO: 9848 - DNA, 20 bp, Artificial Sequence
  chemically synthesized
agaaagaatacaaccaggtc

SEQ ID NO: 9849 - DNA, 20 bp, Artificial Sequence
  chemically synthesized
atacaaccaggtcaagaata

SEQ ID NO: 9850 - DNA, 20 bp, Artificial Sequence
  chemically synthesized
accaggtcaagaatacagaa

SEQ ID NO: 9851 - DNA, 20 bp, Artificial Sequence
  chemically synthesized
gtcaagaatacagaatggaa

SEQ ID NO: 9852 - DNA, 20 bp, Artificial Sequence
  chemically synthesized
cagaatggaacagaacatac

SEQ ID NO: 9853 - DNA, 20 bp, Artificial Sequence
  chemically synthesized
tggaacagaacatacaagaa

SEQ ID NO: 9854 - DNA, 20 bp, Artificial Sequence
  chemically synthesized
ccactacctgttaaaaatga

SEQ ID NO: 9855 - DNA, 20 bp, Artificial Sequence
  chemically synthesized
tcaatatctccttaaaatct

SEQ ID NO: 9856 - DNA, 20 bp, Artificial Sequence
  chemically synthesized
aaatcttagaatgtgtttgt

SEQ ID NO: 9857 - DNA, 20 bp, Artificial Sequence
  chemically synthesized
aatcttagaatgtgtttgtg

SEQ ID NO: 9858 - DNA, 20 bp, Artificial Sequence
  chemically synthesized
atcttagaatgtgtttgtga

SEQ ID NO: 9859 - DNA, 20 bp, Artificial Sequence
  chemically synthesized
cttagaatgtgtttgtgagg

SEQ ID NO: 9860 - DNA, 20 bp, Artificial Sequence
  chemically synthesized
ttagaatgtgtttgtgaggg

SEQ ID NO: 9861 - DNA, 20 bp, Artificial Sequence
  chemically synthesized
tatgtttccaattcatatat

SEQ ID NO: 9862 - DNA, 20 bp, Artificial Sequence
  chemically synthesized
attgattctaaaaaaaatgt

SEQ ID NO: 9863 - DNA, 20 bp, Artificial Sequence
  chemically synthesized
ttgattctaaaaaaaatgtt

SEQ ID NO: 9864 - DNA, 20 bp, Artificial Sequence
  chemically synthesized
aaaatgttaggtaaattctt

SEQ ID NO: 9865 - DNA, 20 bp, Artificial Sequence
  chemically synthesized
aaatgttaggtaaattctta

SEQ ID NO: 9866 - DNA, 20 bp, Artificial Sequence
  chemically synthesized
aggtaaattcttaaggccat

SEQ ID NO: 9867 - DNA, 20 bp, Artificial Sequence
  chemically synthesized
ggtaaattcttaaggccatg

SEQ ID NO: 9868 - DNA, 20 bp, Artificial Sequence
  chemically synthesized
atctttgtctgttaattcca

SEQ ID NO: 9869 - DNA, 20 bp, Artificial Sequence
  chemically synthesized
gtctgttaattccaaagact

SEQ ID NO: 9870 - DNA, 20 bp, Artificial Sequence
  chemically synthesized
cctgaaatgattttacacat

SEQ ID NO: 9871 - DNA, 20 bp, Artificial Sequence
  chemically synthesized
ctgaaatgattttacacatt

SEQ ID NO: 9872 - DNA, 20 bp, Artificial Sequence
  chemically synthesized
gaaatgattttacacattgg

SEQ ID NO: 9873 - DNA, 20 bp, Artificial Sequence
  chemically synthesized
attttacacattgggagatc

SEQ ID NO: 9874 - DNA, 20 bp, Artificial Sequence
  chemically synthesized
ggttacatgtttattctata

SEQ ID NO: 9875 - DNA, 20 bp, Artificial Sequence
  chemically synthesized
tattctatatggattgcatt

SEQ ID NO: 9876 - DNA, 20 bp, Artificial Sequence
  chemically synthesized
ttctatatggattgcattga

SEQ ID NO: 9877 - DNA, 20 bp, Artificial Sequence
  chemically synthesized
tctatatggattgcattgag

SEQ ID NO: 9878 - DNA, 20 bp, Artificial Sequence
  chemically synthesized
cattgagaggatttgtataa

SEQ ID NO: 9879 - DNA, 20 bp, Artificial Sequence
  chemically synthesized
gaggatttgtataacagaat

SEQ ID NO: 9880 - DNA, 20 bp, Artificial Sequence
  chemically synthesized
aggatttgtataacagaata

SEQ ID NO: 9881 - DNA, 20 bp, Artificial Sequence
  chemically synthesized
ctttttttcttttctcttct

SEQ ID NO: 9882 - DNA, 20 bp, Artificial Sequence
  chemically synthesized
ttttcttttctcttctgaga

SEQ ID NO: 9883 - DNA, 20 bp, Artificial Sequence
  chemically synthesized
ttcttttctcttctgagatg

SEQ ID NO: 9884 - DNA, 20 bp, Artificial Sequence
  chemically synthesized
gagtttcatccctattgccc

SEQ ID NO: 9885 - DNA, 20 bp, Artificial Sequence
  chemically synthesized
ttcatccctattgcccaagc

SEQ ID NO: 9886 - DNA, 20 bp, Artificial Sequence
  chemically synthesized
catccctattgcccaagcta

SEQ ID NO: 9887 - DNA, 20 bp, Artificial Sequence
  chemically synthesized
ttgcccaagctagagtgcaa

SEQ ID NO: 9888 - DNA, 20 bp, Artificial Sequence
  chemically synthesized
tagagtgcaatggtgcaatc

SEQ ID NO: 9889 - DNA, 20 bp, Artificial Sequence
  chemically synthesized
agagtgcaatggtgcaatct

SEQ ID NO: 9890 - DNA, 20 bp, Artificial Sequence
  chemically synthesized
tcaccgcaacctctgcctcc

SEQ ID NO: 9891 - DNA, 20 bp, Artificial Sequence
  chemically synthesized
caccgcaacctctgcctcct

SEQ ID NO: 9892 - DNA, 20 bp, Artificial Sequence
  chemically synthesized
aacctctgcctcctgggttc

SEQ ID NO: 9893 - DNA, 20 bp, Artificial Sequence
  chemically synthesized
ttcaagcaattctcctgcct

SEQ ID NO: 9894 - DNA, 20 bp, Artificial Sequence
  chemically synthesized
tcctgcctcagccacctgaa

SEQ ID NO: 9895 - DNA, 20 bp, Artificial Sequence
  chemically synthesized
gcctcagccacctgaatagc

SEQ ID NO: 9896 - DNA, 20 bp, Artificial Sequence
  chemically synthesized
cctcagccacctgaatagct

SEQ ID NO: 9897 - DNA, 20 bp, Artificial Sequence
  chemically synthesized
cacctgaatagctgggactg

SEQ ID NO: 9898 - DNA, 20 bp, Artificial Sequence
  chemically synthesized
acctgaatagctgggactgc

SEQ ID NO: 9899 - DNA, 20 bp, Artificial Sequence
  chemically synthesized
gcaggcatgcaccacacgcc

SEQ ID NO: 9900 - DNA, 20 bp, Artificial Sequence
  chemically synthesized
cccggctgattttgtatttt

SEQ ID NO: 9901 - DNA, 20 bp, Artificial Sequence
  chemically synthesized
ggctgattttgtatttttag

SEQ ID NO: 9902 - DNA, 20 bp, Artificial Sequence
  chemically synthesized
ctgattttgtatttttagta

SEQ ID NO: 9903 - DNA, 20 bp, Artificial Sequence
  chemically synthesized
ttttgtatttttagtagaga

SEQ ID NO: 9904 - DNA, 20 bp, Artificial Sequence
  chemically synthesized
tttgtatttttagtagagat

SEQ ID NO: 9905 - DNA, 20 bp, Artificial Sequence
  chemically synthesized
ttgtatttttagtagagatg

SEQ ID NO: 9906 - DNA, 20 bp, Artificial Sequence
  chemically synthesized
gagatggggtttcaccatgt

SEQ ID NO: 9907 - DNA, 20 bp, Artificial Sequence
  chemically synthesized
tggggtttcaccatgttggt

SEQ ID NO: 9908 - DNA, 20 bp, Artificial Sequence
  chemically synthesized
ggggtttcaccatgttggtc

SEQ ID NO: 9909 - DNA, 20 bp, Artificial Sequence
  chemically synthesized
tttcaccatgttggtcaggc

SEQ ID NO: 9910 - DNA, 20 bp, Artificial Sequence
  chemically synthesized
ggtcttgaactcctgacctc

SEQ ID NO: 9911 - DNA, 20 bp, Artificial Sequence
  chemically synthesized
ctcaagtgatctgcctgcct

SEQ ID NO: 9912 - DNA, 20 bp, Artificial Sequence
  chemically synthesized
ctgcctgccttggcctccca

SEQ ID NO: 9913 - DNA, 20 bp, Artificial Sequence
  chemically synthesized
gccttggcctcccaaagtgc

SEQ ID NO: 9914 - DNA, 20 bp, Artificial Sequence
  chemically synthesized
ccttggcctcccaaagtgct

SEQ ID NO: 9915 - DNA, 20 bp, Artificial Sequence
  chemically synthesized
tcccaaagtgctgggtttac

SEQ ID NO: 9916 - DNA, 20 bp, Artificial Sequence
  chemically synthesized
agtgctgggtttacaagcct

SEQ ID NO: 9917 - DNA, 20 bp, Artificial Sequence
  chemically synthesized
caagcctgagccaccgcatc

SEQ ID NO: 9918 - DNA, 20 bp, Artificial Sequence
  chemically synthesized
cctgagccaccgcatccagc

SEQ ID NO: 9919 - DNA, 20 bp, Artificial Sequence
  chemically synthesized
ctgagccaccgcatccagcc

SEQ ID NO: 9920 - DNA, 20 bp, Artificial Sequence
  chemically synthesized
ccaccgcatccagccaggat

SEQ ID NO: 9921 - DNA, 20 bp, Artificial Sequence
  chemically synthesized
caccgcatccagccaggata

SEQ ID NO: 9922 - DNA, 20 bp, Artificial Sequence
  chemically synthesized
ccagccaggataaggtctaa

SEQ ID NO: 9923 - DNA, 20 bp, Artificial Sequence
  chemically synthesized
gccaggataaggtctaaaag

SEQ ID NO: 9924 - DNA, 20 bp, Artificial Sequence
  chemically synthesized
ggataaggtctaaaagtgga

SEQ ID NO: 9925 - DNA, 20 bp, Artificial Sequence
  chemically synthesized
aggtctaaaagtggaaagaa

SEQ ID NO: 9926 - DNA, 20 bp, Artificial Sequence
  chemically synthesized
gaatagcatctactcttgtt

SEQ ID NO: 9927 - DNA, 20 bp, Artificial Sequence
  chemically synthesized
aatagcatctactcttgttc

SEQ ID NO: 9928 - DNA, 20 bp, Artificial Sequence
  chemically synthesized
actcttgttcaggaaacaat

SEQ ID NO: 9929 - DNA, 20 bp, Artificial Sequence
  chemically synthesized
ctcttgttcaggaaacaatg

SEQ ID NO: 9930 - DNA, 20 bp, Artificial Sequence
  chemically synthesized
ggaaacaatgaggacctgac

SEQ ID NO: 9931 - DNA, 20 bp, Artificial Sequence
  chemically synthesized
gaaacaatgaggacctgact

SEQ ID NO: 9932 - DNA, 20 bp, Artificial Sequence
  chemically synthesized
acaatgaggacctgactggg

SEQ ID NO: 9933 - DNA, 20 bp, Artificial Sequence
  chemically synthesized
tgaggacctgactgggcagt

SEQ ID NO: 9934 - DNA, 20 bp, Artificial Sequence
  chemically synthesized
aggacctgactgggcagtaa

SEQ ID NO: 9935 - DNA, 20 bp, Artificial Sequence
  chemically synthesized
acctgactgggcagtaagag

SEQ ID NO: 9936 - DNA, 20 bp, Artificial Sequence
  chemically synthesized
gcagtaagagtggtgattaa

SEQ ID NO: 9937 - DNA, 20 bp, Artificial Sequence
  chemically synthesized
taagagtggtgattaataga

SEQ ID NO: 9938 - DNA, 20 bp, Artificial Sequence
  chemically synthesized
aagagtggtgattaatagat

SEQ ID NO: 9939 - DNA, 20 bp, Artificial Sequence
  chemically synthesized
agagtggtgattaatagata

SEQ ID NO: 9940 - DNA, 20 bp, Artificial Sequence
  chemically synthesized
taatagatagggacaaattg

SEQ ID NO: 9941 - DNA, 20 bp, Artificial Sequence
  chemically synthesized
tagatagggacaaattgaag

SEQ ID NO: 9942 - DNA, 20 bp, Artificial Sequence
  chemically synthesized
agcagaatcgaactgttgat

SEQ ID NO: 9943 - DNA, 20 bp, Artificial Sequence
  chemically synthesized
cagaatcgaactgttgatta

SEQ ID NO: 9944 - DNA, 20 bp, Artificial Sequence
  chemically synthesized
agaatcgaactgttgattag

SEQ ID NO: 9945 - DNA, 20 bp, Artificial Sequence
  chemically synthesized
atcgaactgttgattagagg

SEQ ID NO: 9946 - DNA, 20 bp, Artificial Sequence
  chemically synthesized
tcgaactgttgattagaggt

SEQ ID NO: 9947 - DNA, 20 bp, Artificial Sequence
  chemically synthesized
cgaactgttgattagaggta

SEQ ID NO: 9948 - DNA, 20 bp, Artificial Sequence
  chemically synthesized
atgattttaatctgtgacct

SEQ ID NO: 9949 - DNA, 20 bp, Artificial Sequence
  chemically synthesized
taatctgtgaccttggtgaa

SEQ ID NO: 9950 - DNA, 20 bp, Artificial Sequence
  chemically synthesized
aatctgtgaccttggtgaat

SEQ ID NO: 9951 - DNA, 20 bp, Artificial Sequence
  chemically synthesized
tgtgaccttggtgaatgggc

SEQ ID NO: 9952 - DNA, 20 bp, Artificial Sequence
  chemically synthesized
gaccttggtgaatgggcaag

SEQ ID NO: 9953 - DNA, 20 bp, Artificial Sequence
  chemically synthesized
tagctatctaatgactaaaa

SEQ ID NO: 9954 - DNA, 20 bp, Artificial Sequence
  chemically synthesized
atgactaaaatggaaaacac

SEQ ID NO: 9955 - DNA, 20 bp, Artificial Sequence
  chemically synthesized
actaaaatggaaaacactgg

SEQ ID NO: 9956 - DNA, 20 bp, Artificial Sequence
  chemically synthesized
taaaatggaaaacactggaa

SEQ ID NO: 9957 - DNA, 20 bp, Artificial Sequence
  chemically synthesized
ggaaaacactggaagagaaa

SEQ ID NO: 9958 - DNA, 20 bp, Artificial Sequence
  chemically synthesized
cactggaagagaaacagttt

SEQ ID NO: 9959 - DNA, 20 bp, Artificial Sequence
  chemically synthesized
agaaacagttttagtataac

SEQ ID NO: 9960 - DNA, 20 bp, Artificial Sequence
  chemically synthesized
acaagtgaaatacccatgct

SEQ ID NO: 9961 - DNA, 20 bp, Artificial Sequence
  chemically synthesized
gaaatacccatgctgagtct

SEQ ID NO: 9962 - DNA, 20 bp, Artificial Sequence
  chemically synthesized
aaatacccatgctgagtctg

SEQ ID NO: 9963 - DNA, 20 bp, Artificial Sequence
  chemically synthesized
tgctgagtctgaggtgccta

SEQ ID NO: 9964 - DNA, 20 bp, Artificial Sequence
  chemically synthesized
gctgagtctgaggtgcctat

SEQ ID NO: 9965 - DNA, 20 bp, Artificial Sequence
  chemically synthesized
tataggacatctatataaat

SEQ ID NO: 9966 - DNA, 20 bp, Artificial Sequence
  chemically synthesized
gacatctatataaataagcc

SEQ ID NO: 9967 - DNA, 20 bp, Artificial Sequence
  chemically synthesized
ccagtacattgtttgatata

SEQ ID NO: 9968 - DNA, 20 bp, Artificial Sequence
  chemically synthesized
cagtacattgtttgatatat

SEQ ID NO: 9969 - DNA, 20 bp, Artificial Sequence
  chemically synthesized
cattgtttgatatatgggtt

SEQ ID NO: 9970 - DNA, 20 bp, Artificial Sequence
  chemically synthesized
tgatatatgggtttggcact

SEQ ID NO: 9971 - DNA, 20 bp, Artificial Sequence
  chemically synthesized
gatatatgggtttggcactg

SEQ ID NO: 9972 - DNA, 20 bp, Artificial Sequence
  chemically synthesized
tatgggtttggcactgaggt

SEQ ID NO: 9973 - DNA, 20 bp, Artificial Sequence
  chemically synthesized
tgggtttggcactgaggttg

SEQ ID NO: 9974 - DNA, 20 bp, Artificial Sequence
  chemically synthesized
gggtttggcactgaggttgg

SEQ ID NO: 9975 - DNA, 20 bp, Artificial Sequence
  chemically synthesized
ttggcactgaggttggaggt

SEQ ID NO: 9976 - DNA, 20 bp, Artificial Sequence
  chemically synthesized
ggcactgaggttggaggtca

SEQ ID NO: 9977 - DNA, 20 bp, Artificial Sequence
  chemically synthesized
gcactgaggttggaggtcag

SEQ ID NO: 9978 - DNA, 20 bp, Artificial Sequence
  chemically synthesized
tgaggttggaggtcagaggt

SEQ ID NO: 9979 - DNA, 20 bp, Artificial Sequence
  chemically synthesized
ggaggtcagaggttagaaat

SEQ ID NO: 9980 - DNA, 20 bp, Artificial Sequence
  chemically synthesized
aggtcagaggttagaaatca

SEQ ID NO: 9981 - DNA, 20 bp, Artificial Sequence
  chemically synthesized
cagaggttagaaatcagagt

SEQ ID NO: 9982 - DNA, 20 bp, Artificial Sequence
  chemically synthesized
agaggttagaaatcagagtt

SEQ ID NO: 9983 - DNA, 20 bp, Artificial Sequence
  chemically synthesized
tagaaatcagagttgggaat

SEQ ID NO: 9984 - DNA, 20 bp, Artificial Sequence
  chemically synthesized
agaaatcagagttgggaatt

SEQ ID NO: 9985 - DNA, 20 bp, Artificial Sequence
  chemically synthesized
agttgggaattgggattata

SEQ ID NO: 9986 - DNA, 20 bp, Artificial Sequence
  chemically synthesized
gttgggaattgggattatac

SEQ ID NO: 9987 - DNA, 20 bp, Artificial Sequence
  chemically synthesized
ggattatacaggctgtattt

SEQ ID NO: 9988 - DNA, 20 bp, Artificial Sequence
  chemically synthesized
attatacaggctgtatttaa

SEQ ID NO: 9989 - DNA, 20 bp, Artificial Sequence
  chemically synthesized
acaggctgtatttaagagtt

SEQ ID NO: 9990 - DNA, 20 bp, Artificial Sequence
  chemically synthesized
ttagatataactgtgaatcc

SEQ ID NO: 9991 - DNA, 20 bp, Artificial Sequence
  chemically synthesized
agatataactgtgaatccaa

SEQ ID NO: 9992 - DNA, 20 bp, Artificial Sequence
  chemically synthesized
ccaagagtgtgatgaataca

SEQ ID NO: 9993 - DNA, 20 bp, Artificial Sequence
  chemically synthesized
gatgaatacaaagttaaatg

SEQ ID NO: 9994 - DNA, 20 bp, Artificial Sequence
  chemically synthesized
atgaatacaaagttaaatga

SEQ ID NO: 9995 - DNA, 20 bp, Artificial Sequence
  chemically synthesized
aacatttaatgtgaaatctc

SEQ ID NO: 9996 - DNA, 20 bp, Artificial Sequence
  chemically synthesized
acatttaatgtgaaatctca

SEQ ID NO: 9997 - DNA, 20 bp, Artificial Sequence
  chemically synthesized
tttaatgtgaaatctcaagg

SEQ ID NO: 9998 - DNA, 20 bp, Artificial Sequence
  chemically synthesized
tgaaatctcaaggaagtatg

SEQ ID NO: 9999 - DNA, 20 bp, Artificial Sequence
  chemically synthesized
atctcaaggaagtatgaagt

SEQ ID NO: 10000 - DNA, 20 bp, Artificial Sequence
  chemically synthesized
aggaagtatgaagtaagaca

SEQ ID NO: 10001 - DNA, 20 bp, Artificial Sequence
  chemically synthesized
cccaaaatccccgatgattt

SEQ ID NO: 10002 - DNA, 20 bp, Artificial Sequence
  chemically synthesized
tccccgatgattttagaact

SEQ ID NO: 10003 - DNA, 20 bp, Artificial Sequence
  chemically synthesized
aactcagtatcgattttaat

SEQ ID NO: 10004 - DNA, 20 bp, Artificial Sequence
  chemically synthesized
taattagtgtaatgccaatg

SEQ ID NO: 10005 - DNA, 20 bp, Artificial Sequence
  chemically synthesized
aattagtgtaatgccaatgt

SEQ ID NO: 10006 - DNA, 20 bp, Artificial Sequence
  chemically synthesized
agtgtaatgccaatgtgggt

SEQ ID NO: 10007 - DNA, 20 bp, Artificial Sequence
  chemically synthesized
aatgccaatgtgggttagaa

SEQ ID NO: 10008 - DNA, 20 bp, Artificial Sequence
  chemically synthesized
gccaatgtgggttagaatgg

SEQ ID NO: 10009 - DNA, 20 bp, Artificial Sequence
  chemically synthesized
aatggaagtcaacttgctgt

SEQ ID NO: 10010 - DNA, 20 bp, Artificial Sequence
  chemically synthesized
agtcaacttgctgttggttt

SEQ ID NO: 10011 - DNA, 20 bp, Artificial Sequence
  chemically synthesized
tcaacttgctgttggtttca

SEQ ID NO: 10012 - DNA, 20 bp, Artificial Sequence
  chemically synthesized
acttgctgttggtttcagag

SEQ ID NO: 10013 - DNA, 20 bp, Artificial Sequence
  chemically synthesized
cttgctgttggtttcagagc

SEQ ID NO: 10014 - DNA, 20 bp, Artificial Sequence
  chemically synthesized
gctgttggtttcagagcagg

SEQ ID NO: 10015 - DNA, 20 bp, Artificial Sequence
  chemically synthesized
ctgttggtttcagagcaggt

SEQ ID NO: 10016 - DNA, 20 bp, Artificial Sequence
  chemically synthesized
gttggtttcagagcaggtag

SEQ ID NO: 10017 - DNA, 20 bp, Artificial Sequence
  chemically synthesized
tttcagagcaggtaggagat

SEQ ID NO: 10018 - DNA, 20 bp, Artificial Sequence
  chemically synthesized
ttcagagcaggtaggagata

SEQ ID NO: 10019 - DNA, 20 bp, Artificial Sequence
  chemically synthesized
gcaggtaggagataaggttc

SEQ ID NO: 10020 - DNA, 20 bp, Artificial Sequence
  chemically synthesized
taaggttctagattttgaca

SEQ ID NO: 10021 - DNA, 20 bp, Artificial Sequence
  chemically synthesized
ctagattttgacacagtgaa

SEQ ID NO: 10022 - DNA, 20 bp, Artificial Sequence
  chemically synthesized
cagtgaaaagctgaaacaaa

SEQ ID NO: 10023 - DNA, 20 bp, Artificial Sequence
  chemically synthesized
agtgaaaagctgaaacaaaa

SEQ ID NO: 10024 - DNA, 20 bp, Artificial Sequence
  chemically synthesized
aaagctgaaacaaaaaggaa

SEQ ID NO: 10025 - DNA, 20 bp, Artificial Sequence
  chemically synthesized
aagctgaaacaaaaaggaaa

SEQ ID NO: 10026 - DNA, 20 bp, Artificial Sequence
  chemically synthesized
ctgaaacaaaaaggaaaagg

SEQ ID NO: 10027 - DNA, 20 bp, Artificial Sequence
  chemically synthesized
tgaaacaaaaaggaaaaggt

SEQ ID NO: 10028 - DNA, 20 bp, Artificial Sequence
  chemically synthesized
gaaacaaaaaggaaaaggta

SEQ ID NO: 10029 - DNA, 20 bp, Artificial Sequence
  chemically synthesized
aaaaggaaaaggtagggtga

SEQ ID NO: 10030 - DNA, 20 bp, Artificial Sequence
  chemically synthesized
ggaaaaggtagggtgaaaga

SEQ ID NO: 10031 - DNA, 20 bp, Artificial Sequence
  chemically synthesized
gaaaaggtagggtgaaagat

SEQ ID NO: 10032 - DNA, 20 bp, Artificial Sequence
  chemically synthesized
gaaagatgggaaatgtatgt

SEQ ID NO: 10033 - DNA, 20 bp, Artificial Sequence
  chemically synthesized
aaagatgggaaatgtatgta

SEQ ID NO: 10034 - DNA, 20 bp, Artificial Sequence
  chemically synthesized
agatgggaaatgtatgtaag

SEQ ID NO: 10035 - DNA, 20 bp, Artificial Sequence
  chemically synthesized
gatgggaaatgtatgtaagg

SEQ ID NO: 10036 - DNA, 20 bp, Artificial Sequence
  chemically synthesized
gaaatgtatgtaaggaggat

SEQ ID NO: 10037 - DNA, 20 bp, Artificial Sequence
  chemically synthesized
tgtaaggaggatgagccaca

SEQ ID NO: 10038 - DNA, 20 bp, Artificial Sequence
  chemically synthesized
ggaggatgagccacatggta

SEQ ID NO: 10039 - DNA, 20 bp, Artificial Sequence
  chemically synthesized
gaggatgagccacatggtat

SEQ ID NO: 10040 - DNA, 20 bp, Artificial Sequence
  chemically synthesized
ggatgagccacatggtatgg

SEQ ID NO: 10041 - DNA, 20 bp, Artificial Sequence
  chemically synthesized
gatgagccacatggtatggg

SEQ ID NO: 10042 - DNA, 20 bp, Artificial Sequence
  chemically synthesized
catggtatgggaggtatact

SEQ ID NO: 10043 - DNA, 20 bp, Artificial Sequence
  chemically synthesized
atggtatgggaggtatacta

SEQ ID NO: 10044 - DNA, 20 bp, Artificial Sequence
  chemically synthesized
gggaggtatactaaggactc

SEQ ID NO: 10045 - DNA, 20 bp, Artificial Sequence
  chemically synthesized
ggaggtatactaaggactct

SEQ ID NO: 10046 - DNA, 20 bp, Artificial Sequence
  chemically synthesized
gaggtatactaaggactcta

SEQ ID NO: 10047 - DNA, 20 bp, Artificial Sequence
  chemically synthesized
tatactaaggactctagggt

SEQ ID NO: 10048 - DNA, 20 bp, Artificial Sequence
  chemically synthesized
tactaaggactctagggtca

SEQ ID NO: 10049 - DNA, 20 bp, Artificial Sequence
  chemically synthesized
actctagggtcagagaaata

SEQ ID NO: 10050 - DNA, 20 bp, Artificial Sequence
  chemically synthesized
ctctagggtcagagaaatat

SEQ ID NO: 10051 - DNA, 20 bp, Artificial Sequence
  chemically synthesized
ttctacaaaattcacattct

SEQ ID NO: 10052 - DNA, 20 bp, Artificial Sequence
  chemically synthesized
acaaaattcacattcttggc

SEQ ID NO: 10053 - DNA, 20 bp, Artificial Sequence
  chemically synthesized
caaaattcacattcttggct

SEQ ID NO: 10054 - DNA, 20 bp, Artificial Sequence
  chemically synthesized
ttcacattcttggctgggtg

SEQ ID NO: 10055 - DNA, 20 bp, Artificial Sequence
  chemically synthesized
acattcttggctgggtgtgg

SEQ ID NO: 10056 - DNA, 20 bp, Artificial Sequence
  chemically synthesized
gtggctcacgcctgtgatcc

SEQ ID NO: 10057 - DNA, 20 bp, Artificial Sequence
  chemically synthesized
gcctgtgatcccagcacttt

SEQ ID NO: 10058 - DNA, 20 bp, Artificial Sequence
  chemically synthesized
ctgtgatcccagcactttca

SEQ ID NO: 10059 - DNA, 20 bp, Artificial Sequence
  chemically synthesized
tgtgatcccagcactttcag

SEQ ID NO: 10060 - DNA, 20 bp, Artificial Sequence
  chemically synthesized
tcccagcactttcagaggcc

SEQ ID NO: 10061 - DNA, 20 bp, Artificial Sequence
  chemically synthesized
cccagcactttcagaggccg

SEQ ID NO: 10062 - DNA, 20 bp, Artificial Sequence
  chemically synthesized
cagcactttcagaggccgag

SEQ ID NO: 10063 - DNA, 20 bp, Artificial Sequence
  chemically synthesized
agcactttcagaggccgagg

SEQ ID NO: 10064 - DNA, 20 bp, Artificial Sequence
  chemically synthesized
gcactttcagaggccgagga

SEQ ID NO: 10065 - DNA, 20 bp, Artificial Sequence
  chemically synthesized
ctttcagaggccgaggaggg

SEQ ID NO: 10066 - DNA, 20 bp, Artificial Sequence
  chemically synthesized
gagggtggatcacctgatgt

SEQ ID NO: 10067 - DNA, 20 bp, Artificial Sequence
  chemically synthesized
agggtggatcacctgatgtt

SEQ ID NO: 10068 - DNA, 20 bp, Artificial Sequence
  chemically synthesized
ggtggatcacctgatgttag

SEQ ID NO: 10069 - DNA, 20 bp, Artificial Sequence
  chemically synthesized
tcacctgatgttaggagttc

SEQ ID NO: 10070 - DNA, 20 bp, Artificial Sequence
  chemically synthesized
tgatgttaggagttcgagat

SEQ ID NO: 10071 - DNA, 20 bp, Artificial Sequence
  chemically synthesized
cgagatcagcctgaccaaca

SEQ ID NO: 10072 - DNA, 20 bp, Artificial Sequence
  chemically synthesized
aaccccctatctactaaaaa

SEQ ID NO: 10073 - DNA, 20 bp, Artificial Sequence
  chemically synthesized
atctactaaaaatagaaaat

SEQ ID NO: 10074 - DNA, 20 bp, Artificial Sequence
  chemically synthesized
actaaaaatagaaaattagc

SEQ ID NO: 10075 - DNA, 20 bp, Artificial Sequence
  chemically synthesized
ctaaaaatagaaaattagcc

SEQ ID NO: 10076 - DNA, 20 bp, Artificial Sequence
  chemically synthesized
aatagaaaattagccaggca

SEQ ID NO: 10077 - DNA, 20 bp, Artificial Sequence
  chemically synthesized
agaaaattagccaggcatgg

SEQ ID NO: 10078 - DNA, 20 bp, Artificial Sequence
  chemically synthesized
aaattagccaggcatggtgg

SEQ ID NO: 10079 - DNA, 20 bp, Artificial Sequence
  chemically synthesized
atggtggtggcacatgcctg

SEQ ID NO: 10080 - DNA, 20 bp, Artificial Sequence
  chemically synthesized
gtggcacatgcctgtagtgc

SEQ ID NO: 10081 - DNA, 20 bp, Artificial Sequence
  chemically synthesized
tgcctgtagtgccagctact

SEQ ID NO: 10082 - DNA, 20 bp, Artificial Sequence
  chemically synthesized
gcctgtagtgccagctactt

SEQ ID NO: 10083 - DNA, 20 bp, Artificial Sequence
  chemically synthesized
ctgtagtgccagctacttgg

SEQ ID NO: 10084 - DNA, 20 bp, Artificial Sequence
  chemically synthesized
tgtagtgccagctacttggg

SEQ ID NO: 10085 - DNA, 20 bp, Artificial Sequence
  chemically synthesized
tgccagctacttgggaggct

SEQ ID NO: 10086 - DNA, 20 bp, Artificial Sequence
  chemically synthesized
gccagctacttgggaggctg

SEQ ID NO: 10087 - DNA, 20 bp, Artificial Sequence
  chemically synthesized
agctacttgggaggctgagg

SEQ ID NO: 10088 - DNA, 20 bp, Artificial Sequence
  chemically synthesized
gctacttgggaggctgaggc

SEQ ID NO: 10089 - DNA, 20 bp, Artificial Sequence
  chemically synthesized
tacttgggaggctgaggcag

SEQ ID NO: 10090 - DNA, 20 bp, Artificial Sequence
  chemically synthesized
gcaggagaatcgcttgaacc

SEQ ID NO: 10091 - DNA, 20 bp, Artificial Sequence
  chemically synthesized
caggagaatcgcttgaacct

SEQ ID NO: 10092 - DNA, 20 bp, Artificial Sequence
  chemically synthesized
ggagaatcgcttgaacctgg

SEQ ID NO: 10093 - DNA, 20 bp, Artificial Sequence
  chemically synthesized
gagaatcgcttgaacctggg

SEQ ID NO: 10094 - DNA, 20 bp, Artificial Sequence
  chemically synthesized
aatcgcttgaacctgggagg

SEQ ID NO: 10095 - DNA, 20 bp, Artificial Sequence
  chemically synthesized
aacctgggaggcagatgttg

SEQ ID NO: 10096 - DNA, 20 bp, Artificial Sequence
  chemically synthesized
tgggaggcagatgttgcagt

SEQ ID NO: 10097 - DNA, 20 bp, Artificial Sequence
  chemically synthesized
ggcagatgttgcagtgagcc

SEQ ID NO: 10098 - DNA, 20 bp, Artificial Sequence
  chemically synthesized
tggatcatgccattgcactc

SEQ ID NO: 10099 - DNA, 20 bp, Artificial Sequence
  chemically synthesized
catgccattgcactccagcc

SEQ ID NO: 10100 - DNA, 20 bp, Artificial Sequence
  chemically synthesized
atgccattgcactccagcct

SEQ ID NO: 10101 - DNA, 20 bp, Artificial Sequence
  chemically synthesized
cactccagcctgggcaacca

SEQ ID NO: 10102 - DNA, 20 bp, Artificial Sequence
  chemically synthesized
accatagcaatgctctatct

SEQ ID NO: 10103 - DNA, 20 bp, Artificial Sequence
  chemically synthesized
atctcagaaaaaaaaaaaaa

SEQ ID NO: 10104 - DNA, 20 bp, Artificial Sequence
  chemically synthesized
cctgaaaaaataaattattt

SEQ ID NO: 10105 - DNA, 20 bp, Artificial Sequence
  chemically synthesized
tgtacctaattcataatttt

SEQ ID NO: 10106 - DNA, 20 bp, Artificial Sequence
  chemically synthesized
attttcagataatgaatatt

SEQ ID NO: 10107 - DNA, 20 bp, Artificial Sequence
  chemically synthesized
atattgagatgatatatgca

SEQ ID NO: 10108 - DNA, 20 bp, Artificial Sequence
  chemically synthesized
tatatgcacagaacaatgcc

SEQ ID NO: 10109 - DNA, 20 bp, Artificial Sequence
  chemically synthesized
tatgcacagaacaatgccta

SEQ ID NO: 10110 - DNA, 20 bp, Artificial Sequence
  chemically synthesized
aatgcctagagacacattct

SEQ ID NO: 10111 - DNA, 20 bp, Artificial Sequence
  chemically synthesized
agtgtgacattcttaaatgc

SEQ ID NO: 10112 - DNA, 20 bp, Artificial Sequence
  chemically synthesized
gctctccacaattctaatct

SEQ ID NO: 10113 - DNA, 20 bp, Artificial Sequence
  chemically synthesized
cactgtaattattcatttac

SEQ ID NO: 10114 - DNA, 20 bp, Artificial Sequence
  chemically synthesized
ttcatttactggacacatcc

SEQ ID NO: 10115 - DNA, 20 bp, Artificial Sequence
  chemically synthesized
tttatttctcatccttccct

SEQ ID NO: 10116 - DNA, 20 bp, Artificial Sequence
  chemically synthesized
cctcagtgttctctgtattt

SEQ ID NO: 10117 - DNA, 20 bp, Artificial Sequence
  chemically synthesized
ctcagtgttctctgtatttg

SEQ ID NO: 10118 - DNA, 20 bp, Artificial Sequence
  chemically synthesized
tttgaggaactgacatttcc

SEQ ID NO: 10119 - DNA, 20 bp, Artificial Sequence
  chemically synthesized
ttgaggaactgacatttccc

SEQ ID NO: 10120 - DNA, 20 bp, Artificial Sequence
  chemically synthesized
cccaggtttcctcacccttt

SEQ ID NO: 10121 - DNA, 20 bp, Artificial Sequence
  chemically synthesized
gtcgcatgtacattctgcaa

SEQ ID NO: 10122 - DNA, 20 bp, Artificial Sequence
  chemically synthesized
cattctgcaatggtaaacac

SEQ ID NO: 10123 - DNA, 20 bp, Artificial Sequence
  chemically synthesized
tgcaatggtaaacactggct

SEQ ID NO: 10124 - DNA, 20 bp, Artificial Sequence
  chemically synthesized
gcaatggtaaacactggctg

SEQ ID NO: 10125 - DNA, 20 bp, Artificial Sequence
  chemically synthesized
caatggtaaacactggctga

SEQ ID NO: 10126 - DNA, 20 bp, Artificial Sequence
  chemically synthesized
ggtaaacactggctgaggga

SEQ ID NO: 10127 - DNA, 20 bp, Artificial Sequence
  chemically synthesized
cactggctgagggaaagcat

SEQ ID NO: 10128 - DNA, 20 bp, Artificial Sequence
  chemically synthesized
ggctgagggaaagcataagc

SEQ ID NO: 10129 - DNA, 20 bp, Artificial Sequence
  chemically synthesized
agcataagcaagattatttc

SEQ ID NO: 10130 - DNA, 20 bp, Artificial Sequence
  chemically synthesized
ggtctctctctctctctgaa

SEQ ID NO: 10131 - DNA, 20 bp, Artificial Sequence
  chemically synthesized
ctctctgaacggatctccta

SEQ ID NO: 10132 - DNA, 20 bp, Artificial Sequence
  chemically synthesized
tctgaacggatctcctacag

SEQ ID NO: 10133 - DNA, 20 bp, Artificial Sequence
  chemically synthesized
aacggatctcctacagcaga

SEQ ID NO: 10134 - DNA, 20 bp, Artificial Sequence
  chemically synthesized
acagcagacagtctttttta

SEQ ID NO: 10135 - DNA, 20 bp, Artificial Sequence
  chemically synthesized
gtcttttttatggtttttta

SEQ ID NO: 10136 - DNA, 20 bp, Artificial Sequence
  chemically synthesized
tgatactttgatgcccccat

SEQ ID NO: 10137 - DNA, 20 bp, Artificial Sequence
  chemically synthesized
actttgatgcccccattaga

SEQ ID NO: 10138 - DNA, 20 bp, Artificial Sequence
  chemically synthesized
atgcccccattagacagttc

SEQ ID NO: 10139 - DNA, 20 bp, Artificial Sequence
  chemically synthesized
agacagttctggctctctcc

SEQ ID NO: 10140 - DNA, 20 bp, Artificial Sequence
  chemically synthesized
gacagttctggctctctcca

SEQ ID NO: 10141 - DNA, 20 bp, Artificial Sequence
  chemically synthesized
cagttctggctctctccaag

SEQ ID NO: 10142 - DNA, 20 bp, Artificial Sequence
  chemically synthesized
tctctccaaggagcacccac

SEQ ID NO: 10143 - DNA, 20 bp, Artificial Sequence
  chemically synthesized
acccactagctcactgaatc

SEQ ID NO: 10144 - DNA, 20 bp, Artificial Sequence
  chemically synthesized
cactagctcactgaatccag

SEQ ID NO: 10145 - DNA, 20 bp, Artificial Sequence
  chemically synthesized
cactgaatccagtggacctc

SEQ ID NO: 10146 - DNA, 20 bp, Artificial Sequence
  chemically synthesized
atccagtggacctctggtta

SEQ ID NO: 10147 - DNA, 20 bp, Artificial Sequence
  chemically synthesized
tccagtggacctctggttat

SEQ ID NO: 10148 - DNA, 20 bp, Artificial Sequence
  chemically synthesized
ggacctctggttatgggctc

SEQ ID NO: 10149 - DNA, 20 bp, Artificial Sequence
  chemically synthesized
ctggttatgggctctggttc

SEQ ID NO: 10150 - DNA, 20 bp, Artificial Sequence
  chemically synthesized
tgggctctggttctggactc

SEQ ID NO: 10151 - DNA, 20 bp, Artificial Sequence
  chemically synthesized
gctctggttctggactctgg

SEQ ID NO: 10152 - DNA, 20 bp, Artificial Sequence
  chemically synthesized
attttctccttctgcccttc

SEQ ID NO: 10153 - DNA, 20 bp, Artificial Sequence
  chemically synthesized
ttttctccttctgcccttct

SEQ ID NO: 10154 - DNA, 20 bp, Artificial Sequence
  chemically synthesized
ttctgcccttctaggcctaa

SEQ ID NO: 10155 - DNA, 20 bp, Artificial Sequence
  chemically synthesized
tgcccttctaggcctaatgg

SEQ ID NO: 10156 - DNA, 20 bp, Artificial Sequence
  chemically synthesized
ccttctaggcctaatggcgg

SEQ ID NO: 10157 - DNA, 20 bp, Artificial Sequence
  chemically synthesized
ttctaggcctaatggcggaa

SEQ ID NO: 10158 - DNA, 20 bp, Artificial Sequence
  chemically synthesized
tctaggcctaatggcggaag

SEQ ID NO: 10159 - DNA, 20 bp, Artificial Sequence
  chemically synthesized
tttctgatgttactaacatc

SEQ ID NO: 10160 - DNA, 20 bp, Artificial Sequence
  chemically synthesized
ctgtcctttatttgatattt

SEQ ID NO: 10161 - DNA, 20 bp, Artificial Sequence
  chemically synthesized
tattttagctcttccaatac

SEQ ID NO: 10162 - DNA, 20 bp, Artificial Sequence
  chemically synthesized
attttagctcttccaataca

SEQ ID NO: 10163 - DNA, 20 bp, Artificial Sequence
  chemically synthesized
tacaaggataattaactatt

SEQ ID NO: 10164 - DNA, 20 bp, Artificial Sequence
  chemically synthesized
caaggataattaactattaa

SEQ ID NO: 10165 - DNA, 20 bp, Artificial Sequence
  chemically synthesized
ttaagagctgtatttaattc

SEQ ID NO: 10166 - DNA, 20 bp, Artificial Sequence
  chemically synthesized
taagagctgtatttaattct

SEQ ID NO: 10167 - DNA, 20 bp, Artificial Sequence
  chemically synthesized
gctgtatttaattctaggtt

SEQ ID NO: 10168 - DNA, 20 bp, Artificial Sequence
  chemically synthesized
ctaggttgagtaactgataa

SEQ ID NO: 10169 - DNA, 20 bp, Artificial Sequence
  chemically synthesized
atggtttgtcctttccttga

SEQ ID NO: 10170 - DNA, 20 bp, Artificial Sequence
  chemically synthesized
cttctgatactatgtcttat

SEQ ID NO: 10171 - DNA, 20 bp, Artificial Sequence
  chemically synthesized
cttgttgactaatcaaacta

SEQ ID NO: 10172 - DNA, 20 bp, Artificial Sequence
  chemically synthesized
gttgactaatcaaactatag

SEQ ID NO: 10173 - DNA, 20 bp, Artificial Sequence
  chemically synthesized
tgactaatcaaactatagca

SEQ ID NO: 10174 - DNA, 20 bp, Artificial Sequence
  chemically synthesized
gactaatcaaactatagcag

SEQ ID NO: 10175 - DNA, 20 bp, Artificial Sequence
  chemically synthesized
taatcaaactatagcagagg

SEQ ID NO: 10176 - DNA, 20 bp, Artificial Sequence
  chemically synthesized
atcaaactatagcagaggca

SEQ ID NO: 10177 - DNA, 20 bp, Artificial Sequence
  chemically synthesized
tcaaactatagcagaggcag

SEQ ID NO: 10178 - DNA, 20 bp, Artificial Sequence
  chemically synthesized
aactatagcagaggcagagg

SEQ ID NO: 10179 - DNA, 20 bp, Artificial Sequence
  chemically synthesized
actatagcagaggcagagga

SEQ ID NO: 10180 - DNA, 20 bp, Artificial Sequence
  chemically synthesized
cctcatgacctataaatact

SEQ ID NO: 10181 - DNA, 20 bp, Artificial Sequence
  chemically synthesized
ataaatactaagatatcaca

SEQ ID NO: 10182 - DNA, 20 bp, Artificial Sequence
  chemically synthesized
aagatatcacatagtcattt

SEQ ID NO: 10183 - DNA, 20 bp, Artificial Sequence
  chemically synthesized
acatagtcattttagaacca

SEQ ID NO: 10184 - DNA, 20 bp, Artificial Sequence
  chemically synthesized
catagtcattttagaaccaa

SEQ ID NO: 10185 - DNA, 20 bp, Artificial Sequence
  chemically synthesized
ttttagaaccaaaggttcct

SEQ ID NO: 10186 - DNA, 20 bp, Artificial Sequence
  chemically synthesized
gaaccaaaggttcctcagtt

SEQ ID NO: 10187 - DNA, 20 bp, Artificial Sequence
  chemically synthesized
aaccaaaggttcctcagttt

SEQ ID NO: 10188 - DNA, 20 bp, Artificial Sequence
  chemically synthesized
gtctcaaacaaacttctcta

SEQ ID NO: 10189 - DNA, 20 bp, Artificial Sequence
  chemically synthesized
caaacaaacttctctatgga

SEQ ID NO: 10190 - DNA, 20 bp, Artificial Sequence
  chemically synthesized
atagtgtaatactcataatg

SEQ ID NO: 10191 - DNA, 20 bp, Artificial Sequence
  chemically synthesized
gtaatactcataatgtagaa

SEQ ID NO: 10192 - DNA, 20 bp, Artificial Sequence
  chemically synthesized
aatactcataatgtagaaaa

SEQ ID NO: 10193 - DNA, 20 bp, Artificial Sequence
  chemically synthesized
tactcataatgtagaaaaga

SEQ ID NO: 10194 - DNA, 20 bp, Artificial Sequence
  chemically synthesized
agaaaagagagatctaattt

SEQ ID NO: 10195 - DNA, 20 bp, Artificial Sequence
  chemically synthesized
tttttttcatctccaaatac

SEQ ID NO: 10196 - DNA, 20 bp, Artificial Sequence
  chemically synthesized
ttttttcatctccaaatact

SEQ ID NO: 10197 - DNA, 20 bp, Artificial Sequence
  chemically synthesized
tttttcatctccaaatacta

SEQ ID NO: 10198 - DNA, 20 bp, Artificial Sequence
  chemically synthesized
tctccaaatactagggaaat

SEQ ID NO: 10199 - DNA, 20 bp, Artificial Sequence
  chemically synthesized
tccaaatactagggaaataa

SEQ ID NO: 10200 - DNA, 20 bp, Artificial Sequence
  chemically synthesized
ctagggaaataagagtttac

SEQ ID NO: 10201 - DNA, 20 bp, Artificial Sequence
  chemically synthesized
agacaatgtctctaccataa

SEQ ID NO: 10202 - DNA, 20 bp, Artificial Sequence
  chemically synthesized
acaatgtctctaccataaaa

SEQ ID NO: 10203 - DNA, 20 bp, Artificial Sequence
  chemically synthesized
caatgtctctaccataaaag

SEQ ID NO: 10204 - DNA, 20 bp, Artificial Sequence
  chemically synthesized
ccataaaagaggttaaaatt

SEQ ID NO: 10205 - DNA, 20 bp, Artificial Sequence
  chemically synthesized
taaaagaggttaaaatttag

SEQ ID NO: 10206 - DNA, 20 bp, Artificial Sequence
  chemically synthesized
aagaggttaaaatttagtgg

SEQ ID NO: 10207 - DNA, 20 bp, Artificial Sequence
  chemically synthesized
agaggttaaaatttagtggt

SEQ ID NO: 10208 - DNA, 20 bp, Artificial Sequence
  chemically synthesized
tagtggtaggaatatacaat

SEQ ID NO: 10209 - DNA, 20 bp, Artificial Sequence
  chemically synthesized
tggtaggaatatacaatgag

SEQ ID NO: 10210 - DNA, 20 bp, Artificial Sequence
  chemically synthesized
gaatatacaatgagcagatt

SEQ ID NO: 10211 - DNA, 20 bp, Artificial Sequence
  chemically synthesized
aatgagcagattaagtacat

SEQ ID NO: 10212 - DNA, 20 bp, Artificial Sequence
  chemically synthesized
gagcagattaagtacattag

SEQ ID NO: 10213 - DNA, 20 bp, Artificial Sequence
  chemically synthesized
agcagattaagtacattagt

SEQ ID NO: 10214 - DNA, 20 bp, Artificial Sequence
  chemically synthesized
ggaaaaacactaaatattat

SEQ ID NO: 10215 - DNA, 20 bp, Artificial Sequence
  chemically synthesized
aaacactaaatattataaga

SEQ ID NO: 10216 - DNA, 20 bp, Artificial Sequence
  chemically synthesized
acactaaatattataagaaa

SEQ ID NO: 10217 - DNA, 20 bp, Artificial Sequence
  chemically synthesized
taagaaagagcccataattg

SEQ ID NO: 10218 - DNA, 20 bp, Artificial Sequence
  chemically synthesized
gaaagagcccataattgtag

SEQ ID NO: 10219 - DNA, 20 bp, Artificial Sequence
  chemically synthesized
aagagcccataattgtagca

SEQ ID NO: 10220 - DNA, 20 bp, Artificial Sequence
  chemically synthesized
cataattgtagcagagttta

SEQ ID NO: 10221 - DNA, 20 bp, Artificial Sequence
  chemically synthesized
attgtagcagagtttataga

SEQ ID NO: 10222 - DNA, 20 bp, Artificial Sequence
  chemically synthesized
ttgtagcagagtttatagac

SEQ ID NO: 10223 - DNA, 20 bp, Artificial Sequence
  chemically synthesized
tgtagcagagtttatagaca

SEQ ID NO: 10224 - DNA, 20 bp, Artificial Sequence
  chemically synthesized
gagtttatagacagggcttt

SEQ ID NO: 10225 - DNA, 20 bp, Artificial Sequence
  chemically synthesized
tatagacagggctttaagcc

SEQ ID NO: 10226 - DNA, 20 bp, Artificial Sequence
  chemically synthesized
cagttaaaattaaaaaaaaa

SEQ ID NO: 10227 - DNA, 20 bp, Artificial Sequence
  chemically synthesized
attaaaaaaaaatagcttct

SEQ ID NO: 10228 - DNA, 20 bp, Artificial Sequence
  chemically synthesized
aaaaaaatagcttcttagtt

SEQ ID NO: 10229 - DNA, 20 bp, Artificial Sequence
  chemically synthesized
tcttagttgagataacatat

SEQ ID NO: 10230 - DNA, 20 bp, Artificial Sequence
  chemically synthesized
agttgagataacatataagt

SEQ ID NO: 10231 - DNA, 20 bp, Artificial Sequence
  chemically synthesized
gttgagataacatataagtt

SEQ ID NO: 10232 - DNA, 20 bp, Artificial Sequence
  chemically synthesized
aacatataagttaggactta

SEQ ID NO: 10233 - DNA, 20 bp, Artificial Sequence
  chemically synthesized
taagttaggacttaaagtat

SEQ ID NO: 10234 - DNA, 20 bp, Artificial Sequence
  chemically synthesized
aggacttaaagtatgagtac

SEQ ID NO: 10235 - DNA, 20 bp, Artificial Sequence
  chemically synthesized
cttaaagtatgagtacaaga

SEQ ID NO: 10236 - DNA, 20 bp, Artificial Sequence
  chemically synthesized
agtatgagtacaagatagac

SEQ ID NO: 10237 - DNA, 20 bp, Artificial Sequence
  chemically synthesized
gtatgagtacaagatagaca

SEQ ID NO: 10238 - DNA, 20 bp, Artificial Sequence
  chemically synthesized
caagatagacaaggcaaaat

SEQ ID NO: 10239 - DNA, 20 bp, Artificial Sequence
  chemically synthesized
aagatagacaaggcaaaatg

SEQ ID NO: 10240 - DNA, 20 bp, Artificial Sequence
  chemically synthesized
agatagacaaggcaaaatga

SEQ ID NO: 10241 - DNA, 20 bp, Artificial Sequence
  chemically synthesized
agacaaggcaaaatgaggga

SEQ ID NO: 10242 - DNA, 20 bp, Artificial Sequence
  chemically synthesized
aatgagggaaagacatcacc

SEQ ID NO: 10243 - DNA, 20 bp, Artificial Sequence
  chemically synthesized
tgagggaaagacatcaccca

SEQ ID NO: 10244 - DNA, 20 bp, Artificial Sequence
  chemically synthesized
catcacccagagtaaatgaa

SEQ ID NO: 10245 - DNA, 20 bp, Artificial Sequence
  chemically synthesized
gtaaatgaacagcatgtaca

SEQ ID NO: 10246 - DNA, 20 bp, Artificial Sequence
  chemically synthesized
aacagcatgtacaaagctaa

SEQ ID NO: 10247 - DNA, 20 bp, Artificial Sequence
  chemically synthesized
cagcatgtacaaagctaaca

SEQ ID NO: 10248 - DNA, 20 bp, Artificial Sequence
  chemically synthesized
aaagctaacagagtcaaatg

SEQ ID NO: 10249 - DNA, 20 bp, Artificial Sequence
  chemically synthesized
atgcagaaatccaaattctc

SEQ ID NO: 10250 - DNA, 20 bp, Artificial Sequence
  chemically synthesized
tccaaattctctagattgac

SEQ ID NO: 10251 - DNA, 20 bp, Artificial Sequence
  chemically synthesized
ccaaattctctagattgact

SEQ ID NO: 10252 - DNA, 20 bp, Artificial Sequence
  chemically synthesized
caaattctctagattgactg

SEQ ID NO: 10253 - DNA, 20 bp, Artificial Sequence
  chemically synthesized
gtaattttgtcaatgcactc

SEQ ID NO: 10254 - DNA, 20 bp, Artificial Sequence
  chemically synthesized
actcaagtatgcatctgtaa

SEQ ID NO: 10255 - DNA, 20 bp, Artificial Sequence
  chemically synthesized
tgtgtgttcttatgtgtgca

SEQ ID NO: 10256 - DNA, 20 bp, Artificial Sequence
  chemically synthesized
gtgcatggaatgtttgttca

SEQ ID NO: 10257 - DNA, 20 bp, Artificial Sequence
  chemically synthesized
gcatggaatgtttgttcatg

SEQ ID NO: 10258 - DNA, 20 bp, Artificial Sequence
  chemically synthesized
aatgtttgttcatggagcat

SEQ ID NO: 10259 - DNA, 20 bp, Artificial Sequence
  chemically synthesized
atggagcataagaaattgtg

SEQ ID NO: 10260 - DNA, 20 bp, Artificial Sequence
  chemically synthesized
taagaaattgtgtagacata

SEQ ID NO: 10261 - DNA, 20 bp, Artificial Sequence
  chemically synthesized
acacatctgtatgtgtatat

SEQ ID NO: 10262 - DNA, 20 bp, Artificial Sequence
  chemically synthesized
acatctgtatgtgtatatca

SEQ ID NO: 10263 - DNA, 20 bp, Artificial Sequence
  chemically synthesized
gagaatgtttacattgctac

SEQ ID NO: 10264 - DNA, 20 bp, Artificial Sequence
  chemically synthesized
ttttatatgactacatgcac

SEQ ID NO: 10265 - DNA, 20 bp, Artificial Sequence
  chemically synthesized
caagcattcatgctacatgt

SEQ ID NO: 10266 - DNA, 20 bp, Artificial Sequence
  chemically synthesized
attcatgctacatgtcagtt

SEQ ID NO: 10267 - DNA, 20 bp, Artificial Sequence
  chemically synthesized
gtttggtatatttttcctgt

SEQ ID NO: 10268 - DNA, 20 bp, Artificial Sequence
  chemically synthesized
tacttatgtgttttccacta

SEQ ID NO: 10269 - DNA, 20 bp, Artificial Sequence
  chemically synthesized
acttatgtgttttccactaa

SEQ ID NO: 10270 - DNA, 20 bp, Artificial Sequence
  chemically synthesized
gaatgtgaaaactcctcatc

SEQ ID NO: 10271 - DNA, 20 bp, Artificial Sequence
  chemically synthesized
ctcatcgagaaatgaacaat

SEQ ID NO: 10272 - DNA, 20 bp, Artificial Sequence
  chemically synthesized
gaaatgaacaataagtaaca

SEQ ID NO: 10273 - DNA, 20 bp, Artificial Sequence
  chemically synthesized
aaatgaacaataagtaacac

SEQ ID NO: 10274 - DNA, 20 bp, Artificial Sequence
  chemically synthesized
tcatctcttcatttaaaata

SEQ ID NO: 10275 - DNA, 20 bp, Artificial Sequence
  chemically synthesized
atctcttcatttaaaataca

SEQ ID NO: 10276 - DNA, 20 bp, Artificial Sequence
  chemically synthesized
ttaaaatacagagtgacatt

SEQ ID NO: 10277 - DNA, 20 bp, Artificial Sequence
  chemically synthesized
aaatacagagtgacattcag

SEQ ID NO: 10278 - DNA, 20 bp, Artificial Sequence
  chemically synthesized
aatacagagtgacattcaga

SEQ ID NO: 10279 - DNA, 20 bp, Artificial Sequence
  chemically synthesized
atacagagtgacattcagaa

SEQ ID NO: 10280 - DNA, 20 bp, Artificial Sequence
  chemically synthesized
agagtgacattcagaagggc

SEQ ID NO: 10281 - DNA, 20 bp, Artificial Sequence
  chemically synthesized
gagtgacattcagaagggca

SEQ ID NO: 10282 - DNA, 20 bp, Artificial Sequence
  chemically synthesized
agtgacattcagaagggcaa

SEQ ID NO: 10283 - DNA, 20 bp, Artificial Sequence
  chemically synthesized
acattcagaagggcaaggga

SEQ ID NO: 10284 - DNA, 20 bp, Artificial Sequence
  chemically synthesized
agaagggcaagggatagcac

SEQ ID NO: 10285 - DNA, 20 bp, Artificial Sequence
  chemically synthesized
gcaagggatagcacaagtgt

SEQ ID NO: 10286 - DNA, 20 bp, Artificial Sequence
  chemically synthesized
agcacaagtgtgagatttta

SEQ ID NO: 10287 - DNA, 20 bp, Artificial Sequence
  chemically synthesized
gattttaaagtgtgattgtt

SEQ ID NO: 10288 - DNA, 20 bp, Artificial Sequence
  chemically synthesized
aaagtgtgattgtttggaca

SEQ ID NO: 10289 - DNA, 20 bp, Artificial Sequence
  chemically synthesized
ttggacacagtaattattca

SEQ ID NO: 10290 - DNA, 20 bp, Artificial Sequence
  chemically synthesized
gcttaattaatgtatgctac

SEQ ID NO: 10291 - DNA, 20 bp, Artificial Sequence
  chemically synthesized
aattaatgtatgctacaaga

SEQ ID NO: 10292 - DNA, 20 bp, Artificial Sequence
  chemically synthesized
taatgtatgctacaagacag

SEQ ID NO: 10293 - DNA, 20 bp, Artificial Sequence
  chemically synthesized
tatgctacaagacagcagtt

SEQ ID NO: 10294 - DNA, 20 bp, Artificial Sequence
  chemically synthesized
gttgagtgattattgtacat

SEQ ID NO: 10295 - DNA, 20 bp, Artificial Sequence
  chemically synthesized
gattattgtacatgagcaac

SEQ ID NO: 10296 - DNA, 20 bp, Artificial Sequence
  chemically synthesized
ctggtatttattctgctttg

SEQ ID NO: 10297 - DNA, 20 bp, Artificial Sequence
  chemically synthesized
tggtatttattctgctttgt

SEQ ID NO: 10298 - DNA, 20 bp, Artificial Sequence
  chemically synthesized
tattctgctttgtgggttat

SEQ ID NO: 10299 - DNA, 20 bp, Artificial Sequence
  chemically synthesized
tctgctttgtgggttattag

SEQ ID NO: 10300 - DNA, 20 bp, Artificial Sequence
  chemically synthesized
ctgctttgtgggttattagt

SEQ ID NO: 10301 - DNA, 20 bp, Artificial Sequence
  chemically synthesized
tgctttgtgggttattagtg

SEQ ID NO: 10302 - DNA, 20 bp, Artificial Sequence
  chemically synthesized
ggggactcaaaaatatgaca

SEQ ID NO: 10303 - DNA, 20 bp, Artificial Sequence
  chemically synthesized
gggactcaaaaatatgacaa

SEQ ID NO: 10304 - DNA, 20 bp, Artificial Sequence
  chemically synthesized
aaaatatgacaaaggaattt

SEQ ID NO: 10305 - DNA, 20 bp, Artificial Sequence
  chemically synthesized
atatgacaaaggaatttcag

SEQ ID NO: 10306 - DNA, 20 bp, Artificial Sequence
  chemically synthesized
aaaggaatttcagaagctgt

SEQ ID NO: 10307 - DNA, 20 bp, Artificial Sequence
  chemically synthesized
gaatttcagaagctgttaga

SEQ ID NO: 10308 - DNA, 20 bp, Artificial Sequence
  chemically synthesized
tttcagaagctgttagatgg

SEQ ID NO: 10309 - DNA, 20 bp, Artificial Sequence
  chemically synthesized
ctatctatgtgctcccactc

SEQ ID NO: 10310 - DNA, 20 bp, Artificial Sequence
  chemically synthesized
atctatgtgctcccactcaa

SEQ ID NO: 10311 - DNA, 20 bp, Artificial Sequence
  chemically synthesized
gtgctcccactcaagagata

SEQ ID NO: 10312 - DNA, 20 bp, Artificial Sequence
  chemically synthesized
tcccactcaagagatatggt

SEQ ID NO: 10313 - DNA, 20 bp, Artificial Sequence
  chemically synthesized
cccactcaagagatatggtg

SEQ ID NO: 10314 - DNA, 20 bp, Artificial Sequence
  chemically synthesized
ctcaagagatatggtgaggt

SEQ ID NO: 10315 - DNA, 20 bp, Artificial Sequence
  chemically synthesized
atatggtgaggtgagctctt

SEQ ID NO: 10316 - DNA, 20 bp, Artificial Sequence
  chemically synthesized
tatggtgaggtgagctcttt

SEQ ID NO: 10317 - DNA, 20 bp, Artificial Sequence
  chemically synthesized
atggtgaggtgagctctttg

SEQ ID NO: 10318 - DNA, 20 bp, Artificial Sequence
  chemically synthesized
gtgaggtgagctctttgggg

SEQ ID NO: 10319 - DNA, 20 bp, Artificial Sequence
  chemically synthesized
agctctttggggtggacaca

SEQ ID NO: 10320 - DNA, 20 bp, Artificial Sequence
  chemically synthesized
ctctttggggtggacacata

SEQ ID NO: 10321 - DNA, 20 bp, Artificial Sequence
  chemically synthesized
tctttggggtggacacatag

SEQ ID NO: 10322 - DNA, 20 bp, Artificial Sequence
  chemically synthesized
acacatagaggaaatacttt

SEQ ID NO: 10323 - DNA, 20 bp, Artificial Sequence
  chemically synthesized
atagaggaaatactttgaga

SEQ ID NO: 10324 - DNA, 20 bp, Artificial Sequence
  chemically synthesized
agaggaaatactttgagaaa

SEQ ID NO: 10325 - DNA, 20 bp, Artificial Sequence
  chemically synthesized
gaggaaatactttgagaaag

SEQ ID NO: 10326 - DNA, 20 bp, Artificial Sequence
  chemically synthesized
atactttgagaaagaggttt

SEQ ID NO: 10327 - DNA, 20 bp, Artificial Sequence
  chemically synthesized
tactttgagaaagaggtttt

SEQ ID NO: 10328 - DNA, 20 bp, Artificial Sequence
  chemically synthesized
ggttttgggattaatgaaac

SEQ ID NO: 10329 - DNA, 20 bp, Artificial Sequence
  chemically synthesized
ttttgggattaatgaaactg

SEQ ID NO: 10330 - DNA, 20 bp, Artificial Sequence
  chemically synthesized
tgggattaatgaaactggag

SEQ ID NO: 10331 - DNA, 20 bp, Artificial Sequence
  chemically synthesized
attaatgaaactggagaaga

SEQ ID NO: 10332 - DNA, 20 bp, Artificial Sequence
  chemically synthesized
ttaatgaaactggagaagaa

SEQ ID NO: 10333 - DNA, 20 bp, Artificial Sequence
  chemically synthesized
taatgaaactggagaagaaa

SEQ ID NO: 10334 - DNA, 20 bp, Artificial Sequence
  chemically synthesized
cttctaaaacctctttcttt

SEQ ID NO: 10335 - DNA, 20 bp, Artificial Sequence
  chemically synthesized
ttctaaaacctctttctttg

SEQ ID NO: 10336 - DNA, 20 bp, Artificial Sequence
  chemically synthesized
aacctctttctttgaggttt

SEQ ID NO: 10337 - DNA, 20 bp, Artificial Sequence
  chemically synthesized
acctctttctttgaggtttt

SEQ ID NO: 10338 - DNA, 20 bp, Artificial Sequence
  chemically synthesized
ttctttgaggttttaggttt

SEQ ID NO: 10339 - DNA, 20 bp, Artificial Sequence
  chemically synthesized
tctttgaggttttaggtttg

SEQ ID NO: 10340 - DNA, 20 bp, Artificial Sequence
  chemically synthesized
ctttgaggttttaggtttga

SEQ ID NO: 10341 - DNA, 20 bp, Artificial Sequence
  chemically synthesized
gagggtgctacatacttcct

SEQ ID NO: 10342 - DNA, 20 bp, Artificial Sequence
  chemically synthesized
agggtgctacatacttccta

SEQ ID NO: 10343 - DNA, 20 bp, Artificial Sequence
  chemically synthesized
gggtgctacatacttcctaa

SEQ ID NO: 10344 - DNA, 20 bp, Artificial Sequence
  chemically synthesized
tacatacttcctaagggtct

SEQ ID NO: 10345 - DNA, 20 bp, Artificial Sequence
  chemically synthesized
acatacttcctaagggtctt

SEQ ID NO: 10346 - DNA, 20 bp, Artificial Sequence
  chemically synthesized
cttcctaagggtcttgggta

SEQ ID NO: 10347 - DNA, 20 bp, Artificial Sequence
  chemically synthesized
ttcctaagggtcttgggtac

SEQ ID NO: 10348 - DNA, 20 bp, Artificial Sequence
  chemically synthesized
cctaagggtcttgggtacag

SEQ ID NO: 10349 - DNA, 20 bp, Artificial Sequence
  chemically synthesized
gtcttgggtacaggagtttg

SEQ ID NO: 10350 - DNA, 20 bp, Artificial Sequence
  chemically synthesized
ggagtttgaagtgattgcca

SEQ ID NO: 10351 - DNA, 20 bp, Artificial Sequence
  chemically synthesized
ttgaagtgattgccacagaa

SEQ ID NO: 10352 - DNA, 20 bp, Artificial Sequence
  chemically synthesized
agaatggctacgttcattgc

SEQ ID NO: 10353 - DNA, 20 bp, Artificial Sequence
  chemically synthesized
cgttcattgccagatccaaa

SEQ ID NO: 10354 - DNA, 20 bp, Artificial Sequence
  chemically synthesized
gttcattgccagatccaaac

SEQ ID NO: 10355 - DNA, 20 bp, Artificial Sequence
  chemically synthesized
ttcattgccagatccaaaca

SEQ ID NO: 10356 - DNA, 20 bp, Artificial Sequence
  chemically synthesized
tcattgccagatccaaacag

SEQ ID NO: 10357 - DNA, 20 bp, Artificial Sequence
  chemically synthesized
cattgccagatccaaacagg

SEQ ID NO: 10358 - DNA, 20 bp, Artificial Sequence
  chemically synthesized
agatccaaacagggggcttg

SEQ ID NO: 10359 - DNA, 20 bp, Artificial Sequence
  chemically synthesized
gatccaaacagggggcttgt

SEQ ID NO: 10360 - DNA, 20 bp, Artificial Sequence
  chemically synthesized
aatttccttcttttcattca

SEQ ID NO: 10361 - DNA, 20 bp, Artificial Sequence
  chemically synthesized
tccttcttttcattcacaga

SEQ ID NO: 10362 - DNA, 20 bp, Artificial Sequence
  chemically synthesized
ccttcttttcattcacagac

SEQ ID NO: 10363 - DNA, 20 bp, Artificial Sequence
  chemically synthesized
cttcttttcattcacagaca

SEQ ID NO: 10364 - DNA, 20 bp, Artificial Sequence
  chemically synthesized
tcattcacagacagggattt

SEQ ID NO: 10365 - DNA, 20 bp, Artificial Sequence
  chemically synthesized
ctctgtttcacaatgttttc

SEQ ID NO: 10366 - DNA, 20 bp, Artificial Sequence
  chemically synthesized
ctgtgcaatcactgccacaa

SEQ ID NO: 10367 - DNA, 20 bp, Artificial Sequence
  chemically synthesized
ttcattgtttccatcaactt

SEQ ID NO: 10368 - DNA, 20 bp, Artificial Sequence
  chemically synthesized
ccatcacctcaatataatta

SEQ ID NO: 10369 - DNA, 20 bp, Artificial Sequence
  chemically synthesized
cacctcaatataattacagc

SEQ ID NO: 10370 - DNA, 20 bp, Artificial Sequence
  chemically synthesized
aagctcctctgactataccc

SEQ ID NO: 10371 - DNA, 20 bp, Artificial Sequence
  chemically synthesized
tcctctgactatacccaagt

SEQ ID NO: 10372 - DNA, 20 bp, Artificial Sequence
  chemically synthesized
caagttagactttgtctaat

SEQ ID NO: 10373 - DNA, 20 bp, Artificial Sequence
  chemically synthesized
attatgtcactctcatatgc

SEQ ID NO: 10374 - DNA, 20 bp, Artificial Sequence
  chemically synthesized
ctctcatatgcaagaaactt

SEQ ID NO: 10375 - DNA, 20 bp, Artificial Sequence
  chemically synthesized
gtgatttttgctcaaaacga

SEQ ID NO: 10376 - DNA, 20 bp, Artificial Sequence
  chemically synthesized
gctatttttcttacttcatc

SEQ ID NO: 10377 - DNA, 20 bp, Artificial Sequence
  chemically synthesized
cttcatctggtctctgcatc

SEQ ID NO: 10378 - DNA, 20 bp, Artificial Sequence
  chemically synthesized
acgtgctgtttcctaaatct

SEQ ID NO: 10379 - DNA, 20 bp, Artificial Sequence
  chemically synthesized
ttgctcacataaacaaaaat

SEQ ID NO: 10380 - DNA, 20 bp, Artificial Sequence
  chemically synthesized
ctcacataaacaaaaatcag

SEQ ID NO: 10381 - DNA, 20 bp, Artificial Sequence
  chemically synthesized
cacatgtgtgtgtatatata

SEQ ID NO: 10382 - DNA, 20 bp, Artificial Sequence
  chemically synthesized
tgtgtgtgtatatatataga

SEQ ID NO: 10383 - DNA, 20 bp, Artificial Sequence
  chemically synthesized
tgtgtgtatatatatagaaa

SEQ ID NO: 10384 - DNA, 20 bp, Artificial Sequence
  chemically synthesized
ataaaacttgtacatattta

SEQ ID NO: 10385 - DNA, 20 bp, Artificial Sequence
  chemically synthesized
cttgtacatatttatagaaa

SEQ ID NO: 10386 - DNA, 20 bp, Artificial Sequence
  chemically synthesized
tgtacatatttatagaaaca

SEQ ID NO: 10387 - DNA, 20 bp, Artificial Sequence
  chemically synthesized
tacatatttatagaaacaga

SEQ ID NO: 10388 - DNA, 20 bp, Artificial Sequence
  chemically synthesized
tagaaacagagagctgaaca

SEQ ID NO: 10389 - DNA, 20 bp, Artificial Sequence
  chemically synthesized
gaaacagagagctgaacaaa

SEQ ID NO: 10390 - DNA, 20 bp, Artificial Sequence
  chemically synthesized
caaagagatttattatttat

SEQ ID NO: 10391 - DNA, 20 bp, Artificial Sequence
  chemically synthesized
aaagagatttattatttatt

SEQ ID NO: 10392 - DNA, 20 bp, Artificial Sequence
  chemically synthesized
gagatttattatttattggg

SEQ ID NO: 10393 - DNA, 20 bp, Artificial Sequence
  chemically synthesized
atttattgggtagtgtgata

SEQ ID NO: 10394 - DNA, 20 bp, Artificial Sequence
  chemically synthesized
gtagtgtgataaagacttta

SEQ ID NO: 10395 - DNA, 20 bp, Artificial Sequence
  chemically synthesized
tagtgtgataaagactttac

SEQ ID NO: 10396 - DNA, 20 bp, Artificial Sequence
  chemically synthesized
tttacaggtatcaattcaat

SEQ ID NO: 10397 - DNA, 20 bp, Artificial Sequence
  chemically synthesized
agttcttacaaaaatccttt

SEQ ID NO: 10398 - DNA, 20 bp, Artificial Sequence
  chemically synthesized
gttcttacaaaaatccttta

SEQ ID NO: 10399 - DNA, 20 bp, Artificial Sequence
  chemically synthesized
tgataaatctatcatatgca

SEQ ID NO: 10400 - DNA, 20 bp, Artificial Sequence
  chemically synthesized
ctatcatatgcacagcttaa

SEQ ID NO: 10401 - DNA, 20 bp, Artificial Sequence
  chemically synthesized
atggaattataaatatgttt

SEQ ID NO: 10402 - DNA, 20 bp, Artificial Sequence
  chemically synthesized
tggaattataaatatgtttc

SEQ ID NO: 10403 - DNA, 20 bp, Artificial Sequence
  chemically synthesized
tataaatatgtttcaggtca

SEQ ID NO: 10404 - DNA, 20 bp, Artificial Sequence
  chemically synthesized
taaatatgtttcaggtcaca

SEQ ID NO: 10405 - DNA, 20 bp, Artificial Sequence
  chemically synthesized
aaatatgtttcaggtcacag

SEQ ID NO: 10406 - DNA, 20 bp, Artificial Sequence
  chemically synthesized
tatgtttcaggtcacagagg

SEQ ID NO: 10407 - DNA, 20 bp, Artificial Sequence
  chemically synthesized
gtttcaggtcacagaggtag

SEQ ID NO: 10408 - DNA, 20 bp, Artificial Sequence
  chemically synthesized
ggtcacagaggtagcagatg

SEQ ID NO: 10409 - DNA, 20 bp, Artificial Sequence
  chemically synthesized
cagaggtagcagatgaagta

SEQ ID NO: 10410 - DNA, 20 bp, Artificial Sequence
  chemically synthesized
atgaagtacagatgaaaacc

SEQ ID NO: 10411 - DNA, 20 bp, Artificial Sequence
  chemically synthesized
agtacagatgaaaaccaaga

SEQ ID NO: 10412 - DNA, 20 bp, Artificial Sequence
  chemically synthesized
cagatgaaaaccaagacagc

SEQ ID NO: 10413 - DNA, 20 bp, Artificial Sequence
  chemically synthesized
gacagccagttcacatgcct

SEQ ID NO: 10414 - DNA, 20 bp, Artificial Sequence
  chemically synthesized
cagccagttcacatgcctta

SEQ ID NO: 10415 - DNA, 20 bp, Artificial Sequence
  chemically synthesized
attctctattaataccattg

SEQ ID NO: 10416 - DNA, 20 bp, Artificial Sequence
  chemically synthesized
ttaataccattgaagacgtt

SEQ ID NO: 10417 - DNA, 20 bp, Artificial Sequence
  chemically synthesized
aataccattgaagacgttaa

SEQ ID NO: 10418 - DNA, 20 bp, Artificial Sequence
  chemically synthesized
ccattgaagacgttaagaga

SEQ ID NO: 10419 - DNA, 20 bp, Artificial Sequence
  chemically synthesized
aagacgttaagagaaagttc

SEQ ID NO: 10420 - DNA, 20 bp, Artificial Sequence
  chemically synthesized
agacgttaagagaaagttca

SEQ ID NO: 10421 - DNA, 20 bp, Artificial Sequence
  chemically synthesized
ttaagagaaagttcaaggtt

SEQ ID NO: 10422 - DNA, 20 bp, Artificial Sequence
  chemically synthesized
ttcaaggtttggcccttgat

SEQ ID NO: 10423 - DNA, 20 bp, Artificial Sequence
  chemically synthesized
tttggcccttgattggtctc

SEQ ID NO: 10424 - DNA, 20 bp, Artificial Sequence
  chemically synthesized
ttggcccttgattggtctct

SEQ ID NO: 10425 - DNA, 20 bp, Artificial Sequence
  chemically synthesized
gcccttgattggtctctagg

SEQ ID NO: 10426 - DNA, 20 bp, Artificial Sequence
  chemically synthesized
aaaaatatgttgtttaaaat

SEQ ID NO: 10427 - DNA, 20 bp, Artificial Sequence
  chemically synthesized
aatatgttgtttaaaataag

SEQ ID NO: 10428 - DNA, 20 bp, Artificial Sequence
  chemically synthesized
atgttgtttaaaataagtag

SEQ ID NO: 10429 - DNA, 20 bp, Artificial Sequence
  chemically synthesized
aaataagtagaagtgaactg

SEQ ID NO: 10430 - DNA, 20 bp, Artificial Sequence
  chemically synthesized
gtgaactgcagtcaccaaat

SEQ ID NO: 10431 - DNA, 20 bp, Artificial Sequence
  chemically synthesized
caccaaatgagctatatcct

SEQ ID NO: 10432 - DNA, 20 bp, Artificial Sequence
  chemically synthesized
cctgagtttcatacaaataa

SEQ ID NO: 10433 - DNA, 20 bp, Artificial Sequence
  chemically synthesized
catacaaataatagcctata

SEQ ID NO: 10434 - DNA, 20 bp, Artificial Sequence
  chemically synthesized
ctatacagaacttctaattt

SEQ ID NO: 10435 - DNA, 20 bp, Artificial Sequence
  chemically synthesized
acaatcctcttacacctcca

SEQ ID NO: 10436 - DNA, 20 bp, Artificial Sequence
  chemically synthesized
aatcctcttacacctccaaa

SEQ ID NO: 10437 - DNA, 20 bp, Artificial Sequence
  chemically synthesized
gtaaaaacattgtcttattc

SEQ ID NO: 10438 - DNA, 20 bp, Artificial Sequence
  chemically synthesized
aaaaacattgtcttattcta

SEQ ID NO: 10439 - DNA, 20 bp, Artificial Sequence
  chemically synthesized
tagagacgatttccccttcc

SEQ ID NO: 10440 - DNA, 20 bp, Artificial Sequence
  chemically synthesized
agagacgatttccccttcct

SEQ ID NO: 10441 - DNA, 20 bp, Artificial Sequence
  chemically synthesized
agacgatttccccttcctag

SEQ ID NO: 10442 - DNA, 20 bp, Artificial Sequence
  chemically synthesized
accccactaaatccacccac

SEQ ID NO: 10443 - DNA, 20 bp, Artificial Sequence
  chemically synthesized
acgagttctctcttttcttg

SEQ ID NO: 10444 - DNA, 20 bp, Artificial Sequence
  chemically synthesized
cgagttctctcttttcttgc

SEQ ID NO: 10445 - DNA, 20 bp, Artificial Sequence
  chemically synthesized
ctcttttcttgcaggattgc

SEQ ID NO: 10446 - DNA, 20 bp, Artificial Sequence
  chemically synthesized
tttcttgcaggattgcaaga

SEQ ID NO: 10447 - DNA, 20 bp, Artificial Sequence
  chemically synthesized
tccaacattctcatttccat

SEQ ID NO: 10448 - DNA, 20 bp, Artificial Sequence
  chemically synthesized
attctcatttccatcagaaa

SEQ ID NO: 10449 - DNA, 20 bp, Artificial Sequence
  chemically synthesized
tcagaaatagtgcgtccttt

SEQ ID NO: 10450 - DNA, 20 bp, Artificial Sequence
  chemically synthesized
gtgcgtccttttggctgaat

SEQ ID NO: 10451 - DNA, 20 bp, Artificial Sequence
  chemically synthesized
tgcgtccttttggctgaatc

SEQ ID NO: 10452 - DNA, 20 bp, Artificial Sequence
  chemically synthesized
gcgtccttttggctgaatca

SEQ ID NO: 10453 - DNA, 20 bp, Artificial Sequence
  chemically synthesized
ctgaatcagggtaaaatata

SEQ ID NO: 10454 - DNA, 20 bp, Artificial Sequence
  chemically synthesized
atcagggtaaaatataaaga

SEQ ID NO: 10455 - DNA, 20 bp, Artificial Sequence
  chemically synthesized
gtaaaatataaagacagaaa

SEQ ID NO: 10456 - DNA, 20 bp, Artificial Sequence
  chemically synthesized
aaaatataaagacagaaaaa

SEQ ID NO: 10457 - DNA, 20 bp, Artificial Sequence
  chemically synthesized
aagagtacaatgatatttct

SEQ ID NO: 10458 - DNA, 20 bp, Artificial Sequence
  chemically synthesized
gagtacaatgatatttctta

SEQ ID NO: 10459 - DNA, 20 bp, Artificial Sequence
  chemically synthesized
gtacaatgatatttcttaga

SEQ ID NO: 10460 - DNA, 20 bp, Artificial Sequence
  chemically synthesized
tttattctatttttatcatg

SEQ ID NO: 10461 - DNA, 20 bp, Artificial Sequence
  chemically synthesized
ttattctatttttatcatgc

SEQ ID NO: 10462 - DNA, 20 bp, Artificial Sequence
  chemically synthesized
ttatcatgcaggaactgaat

SEQ ID NO: 10463 - DNA, 20 bp, Artificial Sequence
  chemically synthesized
tcatgcaggaactgaatcag

SEQ ID NO: 10464 - DNA, 20 bp, Artificial Sequence
  chemically synthesized
catgcaggaactgaatcagc

SEQ ID NO: 10465 - DNA, 20 bp, Artificial Sequence
  chemically synthesized
gcaggaactgaatcagcagg

SEQ ID NO: 10466 - DNA, 20 bp, Artificial Sequence
  chemically synthesized
caggaactgaatcagcaggc

SEQ ID NO: 10467 - DNA, 20 bp, Artificial Sequence
  chemically synthesized
tccccaacctcccccatcta

SEQ ID NO: 10468 - DNA, 20 bp, Artificial Sequence
  chemically synthesized
ccccaacctcccccatctaa

SEQ ID NO: 10469 - DNA, 20 bp, Artificial Sequence
  chemically synthesized
ccaacctcccccatctaaag

SEQ ID NO: 10470 - DNA, 20 bp, Artificial Sequence
  chemically synthesized
ctcccccatctaaaggagat

SEQ ID NO: 10471 - DNA, 20 bp, Artificial Sequence
  chemically synthesized
atctaaaggagatgagattt

SEQ ID NO: 10472 - DNA, 20 bp, Artificial Sequence
  chemically synthesized
tctaaaggagatgagatttt

SEQ ID NO: 10473 - DNA, 20 bp, Artificial Sequence
  chemically synthesized
ggagatgagattttgggaca

SEQ ID NO: 10474 - DNA, 20 bp, Artificial Sequence
  chemically synthesized
gagatgagattttgggacat

SEQ ID NO: 10475 - DNA, 20 bp, Artificial Sequence
  chemically synthesized
ttgggacataggtacaaaca

SEQ ID NO: 10476 - DNA, 20 bp, Artificial Sequence
  chemically synthesized
ggacataggtacaaacatag

SEQ ID NO: 10477 - DNA, 20 bp, Artificial Sequence
  chemically synthesized
ggtacaaacatagtggacca

SEQ ID NO: 10478 - DNA, 20 bp, Artificial Sequence
  chemically synthesized
gtacaaacatagtggaccat

SEQ ID NO: 10479 - DNA, 20 bp, Artificial Sequence
  chemically synthesized
gtggaccataggtacaaaca

SEQ ID NO: 10480 - DNA, 20 bp, Artificial Sequence
  chemically synthesized
gaccataggtacaaacatag

SEQ ID NO: 10481 - DNA, 20 bp, Artificial Sequence
  chemically synthesized
ataggtacaaacatagtgga

SEQ ID NO: 10482 - DNA, 20 bp, Artificial Sequence
  chemically synthesized
taggtacaaacatagtggac

SEQ ID NO: 10483 - DNA, 20 bp, Artificial Sequence
  chemically synthesized
aggtacaaacatagtggaca

SEQ ID NO: 10484 - DNA, 20 bp, Artificial Sequence
  chemically synthesized
aacatagtggacagggaact

SEQ ID NO: 10485 - DNA, 20 bp, Artificial Sequence
  chemically synthesized
atagtggacagggaactcag

SEQ ID NO: 10486 - DNA, 20 bp, Artificial Sequence
  chemically synthesized
cagggaactcagtggtcttg

SEQ ID NO: 10487 - DNA, 20 bp, Artificial Sequence
  chemically synthesized
agggaactcagtggtcttgt

SEQ ID NO: 10488 - DNA, 20 bp, Artificial Sequence
  chemically synthesized
ctcagtggtcttgtgggcta

SEQ ID NO: 10489 - DNA, 20 bp, Artificial Sequence
  chemically synthesized
gtgggctacagcattaacca

SEQ ID NO: 10490 - DNA, 20 bp, Artificial Sequence
  chemically synthesized
gcattaaccacagcatttgt

SEQ ID NO: 10491 - DNA, 20 bp, Artificial Sequence
  chemically synthesized
agcatttgttagttactgcc

SEQ ID NO: 10492 - DNA, 20 bp, Artificial Sequence
  chemically synthesized
atttgttagttactgccaag

SEQ ID NO: 10493 - DNA, 20 bp, Artificial Sequence
  chemically synthesized
tgccaagaagcctgtatctg

SEQ ID NO: 10494 - DNA, 20 bp, Artificial Sequence
  chemically synthesized
gccaagaagcctgtatctgt

SEQ ID NO: 10495 - DNA, 20 bp, Artificial Sequence
  chemically synthesized
ccaagaagcctgtatctgta

SEQ ID NO: 10496 - DNA, 20 bp, Artificial Sequence
  chemically synthesized
gtagggtaaaatcctcgctg

SEQ ID NO: 10497 - DNA, 20 bp, Artificial Sequence
  chemically synthesized
gggtaaaatcctcgctgaag

SEQ ID NO: 10498 - DNA, 20 bp, Artificial Sequence
  chemically synthesized
ggtaaaatcctcgctgaagt

SEQ ID NO: 10499 - DNA, 20 bp, Artificial Sequence
  chemically synthesized
caatcaatatcacgttgcct

SEQ ID NO: 10500 - DNA, 20 bp, Artificial Sequence
  chemically synthesized
atcaatatcacgttgcctaa

SEQ ID NO: 10501 - DNA, 20 bp, Artificial Sequence
  chemically synthesized
atatcacgttgcctaagagc

SEQ ID NO: 10502 - DNA, 20 bp, Artificial Sequence
  chemically synthesized
tatcacgttgcctaagagct

SEQ ID NO: 10503 - DNA, 20 bp, Artificial Sequence
  chemically synthesized
atcacgttgcctaagagctg

SEQ ID NO: 10504 - DNA, 20 bp, Artificial Sequence
  chemically synthesized
cacgttgcctaagagctggg

SEQ ID NO: 10505 - DNA, 20 bp, Artificial Sequence
  chemically synthesized
acgttgcctaagagctgggg

SEQ ID NO: 10506 - DNA, 20 bp, Artificial Sequence
  chemically synthesized
cgttgcctaagagctgggga

SEQ ID NO: 10507 - DNA, 20 bp, Artificial Sequence
  chemically synthesized
ttgcctaagagctggggagg

SEQ ID NO: 10508 - DNA, 20 bp, Artificial Sequence
  chemically synthesized
taagagctggggagggagtg

SEQ ID NO: 10509 - DNA, 20 bp, Artificial Sequence
  chemically synthesized
gggagggagtgaagataaaa

SEQ ID NO: 10510 - DNA, 20 bp, Artificial Sequence
  chemically synthesized
agtgaagataaaaaagaaaa

SEQ ID NO: 10511 - DNA, 20 bp, Artificial Sequence
  chemically synthesized
ataaaaaagaaaatggtaca

SEQ ID NO: 10512 - DNA, 20 bp, Artificial Sequence
  chemically synthesized
agaaaatggtacatagtgaa

SEQ ID NO: 10513 - DNA, 20 bp, Artificial Sequence
  chemically synthesized
aaatggtacatagtgaatag

SEQ ID NO: 10514 - DNA, 20 bp, Artificial Sequence
  chemically synthesized
aatggtacatagtgaataga

SEQ ID NO: 10515 - DNA, 20 bp, Artificial Sequence
  chemically synthesized
catagtgaatagaaggcctc

SEQ ID NO: 10516 - DNA, 20 bp, Artificial Sequence
  chemically synthesized
gtgaatagaaggcctcaagc

SEQ ID NO: 10517 - DNA, 20 bp, Artificial Sequence
  chemically synthesized
aaggcctcaagctggacttg

SEQ ID NO: 10518 - DNA, 20 bp, Artificial Sequence
  chemically synthesized
caagctggacttgcagtaaa

SEQ ID NO: 10519 - DNA, 20 bp, Artificial Sequence
  chemically synthesized
acacttacatcctttttcac

SEQ ID NO: 10520 - DNA, 20 bp, Artificial Sequence
  chemically synthesized
acttacatcctttttcacca

SEQ ID NO: 10521 - DNA, 20 bp, Artificial Sequence
  chemically synthesized
atcctttttcaccagagttt

SEQ ID NO: 10522 - DNA, 20 bp, Artificial Sequence
  chemically synthesized
ttgagcaactctcaccatta

SEQ ID NO: 10523 - DNA, 20 bp, Artificial Sequence
  chemically synthesized
tgagcaactctcaccattat

SEQ ID NO: 10524 - DNA, 20 bp, Artificial Sequence
  chemically synthesized
caactctcaccattatgggc

SEQ ID NO: 10525 - DNA, 20 bp, Artificial Sequence
  chemically synthesized
caccattatgggctagatat

SEQ ID NO: 10526 - DNA, 20 bp, Artificial Sequence
  chemically synthesized
gatatcagcttcaatatgac

SEQ ID NO: 10527 - DNA, 20 bp, Artificial Sequence
  chemically synthesized
atcagcttcaatatgactgg

SEQ ID NO: 10528 - DNA, 20 bp, Artificial Sequence
  chemically synthesized
tgattgtttcattttttttt

SEQ ID NO: 10529 - DNA, 20 bp, Artificial Sequence
  chemically synthesized
attgtttcatttttttttta

SEQ ID NO: 10530 - DNA, 20 bp, Artificial Sequence
  chemically synthesized
agagacttcgtccttttaaa

SEQ ID NO: 10531 - DNA, 20 bp, Artificial Sequence
  chemically synthesized
gacttcgtccttttaaaaag

SEQ ID NO: 10532 - DNA, 20 bp, Artificial Sequence
  chemically synthesized
acttcgtccttttaaaaagt

SEQ ID NO: 10533 - DNA, 20 bp, Artificial Sequence
  chemically synthesized
ccttttaaaaagtaggataa

SEQ ID NO: 10534 - DNA, 20 bp, Artificial Sequence
  chemically synthesized
aagtaggataatagtacttc

SEQ ID NO: 10535 - DNA, 20 bp, Artificial Sequence
  chemically synthesized
agtaggataatagtacttca

SEQ ID NO: 10536 - DNA, 20 bp, Artificial Sequence
  chemically synthesized
gataatagtacttcaaggaa

SEQ ID NO: 10537 - DNA, 20 bp, Artificial Sequence
  chemically synthesized
agtacttcaaggaacagtaa

SEQ ID NO: 10538 - DNA, 20 bp, Artificial Sequence
  chemically synthesized
cttcaaggaacagtaatgga

SEQ ID NO: 10539 - DNA, 20 bp, Artificial Sequence
  chemically synthesized
ttcaaggaacagtaatggat

SEQ ID NO: 10540 - DNA, 20 bp, Artificial Sequence
  chemically synthesized
ggaacagtaatggataggat

SEQ ID NO: 10541 - DNA, 20 bp, Artificial Sequence
  chemically synthesized
taatggataggataagtccc

SEQ ID NO: 10542 - DNA, 20 bp, Artificial Sequence
  chemically synthesized
tttcccaaacactcataaca

SEQ ID NO: 10543 - DNA, 20 bp, Artificial Sequence
  chemically synthesized
atcctgtaccatgcgtacaa

SEQ ID NO: 10544 - DNA, 20 bp, Artificial Sequence
  chemically synthesized
aaaagtataccatcatcatt

SEQ ID NO: 10545 - DNA, 20 bp, Artificial Sequence
  chemically synthesized
aagtataccatcatcattcg

SEQ ID NO: 10546 - DNA, 20 bp, Artificial Sequence
  chemically synthesized
agtataccatcatcattcgg

SEQ ID NO: 10547 - DNA, 20 bp, Artificial Sequence
  chemically synthesized
gtataccatcatcattcgga

SEQ ID NO: 10548 - DNA, 20 bp, Artificial Sequence
  chemically synthesized
ggaaacaatcctctttttaa

SEQ ID NO: 10549 - DNA, 20 bp, Artificial Sequence
  chemically synthesized
cagcttcccactactttgtt

SEQ ID NO: 10550 - DNA, 20 bp, Artificial Sequence
  chemically synthesized
gttgatctttttctaacctc

SEQ ID NO: 10551 - DNA, 20 bp, Artificial Sequence
  chemically synthesized
ttgatctttttctaacctcc

SEQ ID NO: 10552 - DNA, 20 bp, Artificial Sequence
  chemically synthesized
ttctaacctccaggactatg

SEQ ID NO: 10553 - DNA, 20 bp, Artificial Sequence
  chemically synthesized
acctccaggactatgcagaa

SEQ ID NO: 10554 - DNA, 20 bp, Artificial Sequence
  chemically synthesized
aaagtgactattaattttta

SEQ ID NO: 10555 - DNA, 20 bp, Artificial Sequence
  chemically synthesized
atagaaaatttcgctgacca

SEQ ID NO: 10556 - DNA, 20 bp, Artificial Sequence
  chemically synthesized
tagaaaatttcgctgaccaa

SEQ ID NO: 10557 - DNA, 20 bp, Artificial Sequence
  chemically synthesized
aaatttcgctgaccaaagga

SEQ ID NO: 10558 - DNA, 20 bp, Artificial Sequence
  chemically synthesized
ttccctcatccaaaaacact

SEQ ID NO: 10559 - DNA, 20 bp, Artificial Sequence
  chemically synthesized
aaaaacactcagtttgattt

SEQ ID NO: 10560 - DNA, 20 bp, Artificial Sequence
  chemically synthesized
acactcagtttgattttggc

SEQ ID NO: 10561 - DNA, 20 bp, Artificial Sequence
  chemically synthesized
ttttggccagaattttttat

SEQ ID NO: 10562 - DNA, 20 bp, Artificial Sequence
  chemically synthesized
tttttataagatgtgttttt

SEQ ID NO: 10563 - DNA, 20 bp, Artificial Sequence
  chemically synthesized
tttataagatgtgtttttca

SEQ ID NO: 10564 - DNA, 20 bp, Artificial Sequence
  chemically synthesized
tgtttttcagagctatcaaa

SEQ ID NO: 10565 - DNA, 20 bp, Artificial Sequence
  chemically synthesized
tttcagagctatcaaatggt

SEQ ID NO: 10566 - DNA, 20 bp, Artificial Sequence
  chemically synthesized
cagagctatcaaatggtaag

SEQ ID NO: 10567 - DNA, 20 bp, Artificial Sequence
  chemically synthesized
aagtggccttccattattca

SEQ ID NO: 10568 - DNA, 20 bp, Artificial Sequence
  chemically synthesized
gtccttgctctaccaaattt

SEQ ID NO: 10569 - DNA, 20 bp, Artificial Sequence
  chemically synthesized
aattttagttatgttattta

SEQ ID NO: 10570 - DNA, 20 bp, Artificial Sequence
  chemically synthesized
tgctgaaatatcatatccca

SEQ ID NO: 10571 - DNA, 20 bp, Artificial Sequence
  chemically synthesized
ccatagctgactcataacac

SEQ ID NO: 10572 - DNA, 20 bp, Artificial Sequence
  chemically synthesized
atagctgactcataacacaa

SEQ ID NO: 10573 - DNA, 20 bp, Artificial Sequence
  chemically synthesized
ctgactcataacacaagaga

SEQ ID NO: 10574 - DNA, 20 bp, Artificial Sequence
  chemically synthesized
aaagccacctctgctttcaa

SEQ ID NO: 10575 - DNA, 20 bp, Artificial Sequence
  chemically synthesized
tctgctttcaaaagtaccca

SEQ ID NO: 10576 - DNA, 20 bp, Artificial Sequence
  chemically synthesized
tacccatagtgcaaatatct

SEQ ID NO: 10577 - DNA, 20 bp, Artificial Sequence
  chemically synthesized
acccatagtgcaaatatcta

SEQ ID NO: 10578 - DNA, 20 bp, Artificial Sequence
  chemically synthesized
cccatagtgcaaatatctaa

SEQ ID NO: 10579 - DNA, 20 bp, Artificial Sequence
  chemically synthesized
agtgcaaatatctaagggta

SEQ ID NO: 10580 - DNA, 20 bp, Artificial Sequence
  chemically synthesized
gcaaatatctaagggtaaag

SEQ ID NO: 10581 - DNA, 20 bp, Artificial Sequence
  chemically synthesized
atatctaagggtaaagaaga

SEQ ID NO: 10582 - DNA, 20 bp, Artificial Sequence
  chemically synthesized
aagggtaaagaagaaagcgt

SEQ ID NO: 10583 - DNA, 20 bp, Artificial Sequence
  chemically synthesized
tgagtgtacttactactcac

SEQ ID NO: 10584 - DNA, 20 bp, Artificial Sequence
  chemically synthesized
gagtgtacttactactcacc

SEQ ID NO: 10585 - DNA, 20 bp, Artificial Sequence
  chemically synthesized
tgtacttactactcaccagg

SEQ ID NO: 10586 - DNA, 20 bp, Artificial Sequence
  chemically synthesized
actactcaccaggaagttct

SEQ ID NO: 10587 - DNA, 20 bp, Artificial Sequence
  chemically synthesized
ctactcaccaggaagttctc

SEQ ID NO: 10588 - DNA, 20 bp, Artificial Sequence
  chemically synthesized
tactcaccaggaagttctca

SEQ ID NO: 10589 - DNA, 20 bp, Artificial Sequence
  chemically synthesized
aagttctcagggtccacgtg

SEQ ID NO: 10590 - DNA, 20 bp, Artificial Sequence
  chemically synthesized
ggtccacgtgcagcttgtta

SEQ ID NO: 10591 - DNA, 20 bp, Artificial Sequence
  chemically synthesized
acgtgcagcttgttacagtg

SEQ ID NO: 10592 - DNA, 20 bp, Artificial Sequence
  chemically synthesized
cgtgcagcttgttacagtgc

SEQ ID NO: 10593 - DNA, 20 bp, Artificial Sequence
  chemically synthesized
ttgttacagtgcaggtcact

SEQ ID NO: 10594 - DNA, 20 bp, Artificial Sequence
  chemically synthesized
acagtgcaggtcactcagtg

SEQ ID NO: 10595 - DNA, 20 bp, Artificial Sequence
  chemically synthesized
gcaggtcactcagtgtagca

SEQ ID NO: 10596 - DNA, 20 bp, Artificial Sequence
  chemically synthesized
caggtcactcagtgtagcaa

SEQ ID NO: 10597 - DNA, 20 bp, Artificial Sequence
  chemically synthesized
agtgtagcaaaggtgccttt

SEQ ID NO: 10598 - DNA, 20 bp, Artificial Sequence
  chemically synthesized
gtgtagcaaaggtgcctttg

SEQ ID NO: 10599 - DNA, 20 bp, Artificial Sequence
  chemically synthesized
gtgcctttgaggtcatccgt

SEQ ID NO: 10600 - DNA, 20 bp, Artificial Sequence
  chemically synthesized
gaggtcatccgtgagcataa

SEQ ID NO: 10601 - DNA, 20 bp, Artificial Sequence
  chemically synthesized
tgagcataacagcttttccg

SEQ ID NO: 10602 - DNA, 20 bp, Artificial Sequence
  chemically synthesized
gagcataacagcttttccga

SEQ ID NO: 10603 - DNA, 20 bp, Artificial Sequence
  chemically synthesized
gcataacagcttttccgaag

SEQ ID NO: 10604 - DNA, 20 bp, Artificial Sequence
  chemically synthesized
acagcttttccgaaggagat

SEQ ID NO: 10605 - DNA, 20 bp, Artificial Sequence
  chemically synthesized
cttgccatgtgccttgactt

SEQ ID NO: 10606 - DNA, 20 bp, Artificial Sequence
  chemically synthesized
ttgccatgtgccttgacttt

SEQ ID NO: 10607 - DNA, 20 bp, Artificial Sequence
  chemically synthesized
tgccatgtgccttgactttg

SEQ ID NO: 10608 - DNA, 20 bp, Artificial Sequence
  chemically synthesized
tggggttgcccattattgca

SEQ ID NO: 10609 - DNA, 20 bp, Artificial Sequence
  chemically synthesized
gttgcccattattgcacagt

SEQ ID NO: 10610 - DNA, 20 bp, Artificial Sequence
  chemically synthesized
tgcccattattgcacagtca

SEQ ID NO: 10611 - DNA, 20 bp, Artificial Sequence
  chemically synthesized
attattgcacagtcagagcc

SEQ ID NO: 10612 - DNA, 20 bp, Artificial Sequence
  chemically synthesized
ccagatatccaaaactttca

SEQ ID NO: 10613 - DNA, 20 bp, Artificial Sequence
  chemically synthesized
caaaactttcaaagtacctc

SEQ ID NO: 10614 - DNA, 20 bp, Artificial Sequence
  chemically synthesized
aaaactttcaaagtacctct

SEQ ID NO: 10615 - DNA, 20 bp, Artificial Sequence
  chemically synthesized
tcaaagtacctctaggtcca

SEQ ID NO: 10616 - DNA, 20 bp, Artificial Sequence
  chemically synthesized
caaagtacctctaggtccat

SEQ ID NO: 10617 - DNA, 20 bp, Artificial Sequence
  chemically synthesized
agtacctctaggtccatggg

SEQ ID NO: 10618 - DNA, 20 bp, Artificial Sequence
  chemically synthesized
taggtccatgggtagacaac

SEQ ID NO: 10619 - DNA, 20 bp, Artificial Sequence
  chemically synthesized
aggtccatgggtagacaacc

SEQ ID NO: 10620 - DNA, 20 bp, Artificial Sequence
  chemically synthesized
gtccatgggtagacaaccag

SEQ ID NO: 10621 - DNA, 20 bp, Artificial Sequence
  chemically synthesized
ggtagacaaccaggagactg

SEQ ID NO: 10622 - DNA, 20 bp, Artificial Sequence
  chemically synthesized
gtagacaaccaggagactgt

SEQ ID NO: 10623 - DNA, 20 bp, Artificial Sequence
  chemically synthesized
acaaccaggagactgtggga

SEQ ID NO: 10624 - DNA, 20 bp, Artificial Sequence
  chemically synthesized
ctgtgggatagtcataatca

SEQ ID NO: 10625 - DNA, 20 bp, Artificial Sequence
  chemically synthesized
gtgggatagtcataatcaca

SEQ ID NO: 10626 - DNA, 20 bp, Artificial Sequence
  chemically synthesized
ggatagtcataatcacagag

SEQ ID NO: 10627 - DNA, 20 bp, Artificial Sequence
  chemically synthesized
gatagtcataatcacagagc

SEQ ID NO: 10628 - DNA, 20 bp, Artificial Sequence
  chemically synthesized
ataatcacagagcaggtgca

SEQ ID NO: 10629 - DNA, 20 bp, Artificial Sequence
  chemically synthesized
tcacagagcaggtgcaaagt

SEQ ID NO: 10630 - DNA, 20 bp, Artificial Sequence
  chemically synthesized
ggtgcaaagtcagactatgt

SEQ ID NO: 10631 - DNA, 20 bp, Artificial Sequence
  chemically synthesized
agtcagactatgtaagacaa

SEQ ID NO: 10632 - DNA, 20 bp, Artificial Sequence
  chemically synthesized
gtcagactatgtaagacaac

SEQ ID NO: 10633 - DNA, 20 bp, Artificial Sequence
  chemically synthesized
caacgggctaatccctcttt

SEQ ID NO: 10634 - DNA, 20 bp, Artificial Sequence
  chemically synthesized
tgcctttctgcaccttgtcc

SEQ ID NO: 10635 - DNA, 20 bp, Artificial Sequence
  chemically synthesized
ctgcaccttgtcccggcttc

SEQ ID NO: 10636 - DNA, 20 bp, Artificial Sequence
  chemically synthesized
gcttccagtacctacctgcc

SEQ ID NO: 10637 - DNA, 20 bp, Artificial Sequence
  chemically synthesized
cctgcccagaatctcacctc

SEQ ID NO: 10638 - DNA, 20 bp, Artificial Sequence
  chemically synthesized
ctcaccttaaccttgcttca

SEQ ID NO: 10639 - DNA, 20 bp, Artificial Sequence
  chemically synthesized
tcaccttaaccttgcttcac

SEQ ID NO: 10640 - DNA, 20 bp, Artificial Sequence
  chemically synthesized
cttaaccttgcttcacaggc

SEQ ID NO: 10641 - DNA, 20 bp, Artificial Sequence
  chemically synthesized
aaccttgcttcacaggctgg

SEQ ID NO: 10642 - DNA, 20 bp, Artificial Sequence
  chemically synthesized
cttgcttcacaggctggtgg

SEQ ID NO: 10643 - DNA, 20 bp, Artificial Sequence
  chemically synthesized
gcttcacaggctggtggcag

SEQ ID NO: 10644 - DNA, 20 bp, Artificial Sequence
  chemically synthesized
ggtggcagcagccttcttgt

SEQ ID NO: 10645 - DNA, 20 bp, Artificial Sequence
  chemically synthesized
ggcagcagccttcttgtcag

SEQ ID NO: 10646 - DNA, 20 bp, Artificial Sequence
  chemically synthesized
gtcagcagtgaaatgcacta

SEQ ID NO: 10647 - DNA, 20 bp, Artificial Sequence
  chemically synthesized
agtgaaatgcactacagtgt

SEQ ID NO: 10648 - DNA, 20 bp, Artificial Sequence
  chemically synthesized
atgcactacagtgtcagatc

SEQ ID NO: 10649 - DNA, 20 bp, Artificial Sequence
  chemically synthesized
tgcactacagtgtcagatct

SEQ ID NO: 10650 - DNA, 20 bp, Artificial Sequence
  chemically synthesized
cactacagtgtcagatctgg

SEQ ID NO: 10651 - DNA, 20 bp, Artificial Sequence
  chemically synthesized
tgtcagatctgggagtttcc

SEQ ID NO: 10652 - DNA, 20 bp, Artificial Sequence
  chemically synthesized
tgggagtttcctggtgatca

SEQ ID NO: 10653 - DNA, 20 bp, Artificial Sequence
  chemically synthesized
gtttcctggtgatcacagat

SEQ ID NO: 10654 - DNA, 20 bp, Artificial Sequence
  chemically synthesized
cctggtgatcacagatgagc

SEQ ID NO: 10655 - DNA, 20 bp, Artificial Sequence
  chemically synthesized
ggtgatcacagatgagccag

SEQ ID NO: 10656 - DNA, 20 bp, Artificial Sequence
  chemically synthesized
ctgcattgctgcttcatgtg

SEQ ID NO: 10657 - DNA, 20 bp, Artificial Sequence
  chemically synthesized
ggctttttacttctcctctc

SEQ ID NO: 10658 - DNA, 20 bp, Artificial Sequence
  chemically synthesized
tacttctcctctctggcccc

SEQ ID NO: 10659 - DNA, 20 bp, Artificial Sequence
  chemically synthesized
ccccagccctttgcctctcc

SEQ ID NO: 10660 - DNA, 20 bp, Artificial Sequence
  chemically synthesized
agtgaaatgaatctattgac

SEQ ID NO: 10661 - DNA, 20 bp, Artificial Sequence
  chemically synthesized
gaccagccctttgcctccct

SEQ ID NO: 10662 - DNA, 20 bp, Artificial Sequence
  chemically synthesized
cctcagtaaaatgaatctat

SEQ ID NO: 10663 - DNA, 20 bp, Artificial Sequence
  chemically synthesized
gtaaaatgaatctattggtc

SEQ ID NO: 10664 - DNA, 20 bp, Artificial Sequence
  chemically synthesized
taaaatgaatctattggtca

SEQ ID NO: 10665 - DNA, 20 bp, Artificial Sequence
  chemically synthesized
aaaatgaatctattggtcaa

SEQ ID NO: 10666 - DNA, 20 bp, Artificial Sequence
  chemically synthesized
atgaatctattggtcaaggg

SEQ ID NO: 10667 - DNA, 20 bp, Artificial Sequence
  chemically synthesized
tgaatctattggtcaagggt

SEQ ID NO: 10668 - DNA, 20 bp, Artificial Sequence
  chemically synthesized
tcaagggtgggttgtgactc

SEQ ID NO: 10669 - DNA, 20 bp, Artificial Sequence
  chemically synthesized
caagggtgggttgtgactcc

SEQ ID NO: 10670 - DNA, 20 bp, Artificial Sequence
  chemically synthesized
aagggtgggttgtgactcca

SEQ ID NO: 10671 - DNA, 20 bp, Artificial Sequence
  chemically synthesized
agggtgggttgtgactccag

SEQ ID NO: 10672 - DNA, 20 bp, Artificial Sequence
  chemically synthesized
gtgggttgtgactccagggg

SEQ ID NO: 10673 - DNA, 20 bp, Artificial Sequence
  chemically synthesized
tgggttgtgactccaggggt

SEQ ID NO: 10674 - DNA, 20 bp, Artificial Sequence
  chemically synthesized
gggttgtgactccaggggtg

SEQ ID NO: 10675 - DNA, 20 bp, Artificial Sequence
  chemically synthesized
gtgactccaggggtggggtt

SEQ ID NO: 10676 - DNA, 20 bp, Artificial Sequence
  chemically synthesized
tgactccaggggtggggttt

SEQ ID NO: 10677 - DNA, 20 bp, Artificial Sequence
  chemically synthesized
tccaggggtggggtttgggc

SEQ ID NO: 10678 - DNA, 20 bp, Artificial Sequence
  chemically synthesized
ccaggggtggggtttgggca

SEQ ID NO: 10679 - DNA, 20 bp, Artificial Sequence
  chemically synthesized
ggggtggggtttgggcaagg

SEQ ID NO: 10680 - DNA, 20 bp, Artificial Sequence
  chemically synthesized
tttgggcaaggaagttttgc

SEQ ID NO: 10681 - DNA, 20 bp, Artificial Sequence
  chemically synthesized
ggcaaggaagttttgcaaga

SEQ ID NO: 10682 - DNA, 20 bp, Artificial Sequence
  chemically synthesized
gttttgcaagatggacattc

SEQ ID NO: 10683 - DNA, 20 bp, Artificial Sequence
  chemically synthesized
atggacattcgagtttctga

SEQ ID NO: 10684 - DNA, 20 bp, Artificial Sequence
  chemically synthesized
ttcgagtttctgatagaatc

SEQ ID NO: 10685 - DNA, 20 bp, Artificial Sequence
  chemically synthesized
tcgagtttctgatagaatcc

SEQ ID NO: 10686 - DNA, 20 bp, Artificial Sequence
  chemically synthesized
agtttctgatagaatccagg

SEQ ID NO: 10687 - DNA, 20 bp, Artificial Sequence
  chemically synthesized
tagaatccaggtggccttct

SEQ ID NO: 10688 - DNA, 20 bp, Artificial Sequence
  chemically synthesized
agaatccaggtggccttctc

SEQ ID NO: 10689 - DNA, 20 bp, Artificial Sequence
  chemically synthesized
gaatccaggtggccttctca

SEQ ID NO: 10690 - DNA, 20 bp, Artificial Sequence
  chemically synthesized
aatccaggtggccttctcag

SEQ ID NO: 10691 - DNA, 20 bp, Artificial Sequence
  chemically synthesized
ctcaggggaactttgctgtt

SEQ ID NO: 10692 - DNA, 20 bp, Artificial Sequence
  chemically synthesized
tcaggggaactttgctgttc

SEQ ID NO: 10693 - DNA, 20 bp, Artificial Sequence
  chemically synthesized
cctacactacccccaccatc

SEQ ID NO: 10694 - DNA, 20 bp, Artificial Sequence
  chemically synthesized
tacccccaccatccagtgtg

SEQ ID NO: 10695 - DNA, 20 bp, Artificial Sequence
  chemically synthesized
cagtgtgcagtttatttctc

SEQ ID NO: 10696 - DNA, 20 bp, Artificial Sequence
  chemically synthesized
agtgtgcagtttatttctca

SEQ ID NO: 10697 - DNA, 20 bp, Artificial Sequence
  chemically synthesized
ttatttctcaaggacttcgc

SEQ ID NO: 10698 - DNA, 20 bp, Artificial Sequence
  chemically synthesized
tttctcaaggacttcgccag

SEQ ID NO: 10699 - DNA, 20 bp, Artificial Sequence
  chemically synthesized
ataacctgaatgctgacaaa

SEQ ID NO: 10700 - DNA, 20 bp, Artificial Sequence
  chemically synthesized
taacctgaatgctgacaaat

SEQ ID NO: 10701 - DNA, 20 bp, Artificial Sequence
  chemically synthesized
gaatgctgacaaataggaat

SEQ ID NO: 10702 - DNA, 20 bp, Artificial Sequence
  chemically synthesized
aggaataagttacaactgaa

SEQ ID NO: 10703 - DNA, 20 bp, Artificial Sequence
  chemically synthesized
ggaataagttacaactgaaa

SEQ ID NO: 10704 - DNA, 20 bp, Artificial Sequence
  chemically synthesized
aagttacaactgaaaaggat

SEQ ID NO: 10705 - DNA, 20 bp, Artificial Sequence
  chemically synthesized
gataagaattacgaatatct

SEQ ID NO: 10706 - DNA, 20 bp, Artificial Sequence
  chemically synthesized
atatcttagccatcaattcc

SEQ ID NO: 10707 - DNA, 20 bp, Artificial Sequence
  chemically synthesized
ttagccatcaattcctggat

SEQ ID NO: 10708 - DNA, 20 bp, Artificial Sequence
  chemically synthesized
tagccatcaattcctggatc

SEQ ID NO: 10709 - DNA, 20 bp, Artificial Sequence
  chemically synthesized
gccatcaattcctggatcag

SEQ ID NO: 10710 - DNA, 20 bp, Artificial Sequence
  chemically synthesized
gtgttatcctgttattcatc

SEQ ID NO: 10711 - DNA, 20 bp, Artificial Sequence
  chemically synthesized
tgttatcctgttattcatcc

SEQ ID NO: 10712 - DNA, 20 bp, Artificial Sequence
  chemically synthesized
ttattcatccaggctttatg

SEQ ID NO: 10713 - DNA, 20 bp, Artificial Sequence
  chemically synthesized
ttcatccaggctttatgtgg

SEQ ID NO: 10714 - DNA, 20 bp, Artificial Sequence
  chemically synthesized
atccaggctttatgtggaag

SEQ ID NO: 10715 - DNA, 20 bp, Artificial Sequence
  chemically synthesized
gctttatgtggaagaagcca

SEQ ID NO: 10716 - DNA, 20 bp, Artificial Sequence
  chemically synthesized
gaagaagccacagcctttct

SEQ ID NO: 10717 - DNA, 20 bp, Artificial Sequence
  chemically synthesized
tcttggttttcaattctctt

SEQ ID NO: 10718 - DNA, 20 bp, Artificial Sequence
  chemically synthesized
cattgaatacacaatttcat

SEQ ID NO: 10719 - DNA, 20 bp, Artificial Sequence
  chemically synthesized
tttttttttttttttttttt

SEQ ID NO: 10720 - DNA, 20 bp, Artificial Sequence
  chemically synthesized
ttttttttttttttttgaga

SEQ ID NO: 10721 - DNA, 20 bp, Artificial Sequence
  chemically synthesized
ttttttttttttttgagatg

SEQ ID NO: 10722 - DNA, 20 bp, Artificial Sequence
  chemically synthesized
tggagtctcgctttgtcacc

SEQ ID NO: 10723 - DNA, 20 bp, Artificial Sequence
  chemically synthesized
ggagtctcgctttgtcaccc

SEQ ID NO: 10724 - DNA, 20 bp, Artificial Sequence
  chemically synthesized
tctcgctttgtcacccaggc

SEQ ID NO: 10725 - DNA, 20 bp, Artificial Sequence
  chemically synthesized
tcgctttgtcacccaggctg

SEQ ID NO: 10726 - DNA, 20 bp, Artificial Sequence
  chemically synthesized
gtcacccaggctggagtgtg

SEQ ID NO: 10727 - DNA, 20 bp, Artificial Sequence
  chemically synthesized
acccaggctggagtgtgcag

SEQ ID NO: 10728 - DNA, 20 bp, Artificial Sequence
  chemically synthesized
gcgcgatctctgctcaccgc

SEQ ID NO: 10729 - DNA, 20 bp, Artificial Sequence
  chemically synthesized
tcaccgcaagctctgcctcc

SEQ ID NO: 10730 - DNA, 20 bp, Artificial Sequence
  chemically synthesized
caccgcaagctctgcctccc

SEQ ID NO: 10731 - DNA, 20 bp, Artificial Sequence
  chemically synthesized
ttcacgccattctcctgcct

SEQ ID NO: 10732 - DNA, 20 bp, Artificial Sequence
  chemically synthesized
ttctcctgcctcagcctccc

SEQ ID NO: 10733 - DNA, 20 bp, Artificial Sequence
  chemically synthesized
tcctgcctcagcctcccgag

SEQ ID NO: 10734 - DNA, 20 bp, Artificial Sequence
  chemically synthesized
gcctcagcctcccgagtagc

SEQ ID NO: 10735 - DNA, 20 bp, Artificial Sequence
  chemically synthesized
cctcagcctcccgagtagct

SEQ ID NO: 10736 - DNA, 20 bp, Artificial Sequence
  chemically synthesized
ctcccgagtagctgggacta

SEQ ID NO: 10737 - DNA, 20 bp, Artificial Sequence
  chemically synthesized
tcccgagtagctgggactac

SEQ ID NO: 10738 - DNA, 20 bp, Artificial Sequence
  chemically synthesized
caggcacccgccactgtctc

SEQ ID NO: 10739 - DNA, 20 bp, Artificial Sequence
  chemically synthesized
tggctaattttttgtatttt

SEQ ID NO: 10740 - DNA, 20 bp, Artificial Sequence
  chemically synthesized
ctaattttttgtatttttag

SEQ ID NO: 10741 - DNA, 20 bp, Artificial Sequence
  chemically synthesized
aattttttgtatttttagta

SEQ ID NO: 10742 - DNA, 20 bp, Artificial Sequence
  chemically synthesized
ttttgtatttttagtagaga

SEQ ID NO: 10743 - DNA, 20 bp, Artificial Sequence
  chemically synthesized
tttgtatttttagtagagat

SEQ ID NO: 10744 - DNA, 20 bp, Artificial Sequence
  chemically synthesized
ttgtatttttagtagagatg

SEQ ID NO: 10745 - DNA, 20 bp, Artificial Sequence
  chemically synthesized
gagatggggtttcaccatgt

SEQ ID NO: 10746 - DNA, 20 bp, Artificial Sequence
  chemically synthesized
tggggtttcaccatgttagc

SEQ ID NO: 10747 - DNA, 20 bp, Artificial Sequence
  chemically synthesized
ggggtttcaccatgttagcc

SEQ ID NO: 10748 - DNA, 20 bp, Artificial Sequence
  chemically synthesized
tttcaccatgttagccagga

SEQ ID NO: 10749 - DNA, 20 bp, Artificial Sequence
  chemically synthesized
acctcgtgatccgcccacct

SEQ ID NO: 10750 - DNA, 20 bp, Artificial Sequence
  chemically synthesized
ccgcccacctcagcctccca

SEQ ID NO: 10751 - DNA, 20 bp, Artificial Sequence
  chemically synthesized
acctcagcctcccaaagtgc

SEQ ID NO: 10752 - DNA, 20 bp, Artificial Sequence
  chemically synthesized
cctcagcctcccaaagtgct

SEQ ID NO: 10753 - DNA, 20 bp, Artificial Sequence
  chemically synthesized
ctcccaaagtgctgggatta

SEQ ID NO: 10754 - DNA, 20 bp, Artificial Sequence
  chemically synthesized
tcccaaagtgctgggattac

SEQ ID NO: 10755 - DNA, 20 bp, Artificial Sequence
  chemically synthesized
agtgctgggattacaggtgt

SEQ ID NO: 10756 - DNA, 20 bp, Artificial Sequence
  chemically synthesized
caggtgtgagccaccgcgcc

SEQ ID NO: 10757 - DNA, 20 bp, Artificial Sequence
  chemically synthesized
cggccaatttcatcactttt

SEQ ID NO: 10758 - DNA, 20 bp, Artificial Sequence
  chemically synthesized
aatttcatcactttttagaa

SEQ ID NO: 10759 - DNA, 20 bp, Artificial Sequence
  chemically synthesized
tagaaataaacacctctatc

SEQ ID NO: 10760 - DNA, 20 bp, Artificial Sequence
  chemically synthesized
acctctatccagcatcaact

SEQ ID NO: 10761 - DNA, 20 bp, Artificial Sequence
  chemically synthesized
tctatccagcatcaacttgg

SEQ ID NO: 10762 - DNA, 20 bp, Artificial Sequence
  chemically synthesized
tccagcatcaacttggaaga

SEQ ID NO: 10763 - DNA, 20 bp, Artificial Sequence
  chemically synthesized
agcatcaacttggaagaaag

SEQ ID NO: 10764 - DNA, 20 bp, Artificial Sequence
  chemically synthesized
aacttggaagaaagcagaat

SEQ ID NO: 10765 - DNA, 20 bp, Artificial Sequence
  chemically synthesized
aagcagaataagaaacaaac

SEQ ID NO: 10766 - DNA, 20 bp, Artificial Sequence
  chemically synthesized
agcagaataagaaacaaact

SEQ ID NO: 10767 - DNA, 20 bp, Artificial Sequence
  chemically synthesized
gcagaataagaaacaaacta

SEQ ID NO: 10768 - DNA, 20 bp, Artificial Sequence
  chemically synthesized
gaataagaaacaaactaggg

SEQ ID NO: 10769 - DNA, 20 bp, Artificial Sequence
  chemically synthesized
aagaaacaaactagggaagt

SEQ ID NO: 10770 - DNA, 20 bp, Artificial Sequence
  chemically synthesized
agaaacaaactagggaagta

SEQ ID NO: 10771 - DNA, 20 bp, Artificial Sequence
  chemically synthesized
gaaacaaactagggaagtaa

SEQ ID NO: 10772 - DNA, 20 bp, Artificial Sequence
  chemically synthesized
aaacaaactagggaagtaag

SEQ ID NO: 10773 - DNA, 20 bp, Artificial Sequence
  chemically synthesized
tagggaagtaaggggaaaac

SEQ ID NO: 10774 - DNA, 20 bp, Artificial Sequence
  chemically synthesized
agggaagtaaggggaaaact

SEQ ID NO: 10775 - DNA, 20 bp, Artificial Sequence
  chemically synthesized
actgtgttttttaatccatt

SEQ ID NO: 10776 - DNA, 20 bp, Artificial Sequence
  chemically synthesized
gtgttttttaatccatttag

SEQ ID NO: 10777 - DNA, 20 bp, Artificial Sequence
  chemically synthesized
tttttaatccatttagtagt

SEQ ID NO: 10778 - DNA, 20 bp, Artificial Sequence
  chemically synthesized
tcagtgtacttatctgaaca

SEQ ID NO: 10779 - DNA, 20 bp, Artificial Sequence
  chemically synthesized
cagtgtacttatctgaacaa

SEQ ID NO: 10780 - DNA, 20 bp, Artificial Sequence
  chemically synthesized
gtgtacttatctgaacaaag

SEQ ID NO: 10781 - DNA, 20 bp, Artificial Sequence
  chemically synthesized
tcctctgaatcattgaacaa

SEQ ID NO: 10782 - DNA, 20 bp, Artificial Sequence
  chemically synthesized
acatatctacaaaattatgc

SEQ ID NO: 10783 - DNA, 20 bp, Artificial Sequence
  chemically synthesized
aattatgccagaacatctaa

SEQ ID NO: 10784 - DNA, 20 bp, Artificial Sequence
  chemically synthesized
gccagaacatctaatagtgt

SEQ ID NO: 10785 - DNA, 20 bp, Artificial Sequence
  chemically synthesized
ccagaacatctaatagtgtt

SEQ ID NO: 10786 - DNA, 20 bp, Artificial Sequence
  chemically synthesized
cagaacatctaatagtgttg

SEQ ID NO: 10787 - DNA, 20 bp, Artificial Sequence
  chemically synthesized
agaacatctaatagtgttgg

SEQ ID NO: 10788 - DNA, 20 bp, Artificial Sequence
  chemically synthesized
aacatctaatagtgttgggg

SEQ ID NO: 10789 - DNA, 20 bp, Artificial Sequence
  chemically synthesized
atctaatagtgttgggggag

SEQ ID NO: 10790 - DNA, 20 bp, Artificial Sequence
  chemically synthesized
agaagtgtgctgctctgttc

SEQ ID NO: 10791 - DNA, 20 bp, Artificial Sequence
  chemically synthesized
gtgtgctgctctgttcaagc

SEQ ID NO: 10792 - DNA, 20 bp, Artificial Sequence
  chemically synthesized
gtgctgctctgttcaagcaa

SEQ ID NO: 10793 - DNA, 20 bp, Artificial Sequence
  chemically synthesized
tgctgctctgttcaagcaag

SEQ ID NO: 10794 - DNA, 20 bp, Artificial Sequence
  chemically synthesized
gctctgttcaagcaagagga

SEQ ID NO: 10795 - DNA, 20 bp, Artificial Sequence
  chemically synthesized
ctctgttcaagcaagaggat

SEQ ID NO: 10796 - DNA, 20 bp, Artificial Sequence
  chemically synthesized
ctgttcaagcaagaggatag

SEQ ID NO: 10797 - DNA, 20 bp, Artificial Sequence
  chemically synthesized
caagaggataggagattccg

SEQ ID NO: 10798 - DNA, 20 bp, Artificial Sequence
  chemically synthesized
ggagattccgtggcccgtgc

SEQ ID NO: 10799 - DNA, 20 bp, Artificial Sequence
  chemically synthesized
gagattccgtggcccgtgct

SEQ ID NO: 10800 - DNA, 20 bp, Artificial Sequence
  chemically synthesized
ccgtggcccgtgctgggcat

SEQ ID NO: 10801 - DNA, 20 bp, Artificial Sequence
  chemically synthesized
cgtggcccgtgctgggcatt

SEQ ID NO: 10802 - DNA, 20 bp, Artificial Sequence
  chemically synthesized
ggcattaggtcatttgtgtc

SEQ ID NO: 10803 - DNA, 20 bp, Artificial Sequence
  chemically synthesized
taggtcatttgtgtctggca

SEQ ID NO: 10804 - DNA, 20 bp, Artificial Sequence
  chemically synthesized
aggtcatttgtgtctggcac

SEQ ID NO: 10805 - DNA, 20 bp, Artificial Sequence
  chemically synthesized
tctggcacaggcttgatcta

SEQ ID NO: 10806 - DNA, 20 bp, Artificial Sequence
  chemically synthesized
aacttgtctttatatctaat

SEQ ID NO: 10807 - DNA, 20 bp, Artificial Sequence
  chemically synthesized
acttgtctttatatctaatc

SEQ ID NO: 10808 - DNA, 20 bp, Artificial Sequence
  chemically synthesized
tctttatatctaatcaggca

SEQ ID NO: 10809 - DNA, 20 bp, Artificial Sequence
  chemically synthesized
tcttcactgacaatattcca

SEQ ID NO: 10810 - DNA, 20 bp, Artificial Sequence
  chemically synthesized
cttcactgacaatattccac

SEQ ID NO: 10811 - DNA, 20 bp, Artificial Sequence
  chemically synthesized
acgtctcatgcgtctcaaac

SEQ ID NO: 10812 - DNA, 20 bp, Artificial Sequence
  chemically synthesized
gcgtctcaaacaagcaattt

SEQ ID NO: 10813 - DNA, 20 bp, Artificial Sequence
  chemically synthesized
cgtctcaaacaagcaatttc

SEQ ID NO: 10814 - DNA, 20 bp, Artificial Sequence
  chemically synthesized
caaacaagcaatttcaggaa

SEQ ID NO: 10815 - DNA, 20 bp, Artificial Sequence
  chemically synthesized
caagcaatttcaggaataga

SEQ ID NO: 10816 - DNA, 20 bp, Artificial Sequence
  chemically synthesized
aagcaatttcaggaatagac

SEQ ID NO: 10817 - DNA, 20 bp, Artificial Sequence
  chemically synthesized
agcaatttcaggaatagaca

SEQ ID NO: 10818 - DNA, 20 bp, Artificial Sequence
  chemically synthesized
tagacagggcacacttccac

SEQ ID NO: 10819 - DNA, 20 bp, Artificial Sequence
  chemically synthesized
acagggcacacttccaccgg

SEQ ID NO: 10820 - DNA, 20 bp, Artificial Sequence
  chemically synthesized
agggcacacttccaccggca

SEQ ID NO: 10821 - DNA, 20 bp, Artificial Sequence
  chemically synthesized
ggcacacttccaccggcaga

SEQ ID NO: 10822 - DNA, 20 bp, Artificial Sequence
  chemically synthesized
acacttccaccggcagagag

SEQ ID NO: 10823 - DNA, 20 bp, Artificial Sequence
  chemically synthesized
tccaccggcagagagaagaa

SEQ ID NO: 10824 - DNA, 20 bp, Artificial Sequence
  chemically synthesized
acagtttattttatattctt

SEQ ID NO: 10825 - DNA, 20 bp, Artificial Sequence
  chemically synthesized
cagtttattttatattctta

SEQ ID NO: 10826 - DNA, 20 bp, Artificial Sequence
  chemically synthesized
aggcttactgtcctcatact

SEQ ID NO: 10827 - DNA, 20 bp, Artificial Sequence
  chemically synthesized
gcttactgtcctcatactta

SEQ ID NO: 10828 - DNA, 20 bp, Artificial Sequence
  chemically synthesized
cttactgtcctcatacttag

SEQ ID NO: 10829 - DNA, 20 bp, Artificial Sequence
  chemically synthesized
tgtcctcatacttagaggtt

SEQ ID NO: 10830 - DNA, 20 bp, Artificial Sequence
  chemically synthesized
gtcctcatacttagaggttc

SEQ ID NO: 10831 - DNA, 20 bp, Artificial Sequence
  chemically synthesized
tacttagaggttcaggatgc

SEQ ID NO: 10832 - DNA, 20 bp, Artificial Sequence
  chemically synthesized
ctggtttgtgtgttacccct

SEQ ID NO: 10833 - DNA, 20 bp, Artificial Sequence
  chemically synthesized
cccctgagataaatccttac

SEQ ID NO: 10834 - DNA, 20 bp, Artificial Sequence
  chemically synthesized
ataaatccttacaagaaata

SEQ ID NO: 10835 - DNA, 20 bp, Artificial Sequence
  chemically synthesized
tccttacaagaaataaagtt

SEQ ID NO: 10836 - DNA, 20 bp, Artificial Sequence
  chemically synthesized
ccttacaagaaataaagttt

SEQ ID NO: 10837 - DNA, 20 bp, Artificial Sequence
  chemically synthesized
atcacccccatgtgtatttc

SEQ ID NO: 10838 - DNA, 20 bp, Artificial Sequence
  chemically synthesized
tcacccccatgtgtatttca

SEQ ID NO: 10839 - DNA, 20 bp, Artificial Sequence
  chemically synthesized
acccccatgtgtatttcaag

SEQ ID NO: 10840 - DNA, 20 bp, Artificial Sequence
  chemically synthesized
caaggagactctaaatttca

SEQ ID NO: 10841 - DNA, 20 bp, Artificial Sequence
  chemically synthesized
aggagactctaaatttcaaa

SEQ ID NO: 10842 - DNA, 20 bp, Artificial Sequence
  chemically synthesized
gagttaaacccaatatatta

SEQ ID NO: 10843 - DNA, 20 bp, Artificial Sequence
  chemically synthesized
taaagctgaatttctgatat

SEQ ID NO: 10844 - DNA, 20 bp, Artificial Sequence
  chemically synthesized
aagctgaatttctgatatta

SEQ ID NO: 10845 - DNA, 20 bp, Artificial Sequence
  chemically synthesized
atattagagacacaatattt

SEQ ID NO: 10846 - DNA, 20 bp, Artificial Sequence
  chemically synthesized
atattttagtctacttgata

SEQ ID NO: 10847 - DNA, 20 bp, Artificial Sequence
  chemically synthesized
ttagtctacttgatatagtt

SEQ ID NO: 10848 - DNA, 20 bp, Artificial Sequence
  chemically synthesized
agtctacttgatatagttga

SEQ ID NO: 10849 - DNA, 20 bp, Artificial Sequence
  chemically synthesized
gtctacttgatatagttgag

SEQ ID NO: 10850 - DNA, 20 bp, Artificial Sequence
  chemically synthesized
tacttgatatagttgagagg

SEQ ID NO: 10851 - DNA, 20 bp, Artificial Sequence
  chemically synthesized
aggcagttacctgttttact

SEQ ID NO: 10852 - DNA, 20 bp, Artificial Sequence
  chemically synthesized
ggcagttacctgttttactt

SEQ ID NO: 10853 - DNA, 20 bp, Artificial Sequence
  chemically synthesized
acctgttttacttaggaaca

SEQ ID NO: 10854 - DNA, 20 bp, Artificial Sequence
  chemically synthesized
cctgttttacttaggaacat

SEQ ID NO: 10855 - DNA, 20 bp, Artificial Sequence
  chemically synthesized
ctgttttacttaggaacatg

SEQ ID NO: 10856 - DNA, 20 bp, Artificial Sequence
  chemically synthesized
tttacttaggaacatgggga

SEQ ID NO: 10857 - DNA, 20 bp, Artificial Sequence
  chemically synthesized
aggaacatggggaaagtttg

SEQ ID NO: 10858 - DNA, 20 bp, Artificial Sequence
  chemically synthesized
ggaaagtttgtagtgacaaa

SEQ ID NO: 10859 - DNA, 20 bp, Artificial Sequence
  chemically synthesized
tttgtagtgacaaacagttt

SEQ ID NO: 10860 - DNA, 20 bp, Artificial Sequence
  chemically synthesized
ttgtagtgacaaacagtttg

SEQ ID NO: 10861 - DNA, 20 bp, Artificial Sequence
  chemically synthesized
aaacagtttgaggcaaaacc

SEQ ID NO: 10862 - DNA, 20 bp, Artificial Sequence
  chemically synthesized
gcaaaaccaagattatcttt

SEQ ID NO: 10863 - DNA, 20 bp, Artificial Sequence
  chemically synthesized
aaaaccaagattatctttaa

SEQ ID NO: 10864 - DNA, 20 bp, Artificial Sequence
  chemically synthesized
accaagattatctttaagag

SEQ ID NO: 10865 - DNA, 20 bp, Artificial Sequence
  chemically synthesized
caagattatctttaagagca

SEQ ID NO: 10866 - DNA, 20 bp, Artificial Sequence
  chemically synthesized
gagcagagatcgatgatatg

SEQ ID NO: 10867 - DNA, 20 bp, Artificial Sequence
  chemically synthesized
agatcgatgatatgaagaaa

SEQ ID NO: 10868 - DNA, 20 bp, Artificial Sequence
  chemically synthesized
tcgatgatatgaagaaaaag

SEQ ID NO: 10869 - DNA, 20 bp, Artificial Sequence
  chemically synthesized
atgatatgaagaaaaagaag

SEQ ID NO: 10870 - DNA, 20 bp, Artificial Sequence
  chemically synthesized
gtggcaactttgactatatg

SEQ ID NO: 10871 - DNA, 20 bp, Artificial Sequence
  chemically synthesized
tggcaactttgactatatgc

SEQ ID NO: 10872 - DNA, 20 bp, Artificial Sequence
  chemically synthesized
gcaggaaacacatttatatt

SEQ ID NO: 10873 - DNA, 20 bp, Artificial Sequence
  chemically synthesized
aacacatttatattgagttg

SEQ ID NO: 10874 - DNA, 20 bp, Artificial Sequence
  chemically synthesized
acacatttatattgagttgt

SEQ ID NO: 10875 - DNA, 20 bp, Artificial Sequence
  chemically synthesized
cacatttatattgagttgtg

SEQ ID NO: 10876 - DNA, 20 bp, Artificial Sequence
  chemically synthesized
ttatattgagttgtggggac

SEQ ID NO: 10877 - DNA, 20 bp, Artificial Sequence
  chemically synthesized
tgagttgtggggactggcct

SEQ ID NO: 10878 - DNA, 20 bp, Artificial Sequence
  chemically synthesized
agttgtggggactggcctca

SEQ ID NO: 10879 - DNA, 20 bp, Artificial Sequence
  chemically synthesized
gttgtggggactggcctcag

SEQ ID NO: 10880 - DNA, 20 bp, Artificial Sequence
  chemically synthesized
actggcctcagaggaaactt

SEQ ID NO: 10881 - DNA, 20 bp, Artificial Sequence
  chemically synthesized
ctggcctcagaggaaacttc

SEQ ID NO: 10882 - DNA, 20 bp, Artificial Sequence
  chemically synthesized
cttcaggtcatgtcctttaa

SEQ ID NO: 10883 - DNA, 20 bp, Artificial Sequence
  chemically synthesized
gccctaaaactcattcccaa

SEQ ID NO: 10884 - DNA, 20 bp, Artificial Sequence
  chemically synthesized
attgccatacctcatatcct

SEQ ID NO: 10885 - DNA, 20 bp, Artificial Sequence
  chemically synthesized
ttgccatacctcatatcctt

SEQ ID NO: 10886 - DNA, 20 bp, Artificial Sequence
  chemically synthesized
acatctaaaaccctgcgtac

SEQ ID NO: 10887 - DNA, 20 bp, Artificial Sequence
  chemically synthesized
aaaccctgcgtaccagtgaa

SEQ ID NO: 10888 - DNA, 20 bp, Artificial Sequence
  chemically synthesized
cagctgccccatctttccat

SEQ ID NO: 10889 - DNA, 20 bp, Artificial Sequence
  chemically synthesized
ccatctttccatcagccaac

SEQ ID NO: 10890 - DNA, 20 bp, Artificial Sequence
  chemically synthesized
catctttccatcagccaacc

SEQ ID NO: 10891 - DNA, 20 bp, Artificial Sequence
  chemically synthesized
ccatcagccaaccaggaatt

SEQ ID NO: 10892 - DNA, 20 bp, Artificial Sequence
  chemically synthesized
tcagccaaccaggaattcag

SEQ ID NO: 10893 - DNA, 20 bp, Artificial Sequence
  chemically synthesized
cacttttctctcacccgctc

SEQ ID NO: 10894 - DNA, 20 bp, Artificial Sequence
  chemically synthesized
acttttctctcacccgctcc

SEQ ID NO: 10895 - DNA, 20 bp, Artificial Sequence
  chemically synthesized
tctctcacccgctccaggaa

SEQ ID NO: 10896 - DNA, 20 bp, Artificial Sequence
  chemically synthesized
gctccaggaaaagtgacctg

SEQ ID NO: 10897 - DNA, 20 bp, Artificial Sequence
  chemically synthesized
gtgacctgcagtcactttcc

SEQ ID NO: 10898 - DNA, 20 bp, Artificial Sequence
  chemically synthesized
acctgcagtcactttcctgg

SEQ ID NO: 10899 - DNA, 20 bp, Artificial Sequence
  chemically synthesized
tattgattctttcttgtttg

SEQ ID NO: 10900 - DNA, 20 bp, Artificial Sequence
  chemically synthesized
attgcttctactgtgatcta

SEQ ID NO: 10901 - DNA, 20 bp, Artificial Sequence
  chemically synthesized
gactcttatatcatcaatac

SEQ ID NO: 10902 - DNA, 20 bp, Artificial Sequence
  chemically synthesized
actcttatatcatcaatacc

SEQ ID NO: 10903 - DNA, 20 bp, Artificial Sequence
  chemically synthesized
tcaataccaggttatcattg

SEQ ID NO: 10904 - DNA, 20 bp, Artificial Sequence
  chemically synthesized
ttaattcaacaaatacatat

SEQ ID NO: 10905 - DNA, 20 bp, Artificial Sequence
  chemically synthesized
gattccatatgtcatccatg

SEQ ID NO: 10906 - DNA, 20 bp, Artificial Sequence
  chemically synthesized
catccatttttcttaattct

SEQ ID NO: 10907 - DNA, 20 bp, Artificial Sequence
  chemically synthesized
tctgagaatcttacatgaac

SEQ ID NO: 10908 - DNA, 20 bp, Artificial Sequence
  chemically synthesized
agaatcttacatgaactaga

SEQ ID NO: 10909 - DNA, 20 bp, Artificial Sequence
  chemically synthesized
tcttacatgaactagacaga

SEQ ID NO: 10910 - DNA, 20 bp, Artificial Sequence
  chemically synthesized
aactagacagacagattctc

SEQ ID NO: 10911 - DNA, 20 bp, Artificial Sequence
  chemically synthesized
cagacagattctctggctaa

SEQ ID NO: 10912 - DNA, 20 bp, Artificial Sequence
  chemically synthesized
ggctaatggtgccctcacta

SEQ ID NO: 10913 - DNA, 20 bp, Artificial Sequence
  chemically synthesized
aatggtgccctcactatagt

SEQ ID NO: 10914 - DNA, 20 bp, Artificial Sequence
  chemically synthesized
ggtgccctcactatagtgag

SEQ ID NO: 10915 - DNA, 20 bp, Artificial Sequence
  chemically synthesized
tgccctcactatagtgagca

SEQ ID NO: 10916 - DNA, 20 bp, Artificial Sequence
  chemically synthesized
gccctcactatagtgagcag

SEQ ID NO: 10917 - DNA, 20 bp, Artificial Sequence
  chemically synthesized
cctcactatagtgagcagag

SEQ ID NO: 10918 - DNA, 20 bp, Artificial Sequence
  chemically synthesized
ctatagtgagcagaggagac

SEQ ID NO: 10919 - DNA, 20 bp, Artificial Sequence
  chemically synthesized
gagaccagcatacatactaa

SEQ ID NO: 10920 - DNA, 20 bp, Artificial Sequence
  chemically synthesized
actaaaagaaatgaattaat

SEQ ID NO: 10921 - DNA, 20 bp, Artificial Sequence
  chemically synthesized
taaaagaaatgaattaataa

SEQ ID NO: 10922 - DNA, 20 bp, Artificial Sequence
  chemically synthesized
aatgaattaataagagattt

SEQ ID NO: 10923 - DNA, 20 bp, Artificial Sequence
  chemically synthesized
aattaataagagatttcaga

SEQ ID NO: 10924 - DNA, 20 bp, Artificial Sequence
  chemically synthesized
agatggtattatatgacttg

SEQ ID NO: 10925 - DNA, 20 bp, Artificial Sequence
  chemically synthesized
atattgtacctacaaccatc

SEQ ID NO: 10926 - DNA, 20 bp, Artificial Sequence
  chemically synthesized
cctacaaccatctggtcttt

SEQ ID NO: 10927 - DNA, 20 bp, Artificial Sequence
  chemically synthesized
gtcttttagaaacctgacaa

SEQ ID NO: 10928 - DNA, 20 bp, Artificial Sequence
  chemically synthesized
tttagaaacctgacaaaagc

SEQ ID NO: 10929 - DNA, 20 bp, Artificial Sequence
  chemically synthesized
aacctgacaaaagcaagcaa

SEQ ID NO: 10930 - DNA, 20 bp, Artificial Sequence
  chemically synthesized
acctgacaaaagcaagcaat

SEQ ID NO: 10931 - DNA, 20 bp, Artificial Sequence
  chemically synthesized
cctgacaaaagcaagcaatg

SEQ ID NO: 10932 - DNA, 20 bp, Artificial Sequence
  chemically synthesized
acaaaagcaagcaatgggga

SEQ ID NO: 10933 - DNA, 20 bp, Artificial Sequence
  chemically synthesized
caaaagcaagcaatggggaa

SEQ ID NO: 10934 - DNA, 20 bp, Artificial Sequence
  chemically synthesized
attttcaatttaataaatga

SEQ ID NO: 10935 - DNA, 20 bp, Artificial Sequence
  chemically synthesized
ttttcaatttaataaatgat

SEQ ID NO: 10936 - DNA, 20 bp, Artificial Sequence
  chemically synthesized
tttcaatttaataaatgatg

SEQ ID NO: 10937 - DNA, 20 bp, Artificial Sequence
  chemically synthesized
ttcaatttaataaatgatgg

SEQ ID NO: 10938 - DNA, 20 bp, Artificial Sequence
  chemically synthesized
caatttaataaatgatgggg

SEQ ID NO: 10939 - DNA, 20 bp, Artificial Sequence
  chemically synthesized
aataaatgatgggggagaac

SEQ ID NO: 10940 - DNA, 20 bp, Artificial Sequence
  chemically synthesized
aatgatgggggagaactggc

SEQ ID NO: 10941 - DNA, 20 bp, Artificial Sequence
  chemically synthesized
catatgctgaaaaatgaaac

SEQ ID NO: 10942 - DNA, 20 bp, Artificial Sequence
  chemically synthesized
accttatccaaaattaactc

SEQ ID NO: 10943 - DNA, 20 bp, Artificial Sequence
  chemically synthesized
tatccaaaattaactccaga

SEQ ID NO: 10944 - DNA, 20 bp, Artificial Sequence
  chemically synthesized
aaaattaactccagatggat

SEQ ID NO: 10945 - DNA, 20 bp, Artificial Sequence
  chemically synthesized
aattaactccagatggatta

SEQ ID NO: 10946 - DNA, 20 bp, Artificial Sequence
  chemically synthesized
gaaaaaccccaaactataaa

SEQ ID NO: 10947 - DNA, 20 bp, Artificial Sequence
  chemically synthesized
accccaaactataaaaagcc

SEQ ID NO: 10948 - DNA, 20 bp, Artificial Sequence
  chemically synthesized
aaaaagcctagaaaaaaatc

SEQ ID NO: 10949 - DNA, 20 bp, Artificial Sequence
  chemically synthesized
aaaagcctagaaaaaaatca

SEQ ID NO: 10950 - DNA, 20 bp, Artificial Sequence
  chemically synthesized
tactattcatgatataaaca

SEQ ID NO: 10951 - DNA, 20 bp, Artificial Sequence
  chemically synthesized
actattcatgatataaacac

SEQ ID NO: 10952 - DNA, 20 bp, Artificial Sequence
  chemically synthesized
tcatgatataaacacgggca

SEQ ID NO: 10953 - DNA, 20 bp, Artificial Sequence
  chemically synthesized
gggcacagatttcatgatga

SEQ ID NO: 10954 - DNA, 20 bp, Artificial Sequence
  chemically synthesized
tttcatgatgaaagcgtgaa

SEQ ID NO: 10955 - DNA, 20 bp, Artificial Sequence
  chemically synthesized
gaaagcgtgaaaagcaattg

SEQ ID NO: 10956 - DNA, 20 bp, Artificial Sequence
  chemically synthesized
gtgaaaagcaattgcagcaa

SEQ ID NO: 10957 - DNA, 20 bp, Artificial Sequence
  chemically synthesized
caaaagcaaaaattgaccaa

SEQ ID NO: 10958 - DNA, 20 bp, Artificial Sequence
  chemically synthesized
aatggaatctaattaaacta

SEQ ID NO: 10959 - DNA, 20 bp, Artificial Sequence
  chemically synthesized
tggaatctaattaaactaaa

SEQ ID NO: 10960 - DNA, 20 bp, Artificial Sequence
  chemically synthesized
taaactaaagagctcctgct

SEQ ID NO: 10961 - DNA, 20 bp, Artificial Sequence
  chemically synthesized
aaagagctcctgctcagcaa

SEQ ID NO: 10962 - DNA, 20 bp, Artificial Sequence
  chemically synthesized
tcagcaaaagaaactaccat

SEQ ID NO: 10963 - DNA, 20 bp, Artificial Sequence
  chemically synthesized
agcaaaagaaactaccatca

SEQ ID NO: 10964 - DNA, 20 bp, Artificial Sequence
  chemically synthesized
agaaactaccatcagagcga

SEQ ID NO: 10965 - DNA, 20 bp, Artificial Sequence
  chemically synthesized
tcagagcgaaagacaatcta

SEQ ID NO: 10966 - DNA, 20 bp, Artificial Sequence
  chemically synthesized
gcgaaagacaatctacagaa

SEQ ID NO: 10967 - DNA, 20 bp, Artificial Sequence
  chemically synthesized
cgaaagacaatctacagaat

SEQ ID NO: 10968 - DNA, 20 bp, Artificial Sequence
  chemically synthesized
acaatctacagaatgggaaa

SEQ ID NO: 10969 - DNA, 20 bp, Artificial Sequence
  chemically synthesized
tccaatctattcttctgaca

SEQ ID NO: 10970 - DNA, 20 bp, Artificial Sequence
  chemically synthesized
ccaatctattcttctgacaa

SEQ ID NO: 10971 - DNA, 20 bp, Artificial Sequence
  chemically synthesized
tctgacaaaggcctaatatc

SEQ ID NO: 10972 - DNA, 20 bp, Artificial Sequence
  chemically synthesized
tgacaaaggcctaatatcca

SEQ ID NO: 10973 - DNA, 20 bp, Artificial Sequence
  chemically synthesized
gcctaatatccagagtaaac

SEQ ID NO: 10974 - DNA, 20 bp, Artificial Sequence
  chemically synthesized
agaaacttaaacaactttac

SEQ ID NO: 10975 - DNA, 20 bp, Artificial Sequence
  chemically synthesized
aaaaaaacccattaaaacca

SEQ ID NO: 10976 - DNA, 20 bp, Artificial Sequence
  chemically synthesized
gtacgtgtacccctgaattt

SEQ ID NO: 10977 - DNA, 20 bp, Artificial Sequence
  chemically synthesized
tacgtgtacccctgaattta

SEQ ID NO: 10978 - DNA, 20 bp, Artificial Sequence
  chemically synthesized
tacccctgaatttaaggtaa

SEQ ID NO: 10979 - DNA, 20 bp, Artificial Sequence
  chemically synthesized
gtaacagtaaattaaattaa

SEQ ID NO: 10980 - DNA, 20 bp, Artificial Sequence
  chemically synthesized
aaattaaaagaaaaatgcca

SEQ ID NO: 10981 - DNA, 20 bp, Artificial Sequence
  chemically synthesized
gaaaaatgccatggcaatgt

SEQ ID NO: 10982 - DNA, 20 bp, Artificial Sequence
  chemically synthesized
aatgccatggcaatgtcaga

SEQ ID NO: 10983 - DNA, 20 bp, Artificial Sequence
  chemically synthesized
tgtcagaaagttaccctata

SEQ ID NO: 10984 - DNA, 20 bp, Artificial Sequence
  chemically synthesized
gttaccctatatggcctaaa

SEQ ID NO: 10985 - DNA, 20 bp, Artificial Sequence
  chemically synthesized
taccctatatggcctaaaaa

SEQ ID NO: 10986 - DNA, 20 bp, Artificial Sequence
  chemically synthesized
cctatatggcctaaaaagag

SEQ ID NO: 10987 - DNA, 20 bp, Artificial Sequence
  chemically synthesized
ctatatggcctaaaaagaga

SEQ ID NO: 10988 - DNA, 20 bp, Artificial Sequence
  chemically synthesized
aacttgtttaacatatcatc

SEQ ID NO: 10989 - DNA, 20 bp, Artificial Sequence
  chemically synthesized
tcatcaagaaataaccataa

SEQ ID NO: 10990 - DNA, 20 bp, Artificial Sequence
  chemically synthesized
catcaagaaataaccataaa

SEQ ID NO: 10991 - DNA, 20 bp, Artificial Sequence
  chemically synthesized
ataaccataaaaggaacaac

SEQ ID NO: 10992 - DNA, 20 bp, Artificial Sequence
  chemically synthesized
accataaaaggaacaaccag

SEQ ID NO: 10993 - DNA, 20 bp, Artificial Sequence
  chemically synthesized
aaggaacaaccagcggccct

SEQ ID NO: 10994 - DNA, 20 bp, Artificial Sequence
  chemically synthesized
aggaacaaccagcggccctc

SEQ ID NO: 10995 - DNA, 20 bp, Artificial Sequence
  chemically synthesized
ggaacaaccagcggccctcg

SEQ ID NO: 10996 - DNA, 20 bp, Artificial Sequence
  chemically synthesized
tcggggctgctctgcctatg

SEQ ID NO: 10997 - DNA, 20 bp, Artificial Sequence
  chemically synthesized
gggctgctctgcctatgcag

SEQ ID NO: 10998 - DNA, 20 bp, Artificial Sequence
  chemically synthesized
gtttatttctttactctctc

SEQ ID NO: 10999 - DNA, 20 bp, Artificial Sequence
  chemically synthesized
aaaaaaaacaaaaaacaaaa

SEQ ID NO: 11000 - DNA, 20 bp, Artificial Sequence
  chemically synthesized
aaaacaaaaaacaaaaaaga

SEQ ID NO: 11001 - DNA, 20 bp, Artificial Sequence
  chemically synthesized
caaaaaacaaaaaagaaaga

SEQ ID NO: 11002 - DNA, 20 bp, Artificial Sequence
  chemically synthesized
agaaagtgcatattctgaaa

SEQ ID NO: 11003 - DNA, 20 bp, Artificial Sequence
  chemically synthesized
aagtgcatattctgaaacgg

SEQ ID NO: 11004 - DNA, 20 bp, Artificial Sequence
  chemically synthesized
aacggtagtgactgcatttg

SEQ ID NO: 11005 - DNA, 20 bp, Artificial Sequence
  chemically synthesized
ggtagtgactgcatttgaag

SEQ ID NO: 11006 - DNA, 20 bp, Artificial Sequence
  chemically synthesized
gtagtgactgcatttgaagt

SEQ ID NO: 11007 - DNA, 20 bp, Artificial Sequence
  chemically synthesized
gtgggacctttatgatatga

SEQ ID NO: 11008 - DNA, 20 bp, Artificial Sequence
  chemically synthesized
gggacctttatgatatgatg

SEQ ID NO: 11009 - DNA, 20 bp, Artificial Sequence
  chemically synthesized
cctttatgatatgatggagc

SEQ ID NO: 11010 - DNA, 20 bp, Artificial Sequence
  chemically synthesized
ctttatgatatgatggagcc

SEQ ID NO: 11011 - DNA, 20 bp, Artificial Sequence
  chemically synthesized
tatgatatgatggagccagg

SEQ ID NO: 11012 - DNA, 20 bp, Artificial Sequence
  chemically synthesized
tgatatgatggagccaggca

SEQ ID NO: 11013 - DNA, 20 bp, Artificial Sequence
  chemically synthesized
atggagccaggcagagatgt

SEQ ID NO: 11014 - DNA, 20 bp, Artificial Sequence
  chemically synthesized
ggagccaggcagagatgttg

SEQ ID NO: 11015 - DNA, 20 bp, Artificial Sequence
  chemically synthesized
gccaggcagagatgttggag

SEQ ID NO: 11016 - DNA, 20 bp, Artificial Sequence
  chemically synthesized
gatgttggagaagttcctga

SEQ ID NO: 11017 - DNA, 20 bp, Artificial Sequence
  chemically synthesized
gttggagaagttcctgaaag

SEQ ID NO: 11018 - DNA, 20 bp, Artificial Sequence
  chemically synthesized
ttggagaagttcctgaaaga

SEQ ID NO: 11019 - DNA, 20 bp, Artificial Sequence
  chemically synthesized
gagaagttcctgaaagaagg

SEQ ID NO: 11020 - DNA, 20 bp, Artificial Sequence
  chemically synthesized
agaagttcctgaaagaagga

SEQ ID NO: 11021 - DNA, 20 bp, Artificial Sequence
  chemically synthesized
gaagttcctgaaagaaggaa

SEQ ID NO: 11022 - DNA, 20 bp, Artificial Sequence
  chemically synthesized
aagggcatgtgccaaattct

SEQ ID NO: 11023 - DNA, 20 bp, Artificial Sequence
  chemically synthesized
agggcatgtgccaaattctg

SEQ ID NO: 11024 - DNA, 20 bp, Artificial Sequence
  chemically synthesized
atgtgccaaattctgaggct

SEQ ID NO: 11025 - DNA, 20 bp, Artificial Sequence
  chemically synthesized
tgtgccaaattctgaggctg

SEQ ID NO: 11026 - DNA, 20 bp, Artificial Sequence
  chemically synthesized
tgccaaattctgaggctgag

SEQ ID NO: 11027 - DNA, 20 bp, Artificial Sequence
  chemically synthesized
ttctgaggctgaggagaaaa

SEQ ID NO: 11028 - DNA, 20 bp, Artificial Sequence
  chemically synthesized
gaggctgaggagaaaaaaga

SEQ ID NO: 11029 - DNA, 20 bp, Artificial Sequence
  chemically synthesized
ctgaggagaaaaaagaaaga

SEQ ID NO: 11030 - DNA, 20 bp, Artificial Sequence
  chemically synthesized
aaaaaagaaagaaagaaaaa

SEQ ID NO: 11031 - DNA, 20 bp, Artificial Sequence
  chemically synthesized
aaagaaagaaaaaaagaata

SEQ ID NO: 11032 - DNA, 20 bp, Artificial Sequence
  chemically synthesized
tttacatttcactgtatgta

SEQ ID NO: 11033 - DNA, 20 bp, Artificial Sequence
  chemically synthesized
actgtatgtaaagacattac

SEQ ID NO: 11034 - DNA, 20 bp, Artificial Sequence
  chemically synthesized
ctgtatgtaaagacattaca

SEQ ID NO: 11035 - DNA, 20 bp, Artificial Sequence
  chemically synthesized
atgtaaagacattacaaggc

SEQ ID NO: 11036 - DNA, 20 bp, Artificial Sequence
  chemically synthesized
gtaaagacattacaaggcta

SEQ ID NO: 11037 - DNA, 20 bp, Artificial Sequence
  chemically synthesized
gacattacaaggctagagta

SEQ ID NO: 11038 - DNA, 20 bp, Artificial Sequence
  chemically synthesized
ggctagagtaaagcatgttg

SEQ ID NO: 11039 - DNA, 20 bp, Artificial Sequence
  chemically synthesized
aaagcatgttgaagtaaaaa

SEQ ID NO: 11040 - DNA, 20 bp, Artificial Sequence
  chemically synthesized
aagcatgttgaagtaaaaat

SEQ ID NO: 11041 - DNA, 20 bp, Artificial Sequence
  chemically synthesized
gcatgttgaagtaaaaatag

SEQ ID NO: 11042 - DNA, 20 bp, Artificial Sequence
  chemically synthesized
agtaaaaataggagaaatca

SEQ ID NO: 11043 - DNA, 20 bp, Artificial Sequence
  chemically synthesized
aaaataggagaaatcaaagt

SEQ ID NO: 11044 - DNA, 20 bp, Artificial Sequence
  chemically synthesized
aataggagaaatcaaagtta

SEQ ID NO: 11045 - DNA, 20 bp, Artificial Sequence
  chemically synthesized
taggagaaatcaaagttaga

SEQ ID NO: 11046 - DNA, 20 bp, Artificial Sequence
  chemically synthesized
gagaaatcaaagttagagag

SEQ ID NO: 11047 - DNA, 20 bp, Artificial Sequence
  chemically synthesized
agaaatcaaagttagagaga

SEQ ID NO: 11048 - DNA, 20 bp, Artificial Sequence
  chemically synthesized
gaaatcaaagttagagagaa

SEQ ID NO: 11049 - DNA, 20 bp, Artificial Sequence
  chemically synthesized
caaagttagagagaagggcg

SEQ ID NO: 11050 - DNA, 20 bp, Artificial Sequence
  chemically synthesized
aaagttagagagaagggcgc

SEQ ID NO: 11051 - DNA, 20 bp, Artificial Sequence
  chemically synthesized
aagggcgcaggcttattatt

SEQ ID NO: 11052 - DNA, 20 bp, Artificial Sequence
  chemically synthesized
agggcgcaggcttattattt

SEQ ID NO: 11053 - DNA, 20 bp, Artificial Sequence
  chemically synthesized
ggcttattatttgggtctta

SEQ ID NO: 11054 - DNA, 20 bp, Artificial Sequence
  chemically synthesized
attatttgggtcttatagat

SEQ ID NO: 11055 - DNA, 20 bp, Artificial Sequence
  chemically synthesized
tatttgggtcttatagatga

SEQ ID NO: 11056 - DNA, 20 bp, Artificial Sequence
  chemically synthesized
ttgggtcttatagatgagag

SEQ ID NO: 11057 - DNA, 20 bp, Artificial Sequence
  chemically synthesized
ggtcttatagatgagagtag

SEQ ID NO: 11058 - DNA, 20 bp, Artificial Sequence
  chemically synthesized
tcttatagatgagagtagta

SEQ ID NO: 11059 - DNA, 20 bp, Artificial Sequence
  chemically synthesized
tatagatgagagtagtagag

SEQ ID NO: 11060 - DNA, 20 bp, Artificial Sequence
  chemically synthesized
atagatgagagtagtagagt

SEQ ID NO: 11061 - DNA, 20 bp, Artificial Sequence
  chemically synthesized
aggtattttatactgaaaca

SEQ ID NO: 11062 - DNA, 20 bp, Artificial Sequence
  chemically synthesized
ggtattttatactgaaacat

SEQ ID NO: 11063 - DNA, 20 bp, Artificial Sequence
  chemically synthesized
gtattttatactgaaacata

SEQ ID NO: 11064 - DNA, 20 bp, Artificial Sequence
  chemically synthesized
tattttatactgaaacatag

SEQ ID NO: 11065 - DNA, 20 bp, Artificial Sequence
  chemically synthesized
tatactgaaacataggggac

SEQ ID NO: 11066 - DNA, 20 bp, Artificial Sequence
  chemically synthesized
atactgaaacataggggacg

SEQ ID NO: 11067 - DNA, 20 bp, Artificial Sequence
  chemically synthesized
tactgaaacataggggacga

SEQ ID NO: 11068 - DNA, 20 bp, Artificial Sequence
  chemically synthesized
actgaaacataggggacgag

SEQ ID NO: 11069 - DNA, 20 bp, Artificial Sequence
  chemically synthesized
tgaaacataggggacgaggg

SEQ ID NO: 11070 - DNA, 20 bp, Artificial Sequence
  chemically synthesized
gaggggagctttgcaaacct

SEQ ID NO: 11071 - DNA, 20 bp, Artificial Sequence
  chemically synthesized
ttgcaaacctgagataaaca

SEQ ID NO: 11072 - DNA, 20 bp, Artificial Sequence
  chemically synthesized
cctgagataaacatggtctg

SEQ ID NO: 11073 - DNA, 20 bp, Artificial Sequence
  chemically synthesized
ctgtagtccactcaaaaccc

SEQ ID NO: 11074 - DNA, 20 bp, Artificial Sequence
  chemically synthesized
ccttcttcatctgccttact

SEQ ID NO: 11075 - DNA, 20 bp, Artificial Sequence
  chemically synthesized
tcatctgccttactcagtgc

SEQ ID NO: 11076 - DNA, 20 bp, Artificial Sequence
  chemically synthesized
catctgccttactcagtgca

SEQ ID NO: 11077 - DNA, 20 bp, Artificial Sequence
  chemically synthesized
ggtgctataacaaaatacaa

SEQ ID NO: 11078 - DNA, 20 bp, Artificial Sequence
  chemically synthesized
tataacaaaatacaaaagac

SEQ ID NO: 11079 - DNA, 20 bp, Artificial Sequence
  chemically synthesized
ataacaaaatacaaaagact

SEQ ID NO: 11080 - DNA, 20 bp, Artificial Sequence
  chemically synthesized
acaaaatacaaaagactggg

SEQ ID NO: 11081 - DNA, 20 bp, Artificial Sequence
  chemically synthesized
agactgggtggcttcaacaa

SEQ ID NO: 11082 - DNA, 20 bp, Artificial Sequence
  chemically synthesized
actgggtggcttcaacaaca

SEQ ID NO: 11083 - DNA, 20 bp, Artificial Sequence
  chemically synthesized
agttttttctcacatttctg

SEQ ID NO: 11084 - DNA, 20 bp, Artificial Sequence
  chemically synthesized
gttttttctcacatttctga

SEQ ID NO: 11085 - DNA, 20 bp, Artificial Sequence
  chemically synthesized
catttctgaaggctgactcg

SEQ ID NO: 11086 - DNA, 20 bp, Artificial Sequence
  chemically synthesized
tctgaaggctgactcgtggt

SEQ ID NO: 11087 - DNA, 20 bp, Artificial Sequence
  chemically synthesized
ctgaaggctgactcgtggtc

SEQ ID NO: 11088 - DNA, 20 bp, Artificial Sequence
  chemically synthesized
tgaaggctgactcgtggtca

SEQ ID NO: 11089 - DNA, 20 bp, Artificial Sequence
  chemically synthesized
cgtggtcagggttctcttcc

SEQ ID NO: 11090 - DNA, 20 bp, Artificial Sequence
  chemically synthesized
agggttctcttcctggattg

SEQ ID NO: 11091 - DNA, 20 bp, Artificial Sequence
  chemically synthesized
ttctcttcctggattgcaga

SEQ ID NO: 11092 - DNA, 20 bp, Artificial Sequence
  chemically synthesized
tcttcctggattgcagatgg

SEQ ID NO: 11093 - DNA, 20 bp, Artificial Sequence
  chemically synthesized
acttctcactgtgtcctcac

SEQ ID NO: 11094 - DNA, 20 bp, Artificial Sequence
  chemically synthesized
cttctcactgtgtcctcacc

SEQ ID NO: 11095 - DNA, 20 bp, Artificial Sequence
  chemically synthesized
tctcactgtgtcctcaccgg

SEQ ID NO: 11096 - DNA, 20 bp, Artificial Sequence
  chemically synthesized
ctcactgtgtcctcaccggg

SEQ ID NO: 11097 - DNA, 20 bp, Artificial Sequence
  chemically synthesized
ctgtgtcctcaccgggagga

SEQ ID NO: 11098 - DNA, 20 bp, Artificial Sequence
  chemically synthesized
gtgtcctcaccgggaggaaa

SEQ ID NO: 11099 - DNA, 20 bp, Artificial Sequence
  chemically synthesized
tcaccgggaggaaagagaaa

SEQ ID NO: 11100 - DNA, 20 bp, Artificial Sequence
  chemically synthesized
cttgtctctctgcttctgat

SEQ ID NO: 11101 - DNA, 20 bp, Artificial Sequence
  chemically synthesized
ttgtctctctgcttctgata

SEQ ID NO: 11102 - DNA, 20 bp, Artificial Sequence
  chemically synthesized
taaggaaaataattttatga

SEQ ID NO: 11103 - DNA, 20 bp, Artificial Sequence
  chemically synthesized
aaggaaaataattttatgat

SEQ ID NO: 11104 - DNA, 20 bp, Artificial Sequence
  chemically synthesized
aggaaaataattttatgatg

SEQ ID NO: 11105 - DNA, 20 bp, Artificial Sequence
  chemically synthesized
tgatggggatctgctcttat

SEQ ID NO: 11106 - DNA, 20 bp, Artificial Sequence
  chemically synthesized
taaacctaattacttttcaa

SEQ ID NO: 11107 - DNA, 20 bp, Artificial Sequence
  chemically synthesized
cttttcaaaagcctccccca

SEQ ID NO: 11108 - DNA, 20 bp, Artificial Sequence
  chemically synthesized
caaaagcctcccccacagat

SEQ ID NO: 11109 - DNA, 20 bp, Artificial Sequence
  chemically synthesized
aaaagcctcccccacagata

SEQ ID NO: 11110 - DNA, 20 bp, Artificial Sequence
  chemically synthesized
gcctcccccacagataaggt

SEQ ID NO: 11111 - DNA, 20 bp, Artificial Sequence
  chemically synthesized
cccccacagataaggtcagt

SEQ ID NO: 11112 - DNA, 20 bp, Artificial Sequence
  chemically synthesized
ccccacagataaggtcagtt

SEQ ID NO: 11113 - DNA, 20 bp, Artificial Sequence
  chemically synthesized
ccacagataaggtcagttgg

SEQ ID NO: 11114 - DNA, 20 bp, Artificial Sequence
  chemically synthesized
agataaggtcagttgggagt

SEQ ID NO: 11115 - DNA, 20 bp, Artificial Sequence
  chemically synthesized
gataaggtcagttgggagtt

SEQ ID NO: 11116 - DNA, 20 bp, Artificial Sequence
  chemically synthesized
ataaggtcagttgggagttg

SEQ ID NO: 11117 - DNA, 20 bp, Artificial Sequence
  chemically synthesized
tcagttgggagttggggatt

SEQ ID NO: 11118 - DNA, 20 bp, Artificial Sequence
  chemically synthesized
ggattcagcatgtgaatttt

SEQ ID NO: 11119 - DNA, 20 bp, Artificial Sequence
  chemically synthesized
gattcagcatgtgaattttg

SEQ ID NO: 11120 - DNA, 20 bp, Artificial Sequence
  chemically synthesized
ttcagcatgtgaattttgag

SEQ ID NO: 11121 - DNA, 20 bp, Artificial Sequence
  chemically synthesized
ttttgaggagacacaaacat

SEQ ID NO: 11122 - DNA, 20 bp, Artificial Sequence
  chemically synthesized
tttgaggagacacaaacatt

SEQ ID NO: 11123 - DNA, 20 bp, Artificial Sequence
  chemically synthesized
tcatattaaactcttactta

SEQ ID NO: 11124 - DNA, 20 bp, Artificial Sequence
  chemically synthesized
atattaaactcttacttata

SEQ ID NO: 11125 - DNA, 20 bp, Artificial Sequence
  chemically synthesized
aactatacaaaaattccatt

SEQ ID NO: 11126 - DNA, 20 bp, Artificial Sequence
  chemically synthesized
atacaaaaattccattaagt

SEQ ID NO: 11127 - DNA, 20 bp, Artificial Sequence
  chemically synthesized
cccactacattttgatctca

SEQ ID NO: 11128 - DNA, 20 bp, Artificial Sequence
  chemically synthesized
acattttgatctcacagtgc

SEQ ID NO: 11129 - DNA, 20 bp, Artificial Sequence
  chemically synthesized
cacagtgctggtctgtttct

SEQ ID NO: 11130 - DNA, 20 bp, Artificial Sequence
  chemically synthesized
acatgctcatgctgacttgt

SEQ ID NO: 11131 - DNA, 20 bp, Artificial Sequence
  chemically synthesized
ctgattcatttcttacacct

SEQ ID NO: 11132 - DNA, 20 bp, Artificial Sequence
  chemically synthesized
acctaagtccccacctcccc

SEQ ID NO: 11133 - DNA, 20 bp, Artificial Sequence
  chemically synthesized
ctaagtccccacctccccca

SEQ ID NO: 11134 - DNA, 20 bp, Artificial Sequence
  chemically synthesized
ctcccccagagtcttacaat

SEQ ID NO: 11135 - DNA, 20 bp, Artificial Sequence
  chemically synthesized
tcccccagagtcttacaatg

SEQ ID NO: 11136 - DNA, 20 bp, Artificial Sequence
  chemically synthesized
tgtgaccaatctgcacactt

SEQ ID NO: 11137 - DNA, 20 bp, Artificial Sequence
  chemically synthesized
gtgaccaatctgcacacttg

SEQ ID NO: 11138 - DNA, 20 bp, Artificial Sequence
  chemically synthesized
tgaccaatctgcacacttga

SEQ ID NO: 11139 - DNA, 20 bp, Artificial Sequence
  chemically synthesized
aatctgcacacttgagggca

SEQ ID NO: 11140 - DNA, 20 bp, Artificial Sequence
  chemically synthesized
atctgcacacttgagggcat

SEQ ID NO: 11141 - DNA, 20 bp, Artificial Sequence
  chemically synthesized
tgggattaatttcactttct

SEQ ID NO: 11142 - DNA, 20 bp, Artificial Sequence
  chemically synthesized
gggattaatttcactttctt

SEQ ID NO: 11143 - DNA, 20 bp, Artificial Sequence
  chemically synthesized
tcactttcttaggcatccac

SEQ ID NO: 11144 - DNA, 20 bp, Artificial Sequence
  chemically synthesized
cactttcttaggcatccaca

SEQ ID NO: 11145 - DNA, 20 bp, Artificial Sequence
  chemically synthesized
actttcttaggcatccacaa

SEQ ID NO: 11146 - DNA, 20 bp, Artificial Sequence
  chemically synthesized
gcatccacaagggctgtgaa

SEQ ID NO: 11147 - DNA, 20 bp, Artificial Sequence
  chemically synthesized
cacaagggctgtgaaaagct

SEQ ID NO: 11148 - DNA, 20 bp, Artificial Sequence
  chemically synthesized
tgtgaaaagctaagtgccat

SEQ ID NO: 11149 - DNA, 20 bp, Artificial Sequence
  chemically synthesized
aagctaagtgccattagaaa

SEQ ID NO: 11150 - DNA, 20 bp, Artificial Sequence
  chemically synthesized
tagtattcctcctaataaaa

SEQ ID NO: 11151 - DNA, 20 bp, Artificial Sequence
  chemically synthesized
gactaaaccttgaattccta

SEQ ID NO: 11152 - DNA, 20 bp, Artificial Sequence
  chemically synthesized
aaccttgaattcctaaagct

SEQ ID NO: 11153 - DNA, 20 bp, Artificial Sequence
  chemically synthesized
tggaacactttcccttcctt

SEQ ID NO: 11154 - DNA, 20 bp, Artificial Sequence
  chemically synthesized
taagaaccatccttgctact

SEQ ID NO: 11155 - DNA, 20 bp, Artificial Sequence
  chemically synthesized
ctactcagctgcaatcaatc

SEQ ID NO: 11156 - DNA, 20 bp, Artificial Sequence
  chemically synthesized
gctgcaatcaatccagcccc

SEQ ID NO: 11157 - DNA, 20 bp, Artificial Sequence
  chemically synthesized
ctgcaatcaatccagccccc

SEQ ID NO: 11158 - DNA, 20 bp, Artificial Sequence
  chemically synthesized
cttccaaaacatctgtttct

SEQ ID NO: 11159 - DNA, 20 bp, Artificial Sequence
  chemically synthesized
ccaaaacatctgtttctgag

SEQ ID NO: 11160 - DNA, 20 bp, Artificial Sequence
  chemically synthesized
ttctgagaagtcctgtccta

SEQ ID NO: 11161 - DNA, 20 bp, Artificial Sequence
  chemically synthesized
ctgagaagtcctgtcctata

SEQ ID NO: 11162 - DNA, 20 bp, Artificial Sequence
  chemically synthesized
tgagaagtcctgtcctatag

SEQ ID NO: 11163 - DNA, 20 bp, Artificial Sequence
  chemically synthesized
atagaggtctttcttcccac

SEQ ID NO: 11164 - DNA, 20 bp, Artificial Sequence
  chemically synthesized
acaccatttactcccacttg

SEQ ID NO: 11165 - DNA, 20 bp, Artificial Sequence
  chemically synthesized
cttgcagaactcccgtgtac

SEQ ID NO: 11166 - DNA, 20 bp, Artificial Sequence
  chemically synthesized
catctcatataaaaataaat

SEQ ID NO: 11167 - DNA, 20 bp, Artificial Sequence
  chemically synthesized
atctcatataaaaataaatg

SEQ ID NO: 11168 - DNA, 20 bp, Artificial Sequence
  chemically synthesized
ctcatataaaaataaatgag

SEQ ID NO: 11169 - DNA, 20 bp, Artificial Sequence
  chemically synthesized
gcacacaccacaaacacaaa

SEQ ID NO: 11170 - DNA, 20 bp, Artificial Sequence
  chemically synthesized
cacacaccacaaacacaaac

SEQ ID NO: 11171 - DNA, 20 bp, Artificial Sequence
  chemically synthesized
cacaaacacaaacaggcatg

SEQ ID NO: 11172 - DNA, 20 bp, Artificial Sequence
  chemically synthesized
ccctcaatataaaccctttg

SEQ ID NO: 11173 - DNA, 20 bp, Artificial Sequence
  chemically synthesized
ttgtggctcatatatttaaa

SEQ ID NO: 11174 - DNA, 20 bp, Artificial Sequence
  chemically synthesized
atttaaaaagatgtaaaaaa

SEQ ID NO: 11175 - DNA, 20 bp, Artificial Sequence
  chemically synthesized
ttaaaaagatgtaaaaaaaa

SEQ ID NO: 11176 - DNA, 20 bp, Artificial Sequence
  chemically synthesized
agatgtaaaaaaaagagctg

SEQ ID NO: 11177 - DNA, 20 bp, Artificial Sequence
  chemically synthesized
gaaaatcatgtgtgatctct

SEQ ID NO: 11178 - DNA, 20 bp, Artificial Sequence
  chemically synthesized
aatcatgtgtgatctctcag

SEQ ID NO: 11179 - DNA, 20 bp, Artificial Sequence
  chemically synthesized
tgtgtgatctctcagcagaa

SEQ ID NO: 11180 - DNA, 20 bp, Artificial Sequence
  chemically synthesized
tttattatttgtattgcttg

SEQ ID NO: 11181 - DNA, 20 bp, Artificial Sequence
  chemically synthesized
tttgtattgcttgcagaata

SEQ ID NO: 11182 - DNA, 20 bp, Artificial Sequence
  chemically synthesized
agaataaagcctatccttga

SEQ ID NO: 11183 - DNA, 20 bp, Artificial Sequence
  chemically synthesized
tccttgaaagctctgaatca

SEQ ID NO: 11184 - DNA, 20 bp, Artificial Sequence
  chemically synthesized
ccttgaaagctctgaatcat

SEQ ID NO: 11185 - DNA, 20 bp, Artificial Sequence
  chemically synthesized
tgaaagctctgaatcatggg

SEQ ID NO: 11186 - DNA, 20 bp, Artificial Sequence
  chemically synthesized
agctctgaatcatgggcagt

SEQ ID NO: 11187 - DNA, 20 bp, Artificial Sequence
  chemically synthesized
tgaatcatgggcagtgagct

SEQ ID NO: 11188 - DNA, 20 bp, Artificial Sequence
  chemically synthesized
atcatgggcagtgagctcag

SEQ ID NO: 11189 - DNA, 20 bp, Artificial Sequence
  chemically synthesized
gcagtgagctcagtggtatc

SEQ ID NO: 11190 - DNA, 20 bp, Artificial Sequence
  chemically synthesized
agtgagctcagtggtatctg

SEQ ID NO: 11191 - DNA, 20 bp, Artificial Sequence
  chemically synthesized
gtgagctcagtggtatctgg

SEQ ID NO: 11192 - DNA, 20 bp, Artificial Sequence
  chemically synthesized
gctcagtggtatctggagga

SEQ ID NO: 11193 - DNA, 20 bp, Artificial Sequence
  chemically synthesized
ctcagtggtatctggaggac

SEQ ID NO: 11194 - DNA, 20 bp, Artificial Sequence
  chemically synthesized
tcagtggtatctggaggaca

SEQ ID NO: 11195 - DNA, 20 bp, Artificial Sequence
  chemically synthesized
gtatctggaggacagggcac

SEQ ID NO: 11196 - DNA, 20 bp, Artificial Sequence
  chemically synthesized
ggacagggcactggccactg

SEQ ID NO: 11197 - DNA, 20 bp, Artificial Sequence
  chemically synthesized
ctgcagtcaccatcttctgc

SEQ ID NO: 11198 - DNA, 20 bp, Artificial Sequence
  chemically synthesized
tgcagtcaccatcttctgcc

SEQ ID NO: 11199 - DNA, 20 bp, Artificial Sequence
  chemically synthesized
agtcaccatcttctgccagg

SEQ ID NO: 11200 - DNA, 20 bp, Artificial Sequence
  chemically synthesized
ctgccaggaagcctgcacct

SEQ ID NO: 11201 - DNA, 20 bp, Artificial Sequence
  chemically synthesized
tgccaggaagcctgcacctc

SEQ ID NO: 11202 - DNA, 20 bp, Artificial Sequence
  chemically synthesized
gccaggaagcctgcacctca

SEQ ID NO: 11203 - DNA, 20 bp, Artificial Sequence
  chemically synthesized
ccaggaagcctgcacctcag

SEQ ID NO: 11204 - DNA, 20 bp, Artificial Sequence
  chemically synthesized
gggtgaattctttgccgaaa

SEQ ID NO: 11205 - DNA, 20 bp, Artificial Sequence
  chemically synthesized
gccgaaatggattgccaaaa

SEQ ID NO: 11206 - DNA, 20 bp, Artificial Sequence
  chemically synthesized
tggattgccaaaacggtcac

SEQ ID NO: 11207 - DNA, 20 bp, Artificial Sequence
  chemically synthesized
acggtcaccagcacatttcc

SEQ ID NO: 11208 - DNA, 20 bp, Artificial Sequence
  chemically synthesized
cggtcaccagcacatttccc

SEQ ID NO: 11209 - DNA, 20 bp, Artificial Sequence
  chemically synthesized
gtcaccagcacatttcccag

SEQ ID NO: 11210 - DNA, 20 bp, Artificial Sequence
  chemically synthesized
cacatttcccaggagctgtt

SEQ ID NO: 11211 - DNA, 20 bp, Artificial Sequence
  chemically synthesized
cccaggagctgttgagatga

SEQ ID NO: 11212 - DNA, 20 bp, Artificial Sequence
  chemically synthesized
ccaggagctgttgagatgaa

SEQ ID NO: 11213 - DNA, 20 bp, Artificial Sequence
  chemically synthesized
aggagctgttgagatgaaag

SEQ ID NO: 11214 - DNA, 20 bp, Artificial Sequence
  chemically synthesized
tgagatgaaaggagacaata

SEQ ID NO: 11215 - DNA, 20 bp, Artificial Sequence
  chemically synthesized
agacaataaagatgaaccca

SEQ ID NO: 11216 - DNA, 20 bp, Artificial Sequence
  chemically synthesized
aataaagatgaacccatagt

SEQ ID NO: 11217 - DNA, 20 bp, Artificial Sequence
  chemically synthesized
agatgaacccatagtgagct

SEQ ID NO: 11218 - DNA, 20 bp, Artificial Sequence
  chemically synthesized
atgaacccatagtgagctga

SEQ ID NO: 11219 - DNA, 20 bp, Artificial Sequence
  chemically synthesized
ccatagtgagctgagagctc

SEQ ID NO: 11220 - DNA, 20 bp, Artificial Sequence
  chemically synthesized
gtgagctgagagctccagcc

SEQ ID NO: 11221 - DNA, 20 bp, Artificial Sequence
  chemically synthesized
gagagctccagcctggcctc

SEQ ID NO: 11222 - DNA, 20 bp, Artificial Sequence
  chemically synthesized
cctccagataactacacacc

SEQ ID NO: 11223 - DNA, 20 bp, Artificial Sequence
  chemically synthesized
ctacacaccaagcttccacc

SEQ ID NO: 11224 - DNA, 20 bp, Artificial Sequence
  chemically synthesized
ccaagcttccacccagaatc

SEQ ID NO: 11225 - DNA, 20 bp, Artificial Sequence
  chemically synthesized
gcctatgttaacttccctca

SEQ ID NO: 11226 - DNA, 20 bp, Artificial Sequence
  chemically synthesized
gttaacttccctcaaagcct

SEQ ID NO: 11227 - DNA, 20 bp, Artificial Sequence
  chemically synthesized
ttttgccttcccattaaatg

SEQ ID NO: 11228 - DNA, 20 bp, Artificial Sequence
  chemically synthesized
tttgccttcccattaaatgc

SEQ ID NO: 11229 - DNA, 20 bp, Artificial Sequence
  chemically synthesized
gccttcccattaaatgcagg

SEQ ID NO: 11230 - DNA, 20 bp, Artificial Sequence
  chemically synthesized
gcaggtagttgttccccttc

SEQ ID NO: 11231 - DNA, 20 bp, Artificial Sequence
  chemically synthesized
agttgttccccttcaagcac

SEQ ID NO: 11232 - DNA, 20 bp, Artificial Sequence
  chemically synthesized
ccccttcaagcactagtcac

SEQ ID NO: 11233 - DNA, 20 bp, Artificial Sequence
  chemically synthesized
accatgaaccctgtatgttg

SEQ ID NO: 11234 - DNA, 20 bp, Artificial Sequence
  chemically synthesized
ccatgaaccctgtatgttgt

SEQ ID NO: 11235 - DNA, 20 bp, Artificial Sequence
  chemically synthesized
accctgtatgttgtaggctg

SEQ ID NO: 11236 - DNA, 20 bp, Artificial Sequence
  chemically synthesized
ttgtaggctgaagacgttaa

SEQ ID NO: 11237 - DNA, 20 bp, Artificial Sequence
  chemically synthesized
cgcacacacacacacacaca

SEQ ID NO: 11238 - DNA, 20 bp, Artificial Sequence
  chemically synthesized
cacacacacacacacacaca

SEQ ID NO: 11239 - DNA, 20 bp, Artificial Sequence
  chemically synthesized
ctgactttcaaaatctactc

SEQ ID NO: 11240 - DNA, 20 bp, Artificial Sequence
  chemically synthesized
tttcaattgttcctcacccc

SEQ ID NO: 11241 - DNA, 20 bp, Artificial Sequence
  chemically synthesized
ggacatactttgcccccatc

SEQ ID NO: 11242 - DNA, 20 bp, Artificial Sequence
  chemically synthesized
tttgcccccatctggaatta

SEQ ID NO: 11243 - DNA, 20 bp, Artificial Sequence
  chemically synthesized
ttgcccccatctggaattaa

SEQ ID NO: 11244 - DNA, 20 bp, Artificial Sequence
  chemically synthesized
catctggaattaaaggatat

SEQ ID NO: 11245 - DNA, 20 bp, Artificial Sequence
  chemically synthesized
aaggatataagtttgtaatg

SEQ ID NO: 11246 - DNA, 20 bp, Artificial Sequence
  chemically synthesized
ataagtttgtaatgaagcat

SEQ ID NO: 11247 - DNA, 20 bp, Artificial Sequence
  chemically synthesized
agtttgtaatgaagcattag

SEQ ID NO: 11248 - DNA, 20 bp, Artificial Sequence
  chemically synthesized
agcagcattttatatgtgtc

SEQ ID NO: 11249 - DNA, 20 bp, Artificial Sequence
  chemically synthesized
ttatatgtgtccagctgata

SEQ ID NO: 11250 - DNA, 20 bp, Artificial Sequence
  chemically synthesized
tatatgtgtccagctgatat

SEQ ID NO: 11251 - DNA, 20 bp, Artificial Sequence
  chemically synthesized
gtgtccagctgatataggaa

SEQ ID NO: 11252 - DNA, 20 bp, Artificial Sequence
  chemically synthesized
agctgatataggaatagcct

SEQ ID NO: 11253 - DNA, 20 bp, Artificial Sequence
  chemically synthesized
tagccttagcaatgtatgtt

SEQ ID NO: 11254 - DNA, 20 bp, Artificial Sequence
  chemically synthesized
caatgtatgtttggccacca

SEQ ID NO: 11255 - DNA, 20 bp, Artificial Sequence
  chemically synthesized
caaagttccccactttgact

SEQ ID NO: 11256 - DNA, 20 bp, Artificial Sequence
  chemically synthesized
gaccatacttgtcctgcctc

SEQ ID NO: 11257 - DNA, 20 bp, Artificial Sequence
  chemically synthesized
atacttgtcctgcctccaga

SEQ ID NO: 11258 - DNA, 20 bp, Artificial Sequence
  chemically synthesized
tgttttaaaacaacaaaaat

SEQ ID NO: 11259 - DNA, 20 bp, Artificial Sequence
  chemically synthesized
gttttaaaacaacaaaaatg

SEQ ID NO: 11260 - DNA, 20 bp, Artificial Sequence
  chemically synthesized
ttttaaaacaacaaaaatga

SEQ ID NO: 11261 - DNA, 20 bp, Artificial Sequence
  chemically synthesized
aaaacaacaaaaatgaggga

SEQ ID NO: 11262 - DNA, 20 bp, Artificial Sequence
  chemically synthesized
caaaaatgagggaaagatga

SEQ ID NO: 11263 - DNA, 20 bp, Artificial Sequence
  chemically synthesized
aagatgaaagttctttctac

SEQ ID NO: 11264 - DNA, 20 bp, Artificial Sequence
  chemically synthesized
ctttctactggaatctaata

SEQ ID NO: 11265 - DNA, 20 bp, Artificial Sequence
  chemically synthesized
tactggaatctaataaagaa

SEQ ID NO: 11266 - DNA, 20 bp, Artificial Sequence
  chemically synthesized
tttccacctctcttttctca

SEQ ID NO: 11267 - DNA, 20 bp, Artificial Sequence
  chemically synthesized
caaagtcaaaattgtccatc

SEQ ID NO: 11268 - DNA, 20 bp, Artificial Sequence
  chemically synthesized
aaattgtccatctagatttt

SEQ ID NO: 11269 - DNA, 20 bp, Artificial Sequence
  chemically synthesized
attgtccatctagattttta

SEQ ID NO: 11270 - DNA, 20 bp, Artificial Sequence
  chemically synthesized
ttgtccatctagatttttag

SEQ ID NO: 11271 - DNA, 20 bp, Artificial Sequence
  chemically synthesized
agatttttagaggcactcct

SEQ ID NO: 11272 - DNA, 20 bp, Artificial Sequence
  chemically synthesized
gatttttagaggcactcctt

SEQ ID NO: 11273 - DNA, 20 bp, Artificial Sequence
  chemically synthesized
aggccctaaaacattaccac

SEQ ID NO: 11274 - DNA, 20 bp, Artificial Sequence
  chemically synthesized
ggccctaaaacattaccact

SEQ ID NO: 11275 - DNA, 20 bp, Artificial Sequence
  chemically synthesized
aaaacattaccactgggtct

SEQ ID NO: 11276 - DNA, 20 bp, Artificial Sequence
  chemically synthesized
attaccactgggtctcagcc

SEQ ID NO: 11277 - DNA, 20 bp, Artificial Sequence
  chemically synthesized
ccactgggtctcagcccagt

SEQ ID NO: 11278 - DNA, 20 bp, Artificial Sequence
  chemically synthesized
tcagcccagttagtcctctg

SEQ ID NO: 11279 - DNA, 20 bp, Artificial Sequence
  chemically synthesized
agtttcttcacccccaaccc

SEQ ID NO: 11280 - DNA, 20 bp, Artificial Sequence
  chemically synthesized
ccaaccccagtatcttcaaa

SEQ ID NO: 11281 - DNA, 20 bp, Artificial Sequence
  chemically synthesized
agctcacaccctgctgtgct

SEQ ID NO: 11282 - DNA, 20 bp, Artificial Sequence
  chemically synthesized
agatcaatactccgttgtct

SEQ ID NO: 11283 - DNA, 20 bp, Artificial Sequence
  chemically synthesized
tccgttgtctaagttgcctc

SEQ ID NO: 11284 - DNA, 20 bp, Artificial Sequence
  chemically synthesized
tctaagttgcctcgagacta

SEQ ID NO: 11285 - DNA, 20 bp, Artificial Sequence
  chemically synthesized
ctaagttgcctcgagactaa

SEQ ID NO: 11286 - DNA, 20 bp, Artificial Sequence
  chemically synthesized
tgcctcgagactaaaggcaa

SEQ ID NO: 11287 - DNA, 20 bp, Artificial Sequence
  chemically synthesized
gcctcgagactaaaggcaac

SEQ ID NO: 11288 - DNA, 20 bp, Artificial Sequence
  chemically synthesized
cctcgagactaaaggcaaca

SEQ ID NO: 11289 - DNA, 20 bp, Artificial Sequence
  chemically synthesized
aacagggctgaaacatctcc

SEQ ID NO: 11290 - DNA, 20 bp, Artificial Sequence
  chemically synthesized
catctcctggactcaccttg

SEQ ID NO: 11291 - DNA, 20 bp, Artificial Sequence
  chemically synthesized
tggactcaccttgaagttct

SEQ ID NO: 11292 - DNA, 20 bp, Artificial Sequence
  chemically synthesized
ggactcaccttgaagttctc

SEQ ID NO: 11293 - DNA, 20 bp, Artificial Sequence
  chemically synthesized
aagttctcaggatccacatg

SEQ ID NO: 11294 - DNA, 20 bp, Artificial Sequence
  chemically synthesized
gatccacatgcagcttgtca

SEQ ID NO: 11295 - DNA, 20 bp, Artificial Sequence
  chemically synthesized
acatgcagcttgtcacagtg

SEQ ID NO: 11296 - DNA, 20 bp, Artificial Sequence
  chemically synthesized
ttgtcacagtgcagttcact

SEQ ID NO: 11297 - DNA, 20 bp, Artificial Sequence
  chemically synthesized
cacagtgcagttcactcagc

SEQ ID NO: 11298 - DNA, 20 bp, Artificial Sequence
  chemically synthesized
acagtgcagttcactcagct

SEQ ID NO: 11299 - DNA, 20 bp, Artificial Sequence
  chemically synthesized
gcagttcactcagctgggca

SEQ ID NO: 11300 - DNA, 20 bp, Artificial Sequence
  chemically synthesized
cagttcactcagctgggcaa

SEQ ID NO: 11301 - DNA, 20 bp, Artificial Sequence
  chemically synthesized
agctgggcaaaggtgccctt

SEQ ID NO: 11302 - DNA, 20 bp, Artificial Sequence
  chemically synthesized
aaggtgcccttgagatcatc

SEQ ID NO: 11303 - DNA, 20 bp, Artificial Sequence
  chemically synthesized
aggtgcccttgagatcatcc

SEQ ID NO: 11304 - DNA, 20 bp, Artificial Sequence
  chemically synthesized
gagatcatccaggtgctttg

SEQ ID NO: 11305 - DNA, 20 bp, Artificial Sequence
  chemically synthesized
ggtgctttgtggcatctccc

SEQ ID NO: 11306 - DNA, 20 bp, Artificial Sequence
  chemically synthesized
gtgctttgtggcatctccca

SEQ ID NO: 11307 - DNA, 20 bp, Artificial Sequence
  chemically synthesized
ctttgtggcatctcccaagg

SEQ ID NO: 11308 - DNA, 20 bp, Artificial Sequence
  chemically synthesized
gtggcatctcccaaggaagt

SEQ ID NO: 11309 - DNA, 20 bp, Artificial Sequence
  chemically synthesized
cttgccatgtgccttgactt

SEQ ID NO: 11310 - DNA, 20 bp, Artificial Sequence
  chemically synthesized
ttgccatgtgccttgacttt

SEQ ID NO: 11311 - DNA, 20 bp, Artificial Sequence
  chemically synthesized
tgccatgtgccttgactttg

SEQ ID NO: 11312 - DNA, 20 bp, Artificial Sequence
  chemically synthesized
gactttggggttgcccatga

SEQ ID NO: 11313 - DNA, 20 bp, Artificial Sequence
  chemically synthesized
tttggggttgcccatgatgg

SEQ ID NO: 11314 - DNA, 20 bp, Artificial Sequence
  chemically synthesized
tggggttgcccatgatggca

SEQ ID NO: 11315 - DNA, 20 bp, Artificial Sequence
  chemically synthesized
ggggttgcccatgatggcag

SEQ ID NO: 11316 - DNA, 20 bp, Artificial Sequence
  chemically synthesized
gttgcccatgatggcagagg

SEQ ID NO: 11317 - DNA, 20 bp, Artificial Sequence
  chemically synthesized
tgcccatgatggcagaggca

SEQ ID NO: 11318 - DNA, 20 bp, Artificial Sequence
  chemically synthesized
gcccatgatggcagaggcag

SEQ ID NO: 11319 - DNA, 20 bp, Artificial Sequence
  chemically synthesized
atgatggcagaggcagagga

SEQ ID NO: 11320 - DNA, 20 bp, Artificial Sequence
  chemically synthesized
tgatggcagaggcagaggac

SEQ ID NO: 11321 - DNA, 20 bp, Artificial Sequence
  chemically synthesized
aggcagaggacaggttgcca

SEQ ID NO: 11322 - DNA, 20 bp, Artificial Sequence
  chemically synthesized
acaggttgccaaagctgtca

SEQ ID NO: 11323 - DNA, 20 bp, Artificial Sequence
  chemically synthesized
caaagctgtcaaagaacctc

SEQ ID NO: 11324 - DNA, 20 bp, Artificial Sequence
  chemically synthesized
aaagctgtcaaagaacctct

SEQ ID NO: 11325 - DNA, 20 bp, Artificial Sequence
  chemically synthesized
tcaaagaacctctgggtcca

SEQ ID NO: 11326 - DNA, 20 bp, Artificial Sequence
  chemically synthesized
caaagaacctctgggtccat

SEQ ID NO: 11327 - DNA, 20 bp, Artificial Sequence
  chemically synthesized
agaacctctgggtccatggg

SEQ ID NO: 11328 - DNA, 20 bp, Artificial Sequence
  chemically synthesized
tgggtccatgggtagacaac

SEQ ID NO: 11329 - DNA, 20 bp, Artificial Sequence
  chemically synthesized
gggtccatgggtagacaacc

SEQ ID NO: 11330 - DNA, 20 bp, Artificial Sequence
  chemically synthesized
gtccatgggtagacaaccag

SEQ ID NO: 11331 - DNA, 20 bp, Artificial Sequence
  chemically synthesized
gtagacaaccaggagcctgt

SEQ ID NO: 11332 - DNA, 20 bp, Artificial Sequence
  chemically synthesized
caggagcctgtgagattgac

SEQ ID NO: 11333 - DNA, 20 bp, Artificial Sequence
  chemically synthesized
gcctgtgagattgacaagaa

SEQ ID NO: 11334 - DNA, 20 bp, Artificial Sequence
  chemically synthesized
gattgacaagaacagtttga

SEQ ID NO: 11335 - DNA, 20 bp, Artificial Sequence
  chemically synthesized
gacaagaacagtttgacagt

SEQ ID NO: 11336 - DNA, 20 bp, Artificial Sequence
  chemically synthesized
aagaacagtttgacagtcag

SEQ ID NO: 11337 - DNA, 20 bp, Artificial Sequence
  chemically synthesized
agaacagtttgacagtcaga

SEQ ID NO: 11338 - DNA, 20 bp, Artificial Sequence
  chemically synthesized
cagaaggtgccacaaatcct

SEQ ID NO: 11339 - DNA, 20 bp, Artificial Sequence
  chemically synthesized
aaggtgccacaaatcctgag

SEQ ID NO: 11340 - DNA, 20 bp, Artificial Sequence
  chemically synthesized
acaaatcctgagaagcgacc

SEQ ID NO: 11341 - DNA, 20 bp, Artificial Sequence
  chemically synthesized
gaagcgacctggacttttgc

SEQ ID NO: 11342 - DNA, 20 bp, Artificial Sequence
  chemically synthesized
aagcgacctggacttttgcc

SEQ ID NO: 11343 - DNA, 20 bp, Artificial Sequence
  chemically synthesized
acctggacttttgccaggca

SEQ ID NO: 11344 - DNA, 20 bp, Artificial Sequence
  chemically synthesized
cctggacttttgccaggcac

SEQ ID NO: 11345 - DNA, 20 bp, Artificial Sequence
  chemically synthesized
ctggacttttgccaggcaca

SEQ ID NO: 11346 - DNA, 20 bp, Artificial Sequence
  chemically synthesized
cttccttccctcccttgtcc

SEQ ID NO: 11347 - DNA, 20 bp, Artificial Sequence
  chemically synthesized
ccctcccttgtcctggtcac

SEQ ID NO: 11348 - DNA, 20 bp, Artificial Sequence
  chemically synthesized
ctcccttgtcctggtcacca

SEQ ID NO: 11349 - DNA, 20 bp, Artificial Sequence
  chemically synthesized
gtcaccagagcctaccttcc

SEQ ID NO: 11350 - DNA, 20 bp, Artificial Sequence
  chemically synthesized
tcaccagagcctaccttccc

SEQ ID NO: 11351 - DNA, 20 bp, Artificial Sequence
  chemically synthesized
caccagagcctaccttccca

SEQ ID NO: 11352 - DNA, 20 bp, Artificial Sequence
  chemically synthesized
ccttcccagggtttctcctc

SEQ ID NO: 11353 - DNA, 20 bp, Artificial Sequence
  chemically synthesized
tccacattcaccttgcccca

SEQ ID NO: 11354 - DNA, 20 bp, Artificial Sequence
  chemically synthesized
ccacattcaccttgccccac

SEQ ID NO: 11355 - DNA, 20 bp, Artificial Sequence
  chemically synthesized
cttgccccacaggcttgtga

SEQ ID NO: 11356 - DNA, 20 bp, Artificial Sequence
  chemically synthesized
gccccacaggcttgtgatag

SEQ ID NO: 11357 - DNA, 20 bp, Artificial Sequence
  chemically synthesized
ctcctctgtgaaatgaccca

SEQ ID NO: 11358 - DNA, 20 bp, Artificial Sequence
  chemically synthesized
gtgaaatgacccatggcgtc

SEQ ID NO: 11359 - DNA, 20 bp, Artificial Sequence
  chemically synthesized
atgacccatggcgtctggac

SEQ ID NO: 11360 - DNA, 20 bp, Artificial Sequence
  chemically synthesized
tgacccatggcgtctggact

SEQ ID NO: 11361 - DNA, 20 bp, Artificial Sequence
  chemically synthesized
acccatggcgtctggactag

SEQ ID NO: 11362 - DNA, 20 bp, Artificial Sequence
  chemically synthesized
taggagcttattgataacct

SEQ ID NO: 11363 - DNA, 20 bp, Artificial Sequence
  chemically synthesized
attgataacctcagacgttc

SEQ ID NO: 11364 - DNA, 20 bp, Artificial Sequence
  chemically synthesized
gataacctcagacgttccag

SEQ ID NO: 11365 - DNA, 20 bp, Artificial Sequence
  chemically synthesized
acctcagacgttccagaagc

SEQ ID NO: 11366 - DNA, 20 bp, Artificial Sequence
  chemically synthesized
acgttccagaagcgagtgtg

SEQ ID NO: 11367 - DNA, 20 bp, Artificial Sequence
  chemically synthesized
gcgagtgtgtggaactgctg

SEQ ID NO: 11368 - DNA, 20 bp, Artificial Sequence
  chemically synthesized
cgagtgtgtggaactgctga

SEQ ID NO: 11369 - DNA, 20 bp, Artificial Sequence
  chemically synthesized
gagtgtgtggaactgctgaa

SEQ ID NO: 11370 - DNA, 20 bp, Artificial Sequence
  chemically synthesized
ttccttttattcttcatccc

SEQ ID NO: 11371 - DNA, 20 bp, Artificial Sequence
  chemically synthesized
ttttattcttcatccctagc

SEQ ID NO: 11372 - DNA, 20 bp, Artificial Sequence
  chemically synthesized
cttcatccctagccagccgc

SEQ ID NO: 11373 - DNA, 20 bp, Artificial Sequence
  chemically synthesized
cctagccagccgccggcccc

SEQ ID NO: 11374 - DNA, 20 bp, Artificial Sequence
  chemically synthesized
ccgccggcccctggcctcac

SEQ ID NO: 11375 - DNA, 20 bp, Artificial Sequence
  chemically synthesized
ctggcctcactggatactct

SEQ ID NO: 11376 - DNA, 20 bp, Artificial Sequence
  chemically synthesized
actggatactctaagactat

SEQ ID NO: 11377 - DNA, 20 bp, Artificial Sequence
  chemically synthesized
atactctaagactattggtc

SEQ ID NO: 11378 - DNA, 20 bp, Artificial Sequence
  chemically synthesized
ttggtcaagtttgccttgtc

SEQ ID NO: 11379 - DNA, 20 bp, Artificial Sequence
  chemically synthesized
tggtcaagtttgccttgtca

SEQ ID NO: 11380 - DNA, 20 bp, Artificial Sequence
  chemically synthesized
gtttgccttgtcaaggctat

SEQ ID NO: 11381 - DNA, 20 bp, Artificial Sequence
  chemically synthesized
ccttgtcaaggctattggtc

SEQ ID NO: 11382 - DNA, 20 bp, Artificial Sequence
  chemically synthesized
cttgtcaaggctattggtca

SEQ ID NO: 11383 - DNA, 20 bp, Artificial Sequence
  chemically synthesized
tcaaggctattggtcaaggc

SEQ ID NO: 11384 - DNA, 20 bp, Artificial Sequence
  chemically synthesized
caaggctattggtcaaggca

SEQ ID NO: 11385 - DNA, 20 bp, Artificial Sequence
  chemically synthesized
gctattggtcaaggcaaggc

SEQ ID NO: 11386 - DNA, 20 bp, Artificial Sequence
  chemically synthesized
aggcaaggctggccaaccca

SEQ ID NO: 11387 - DNA, 20 bp, Artificial Sequence
  chemically synthesized
ggcaaggctggccaacccat

SEQ ID NO: 11388 - DNA, 20 bp, Artificial Sequence
  chemically synthesized
aaggctggccaacccatggg

SEQ ID NO: 11389 - DNA, 20 bp, Artificial Sequence
  chemically synthesized
ggctggccaacccatgggtg

SEQ ID NO: 11390 - DNA, 20 bp, Artificial Sequence
  chemically synthesized
gccaacccatgggtggagtt

SEQ ID NO: 11391 - DNA, 20 bp, Artificial Sequence
  chemically synthesized
acccatgggtggagtttagc

SEQ ID NO: 11392 - DNA, 20 bp, Artificial Sequence
  chemically synthesized
cccatgggtggagtttagcc

SEQ ID NO: 11393 - DNA, 20 bp, Artificial Sequence
  chemically synthesized
ccatgggtggagtttagcca

SEQ ID NO: 11394 - DNA, 20 bp, Artificial Sequence
  chemically synthesized
agtttagccagggaccgttt

SEQ ID NO: 11395 - DNA, 20 bp, Artificial Sequence
  chemically synthesized
tagccagggaccgtttcaga

SEQ ID NO: 11396 - DNA, 20 bp, Artificial Sequence
  chemically synthesized
ttcagacagatatttgcatt

SEQ ID NO: 11397 - DNA, 20 bp, Artificial Sequence
  chemically synthesized
gacagatatttgcattgaga

SEQ ID NO: 11398 - DNA, 20 bp, Artificial Sequence
  chemically synthesized
atatttgcattgagatagtg

SEQ ID NO: 11399 - DNA, 20 bp, Artificial Sequence
  chemically synthesized
tatttgcattgagatagtgt

SEQ ID NO: 11400 - DNA, 20 bp, Artificial Sequence
  chemically synthesized
atttgcattgagatagtgtg

SEQ ID NO: 11401 - DNA, 20 bp, Artificial Sequence
  chemically synthesized
tgcattgagatagtgtgggg

SEQ ID NO: 11402 - DNA, 20 bp, Artificial Sequence
  chemically synthesized
gcattgagatagtgtgggga

SEQ ID NO: 11403 - DNA, 20 bp, Artificial Sequence
  chemically synthesized
cattgagatagtgtggggaa

SEQ ID NO: 11404 - DNA, 20 bp, Artificial Sequence
  chemically synthesized
attgagatagtgtggggaag

SEQ ID NO: 11405 - DNA, 20 bp, Artificial Sequence
  chemically synthesized
agtgtggggaaggggccccc

SEQ ID NO: 11406 - DNA, 20 bp, Artificial Sequence
  chemically synthesized
tgtggggaaggggcccccaa

SEQ ID NO: 11407 - DNA, 20 bp, Artificial Sequence
  chemically synthesized
gtggggaaggggcccccaag

SEQ ID NO: 11408 - DNA, 20 bp, Artificial Sequence
  chemically synthesized
gatactgctaatttttttta

SEQ ID NO: 11409 - DNA, 20 bp, Artificial Sequence
  chemically synthesized
gcctttgccttgttccgatt

SEQ ID NO: 11410 - DNA, 20 bp, Artificial Sequence
  chemically synthesized
ttgttccgattcagtcattc

SEQ ID NO: 11411 - DNA, 20 bp, Artificial Sequence
  chemically synthesized
ctctaatttattcttccctt

SEQ ID NO: 11412 - DNA, 20 bp, Artificial Sequence
  chemically synthesized
aatttattcttccctttagc

SEQ ID NO: 11413 - DNA, 20 bp, Artificial Sequence
  chemically synthesized
ctagtttccttctcccatca

SEQ ID NO: 11414 - DNA, 20 bp, Artificial Sequence
  chemically synthesized
agtttccttctcccatcata

SEQ ID NO: 11415 - DNA, 20 bp, Artificial Sequence
  chemically synthesized
gtttccttctcccatcatag

SEQ ID NO: 11416 - DNA, 20 bp, Artificial Sequence
  chemically synthesized
tctcccatcatagaggatac

SEQ ID NO: 11417 - DNA, 20 bp, Artificial Sequence
  chemically synthesized
ctcccatcatagaggatacc

SEQ ID NO: 11418 - DNA, 20 bp, Artificial Sequence
  chemically synthesized
gataccaggacttcttttgt

SEQ ID NO: 11419 - DNA, 20 bp, Artificial Sequence
  chemically synthesized
gttttttaccttcttgtctc

SEQ ID NO: 11420 - DNA, 20 bp, Artificial Sequence
  chemically synthesized
taccttcttgtctctagctc

SEQ ID NO: 11421 - DNA, 20 bp, Artificial Sequence
  chemically synthesized
ttcttgtctctagctccagt

SEQ ID NO: 11422 - DNA, 20 bp, Artificial Sequence
  chemically synthesized
tcttgtctctagctccagtg

SEQ ID NO: 11423 - DNA, 20 bp, Artificial Sequence
  chemically synthesized
tctagctccagtgaggcctg

SEQ ID NO: 11424 - DNA, 20 bp, Artificial Sequence
  chemically synthesized
ccagtgaggcctgtagttta

SEQ ID NO: 11425 - DNA, 20 bp, Artificial Sequence
  chemically synthesized
aggcctgtagtttaaagcta

SEQ ID NO: 11426 - DNA, 20 bp, Artificial Sequence
  chemically synthesized
agcatgtaccaatttttgaa

SEQ ID NO: 11427 - DNA, 20 bp, Artificial Sequence
  chemically synthesized
gtaccaatttttgaaaagtt

SEQ ID NO: 11428 - DNA, 20 bp, Artificial Sequence
  chemically synthesized
taccaatttttgaaaagttc

SEQ ID NO: 11429 - DNA, 20 bp, Artificial Sequence
  chemically synthesized
accaatttttgaaaagttca

SEQ ID NO: 11430 - DNA, 20 bp, Artificial Sequence
  chemically synthesized
agggattgtgaaatgtgttt

SEQ ID NO: 11431 - DNA, 20 bp, Artificial Sequence
  chemically synthesized
gggattgtgaaatgtgtttt

SEQ ID NO: 11432 - DNA, 20 bp, Artificial Sequence
  chemically synthesized
tgtgaaatgtgttttaggca

SEQ ID NO: 11433 - DNA, 20 bp, Artificial Sequence
  chemically synthesized
gtgaaatgtgttttaggcat

SEQ ID NO: 11434 - DNA, 20 bp, Artificial Sequence
  chemically synthesized
atgtgttttaggcataggtc

SEQ ID NO: 11435 - DNA, 20 bp, Artificial Sequence
  chemically synthesized
tgtgttttaggcataggtcc

SEQ ID NO: 11436 - DNA, 20 bp, Artificial Sequence
  chemically synthesized
cataggtccaggatttttga

SEQ ID NO: 11437 - DNA, 20 bp, Artificial Sequence
  chemically synthesized
ataggtccaggatttttgac

SEQ ID NO: 11438 - DNA, 20 bp, Artificial Sequence
  chemically synthesized
atttttgacgggacaaatct

SEQ ID NO: 11439 - DNA, 20 bp, Artificial Sequence
  chemically synthesized
ggacaaatcttagtctcttt

SEQ ID NO: 11440 - DNA, 20 bp, Artificial Sequence
  chemically synthesized
aaatcttagtctctttcagt

SEQ ID NO: 11441 - DNA, 20 bp, Artificial Sequence
  chemically synthesized
tcttagtctctttcagttag

SEQ ID NO: 11442 - DNA, 20 bp, Artificial Sequence
  chemically synthesized
tagtctctttcagttagcag

SEQ ID NO: 11443 - DNA, 20 bp, Artificial Sequence
  chemically synthesized
ttcagttagcagtggtttct

SEQ ID NO: 11444 - DNA, 20 bp, Artificial Sequence
  chemically synthesized
tcagttagcagtggtttcta

SEQ ID NO: 11445 - DNA, 20 bp, Artificial Sequence
  chemically synthesized
agcagtggtttctaaggaaa

SEQ ID NO: 11446 - DNA, 20 bp, Artificial Sequence
  chemically synthesized
attatctcttaatttctcaa

SEQ ID NO: 11447 - DNA, 20 bp, Artificial Sequence
  chemically synthesized
ctcttaatttctcaatagtg

SEQ ID NO: 11448 - DNA, 20 bp, Artificial Sequence
  chemically synthesized
cagtgaaaacaatttctata

SEQ ID NO: 11449 - DNA, 20 bp, Artificial Sequence
  chemically synthesized
aaacaatttctataaagcca

SEQ ID NO: 11450 - DNA, 20 bp, Artificial Sequence
  chemically synthesized
tttctataaagccacagttt

SEQ ID NO: 11451 - DNA, 20 bp, Artificial Sequence
  chemically synthesized
ataaagccacagtttcagcg

SEQ ID NO: 11452 - DNA, 20 bp, Artificial Sequence
  chemically synthesized
ccacagtttcagcgcagtaa

SEQ ID NO: 11453 - DNA, 20 bp, Artificial Sequence
  chemically synthesized
gtttcagcgcagtaatagat

SEQ ID NO: 11454 - DNA, 20 bp, Artificial Sequence
  chemically synthesized
agattagtgttacataatat

SEQ ID NO: 11455 - DNA, 20 bp, Artificial Sequence
  chemically synthesized
aaatcatgactgtttcatct

SEQ ID NO: 11456 - DNA, 20 bp, Artificial Sequence
  chemically synthesized
aaaatatttgattccatatt

SEQ ID NO: 11457 - DNA, 20 bp, Artificial Sequence
  chemically synthesized
aaatatttgattccatattc

SEQ ID NO: 11458 - DNA, 20 bp, Artificial Sequence
  chemically synthesized
tcaggtatgtatgtatacac

SEQ ID NO: 11459 - DNA, 20 bp, Artificial Sequence
  chemically synthesized
agatgatgtgtatttaccac

SEQ ID NO: 11460 - DNA, 20 bp, Artificial Sequence
  chemically synthesized
atgtgtatttaccactggat

SEQ ID NO: 11461 - DNA, 20 bp, Artificial Sequence
  chemically synthesized
cactggataagtgtgtgtgc

SEQ ID NO: 11462 - DNA, 20 bp, Artificial Sequence
  chemically synthesized
gtgtgtgctggctgatgacc

SEQ ID NO: 11463 - DNA, 20 bp, Artificial Sequence
  chemically synthesized
tgtgtgctggctgatgaccc

SEQ ID NO: 11464 - DNA, 20 bp, Artificial Sequence
  chemically synthesized
gtgtgctggctgatgaccca

SEQ ID NO: 11465 - DNA, 20 bp, Artificial Sequence
  chemically synthesized
tggctgatgacccagggttt

SEQ ID NO: 11466 - DNA, 20 bp, Artificial Sequence
  chemically synthesized
gatgacccagggttttggcg

SEQ ID NO: 11467 - DNA, 20 bp, Artificial Sequence
  chemically synthesized
tggcgtagctcttctatgct

SEQ ID NO: 11468 - DNA, 20 bp, Artificial Sequence
  chemically synthesized
tagctcttctatgctcagta

SEQ ID NO: 11469 - DNA, 20 bp, Artificial Sequence
  chemically synthesized
tctatgctcagtaaagatga

SEQ ID NO: 11470 - DNA, 20 bp, Artificial Sequence
  chemically synthesized
atgctcagtaaagatgatgg

SEQ ID NO: 11471 - DNA, 20 bp, Artificial Sequence
  chemically synthesized
gatgatggtagaatgttctt

SEQ ID NO: 11472 - DNA, 20 bp, Artificial Sequence
  chemically synthesized
gatggtagaatgttctttgg

SEQ ID NO: 11473 - DNA, 20 bp, Artificial Sequence
  chemically synthesized
atggtagaatgttctttggc

SEQ ID NO: 11474 - DNA, 20 bp, Artificial Sequence
  chemically synthesized
atgttctttggcaggtactg

SEQ ID NO: 11475 - DNA, 20 bp, Artificial Sequence
  chemically synthesized
ctttggcaggtactgtggat

SEQ ID NO: 11476 - DNA, 20 bp, Artificial Sequence
  chemically synthesized
taattatcttgtataaatgc

SEQ ID NO: 11477 - DNA, 20 bp, Artificial Sequence
  chemically synthesized
aattatcttgtataaatgct

SEQ ID NO: 11478 - DNA, 20 bp, Artificial Sequence
  chemically synthesized
taaatgctaggttcacttct

SEQ ID NO: 11479 - DNA, 20 bp, Artificial Sequence
  chemically synthesized
aaatgctaggttcacttctc

SEQ ID NO: 11480 - DNA, 20 bp, Artificial Sequence
  chemically synthesized
aatgctaggttcacttctca

SEQ ID NO: 11481 - DNA, 20 bp, Artificial Sequence
  chemically synthesized
ttctcagggaatcttactct

SEQ ID NO: 11482 - DNA, 20 bp, Artificial Sequence
  chemically synthesized
ggaatcttactctaagacat

SEQ ID NO: 11483 - DNA, 20 bp, Artificial Sequence
  chemically synthesized
acataagatgtgcgtgtaca

SEQ ID NO: 11484 - DNA, 20 bp, Artificial Sequence
  chemically synthesized
gtacatggaaaacaactcta

SEQ ID NO: 11485 - DNA, 20 bp, Artificial Sequence
  chemically synthesized
acatggaaaacaactctaaa

SEQ ID NO: 11486 - DNA, 20 bp, Artificial Sequence
  chemically synthesized
catggaaaacaactctaaag

SEQ ID NO: 11487 - DNA, 20 bp, Artificial Sequence
  chemically synthesized
gaaaacaactctaaagaggc

SEQ ID NO: 11488 - DNA, 20 bp, Artificial Sequence
  chemically synthesized
aaaacaactctaaagaggca

SEQ ID NO: 11489 - DNA, 20 bp, Artificial Sequence
  chemically synthesized
aaacaactctaaagaggcaa

SEQ ID NO: 11490 - DNA, 20 bp, Artificial Sequence
  chemically synthesized
gggttgtttttattgactaa

SEQ ID NO: 11491 - DNA, 20 bp, Artificial Sequence
  chemically synthesized
cactattataactcgaatat

SEQ ID NO: 11492 - DNA, 20 bp, Artificial Sequence
  chemically synthesized
actcgaatattagtgtactt

SEQ ID NO: 11493 - DNA, 20 bp, Artificial Sequence
  chemically synthesized
gaatattagtgtactttaga

SEQ ID NO: 11494 - DNA, 20 bp, Artificial Sequence
  chemically synthesized
agacagctttatttctaaca

SEQ ID NO: 11495 - DNA, 20 bp, Artificial Sequence
  chemically synthesized
cagtgctgtttctgacatat

SEQ ID NO: 11496 - DNA, 20 bp, Artificial Sequence
  chemically synthesized
ctgacatattggaccattaa

SEQ ID NO: 11497 - DNA, 20 bp, Artificial Sequence
  chemically synthesized
tgacatattggaccattaac

SEQ ID NO: 11498 - DNA, 20 bp, Artificial Sequence
  chemically synthesized
gacatattggaccattaaca

SEQ ID NO: 11499 - DNA, 20 bp, Artificial Sequence
  chemically synthesized
atattggaccattaacaggg

SEQ ID NO: 11500 - DNA, 20 bp, Artificial Sequence
  chemically synthesized
tattggaccattaacagggt

SEQ ID NO: 11501 - DNA, 20 bp, Artificial Sequence
  chemically synthesized
tggaccattaacagggtagg

SEQ ID NO: 11502 - DNA, 20 bp, Artificial Sequence
  chemically synthesized
aacagggtaggaagtattta

SEQ ID NO: 11503 - DNA, 20 bp, Artificial Sequence
  chemically synthesized
agggtaggaagtatttatgg

SEQ ID NO: 11504 - DNA, 20 bp, Artificial Sequence
  chemically synthesized
aagtatttatggtggttttt

SEQ ID NO: 11505 - DNA, 20 bp, Artificial Sequence
  chemically synthesized
ttttggttctgttttgcttt

SEQ ID NO: 11506 - DNA, 20 bp, Artificial Sequence
  chemically synthesized
ggttctgttttgcttttggt

SEQ ID NO: 11507 - DNA, 20 bp, Artificial Sequence
  chemically synthesized
ttgtttttgtttttctctga

SEQ ID NO: 11508 - DNA, 20 bp, Artificial Sequence
  chemically synthesized
tccatgatctctaaccttgc

SEQ ID NO: 11509 - DNA, 20 bp, Artificial Sequence
  chemically synthesized
accttgctagattataatgc

SEQ ID NO: 11510 - DNA, 20 bp, Artificial Sequence
  chemically synthesized
ttgctagattataatgccag

SEQ ID NO: 11511 - DNA, 20 bp, Artificial Sequence
  chemically synthesized
gattataatgccagaagctc

SEQ ID NO: 11512 - DNA, 20 bp, Artificial Sequence
  chemically synthesized
tgccagaagctctggaattc

SEQ ID NO: 11513 - DNA, 20 bp, Artificial Sequence
  chemically synthesized
gctctggaattctggcttat

SEQ ID NO: 11514 - DNA, 20 bp, Artificial Sequence
  chemically synthesized
tctggaattctggcttatcg

SEQ ID NO: 11515 - DNA, 20 bp, Artificial Sequence
  chemically synthesized
ctggaattctggcttatcgg

SEQ ID NO: 11516 - DNA, 20 bp, Artificial Sequence
  chemically synthesized
aattctggcttatcggaggc

SEQ ID NO: 11517 - DNA, 20 bp, Artificial Sequence
  chemically synthesized
ggcaagctgtatcttcaaat

SEQ ID NO: 11518 - DNA, 20 bp, Artificial Sequence
  chemically synthesized
ttcaaattagtttatcccct

SEQ ID NO: 11519 - DNA, 20 bp, Artificial Sequence
  chemically synthesized
tagtttatcccctaagctat

SEQ ID NO: 11520 - DNA, 20 bp, Artificial Sequence
  chemically synthesized
agtttatcccctaagctatc

SEQ ID NO: 11521 - DNA, 20 bp, Artificial Sequence
  chemically synthesized
gattgaaattattataatat

SEQ ID NO: 11522 - DNA, 20 bp, Artificial Sequence
  chemically synthesized
atccttcatgatcctgtgta

SEQ ID NO: 11523 - DNA, 20 bp, Artificial Sequence
  chemically synthesized
cttatatctgctcattgata

SEQ ID NO: 11524 - DNA, 20 bp, Artificial Sequence
  chemically synthesized
tatctgctcattgatacaga

SEQ ID NO: 11525 - DNA, 20 bp, Artificial Sequence
  chemically synthesized
tcattgatacagatggctaa

SEQ ID NO: 11526 - DNA, 20 bp, Artificial Sequence
  chemically synthesized
cattgatacagatggctaaa

SEQ ID NO: 11527 - DNA, 20 bp, Artificial Sequence
  chemically synthesized
gatacagatggctaaaaggc

SEQ ID NO: 11528 - DNA, 20 bp, Artificial Sequence
  chemically synthesized
cagatggctaaaaggccaga

SEQ ID NO: 11529 - DNA, 20 bp, Artificial Sequence
  chemically synthesized
cacacatttacccatgtaac

SEQ ID NO: 11530 - DNA, 20 bp, Artificial Sequence
  chemically synthesized
atgaaatgaaataaaattaa

SEQ ID NO: 11531 - DNA, 20 bp, Artificial Sequence
  chemically synthesized
tgaaatgaaataaaattaaa

SEQ ID NO: 11532 - DNA, 20 bp, Artificial Sequence
  chemically synthesized
ttaaaaggaaaaaaatgcca

SEQ ID NO: 11533 - DNA, 20 bp, Artificial Sequence
  chemically synthesized
aaaaaatgccatggcaacat

SEQ ID NO: 11534 - DNA, 20 bp, Artificial Sequence
  chemically synthesized
aaaaatgccatggcaacatc

SEQ ID NO: 11535 - DNA, 20 bp, Artificial Sequence
  chemically synthesized
aatgccatggcaacatcagg

SEQ ID NO: 11536 - DNA, 20 bp, Artificial Sequence
  chemically synthesized
catcaggaagttatctttta

SEQ ID NO: 11537 - DNA, 20 bp, Artificial Sequence
  chemically synthesized
tatcttttatggtctaaaaa

SEQ ID NO: 11538 - DNA, 20 bp, Artificial Sequence
  chemically synthesized
atcttttatggtctaaaaat

SEQ ID NO: 11539 - DNA, 20 bp, Artificial Sequence
  chemically synthesized
ttttatggtctaaaaatggg

SEQ ID NO: 11540 - DNA, 20 bp, Artificial Sequence
  chemically synthesized
taaataatctaccccttgtt

SEQ ID NO: 11541 - DNA, 20 bp, Artificial Sequence
  chemically synthesized
tgaaaaataacaataaaaat

SEQ ID NO: 11542 - DNA, 20 bp, Artificial Sequence
  chemically synthesized
taacaataaaaatcggcaac

SEQ ID NO: 11543 - DNA, 20 bp, Artificial Sequence
  chemically synthesized
caataaaaatcggcaaccag

SEQ ID NO: 11544 - DNA, 20 bp, Artificial Sequence
  chemically synthesized
ttgcgtctactctgcctatg

SEQ ID NO: 11545 - DNA, 20 bp, Artificial Sequence
  chemically synthesized
cgtctactctgcctatgaag

SEQ ID NO: 11546 - DNA, 20 bp, Artificial Sequence
  chemically synthesized
cttgttttactaaaaaaaaa

SEQ ID NO: 11547 - DNA, 20 bp, Artificial Sequence
  chemically synthesized
ttgttttactaaaaaaaaaa

SEQ ID NO: 11548 - DNA, 20 bp, Artificial Sequence
  chemically synthesized
tactaaaaaaaaaaaggaca

SEQ ID NO: 11549 - DNA, 20 bp, Artificial Sequence
  chemically synthesized
aaaaaaaaaaaggacaaaga

SEQ ID NO: 11550 - DNA, 20 bp, Artificial Sequence
  chemically synthesized
aaaaaaaggacaaagaaaga

SEQ ID NO: 11551 - DNA, 20 bp, Artificial Sequence
  chemically synthesized
agaaagtgcgaattgtgaaa

SEQ ID NO: 11552 - DNA, 20 bp, Artificial Sequence
  chemically synthesized
aagtgcgaattgtgaaatgg

SEQ ID NO: 11553 - DNA, 20 bp, Artificial Sequence
  chemically synthesized
gcgaattgtgaaatggtagt

SEQ ID NO: 11554 - DNA, 20 bp, Artificial Sequence
  chemically synthesized
tgtgaaatggtagtgagtga

SEQ ID NO: 11555 - DNA, 20 bp, Artificial Sequence
  chemically synthesized
gtagtgagtgatggcatttg

SEQ ID NO: 11556 - DNA, 20 bp, Artificial Sequence
  chemically synthesized
gtgagtgatggcatttgaag

SEQ ID NO: 11557 - DNA, 20 bp, Artificial Sequence
  chemically synthesized
tgagtgatggcatttgaagt

SEQ ID NO: 11558 - DNA, 20 bp, Artificial Sequence
  chemically synthesized
gtgggtcctttatgatttga

SEQ ID NO: 11559 - DNA, 20 bp, Artificial Sequence
  chemically synthesized
gggtcctttatgatttgatg

SEQ ID NO: 11560 - DNA, 20 bp, Artificial Sequence
  chemically synthesized
cctttatgatttgatggagc

SEQ ID NO: 11561 - DNA, 20 bp, Artificial Sequence
  chemically synthesized
ctttatgatttgatggagcc

SEQ ID NO: 11562 - DNA, 20 bp, Artificial Sequence
  chemically synthesized
tatgatttgatggagccagg

SEQ ID NO: 11563 - DNA, 20 bp, Artificial Sequence
  chemically synthesized
gatttgatggagccaggcag

SEQ ID NO: 11564 - DNA, 20 bp, Artificial Sequence
  chemically synthesized
ggagccaggcagaagacgtt

SEQ ID NO: 11565 - DNA, 20 bp, Artificial Sequence
  chemically synthesized
agccaggcagaagacgtttg

SEQ ID NO: 11566 - DNA, 20 bp, Artificial Sequence
  chemically synthesized
aggcagaagacgtttggaga

SEQ ID NO: 11567 - DNA, 20 bp, Artificial Sequence
  chemically synthesized
cagaagacgtttggagaaag

SEQ ID NO: 11568 - DNA, 20 bp, Artificial Sequence
  chemically synthesized
ttggagaaagaagttcctga

SEQ ID NO: 11569 - DNA, 20 bp, Artificial Sequence
  chemically synthesized
gagaaagaagttcctgaaag

SEQ ID NO: 11570 - DNA, 20 bp, Artificial Sequence
  chemically synthesized
agaaagaagttcctgaaagt

SEQ ID NO: 11571 - DNA, 20 bp, Artificial Sequence
  chemically synthesized
aagaagttcctgaaagtagg

SEQ ID NO: 11572 - DNA, 20 bp, Artificial Sequence
  chemically synthesized
agaagttcctgaaagtagga

SEQ ID NO: 11573 - DNA, 20 bp, Artificial Sequence
  chemically synthesized
gaagttcctgaaagtaggaa

SEQ ID NO: 11574 - DNA, 20 bp, Artificial Sequence
  chemically synthesized
ctgaaagtaggaagggcatg

SEQ ID NO: 11575 - DNA, 20 bp, Artificial Sequence
  chemically synthesized
aagggcatgtggaaaactct

SEQ ID NO: 11576 - DNA, 20 bp, Artificial Sequence
  chemically synthesized
agggcatgtggaaaactctg

SEQ ID NO: 11577 - DNA, 20 bp, Artificial Sequence
  chemically synthesized
atgtggaaaactctgaggct

SEQ ID NO: 11578 - DNA, 20 bp, Artificial Sequence
  chemically synthesized
tgtggaaaactctgaggctg

SEQ ID NO: 11579 - DNA, 20 bp, Artificial Sequence
  chemically synthesized
ctctgaggctgaggaaaaaa

SEQ ID NO: 11580 - DNA, 20 bp, Artificial Sequence
  chemically synthesized
gaggctgaggaaaaaaaaga

SEQ ID NO: 11581 - DNA, 20 bp, Artificial Sequence
  chemically synthesized
ctgaggaaaaaaaagaaaga

SEQ ID NO: 11582 - DNA, 20 bp, Artificial Sequence
  chemically synthesized
aaaagaaagaaagaaatata

SEQ ID NO: 11583 - DNA, 20 bp, Artificial Sequence
  chemically synthesized
gaaagaaagaaatataaaga

SEQ ID NO: 11584 - DNA, 20 bp, Artificial Sequence
  chemically synthesized
actgtatataaacacattac

SEQ ID NO: 11585 - DNA, 20 bp, Artificial Sequence
  chemically synthesized
ataaacacattacaagccta

SEQ ID NO: 11586 - DNA, 20 bp, Artificial Sequence
  chemically synthesized
tacaagcctaaagtacgttg

SEQ ID NO: 11587 - DNA, 20 bp, Artificial Sequence
  chemically synthesized
aaagtacgttgaagaaaaaa

SEQ ID NO: 11588 - DNA, 20 bp, Artificial Sequence
  chemically synthesized
tgaagaaaaaatagaattca

SEQ ID NO: 11589 - DNA, 20 bp, Artificial Sequence
  chemically synthesized
gaaaaaatagaattcaaagt

SEQ ID NO: 11590 - DNA, 20 bp, Artificial Sequence
  chemically synthesized
aaatagaattcaaagttaga

SEQ ID NO: 11591 - DNA, 20 bp, Artificial Sequence
  chemically synthesized
tagaattcaaagttagacag

SEQ ID NO: 11592 - DNA, 20 bp, Artificial Sequence
  chemically synthesized
agaattcaaagttagacaga

SEQ ID NO: 11593 - DNA, 20 bp, Artificial Sequence
  chemically synthesized
gaattcaaagttagacagaa

SEQ ID NO: 11594 - DNA, 20 bp, Artificial Sequence
  chemically synthesized
caaagttagacagaagggct

SEQ ID NO: 11595 - DNA, 20 bp, Artificial Sequence
  chemically synthesized
aaagttagacagaagggctc

SEQ ID NO: 11596 - DNA, 20 bp, Artificial Sequence
  chemically synthesized
ggcttactatttgcatctta

SEQ ID NO: 11597 - DNA, 20 bp, Artificial Sequence
  chemically synthesized
actatttgcatcttacagat

SEQ ID NO: 11598 - DNA, 20 bp, Artificial Sequence
  chemically synthesized
tatttgcatcttacagatga

SEQ ID NO: 11599 - DNA, 20 bp, Artificial Sequence
  chemically synthesized
ttgcatcttacagatgagag

SEQ ID NO: 11600 - DNA, 20 bp, Artificial Sequence
  chemically synthesized
catcttacagatgagagtag

SEQ ID NO: 11601 - DNA, 20 bp, Artificial Sequence
  chemically synthesized
tcttacagatgagagtagta

SEQ ID NO: 11602 - DNA, 20 bp, Artificial Sequence
  chemically synthesized
acagatgagagtagtagagt

SEQ ID NO: 11603 - DNA, 20 bp, Artificial Sequence
  chemically synthesized
tggtattttattctgaaaca

SEQ ID NO: 11604 - DNA, 20 bp, Artificial Sequence
  chemically synthesized
gtattttattctgaaacaca

SEQ ID NO: 11605 - DNA, 20 bp, Artificial Sequence
  chemically synthesized
tattttattctgaaacacag

SEQ ID NO: 11606 - DNA, 20 bp, Artificial Sequence
  chemically synthesized
tattctgaaacacagaggac

SEQ ID NO: 11607 - DNA, 20 bp, Artificial Sequence
  chemically synthesized
tctgaaacacagaggacaag

SEQ ID NO: 11608 - DNA, 20 bp, Artificial Sequence
  chemically synthesized
tgaaacacagaggacaagtg

SEQ ID NO: 11609 - DNA, 20 bp, Artificial Sequence
  chemically synthesized
aagtggagatttgtaaacct

SEQ ID NO: 11610 - DNA, 20 bp, Artificial Sequence
  chemically synthesized
ttgtaaacctgagataaaca

SEQ ID NO: 11611 - DNA, 20 bp, Artificial Sequence
  chemically synthesized
ttctaatccactgaacaccg

SEQ ID NO: 11612 - DNA, 20 bp, Artificial Sequence
  chemically synthesized
ctttcttcatctgccttact

SEQ ID NO: 11613 - DNA, 20 bp, Artificial Sequence
  chemically synthesized
tcatctgccttacttagtgc

SEQ ID NO: 11614 - DNA, 20 bp, Artificial Sequence
  chemically synthesized
catctgccttacttagtgca

SEQ ID NO: 11615 - DNA, 20 bp, Artificial Sequence
  chemically synthesized
tgcaaggtgctataacaaaa

SEQ ID NO: 11616 - DNA, 20 bp, Artificial Sequence
  chemically synthesized
ggtgctataacaaaatagca

SEQ ID NO: 11617 - DNA, 20 bp, Artificial Sequence
  chemically synthesized
tataacaaaatagcatagac

SEQ ID NO: 11618 - DNA, 20 bp, Artificial Sequence
  chemically synthesized
ataacaaaatagcatagact

SEQ ID NO: 11619 - DNA, 20 bp, Artificial Sequence
  chemically synthesized
agactgggtgacttcaacaa

SEQ ID NO: 11620 - DNA, 20 bp, Artificial Sequence
  chemically synthesized
gactgggtgacttcaacaac

SEQ ID NO: 11621 - DNA, 20 bp, Artificial Sequence
  chemically synthesized
attttttctcacttttctgc

SEQ ID NO: 11622 - DNA, 20 bp, Artificial Sequence
  chemically synthesized
ctcacttttctgctggttcc

SEQ ID NO: 11623 - DNA, 20 bp, Artificial Sequence
  chemically synthesized
cttttctgctggttcctggt

SEQ ID NO: 11624 - DNA, 20 bp, Artificial Sequence
  chemically synthesized
ttttctgctggttcctggtc

SEQ ID NO: 11625 - DNA, 20 bp, Artificial Sequence
  chemically synthesized
tttctgctggttcctggtca

SEQ ID NO: 11626 - DNA, 20 bp, Artificial Sequence
  chemically synthesized
cctggtcagggctctcttcc

SEQ ID NO: 11627 - DNA, 20 bp, Artificial Sequence
  chemically synthesized
ctggtcagggctctcttcct

SEQ ID NO: 11628 - DNA, 20 bp, Artificial Sequence
  chemically synthesized
agggctctcttcctgggttg

SEQ ID NO: 11629 - DNA, 20 bp, Artificial Sequence
  chemically synthesized
gggctctcttcctgggttgc

SEQ ID NO: 11630 - DNA, 20 bp, Artificial Sequence
  chemically synthesized
ctctcttcctgggttgcagg

SEQ ID NO: 11631 - DNA, 20 bp, Artificial Sequence
  chemically synthesized
acttcccactgtgtcctcac

SEQ ID NO: 11632 - DNA, 20 bp, Artificial Sequence
  chemically synthesized
tcccactgtgtcctcaccag

SEQ ID NO: 11633 - DNA, 20 bp, Artificial Sequence
  chemically synthesized
cccactgtgtcctcaccaga

SEQ ID NO: 11634 - DNA, 20 bp, Artificial Sequence
  chemically synthesized
actgtgtcctcaccagaagg

SEQ ID NO: 11635 - DNA, 20 bp, Artificial Sequence
  chemically synthesized
tgtgtcctcaccagaaggaa

SEQ ID NO: 11636 - DNA, 20 bp, Artificial Sequence
  chemically synthesized
ctcaccagaaggaagagaaa

SEQ ID NO: 11637 - DNA, 20 bp, Artificial Sequence
  chemically synthesized
ctaatctctctgcttctgat

SEQ ID NO: 11638 - DNA, 20 bp, Artificial Sequence
  chemically synthesized
taatctctctgcttctgatg

SEQ ID NO: 11639 - DNA, 20 bp, Artificial Sequence
  chemically synthesized
tgaggaaaataattctatga

SEQ ID NO: 11640 - DNA, 20 bp, Artificial Sequence
  chemically synthesized
gaggaaaataattctatgat

SEQ ID NO: 11641 - DNA, 20 bp, Artificial Sequence
  chemically synthesized
aggaaaataattctatgatg

SEQ ID NO: 11642 - DNA, 20 bp, Artificial Sequence
  chemically synthesized
tgatggggatctgctctcat

SEQ ID NO: 11643 - DNA, 20 bp, Artificial Sequence
  chemically synthesized
taaacctgattacttttcca

SEQ ID NO: 11644 - DNA, 20 bp, Artificial Sequence
  chemically synthesized
tccaaagcctcccccacaaa

SEQ ID NO: 11645 - DNA, 20 bp, Artificial Sequence
  chemically synthesized
caaagcctcccccacaaatg

SEQ ID NO: 11646 - DNA, 20 bp, Artificial Sequence
  chemically synthesized
cccccacaaatggagccaat

SEQ ID NO: 11647 - DNA, 20 bp, Artificial Sequence
  chemically synthesized
ccccacaaatggagccaatt

SEQ ID NO: 11648 - DNA, 20 bp, Artificial Sequence
  chemically synthesized
ccacaaatggagccaattgg

SEQ ID NO: 11649 - DNA, 20 bp, Artificial Sequence
  chemically synthesized
aaatggagccaattgggagt

SEQ ID NO: 11650 - DNA, 20 bp, Artificial Sequence
  chemically synthesized
aatggagccaattgggagtt

SEQ ID NO: 11651 - DNA, 20 bp, Artificial Sequence
  chemically synthesized
atggagccaattgggagttg

SEQ ID NO: 11652 - DNA, 20 bp, Artificial Sequence
  chemically synthesized
ccaattgggagttggggatt

SEQ ID NO: 11653 - DNA, 20 bp, Artificial Sequence
  chemically synthesized
gattcagcatgtgaattttc

SEQ ID NO: 11654 - DNA, 20 bp, Artificial Sequence
  chemically synthesized
ttcagcatgtgaattttctg

SEQ ID NO: 11655 - DNA, 20 bp, Artificial Sequence
  chemically synthesized
tgtgaattttctggagacac

SEQ ID NO: 11656 - DNA, 20 bp, Artificial Sequence
  chemically synthesized
tttctggagacacaagcgtt

SEQ ID NO: 11657 - DNA, 20 bp, Artificial Sequence
  chemically synthesized
gcattaactttcaattatat

SEQ ID NO: 11658 - DNA, 20 bp, Artificial Sequence
  chemically synthesized
tttcaattatataagaactc

SEQ ID NO: 11659 - DNA, 20 bp, Artificial Sequence
  chemically synthesized
gaccgtgctgttctgctgct

SEQ ID NO: 11660 - DNA, 20 bp, Artificial Sequence
  chemically synthesized
acacgctgatgctgacttgt

SEQ ID NO: 11661 - DNA, 20 bp, Artificial Sequence
  chemically synthesized
gctgacttgtgagcttctgc

SEQ ID NO: 11662 - DNA, 20 bp, Artificial Sequence
  chemically synthesized
ctggctcatttccttcacct

SEQ ID NO: 11663 - DNA, 20 bp, Artificial Sequence
  chemically synthesized
cacctaagtccccacctccc

SEQ ID NO: 11664 - DNA, 20 bp, Artificial Sequence
  chemically synthesized
ctaagtccccacctccctag

SEQ ID NO: 11665 - DNA, 20 bp, Artificial Sequence
  chemically synthesized
cctccctagaagcttacaat

SEQ ID NO: 11666 - DNA, 20 bp, Artificial Sequence
  chemically synthesized
ctccctagaagcttacaatg

SEQ ID NO: 11667 - DNA, 20 bp, Artificial Sequence
  chemically synthesized
cctccttgaaatgctgtgac

SEQ ID NO: 11668 - DNA, 20 bp, Artificial Sequence
  chemically synthesized
gaaatgctgtgaccagtctg

SEQ ID NO: 11669 - DNA, 20 bp, Artificial Sequence
  chemically synthesized
tgtgaccagtctgtagactt

SEQ ID NO: 11670 - DNA, 20 bp, Artificial Sequence
  chemically synthesized
gtgaccagtctgtagactta

SEQ ID NO: 11671 - DNA, 20 bp, Artificial Sequence
  chemically synthesized
tgaccagtctgtagacttaa

SEQ ID NO: 11672 - DNA, 20 bp, Artificial Sequence
  chemically synthesized
agtctgtagacttaagggta

SEQ ID NO: 11673 - DNA, 20 bp, Artificial Sequence
  chemically synthesized
gtctgtagacttaagggtat

SEQ ID NO: 11674 - DNA, 20 bp, Artificial Sequence
  chemically synthesized
tgggattaatttcacctctt

SEQ ID NO: 11675 - DNA, 20 bp, Artificial Sequence
  chemically synthesized
gggattaatttcacctcttt

SEQ ID NO: 11676 - DNA, 20 bp, Artificial Sequence
  chemically synthesized
gcgtcaacacttaaaatgaa

SEQ ID NO: 11677 - DNA, 20 bp, Artificial Sequence
  chemically synthesized
acttaaaatgaaaagttcct

SEQ ID NO: 11678 - DNA, 20 bp, Artificial Sequence
  chemically synthesized
aaatgaaaagttccttagta

SEQ ID NO: 11679 - DNA, 20 bp, Artificial Sequence
  chemically synthesized
gaaaagttccttagtaaagt

SEQ ID NO: 11680 - DNA, 20 bp, Artificial Sequence
  chemically synthesized
aaaagttccttagtaaagta

SEQ ID NO: 11681 - DNA, 20 bp, Artificial Sequence
  chemically synthesized
aagtaaggatcacttcattg

SEQ ID NO: 11682 - DNA, 20 bp, Artificial Sequence
  chemically synthesized
tcacttcattgtagttaccg

SEQ ID NO: 11683 - DNA, 20 bp, Artificial Sequence
  chemically synthesized
ttcattgtagttaccgtgga

SEQ ID NO: 11684 - DNA, 20 bp, Artificial Sequence
  chemically synthesized
ctaacacctcaacctccctg

SEQ ID NO: 11685 - DNA, 20 bp, Artificial Sequence
  chemically synthesized
aacacctcaacctccctgta

SEQ ID NO: 11686 - DNA, 20 bp, Artificial Sequence
  chemically synthesized
acctccctgtagagcctcac

SEQ ID NO: 11687 - DNA, 20 bp, Artificial Sequence
  chemically synthesized
cctccctgtagagcctcaca

SEQ ID NO: 11688 - DNA, 20 bp, Artificial Sequence
  chemically synthesized
ctccctgtagagcctcacaa

SEQ ID NO: 11689 - DNA, 20 bp, Artificial Sequence
  chemically synthesized
tgtagagcctcacaagggct

SEQ ID NO: 11690 - DNA, 20 bp, Artificial Sequence
  chemically synthesized
agcctcacaagggctgagaa

SEQ ID NO: 11691 - DNA, 20 bp, Artificial Sequence
  chemically synthesized
tcacaagggctgagaaaagc

SEQ ID NO: 11692 - DNA, 20 bp, Artificial Sequence
  chemically synthesized
tgagaaaagccagatgccgt

SEQ ID NO: 11693 - DNA, 20 bp, Artificial Sequence
  chemically synthesized
aagccagatgccgttggaaa

SEQ ID NO: 11694 - DNA, 20 bp, Artificial Sequence
  chemically synthesized
tagtattgcccctaataaaa

SEQ ID NO: 11695 - DNA, 20 bp, Artificial Sequence
  chemically synthesized
ttgcccctaataaaatagaa

SEQ ID NO: 11696 - DNA, 20 bp, Artificial Sequence
  chemically synthesized
gcctaaaccttgacttccta

SEQ ID NO: 11697 - DNA, 20 bp, Artificial Sequence
  chemically synthesized
aaccttgacttcctaaagct

SEQ ID NO: 11698 - DNA, 20 bp, Artificial Sequence
  chemically synthesized
tggaacactttttcttcgtt

SEQ ID NO: 11699 - DNA, 20 bp, Artificial Sequence
  chemically synthesized
ctcgctgctgtgctgcaatc

SEQ ID NO: 11700 - DNA, 20 bp, Artificial Sequence
  chemically synthesized
tcgctgctgtgctgcaatcc

SEQ ID NO: 11701 - DNA, 20 bp, Artificial Sequence
  chemically synthesized
cgctgctgtgctgcaatcca

SEQ ID NO: 11702 - DNA, 20 bp, Artificial Sequence
  chemically synthesized
tgctgtgctgcaatccaggg

SEQ ID NO: 11703 - DNA, 20 bp, Artificial Sequence
  chemically synthesized
gctgtgctgcaatccaggga

SEQ ID NO: 11704 - DNA, 20 bp, Artificial Sequence
  chemically synthesized
ctgtgctgcaatccagggaa

SEQ ID NO: 11705 - DNA, 20 bp, Artificial Sequence
  chemically synthesized
tgtgctgcaatccagggaag

SEQ ID NO: 11706 - DNA, 20 bp, Artificial Sequence
  chemically synthesized
gtgctgcaatccagggaagg

SEQ ID NO: 11707 - DNA, 20 bp, Artificial Sequence
  chemically synthesized
gcaatccagggaagggggtt

SEQ ID NO: 11708 - DNA, 20 bp, Artificial Sequence
  chemically synthesized
cttccaaaacatctgtttct

SEQ ID NO: 11709 - DNA, 20 bp, Artificial Sequence
  chemically synthesized
ttccaaaacatctgtttctg

SEQ ID NO: 11710 - DNA, 20 bp, Artificial Sequence
  chemically synthesized
ccaaaacatctgtttctgag

SEQ ID NO: 11711 - DNA, 20 bp, Artificial Sequence
  chemically synthesized
ttctgaggagtcctgtccta

SEQ ID NO: 11712 - DNA, 20 bp, Artificial Sequence
  chemically synthesized
ctgaggagtcctgtcctata

SEQ ID NO: 11713 - DNA, 20 bp, Artificial Sequence
  chemically synthesized
tgaggagtcctgtcctatag

SEQ ID NO: 11714 - DNA, 20 bp, Artificial Sequence
  chemically synthesized
atagaggtctttcttccaac

SEQ ID NO: 11715 - DNA, 20 bp, Artificial Sequence
  chemically synthesized
gcaccttttactcccacttg

SEQ ID NO: 11716 - DNA, 20 bp, Artificial Sequence
  chemically synthesized
cttgcagaactcccatgtac

SEQ ID NO: 11717 - DNA, 20 bp, Artificial Sequence
  chemically synthesized
gtacaagtttctttattgcc

SEQ ID NO: 11718 - DNA, 20 bp, Artificial Sequence
  chemically synthesized
cacatctaacgtaaacaaaa

SEQ ID NO: 11719 - DNA, 20 bp, Artificial Sequence
  chemically synthesized
ctaacgtaaacaaaaaagtg

SEQ ID NO: 11720 - DNA, 20 bp, Artificial Sequence
  chemically synthesized
aacgtaaacaaaaaagtgtg

SEQ ID NO: 11721 - DNA, 20 bp, Artificial Sequence
  chemically synthesized
gcacatgacacaaacacaca

SEQ ID NO: 11722 - DNA, 20 bp, Artificial Sequence
  chemically synthesized
cctcaacataaaaccctttg

SEQ ID NO: 11723 - DNA, 20 bp, Artificial Sequence
  chemically synthesized
ttgtggctcatatatttaaa

SEQ ID NO: 11724 - DNA, 20 bp, Artificial Sequence
  chemically synthesized
tatttaaaaagacataaaaa

SEQ ID NO: 11725 - DNA, 20 bp, Artificial Sequence
  chemically synthesized
aagacataaaaaaagaactg

SEQ ID NO: 11726 - DNA, 20 bp, Artificial Sequence
  chemically synthesized
gacaaccatgtgtgatctct

SEQ ID NO: 11727 - DNA, 20 bp, Artificial Sequence
  chemically synthesized
aaccatgtgtgatctcttag

SEQ ID NO: 11728 - DNA, 20 bp, Artificial Sequence
  chemically synthesized
tgtgtgatctcttagcagaa

SEQ ID NO: 11729 - DNA, 20 bp, Artificial Sequence
  chemically synthesized
atttattatttgattgcttg

SEQ ID NO: 11730 - DNA, 20 bp, Artificial Sequence
  chemically synthesized
atttgattgcttgcagaata

SEQ ID NO: 11731 - DNA, 20 bp, Artificial Sequence
  chemically synthesized
agaataaagcctatccttga

SEQ ID NO: 11732 - DNA, 20 bp, Artificial Sequence
  chemically synthesized
tccttgaaagctctgcatca

SEQ ID NO: 11733 - DNA, 20 bp, Artificial Sequence
  chemically synthesized
ccttgaaagctctgcatcat

SEQ ID NO: 11734 - DNA, 20 bp, Artificial Sequence
  chemically synthesized
tgaaagctctgcatcatggg

SEQ ID NO: 11735 - DNA, 20 bp, Artificial Sequence
  chemically synthesized
agctctgcatcatgggcagt

SEQ ID NO: 11736 - DNA, 20 bp, Artificial Sequence
  chemically synthesized
tgcatcatgggcagtgagct

SEQ ID NO: 11737 - DNA, 20 bp, Artificial Sequence
  chemically synthesized
atcatgggcagtgagctcag

SEQ ID NO: 11738 - DNA, 20 bp, Artificial Sequence
  chemically synthesized
gcagtgagctcagtggtatc

SEQ ID NO: 11739 - DNA, 20 bp, Artificial Sequence
  chemically synthesized
agtgagctcagtggtatctg

SEQ ID NO: 11740 - DNA, 20 bp, Artificial Sequence
  chemically synthesized
gtgagctcagtggtatctgg

SEQ ID NO: 11741 - DNA, 20 bp, Artificial Sequence
  chemically synthesized
gctcagtggtatctggagga

SEQ ID NO: 11742 - DNA, 20 bp, Artificial Sequence
  chemically synthesized
ctcagtggtatctggaggac

SEQ ID NO: 11743 - DNA, 20 bp, Artificial Sequence
  chemically synthesized
tcagtggtatctggaggaca

SEQ ID NO: 11744 - DNA, 20 bp, Artificial Sequence
  chemically synthesized
gtatctggaggacagggcac

SEQ ID NO: 11745 - DNA, 20 bp, Artificial Sequence
  chemically synthesized
ggacagggcactggccactc

SEQ ID NO: 11746 - DNA, 20 bp, Artificial Sequence
  chemically synthesized
ctccagtcaccatcttctgc

SEQ ID NO: 11747 - DNA, 20 bp, Artificial Sequence
  chemically synthesized
tccagtcaccatcttctgcc

SEQ ID NO: 11748 - DNA, 20 bp, Artificial Sequence
  chemically synthesized
agtcaccatcttctgccagg

SEQ ID NO: 11749 - DNA, 20 bp, Artificial Sequence
  chemically synthesized
ctgccaggaagcctgcacct

SEQ ID NO: 11750 - DNA, 20 bp, Artificial Sequence
  chemically synthesized
tgccaggaagcctgcacctc

SEQ ID NO: 11751 - DNA, 20 bp, Artificial Sequence
  chemically synthesized
gccaggaagcctgcacctca

SEQ ID NO: 11752 - DNA, 20 bp, Artificial Sequence
  chemically synthesized
ccaggaagcctgcacctcag

SEQ ID NO: 11753 - DNA, 20 bp, Artificial Sequence
  chemically synthesized
gggtgaattctttgccgaaa

SEQ ID NO: 11754 - DNA, 20 bp, Artificial Sequence
  chemically synthesized
gccgaaatggattgccaaaa

SEQ ID NO: 11755 - DNA, 20 bp, Artificial Sequence
  chemically synthesized
tggattgccaaaacggtcac

SEQ ID NO: 11756 - DNA, 20 bp, Artificial Sequence
  chemically synthesized
acggtcaccagcacatttcc

SEQ ID NO: 11757 - DNA, 20 bp, Artificial Sequence
  chemically synthesized
cggtcaccagcacatttccc

SEQ ID NO: 11758 - DNA, 20 bp, Artificial Sequence
  chemically synthesized
gtcaccagcacatttcccag

SEQ ID NO: 11759 - DNA, 20 bp, Artificial Sequence
  chemically synthesized
cacatttcccaggagctgtt

SEQ ID NO: 11760 - DNA, 20 bp, Artificial Sequence
  chemically synthesized
cccaggagctgttgagatga

SEQ ID NO: 11761 - DNA, 20 bp, Artificial Sequence
  chemically synthesized
ccaggagctgttgagatgaa

SEQ ID NO: 11762 - DNA, 20 bp, Artificial Sequence
  chemically synthesized
aggagctgttgagatgaaag

SEQ ID NO: 11763 - DNA, 20 bp, Artificial Sequence
  chemically synthesized
tgagatgaaaggagacaata

SEQ ID NO: 11764 - DNA, 20 bp, Artificial Sequence
  chemically synthesized
agacaataaagatgaaccca

SEQ ID NO: 11765 - DNA, 20 bp, Artificial Sequence
  chemically synthesized
aataaagatgaacccatagt

SEQ ID NO: 11766 - DNA, 20 bp, Artificial Sequence
  chemically synthesized
agatgaacccatagtgagct

SEQ ID NO: 11767 - DNA, 20 bp, Artificial Sequence
  chemically synthesized
atgaacccatagtgagctga

SEQ ID NO: 11768 - DNA, 20 bp, Artificial Sequence
  chemically synthesized
ccatagtgagctgagagctc

SEQ ID NO: 11769 - DNA, 20 bp, Artificial Sequence
  chemically synthesized
gtgagctgagagctccagcc

SEQ ID NO: 11770 - DNA, 20 bp, Artificial Sequence
  chemically synthesized
gagagctccagcctggcctc

SEQ ID NO: 11771 - DNA, 20 bp, Artificial Sequence
  chemically synthesized
cctccagataactacacacc

SEQ ID NO: 11772 - DNA, 20 bp, Artificial Sequence
  chemically synthesized
ctacacaccaagcttccacc

SEQ ID NO: 11773 - DNA, 20 bp, Artificial Sequence
  chemically synthesized
ccaagcttccacccagaatc

SEQ ID NO: 11774 - DNA, 20 bp, Artificial Sequence
  chemically synthesized
gcctatgttaacttccctca

SEQ ID NO: 11775 - DNA, 20 bp, Artificial Sequence
  chemically synthesized
gttaacttccctcaaagcct

SEQ ID NO: 11776 - DNA, 20 bp, Artificial Sequence
  chemically synthesized
ttttgctttcccattaaatg

SEQ ID NO: 11777 - DNA, 20 bp, Artificial Sequence
  chemically synthesized
tttgctttcccattaaatgc

SEQ ID NO: 11778 - DNA, 20 bp, Artificial Sequence
  chemically synthesized
gctttcccattaaatgcagg

SEQ ID NO: 11779 - DNA, 20 bp, Artificial Sequence
  chemically synthesized
gcaggtagttgttcttcttg

SEQ ID NO: 11780 - DNA, 20 bp, Artificial Sequence
  chemically synthesized
agttgttcttcttgcagcac

SEQ ID NO: 11781 - DNA, 20 bp, Artificial Sequence
  chemically synthesized
cttcttgcagcactagtcac

SEQ ID NO: 11782 - DNA, 20 bp, Artificial Sequence
  chemically synthesized
accatgaaccctgtatgctg

SEQ ID NO: 11783 - DNA, 20 bp, Artificial Sequence
  chemically synthesized
ccatgaaccctgtatgctgt

SEQ ID NO: 11784 - DNA, 20 bp, Artificial Sequence
  chemically synthesized
ctgtaggctgaaaacgttaa

SEQ ID NO: 11785 - DNA, 20 bp, Artificial Sequence
  chemically synthesized
cacacacacacacacacaca

SEQ ID NO: 11786 - DNA, 20 bp, Artificial Sequence
  chemically synthesized
cacacacacacacacacaca

SEQ ID NO: 11787 - DNA, 20 bp, Artificial Sequence
  chemically synthesized
ctgactttcaaaatctactc

SEQ ID NO: 11788 - DNA, 20 bp, Artificial Sequence
  chemically synthesized
tttcaattgttcctcacccc

SEQ ID NO: 11789 - DNA, 20 bp, Artificial Sequence
  chemically synthesized
ggacatactttgcccccatc

SEQ ID NO: 11790 - DNA, 20 bp, Artificial Sequence
  chemically synthesized
tttgcccccatctggaatta

SEQ ID NO: 11791 - DNA, 20 bp, Artificial Sequence
  chemically synthesized
ttgcccccatctggaattaa

SEQ ID NO: 11792 - DNA, 20 bp, Artificial Sequence
  chemically synthesized
catctggaattaaaggatat

SEQ ID NO: 11793 - DNA, 20 bp, Artificial Sequence
  chemically synthesized
aaggatataagtttgtaatg

SEQ ID NO: 11794 - DNA, 20 bp, Artificial Sequence
  chemically synthesized
ataagtttgtaatgaagcat

SEQ ID NO: 11795 - DNA, 20 bp, Artificial Sequence
  chemically synthesized
agtttgtaatgaagcattag

SEQ ID NO: 11796 - DNA, 20 bp, Artificial Sequence
  chemically synthesized
agcagcattttatatgtgtc

SEQ ID NO: 11797 - DNA, 20 bp, Artificial Sequence
  chemically synthesized
ttatatgtgtccagctgata

SEQ ID NO: 11798 - DNA, 20 bp, Artificial Sequence
  chemically synthesized
tatatgtgtccagctgatat

SEQ ID NO: 11799 - DNA, 20 bp, Artificial Sequence
  chemically synthesized
gtgtccagctgatataggaa

SEQ ID NO: 11800 - DNA, 20 bp, Artificial Sequence
  chemically synthesized
agctgatataggaatagcct

SEQ ID NO: 11801 - DNA, 20 bp, Artificial Sequence
  chemically synthesized
tagccttagcaatgtatgtt

SEQ ID NO: 11802 - DNA, 20 bp, Artificial Sequence
  chemically synthesized
caatgtatgtttggccacca

SEQ ID NO: 11803 - DNA, 20 bp, Artificial Sequence
  chemically synthesized
caaagttccccactttgact

SEQ ID NO: 11804 - DNA, 20 bp, Artificial Sequence
  chemically synthesized
gaccatacttgtcctgcctc

SEQ ID NO: 11805 - DNA, 20 bp, Artificial Sequence
  chemically synthesized
atacttgtcctgcctccaga

SEQ ID NO: 11806 - DNA, 20 bp, Artificial Sequence
  chemically synthesized
tttaaaacgaataacaaaaa

SEQ ID NO: 11807 - DNA, 20 bp, Artificial Sequence
  chemically synthesized
ttaaaacgaataacaaaaat

SEQ ID NO: 11808 - DNA, 20 bp, Artificial Sequence
  chemically synthesized
taaaacgaataacaaaaata

SEQ ID NO: 11809 - DNA, 20 bp, Artificial Sequence
  chemically synthesized
aaaacgaataacaaaaatag

SEQ ID NO: 11810 - DNA, 20 bp, Artificial Sequence
  chemically synthesized
cgaataacaaaaatagggga

SEQ ID NO: 11811 - DNA, 20 bp, Artificial Sequence
  chemically synthesized
gaataacaaaaataggggaa

SEQ ID NO: 11812 - DNA, 20 bp, Artificial Sequence
  chemically synthesized
caaaaataggggaaaggtga

SEQ ID NO: 11813 - DNA, 20 bp, Artificial Sequence
  chemically synthesized
ctttctaccgaaatctaata

SEQ ID NO: 11814 - DNA, 20 bp, Artificial Sequence
  chemically synthesized
taccgaaatctaataaagaa

SEQ ID NO: 11815 - DNA, 20 bp, Artificial Sequence
  chemically synthesized
tttccacctctcttttctca

SEQ ID NO: 11816 - DNA, 20 bp, Artificial Sequence
  chemically synthesized
cctctcttttctcaaagtca

SEQ ID NO: 11817 - DNA, 20 bp, Artificial Sequence
  chemically synthesized
caaagtcaaagttgtccatc

SEQ ID NO: 11818 - DNA, 20 bp, Artificial Sequence
  chemically synthesized
aagttgtccatctagatttt

SEQ ID NO: 11819 - DNA, 20 bp, Artificial Sequence
  chemically synthesized
gttgtccatctagattttca

SEQ ID NO: 11820 - DNA, 20 bp, Artificial Sequence
  chemically synthesized
ttgtccatctagattttcag

SEQ ID NO: 11821 - DNA, 20 bp, Artificial Sequence
  chemically synthesized
agattttcagaggcactcct

SEQ ID NO: 11822 - DNA, 20 bp, Artificial Sequence
  chemically synthesized
gattttcagaggcactcctt

SEQ ID NO: 11823 - DNA, 20 bp, Artificial Sequence
  chemically synthesized
aggccctaaaacattgccac

SEQ ID NO: 11824 - DNA, 20 bp, Artificial Sequence
  chemically synthesized
ggccctaaaacattgccact

SEQ ID NO: 11825 - DNA, 20 bp, Artificial Sequence
  chemically synthesized
aaaacattgccactgggtct

SEQ ID NO: 11826 - DNA, 20 bp, Artificial Sequence
  chemically synthesized
attgccactgggtctcagcc

SEQ ID NO: 11827 - DNA, 20 bp, Artificial Sequence
  chemically synthesized
ccactgggtctcagcccagt

SEQ ID NO: 11828 - DNA, 20 bp, Artificial Sequence
  chemically synthesized
tcagcccagttagtcctctg

SEQ ID NO: 11829 - DNA, 20 bp, Artificial Sequence
  chemically synthesized
agtttcttcactcccaaccc

SEQ ID NO: 11830 - DNA, 20 bp, Artificial Sequence
  chemically synthesized
ccaaccccagtatcttcaaa

SEQ ID NO: 11831 - DNA, 20 bp, Artificial Sequence
  chemically synthesized
agctcacaccctgctgtgct

SEQ ID NO: 11832 - DNA, 20 bp, Artificial Sequence
  chemically synthesized
gctgtgctcagatcaatact

SEQ ID NO: 11833 - DNA, 20 bp, Artificial Sequence
  chemically synthesized
agatcaatactcagttgtct

SEQ ID NO: 11834 - DNA, 20 bp, Artificial Sequence
  chemically synthesized
tcagttgtctaagttgcctc

SEQ ID NO: 11835 - DNA, 20 bp, Artificial Sequence
  chemically synthesized
tctaagttgcctcgagacta

SEQ ID NO: 11836 - DNA, 20 bp, Artificial Sequence
  chemically synthesized
ctaagttgcctcgagactaa

SEQ ID NO: 11837 - DNA, 20 bp, Artificial Sequence
  chemically synthesized
tgcctcgagactaaaggcaa

SEQ ID NO: 11838 - DNA, 20 bp, Artificial Sequence
  chemically synthesized
aacagtgctgaaacatctcc

SEQ ID NO: 11839 - DNA, 20 bp, Artificial Sequence
  chemically synthesized
catctcctggactcaccttg

SEQ ID NO: 11840 - DNA, 20 bp, Artificial Sequence
  chemically synthesized
tggactcaccttgaagttct

SEQ ID NO: 11841 - DNA, 20 bp, Artificial Sequence
  chemically synthesized
ggactcaccttgaagttctc

SEQ ID NO: 11842 - DNA, 20 bp, Artificial Sequence
  chemically synthesized
aagttctcaggatccacatg

SEQ ID NO: 11843 - DNA, 20 bp, Artificial Sequence
  chemically synthesized
gatccacatgcagcttgtca

SEQ ID NO: 11844 - DNA, 20 bp, Artificial Sequence
  chemically synthesized
acatgcagcttgtcacagtg

SEQ ID NO: 11845 - DNA, 20 bp, Artificial Sequence
  chemically synthesized
ttgtcacagtgcagttcact

SEQ ID NO: 11846 - DNA, 20 bp, Artificial Sequence
  chemically synthesized
cacagtgcagttcactcagc

SEQ ID NO: 11847 - DNA, 20 bp, Artificial Sequence
  chemically synthesized
acagtgcagttcactcagct

SEQ ID NO: 11848 - DNA, 20 bp, Artificial Sequence
  chemically synthesized
gcagttcactcagctgggca

SEQ ID NO: 11849 - DNA, 20 bp, Artificial Sequence
  chemically synthesized
cagttcactcagctgggcaa

SEQ ID NO: 11850 - DNA, 20 bp, Artificial Sequence
  chemically synthesized
agctgggcaaaggtgccctt

SEQ ID NO: 11851 - DNA, 20 bp, Artificial Sequence
  chemically synthesized
aaggtgcccttgagatcatc

SEQ ID NO: 11852 - DNA, 20 bp, Artificial Sequence
  chemically synthesized
aggtgcccttgagatcatcc

SEQ ID NO: 11853 - DNA, 20 bp, Artificial Sequence
  chemically synthesized
gagatcatccaggtgcttta

SEQ ID NO: 11854 - DNA, 20 bp, Artificial Sequence
  chemically synthesized
ggtgctttatggcatctccc

SEQ ID NO: 11855 - DNA, 20 bp, Artificial Sequence
  chemically synthesized
gtgctttatggcatctccca

SEQ ID NO: 11856 - DNA, 20 bp, Artificial Sequence
  chemically synthesized
ctttatggcatctcccaagg

SEQ ID NO: 11857 - DNA, 20 bp, Artificial Sequence
  chemically synthesized
atggcatctcccaaggaagt

SEQ ID NO: 11858 - DNA, 20 bp, Artificial Sequence
  chemically synthesized
cttgccatgtgccttgactt

SEQ ID NO: 11859 - DNA, 20 bp, Artificial Sequence
  chemically synthesized
ttgccatgtgccttgacttt

SEQ ID NO: 11860 - DNA, 20 bp, Artificial Sequence
  chemically synthesized
tgccatgtgccttgactttg

SEQ ID NO: 11861 - DNA, 20 bp, Artificial Sequence
  chemically synthesized
gactttggggttgcccatga

SEQ ID NO: 11862 - DNA, 20 bp, Artificial Sequence
  chemically synthesized
tttggggttgcccatgatgg

SEQ ID NO: 11863 - DNA, 20 bp, Artificial Sequence
  chemically synthesized
tggggttgcccatgatggca

SEQ ID NO: 11864 - DNA, 20 bp, Artificial Sequence
  chemically synthesized
ggggttgcccatgatggcag

SEQ ID NO: 11865 - DNA, 20 bp, Artificial Sequence
  chemically synthesized
gttgcccatgatggcagagg

SEQ ID NO: 11866 - DNA, 20 bp, Artificial Sequence
  chemically synthesized
tgcccatgatggcagaggca

SEQ ID NO: 11867 - DNA, 20 bp, Artificial Sequence
  chemically synthesized
gcccatgatggcagaggcag

SEQ ID NO: 11868 - DNA, 20 bp, Artificial Sequence
  chemically synthesized
atgatggcagaggcagagga

SEQ ID NO: 11869 - DNA, 20 bp, Artificial Sequence
  chemically synthesized
tgatggcagaggcagaggac

SEQ ID NO: 11870 - DNA, 20 bp, Artificial Sequence
  chemically synthesized
aggcagaggacaggttgcca

SEQ ID NO: 11871 - DNA, 20 bp, Artificial Sequence
  chemically synthesized
acaggttgccaaagctgtca

SEQ ID NO: 11872 - DNA, 20 bp, Artificial Sequence
  chemically synthesized
caaagctgtcaaagaacctc

SEQ ID NO: 11873 - DNA, 20 bp, Artificial Sequence
  chemically synthesized
aaagctgtcaaagaacctct

SEQ ID NO: 11874 - DNA, 20 bp, Artificial Sequence
  chemically synthesized
tcaaagaacctctgggtcca

SEQ ID NO: 11875 - DNA, 20 bp, Artificial Sequence
  chemically synthesized
caaagaacctctgggtccat

SEQ ID NO: 11876 - DNA, 20 bp, Artificial Sequence
  chemically synthesized
agaacctctgggtccatggg

SEQ ID NO: 11877 - DNA, 20 bp, Artificial Sequence
  chemically synthesized
tgggtccatgggtagacaac

SEQ ID NO: 11878 - DNA, 20 bp, Artificial Sequence
  chemically synthesized
gggtccatgggtagacaacc

SEQ ID NO: 11879 - DNA, 20 bp, Artificial Sequence
  chemically synthesized
gtccatgggtagacaaccag

SEQ ID NO: 11880 - DNA, 20 bp, Artificial Sequence
  chemically synthesized
gtagacaaccaggagcctgt

SEQ ID NO: 11881 - DNA, 20 bp, Artificial Sequence
  chemically synthesized
caggagcctgtgagattgac

SEQ ID NO: 11882 - DNA, 20 bp, Artificial Sequence
  chemically synthesized
gcctgtgagattgacaagaa

SEQ ID NO: 11883 - DNA, 20 bp, Artificial Sequence
  chemically synthesized
gattgacaagaacagtttga

SEQ ID NO: 11884 - DNA, 20 bp, Artificial Sequence
  chemically synthesized
gacaagaacagtttgacagt

SEQ ID NO: 11885 - DNA, 20 bp, Artificial Sequence
  chemically synthesized
aagaacagtttgacagtcag

SEQ ID NO: 11886 - DNA, 20 bp, Artificial Sequence
  chemically synthesized
agaacagtttgacagtcaga

SEQ ID NO: 11887 - DNA, 20 bp, Artificial Sequence
  chemically synthesized
cagaaggtgccacaaatcct

SEQ ID NO: 11888 - DNA, 20 bp, Artificial Sequence
  chemically synthesized
aaggtgccacaaatcctgag

SEQ ID NO: 11889 - DNA, 20 bp, Artificial Sequence
  chemically synthesized
acaaatcctgagaagcgacc

SEQ ID NO: 11890 - DNA, 20 bp, Artificial Sequence
  chemically synthesized
gaagcgacctggacttttgc

SEQ ID NO: 11891 - DNA, 20 bp, Artificial Sequence
  chemically synthesized
aagcgacctggacttttgcc

SEQ ID NO: 11892 - DNA, 20 bp, Artificial Sequence
  chemically synthesized
acctggacttttgccaggca

SEQ ID NO: 11893 - DNA, 20 bp, Artificial Sequence
  chemically synthesized
cctggacttttgccaggcac

SEQ ID NO: 11894 - DNA, 20 bp, Artificial Sequence
  chemically synthesized
ctggacttttgccaggcaca

SEQ ID NO: 11895 - DNA, 20 bp, Artificial Sequence
  chemically synthesized
cttccttccctcccttgtcc

SEQ ID NO: 11896 - DNA, 20 bp, Artificial Sequence
  chemically synthesized
ccctcccttgtcctggtcac

SEQ ID NO: 11897 - DNA, 20 bp, Artificial Sequence
  chemically synthesized
ctcccttgtcctggtcacca

SEQ ID NO: 11898 - DNA, 20 bp, Artificial Sequence
  chemically synthesized
gtcaccagagcctaccttcc

SEQ ID NO: 11899 - DNA, 20 bp, Artificial Sequence
  chemically synthesized
tcaccagagcctaccttccc

SEQ ID NO: 11900 - DNA, 20 bp, Artificial Sequence
  chemically synthesized
caccagagcctaccttccca

SEQ ID NO: 11901 - DNA, 20 bp, Artificial Sequence
  chemically synthesized
ccttcccagggtttctcctc

SEQ ID NO: 11902 - DNA, 20 bp, Artificial Sequence
  chemically synthesized
tccacattcaccttgcccca

SEQ ID NO: 11903 - DNA, 20 bp, Artificial Sequence
  chemically synthesized
ccacattcaccttgccccac

SEQ ID NO: 11904 - DNA, 20 bp, Artificial Sequence
  chemically synthesized
cttgccccacaggcttgtga

SEQ ID NO: 11905 - DNA, 20 bp, Artificial Sequence
  chemically synthesized
gccccacaggcttgtgatag

SEQ ID NO: 11906 - DNA, 20 bp, Artificial Sequence
  chemically synthesized
ctcctctgtgaaatgaccca

SEQ ID NO: 11907 - DNA, 20 bp, Artificial Sequence
  chemically synthesized
gtgaaatgacccatggcgtc

SEQ ID NO: 11908 - DNA, 20 bp, Artificial Sequence
  chemically synthesized
atgacccatggcgtctggac

SEQ ID NO: 11909 - DNA, 20 bp, Artificial Sequence
  chemically synthesized
tgacccatggcgtctggact

SEQ ID NO: 11910 - DNA, 20 bp, Artificial Sequence
  chemically synthesized
acccatggcgtctggactag

SEQ ID NO: 11911 - DNA, 20 bp, Artificial Sequence
  chemically synthesized
taggagcttattgataacct

SEQ ID NO: 11912 - DNA, 20 bp, Artificial Sequence
  chemically synthesized
attgataacctcagacgttc

SEQ ID NO: 11913 - DNA, 20 bp, Artificial Sequence
  chemically synthesized
gataacctcagacgttccag

SEQ ID NO: 11914 - DNA, 20 bp, Artificial Sequence
  chemically synthesized
acctcagacgttccagaagc

SEQ ID NO: 11915 - DNA, 20 bp, Artificial Sequence
  chemically synthesized
acgttccagaagcgagtgtg

SEQ ID NO: 11916 - DNA, 20 bp, Artificial Sequence
  chemically synthesized
gcgagtgtgtggaactgctg

SEQ ID NO: 11917 - DNA, 20 bp, Artificial Sequence
  chemically synthesized
cgagtgtgtggaactgctga

SEQ ID NO: 11918 - DNA, 20 bp, Artificial Sequence
  chemically synthesized
gagtgtgtggaactgctgaa

SEQ ID NO: 11919 - DNA, 20 bp, Artificial Sequence
  chemically synthesized
ttccttttattcttcatccc

SEQ ID NO: 11920 - DNA, 20 bp, Artificial Sequence
  chemically synthesized
ttttattcttcatccctagc

SEQ ID NO: 11921 - DNA, 20 bp, Artificial Sequence
  chemically synthesized
cttcatccctagccagccgc

SEQ ID NO: 11922 - DNA, 20 bp, Artificial Sequence
  chemically synthesized
cctagccagccgccggcccc

SEQ ID NO: 11923 - DNA, 20 bp, Artificial Sequence
  chemically synthesized
ccgccggcccctggcctcac

SEQ ID NO: 11924 - DNA, 20 bp, Artificial Sequence
  chemically synthesized
ctggcctcactggatactct

SEQ ID NO: 11925 - DNA, 20 bp, Artificial Sequence
  chemically synthesized
actggatactctaagactat

SEQ ID NO: 11926 - DNA, 20 bp, Artificial Sequence
  chemically synthesized
atactctaagactattggtc

SEQ ID NO: 11927 - DNA, 20 bp, Artificial Sequence
  chemically synthesized
ttggtcaagtttgccttgtc

SEQ ID NO: 11928 - DNA, 20 bp, Artificial Sequence
  chemically synthesized
tggtcaagtttgccttgtca

SEQ ID NO: 11929 - DNA, 20 bp, Artificial Sequence
  chemically synthesized
gtttgccttgtcaaggctat

SEQ ID NO: 11930 - DNA, 20 bp, Artificial Sequence
  chemically synthesized
ccttgtcaaggctattggtc

SEQ ID NO: 11931 - DNA, 20 bp, Artificial Sequence
  chemically synthesized
cttgtcaaggctattggtca

SEQ ID NO: 11932 - DNA, 20 bp, Artificial Sequence
  chemically synthesized
tcaaggctattggtcaaggc

SEQ ID NO: 11933 - DNA, 20 bp, Artificial Sequence
  chemically synthesized
caaggctattggtcaaggca

SEQ ID NO: 11934 - DNA, 20 bp, Artificial Sequence
  chemically synthesized
gctattggtcaaggcaaggc

SEQ ID NO: 11935 - DNA, 20 bp, Artificial Sequence
  chemically synthesized
aggcaaggctggccaaccca

SEQ ID NO: 11936 - DNA, 20 bp, Artificial Sequence
  chemically synthesized
ggcaaggctggccaacccat

SEQ ID NO: 11937 - DNA, 20 bp, Artificial Sequence
  chemically synthesized
aaggctggccaacccatggg

SEQ ID NO: 11938 - DNA, 20 bp, Artificial Sequence
  chemically synthesized
ggctggccaacccatgggtg

SEQ ID NO: 11939 - DNA, 20 bp, Artificial Sequence
  chemically synthesized
gccaacccatgggtggagtt

SEQ ID NO: 11940 - DNA, 20 bp, Artificial Sequence
  chemically synthesized
acccatgggtggagtttagc

SEQ ID NO: 11941 - DNA, 20 bp, Artificial Sequence
  chemically synthesized
cccatgggtggagtttagcc

SEQ ID NO: 11942 - DNA, 20 bp, Artificial Sequence
  chemically synthesized
ccatgggtggagtttagcca

SEQ ID NO: 11943 - DNA, 20 bp, Artificial Sequence
  chemically synthesized
agtttagccagggaccgttt

SEQ ID NO: 11944 - DNA, 20 bp, Artificial Sequence
  chemically synthesized
tagccagggaccgtttcaga

SEQ ID NO: 11945 - DNA, 20 bp, Artificial Sequence
  chemically synthesized
ttcagacagatatttgcatt

SEQ ID NO: 11946 - DNA, 20 bp, Artificial Sequence
  chemically synthesized
gacagatatttgcattgaga

SEQ ID NO: 11947 - DNA, 20 bp, Artificial Sequence
  chemically synthesized
atatttgcattgagatagtg

SEQ ID NO: 11948 - DNA, 20 bp, Artificial Sequence
  chemically synthesized
tatttgcattgagatagtgt

SEQ ID NO: 11949 - DNA, 20 bp, Artificial Sequence
  chemically synthesized
atttgcattgagatagtgtg

SEQ ID NO: 11950 - DNA, 20 bp, Artificial Sequence
  chemically synthesized
tgcattgagatagtgtgggg

SEQ ID NO: 11951 - DNA, 20 bp, Artificial Sequence
  chemically synthesized
gcattgagatagtgtgggga

SEQ ID NO: 11952 - DNA, 20 bp, Artificial Sequence
  chemically synthesized
cattgagatagtgtggggaa

SEQ ID NO: 11953 - DNA, 20 bp, Artificial Sequence
  chemically synthesized
attgagatagtgtggggaag

SEQ ID NO: 11954 - DNA, 20 bp, Artificial Sequence
  chemically synthesized
agtgtggggaaggggccccc

SEQ ID NO: 11955 - DNA, 20 bp, Artificial Sequence
  chemically synthesized
tgtggggaaggggcccccaa

SEQ ID NO: 11956 - DNA, 20 bp, Artificial Sequence
  chemically synthesized
gtggggaaggggcccccaag

SEQ ID NO: 11957 - DNA, 20 bp, Artificial Sequence
  chemically synthesized
ctgctgcttaatttttttta

SEQ ID NO: 11958 - DNA, 20 bp, Artificial Sequence
  chemically synthesized
gcctttgccttgttccgatt

SEQ ID NO: 11959 - DNA, 20 bp, Artificial Sequence
  chemically synthesized
ctctaatttattcttccctt

SEQ ID NO: 11960 - DNA, 20 bp, Artificial Sequence
  chemically synthesized
aatttattcttccctttagc

SEQ ID NO: 11961 - DNA, 20 bp, Artificial Sequence
  chemically synthesized
ctagttttcttctcccacca

SEQ ID NO: 11962 - DNA, 20 bp, Artificial Sequence
  chemically synthesized
gttttcttctcccaccatag

SEQ ID NO: 11963 - DNA, 20 bp, Artificial Sequence
  chemically synthesized
tctcccaccatagaagatac

SEQ ID NO: 11964 - DNA, 20 bp, Artificial Sequence
  chemically synthesized
ctcccaccatagaagatacc

SEQ ID NO: 11965 - DNA, 20 bp, Artificial Sequence
  chemically synthesized
gataccaggacttcttttgt

SEQ ID NO: 11966 - DNA, 20 bp, Artificial Sequence
  chemically synthesized
gtttttcaccttcttgtctg

SEQ ID NO: 11967 - DNA, 20 bp, Artificial Sequence
  chemically synthesized
caccttcttgtctgtagctc

SEQ ID NO: 11968 - DNA, 20 bp, Artificial Sequence
  chemically synthesized
ttcttgtctgtagctccagt

SEQ ID NO: 11969 - DNA, 20 bp, Artificial Sequence
  chemically synthesized
tcttgtctgtagctccagtg

SEQ ID NO: 11970 - DNA, 20 bp, Artificial Sequence
  chemically synthesized
tgtagctccagtgaggcctg

SEQ ID NO: 11971 - DNA, 20 bp, Artificial Sequence
  chemically synthesized
ccagtgaggcctgtagttta

SEQ ID NO: 11972 - DNA, 20 bp, Artificial Sequence
  chemically synthesized
aggcctgtagtttaaagtta

SEQ ID NO: 11973 - DNA, 20 bp, Artificial Sequence
  chemically synthesized
agcatgtaccaatttttgaa

SEQ ID NO: 11974 - DNA, 20 bp, Artificial Sequence
  chemically synthesized
gtaccaatttttgaaaagtt

SEQ ID NO: 11975 - DNA, 20 bp, Artificial Sequence
  chemically synthesized
taccaatttttgaaaagttc

SEQ ID NO: 11976 - DNA, 20 bp, Artificial Sequence
  chemically synthesized
accaatttttgaaaagttca

SEQ ID NO: 11977 - DNA, 20 bp, Artificial Sequence
  chemically synthesized
agggattgtgaaatgtgttt

SEQ ID NO: 11978 - DNA, 20 bp, Artificial Sequence
  chemically synthesized
gggattgtgaaatgtgtttt

SEQ ID NO: 11979 - DNA, 20 bp, Artificial Sequence
  chemically synthesized
tgtgaaatgtgttttaggca

SEQ ID NO: 11980 - DNA, 20 bp, Artificial Sequence
  chemically synthesized
gtgaaatgtgttttaggcat

SEQ ID NO: 11981 - DNA, 20 bp, Artificial Sequence
  chemically synthesized
atgtgttttaggcataggtc

SEQ ID NO: 11982 - DNA, 20 bp, Artificial Sequence
  chemically synthesized
tgtgttttaggcataggtcc

SEQ ID NO: 11983 - DNA, 20 bp, Artificial Sequence
  chemically synthesized
cataggtccaggatttttga

SEQ ID NO: 11984 - DNA, 20 bp, Artificial Sequence
  chemically synthesized
ataggtccaggatttttgat

SEQ ID NO: 11985 - DNA, 20 bp, Artificial Sequence
  chemically synthesized
atttttgatgggacacgtct

SEQ ID NO: 11986 - DNA, 20 bp, Artificial Sequence
  chemically synthesized
ggacacgtcttagtctcatt

SEQ ID NO: 11987 - DNA, 20 bp, Artificial Sequence
  chemically synthesized
acgtcttagtctcatttagt

SEQ ID NO: 11988 - DNA, 20 bp, Artificial Sequence
  chemically synthesized
tagtctcatttagtaagcat

SEQ ID NO: 11989 - DNA, 20 bp, Artificial Sequence
  chemically synthesized
gtaagcattggtttccaaat

SEQ ID NO: 11990 - DNA, 20 bp, Artificial Sequence
  chemically synthesized
agcattggtttccaaataag

SEQ ID NO: 11991 - DNA, 20 bp, Artificial Sequence
  chemically synthesized
atctttgaatatactctctg

SEQ ID NO: 11992 - DNA, 20 bp, Artificial Sequence
  chemically synthesized
gaatatactctctgtggttt

SEQ ID NO: 11993 - DNA, 20 bp, Artificial Sequence
  chemically synthesized
aatatactctctgtggtttt

SEQ ID NO: 11994 - DNA, 20 bp, Artificial Sequence
  chemically synthesized
gttttaggccattatctctt

SEQ ID NO: 11995 - DNA, 20 bp, Artificial Sequence
  chemically synthesized
attatctcttaagttctcat

SEQ ID NO: 11996 - DNA, 20 bp, Artificial Sequence
  chemically synthesized
ctcttaagttctcattagtg

SEQ ID NO: 11997 - DNA, 20 bp, Artificial Sequence
  chemically synthesized
gtgtagtgaaaaatcctata

SEQ ID NO: 11998 - DNA, 20 bp, Artificial Sequence
  chemically synthesized
tgaaaaatcctataaagcaa

SEQ ID NO: 11999 - DNA, 20 bp, Artificial Sequence
  chemically synthesized
atcctataaagcaacagttt

SEQ ID NO: 12000 - DNA, 20 bp, Artificial Sequence
  chemically synthesized
ataaagcaacagtttcagtg

SEQ ID NO: 12001 - DNA, 20 bp, Artificial Sequence
  chemically synthesized
taaagcaacagtttcagtgc

SEQ ID NO: 12002 - DNA, 20 bp, Artificial Sequence
  chemically synthesized
caacagtttcagtgcaggaa

SEQ ID NO: 12003 - DNA, 20 bp, Artificial Sequence
  chemically synthesized
aatgttatgtaatataatat

SEQ ID NO: 12004 - DNA, 20 bp, Artificial Sequence
  chemically synthesized
aaatcacgcctgtttcatct

SEQ ID NO: 12005 - DNA, 20 bp, Artificial Sequence
  chemically synthesized
cgcctgtttcatctcagcaa

SEQ ID NO: 12006 - DNA, 20 bp, Artificial Sequence
  chemically synthesized
aaaagtattttttttatatt

SEQ ID NO: 12007 - DNA, 20 bp, Artificial Sequence
  chemically synthesized
aaagtattttttttatattc

SEQ ID NO: 12008 - DNA, 20 bp, Artificial Sequence
  chemically synthesized
tttatattcaggtatgtatg

SEQ ID NO: 12009 - DNA, 20 bp, Artificial Sequence
  chemically synthesized
ttatattcaggtatgtatgt

SEQ ID NO: 12010 - DNA, 20 bp, Artificial Sequence
  chemically synthesized
cgatgatgtgtatttatcac

SEQ ID NO: 12011 - DNA, 20 bp, Artificial Sequence
  chemically synthesized
atgtgtatttatcactggat

SEQ ID NO: 12012 - DNA, 20 bp, Artificial Sequence
  chemically synthesized
cactggataagtgtatgtgc

SEQ ID NO: 12013 - DNA, 20 bp, Artificial Sequence
  chemically synthesized
gtatgtgctggctgatgacc

SEQ ID NO: 12014 - DNA, 20 bp, Artificial Sequence
  chemically synthesized
tatgtgctggctgatgaccc

SEQ ID NO: 12015 - DNA, 20 bp, Artificial Sequence
  chemically synthesized
atgtgctggctgatgaccca

SEQ ID NO: 12016 - DNA, 20 bp, Artificial Sequence
  chemically synthesized
tggctgatgacccagggttt

SEQ ID NO: 12017 - DNA, 20 bp, Artificial Sequence
  chemically synthesized
gatgacccagggttttggtg

SEQ ID NO: 12018 - DNA, 20 bp, Artificial Sequence
  chemically synthesized
tggtgtagctcttctatgct

SEQ ID NO: 12019 - DNA, 20 bp, Artificial Sequence
  chemically synthesized
tagctcttctatgctcggta

SEQ ID NO: 12020 - DNA, 20 bp, Artificial Sequence
  chemically synthesized
tctatgctcggtaaagatga

SEQ ID NO: 12021 - DNA, 20 bp, Artificial Sequence
  chemically synthesized
atgctcggtaaagatgatgg

SEQ ID NO: 12022 - DNA, 20 bp, Artificial Sequence
  chemically synthesized
gatggtagaatgctctttac

SEQ ID NO: 12023 - DNA, 20 bp, Artificial Sequence
  chemically synthesized
atgctctttaccagatacta

SEQ ID NO: 12024 - DNA, 20 bp, Artificial Sequence
  chemically synthesized
ctttaccagatactatggat

SEQ ID NO: 12025 - DNA, 20 bp, Artificial Sequence
  chemically synthesized
taattatcttgtataaatgc

SEQ ID NO: 12026 - DNA, 20 bp, Artificial Sequence
  chemically synthesized
aattatcttgtataaatgct

SEQ ID NO: 12027 - DNA, 20 bp, Artificial Sequence
  chemically synthesized
taaatgctaggttcacttct

SEQ ID NO: 12028 - DNA, 20 bp, Artificial Sequence
  chemically synthesized
aaatgctaggttcacttctt

SEQ ID NO: 12029 - DNA, 20 bp, Artificial Sequence
  chemically synthesized
aatgctaggttcacttctta

SEQ ID NO: 12030 - DNA, 20 bp, Artificial Sequence
  chemically synthesized
ttcttagggaatcttattct

SEQ ID NO: 12031 - DNA, 20 bp, Artificial Sequence
  chemically synthesized
ggaatcttattctaagacat

SEQ ID NO: 12032 - DNA, 20 bp, Artificial Sequence
  chemically synthesized
acataagacatgtatttgca

SEQ ID NO: 12033 - DNA, 20 bp, Artificial Sequence
  chemically synthesized
ttgcatggaaaacaactctt

SEQ ID NO: 12034 - DNA, 20 bp, Artificial Sequence
  chemically synthesized
gcatggaaaacaactcttaa

SEQ ID NO: 12035 - DNA, 20 bp, Artificial Sequence
  chemically synthesized
catggaaaacaactcttaag

SEQ ID NO: 12036 - DNA, 20 bp, Artificial Sequence
  chemically synthesized
ggaaaacaactcttaagagg

SEQ ID NO: 12037 - DNA, 20 bp, Artificial Sequence
  chemically synthesized
gaaaacaactcttaagaggc

SEQ ID NO: 12038 - DNA, 20 bp, Artificial Sequence
  chemically synthesized
aaaacaactcttaagaggca

SEQ ID NO: 12039 - DNA, 20 bp, Artificial Sequence
  chemically synthesized
gggactgttttattgactaa

SEQ ID NO: 12040 - DNA, 20 bp, Artificial Sequence
  chemically synthesized
taatagtccacacactgtga

SEQ ID NO: 12041 - DNA, 20 bp, Artificial Sequence
  chemically synthesized
agtccacacactgtgacagc

SEQ ID NO: 12042 - DNA, 20 bp, Artificial Sequence
  chemically synthesized
gtccacacactgtgacagct

SEQ ID NO: 12043 - DNA, 20 bp, Artificial Sequence
  chemically synthesized
tgacagctgggatgtcactg

SEQ ID NO: 12044 - DNA, 20 bp, Artificial Sequence
  chemically synthesized
gctgggatgtcactgtagtt

SEQ ID NO: 12045 - DNA, 20 bp, Artificial Sequence
  chemically synthesized
agacatctttatctgtaact

SEQ ID NO: 12046 - DNA, 20 bp, Artificial Sequence
  chemically synthesized
cagtgctgtttctgacatat

SEQ ID NO: 12047 - DNA, 20 bp, Artificial Sequence
  chemically synthesized
gacatattggccacttaaca

SEQ ID NO: 12048 - DNA, 20 bp, Artificial Sequence
  chemically synthesized
atattggccacttaacatgg

SEQ ID NO: 12049 - DNA, 20 bp, Artificial Sequence
  chemically synthesized
tattggccacttaacatggc

SEQ ID NO: 12050 - DNA, 20 bp, Artificial Sequence
  chemically synthesized
tggccacttaacatggcagg

SEQ ID NO: 12051 - DNA, 20 bp, Artificial Sequence
  chemically synthesized
ttttttctttattttttctt

SEQ ID NO: 12052 - DNA, 20 bp, Artificial Sequence
  chemically synthesized
tttttctttattttttcttt

SEQ ID NO: 12053 - DNA, 20 bp, Artificial Sequence
  chemically synthesized
tctttgggatttttattttt

SEQ ID NO: 12054 - DNA, 20 bp, Artificial Sequence
  chemically synthesized
ttgggatttttattttttgg

SEQ ID NO: 12055 - DNA, 20 bp, Artificial Sequence
  chemically synthesized
tgggatttttattttttggt

SEQ ID NO: 12056 - DNA, 20 bp, Artificial Sequence
  chemically synthesized
tttttattttttggtaggtt

SEQ ID NO: 12057 - DNA, 20 bp, Artificial Sequence
  chemically synthesized
ctgaactcgatccatgacct

SEQ ID NO: 12058 - DNA, 20 bp, Artificial Sequence
  chemically synthesized
aactcgatccatgaccttgg

SEQ ID NO: 12059 - DNA, 20 bp, Artificial Sequence
  chemically synthesized
accttggtagattatgacgt

SEQ ID NO: 12060 - DNA, 20 bp, Artificial Sequence
  chemically synthesized
gattatgacgtcagaaactc

SEQ ID NO: 12061 - DNA, 20 bp, Artificial Sequence
  chemically synthesized
cgtcagaaactctggaaatc

SEQ ID NO: 12062 - DNA, 20 bp, Artificial Sequence
  chemically synthesized
actctggaaatctggcttat

SEQ ID NO: 12063 - DNA, 20 bp, Artificial Sequence
  chemically synthesized
tctggaaatctggcttattg

SEQ ID NO: 12064 - DNA, 20 bp, Artificial Sequence
  chemically synthesized
ctggaaatctggcttattgg

SEQ ID NO: 12065 - DNA, 20 bp, Artificial Sequence
  chemically synthesized
ggaaatctggcttattggag

SEQ ID NO: 12066 - DNA, 20 bp, Artificial Sequence
  chemically synthesized
aaatctggcttattggagga

SEQ ID NO: 12067 - DNA, 20 bp, Artificial Sequence
  chemically synthesized
tctaccttcccctaacctat

SEQ ID NO: 12068 - DNA, 20 bp, Artificial Sequence
  chemically synthesized
ctaccttcccctaacctatc

SEQ ID NO: 12069 - DNA, 20 bp, Artificial Sequence
  chemically synthesized
cccctaacctatcaggttga

SEQ ID NO: 12070 - DNA, 20 bp, Artificial Sequence
  chemically synthesized
ccctaacctatcaggttgat

SEQ ID NO: 12071 - DNA, 20 bp, Artificial Sequence
  chemically synthesized
gataggaattataataatat

SEQ ID NO: 12072 - DNA, 20 bp, Artificial Sequence
  chemically synthesized
aggaattataataatattgg

SEQ ID NO: 12073 - DNA, 20 bp, Artificial Sequence
  chemically synthesized
taatattggtggaatccttt

SEQ ID NO: 12074 - DNA, 20 bp, Artificial Sequence
  chemically synthesized
cagacttcataatcctgtgt

SEQ ID NO: 12075 - DNA, 20 bp, Artificial Sequence
  chemically synthesized
agacttcataatcctgtgta

SEQ ID NO: 12076 - DNA, 20 bp, Artificial Sequence
  chemically synthesized
gtaaggcttatatctgctca

SEQ ID NO: 12077 - DNA, 20 bp, Artificial Sequence
  chemically synthesized
cttatatctgctcaaagtgt

SEQ ID NO: 12078 - DNA, 20 bp, Artificial Sequence
  chemically synthesized
ttatatctgctcaaagtgtt

SEQ ID NO: 12079 - DNA, 20 bp, Artificial Sequence
  chemically synthesized
tatctgctcaaagtgttagg

SEQ ID NO: 12080 - DNA, 20 bp, Artificial Sequence
  chemically synthesized
tcaaagtgttaggcggctaa

SEQ ID NO: 12081 - DNA, 20 bp, Artificial Sequence
  chemically synthesized
gtgttaggcggctaaaagac

SEQ ID NO: 12082 - DNA, 20 bp, Artificial Sequence
  chemically synthesized
taggcggctaaaagaccaga

SEQ ID NO: 12083 - DNA, 20 bp, Artificial Sequence
  chemically synthesized
acatgttgacctgcgcaaca

SEQ ID NO: 12084 - DNA, 20 bp, Artificial Sequence
  chemically synthesized
cacatattgcacttgttctt

SEQ ID NO: 12085 - DNA, 20 bp, Artificial Sequence
  chemically synthesized
atattgcacttgttctttgg

SEQ ID NO: 12086 - DNA, 20 bp, Artificial Sequence
  chemically synthesized
ttctttggaagttaaaataa

SEQ ID NO: 12087 - DNA, 20 bp, Artificial Sequence
  chemically synthesized
agttaaaataaaagttgaat

SEQ ID NO: 12088 - DNA, 20 bp, Artificial Sequence
  chemically synthesized
aaaataaaagttgaataaga

SEQ ID NO: 12089 - DNA, 20 bp, Artificial Sequence
  chemically synthesized
aaataaaagttgaataagaa

SEQ ID NO: 12090 - DNA, 20 bp, Artificial Sequence
  chemically synthesized
aaaagttgaataagaaagga

SEQ ID NO: 12091 - DNA, 20 bp, Artificial Sequence
  chemically synthesized
tgaataagaaaggaaagaaa

SEQ ID NO: 12092 - DNA, 20 bp, Artificial Sequence
  chemically synthesized
aaaaagatttgtcaacttat

SEQ ID NO: 12093 - DNA, 20 bp, Artificial Sequence
  chemically synthesized
gtcaacttatcagtatcttc

SEQ ID NO: 12094 - DNA, 20 bp, Artificial Sequence
  chemically synthesized
ccagttactcacataataat

SEQ ID NO: 12095 - DNA, 20 bp, Artificial Sequence
  chemically synthesized
taagtgacttctctcaatct

SEQ ID NO: 12096 - DNA, 20 bp, Artificial Sequence
  chemically synthesized
aagtgacttctctcaatcta

SEQ ID NO: 12097 - DNA, 20 bp, Artificial Sequence
  chemically synthesized
gacttctctcaatctaagga

SEQ ID NO: 12098 - DNA, 20 bp, Artificial Sequence
  chemically synthesized
acttctctcaatctaaggat

SEQ ID NO: 12099 - DNA, 20 bp, Artificial Sequence
  chemically synthesized
ctctcaatctaaggatgggt

SEQ ID NO: 12100 - DNA, 20 bp, Artificial Sequence
  chemically synthesized
caatctaaggatgggtgaga

SEQ ID NO: 12101 - DNA, 20 bp, Artificial Sequence
  chemically synthesized
tgggtgagaaagatttttat

SEQ ID NO: 12102 - DNA, 20 bp, Artificial Sequence
  chemically synthesized
aaagatttttattggtatgc

SEQ ID NO: 12103 - DNA, 20 bp, Artificial Sequence
  chemically synthesized
tttttattggtatgctggta

SEQ ID NO: 12104 - DNA, 20 bp, Artificial Sequence
  chemically synthesized
tggtatgctggtacagatta

SEQ ID NO: 12105 - DNA, 20 bp, Artificial Sequence
  chemically synthesized
gtatgctggtacagattata

SEQ ID NO: 12106 - DNA, 20 bp, Artificial Sequence
  chemically synthesized
tggtacagattatagagact

SEQ ID NO: 12107 - DNA, 20 bp, Artificial Sequence
  chemically synthesized
ggtacagattatagagactg

SEQ ID NO: 12108 - DNA, 20 bp, Artificial Sequence
  chemically synthesized
agactgaggtgaacccaaat

SEQ ID NO: 12109 - DNA, 20 bp, Artificial Sequence
  chemically synthesized
gactgaggtgaacccaaatt

SEQ ID NO: 12110 - DNA, 20 bp, Artificial Sequence
  chemically synthesized
actgaggtgaacccaaatta

SEQ ID NO: 12111 - DNA, 20 bp, Artificial Sequence
  chemically synthesized
acccaaattagggtctcttt

SEQ ID NO: 12112 - DNA, 20 bp, Artificial Sequence
  chemically synthesized
aaattagggtctctttaaga

SEQ ID NO: 12113 - DNA, 20 bp, Artificial Sequence
  chemically synthesized
aattagggtctctttaagat

SEQ ID NO: 12114 - DNA, 20 bp, Artificial Sequence
  chemically synthesized
attagggtctctttaagata

SEQ ID NO: 12115 - DNA, 20 bp, Artificial Sequence
  chemically synthesized
ttagggtctctttaagatag

SEQ ID NO: 12116 - DNA, 20 bp, Artificial Sequence
  chemically synthesized
ctttaagataggggatctgt

SEQ ID NO: 12117 - DNA, 20 bp, Artificial Sequence
  chemically synthesized
aagataggggatctgtgaga

SEQ ID NO: 12118 - DNA, 20 bp, Artificial Sequence
  chemically synthesized
agataggggatctgtgagat

SEQ ID NO: 12119 - DNA, 20 bp, Artificial Sequence
  chemically synthesized
atctgtgagatgggtgtgta

SEQ ID NO: 12120 - DNA, 20 bp, Artificial Sequence
  chemically synthesized
gatgggtgtgtatagatctt

SEQ ID NO: 12121 - DNA, 20 bp, Artificial Sequence
  chemically synthesized
atagatctttggccatatct

SEQ ID NO: 12122 - DNA, 20 bp, Artificial Sequence
  chemically synthesized
agatctttggccatatctga

SEQ ID NO: 12123 - DNA, 20 bp, Artificial Sequence
  chemically synthesized
tttggccatatctgagagtc

SEQ ID NO: 12124 - DNA, 20 bp, Artificial Sequence
  chemically synthesized
gccatatctgagagtctggt

SEQ ID NO: 12125 - DNA, 20 bp, Artificial Sequence
  chemically synthesized
ccatatctgagagtctggtt

SEQ ID NO: 12126 - DNA, 20 bp, Artificial Sequence
  chemically synthesized
gtctggttgggttccatttg

SEQ ID NO: 12127 - DNA, 20 bp, Artificial Sequence
  chemically synthesized
ctggttgggttccatttgta

SEQ ID NO: 12128 - DNA, 20 bp, Artificial Sequence
  chemically synthesized
atttgtagagcctgaccttt

SEQ ID NO: 12129 - DNA, 20 bp, Artificial Sequence
  chemically synthesized
cctgacctttaagaatgtgt

SEQ ID NO: 12130 - DNA, 20 bp, Artificial Sequence
  chemically synthesized
tgacctttaagaatgtgtca

SEQ ID NO: 12131 - DNA, 20 bp, Artificial Sequence
  chemically synthesized
tttaagaatgtgtcagagac

SEQ ID NO: 12132 - DNA, 20 bp, Artificial Sequence
  chemically synthesized
tgtgtcagagactggtgtct

SEQ ID NO: 12133 - DNA, 20 bp, Artificial Sequence
  chemically synthesized
gactggtgtctaagcccgct

SEQ ID NO: 12134 - DNA, 20 bp, Artificial Sequence
  chemically synthesized
actggtgtctaagcccgcta

SEQ ID NO: 12135 - DNA, 20 bp, Artificial Sequence
  chemically synthesized
aagcccgctaaggcctaaac

SEQ ID NO: 12136 - DNA, 20 bp, Artificial Sequence
  chemically synthesized
aatctctctttttttttttt

SEQ ID NO: 12137 - DNA, 20 bp, Artificial Sequence
  chemically synthesized
tctcttttttttttttgaga

SEQ ID NO: 12138 - DNA, 20 bp, Artificial Sequence
  chemically synthesized
tcttttttttttttgagaca

SEQ ID NO: 12139 - DNA, 20 bp, Artificial Sequence
  chemically synthesized
cagagtcttgttctgtcacc

SEQ ID NO: 12140 - DNA, 20 bp, Artificial Sequence
  chemically synthesized
agagtcttgttctgtcaccc

SEQ ID NO: 12141 - DNA, 20 bp, Artificial Sequence
  chemically synthesized
tcttgttctgtcacccaggc

SEQ ID NO: 12142 - DNA, 20 bp, Artificial Sequence
  chemically synthesized
ttgttctgtcacccaggctg

SEQ ID NO: 12143 - DNA, 20 bp, Artificial Sequence
  chemically synthesized
ctgtcacccaggctggagtg

SEQ ID NO: 12144 - DNA, 20 bp, Artificial Sequence
  chemically synthesized
tcacccaggctggagtgcag

SEQ ID NO: 12145 - DNA, 20 bp, Artificial Sequence
  chemically synthesized
ggagtgcagtggtatgatct

SEQ ID NO: 12146 - DNA, 20 bp, Artificial Sequence
  chemically synthesized
tcactgcaactcctgccttc

SEQ ID NO: 12147 - DNA, 20 bp, Artificial Sequence
  chemically synthesized
cactgcaactcctgccttcc

SEQ ID NO: 12148 - DNA, 20 bp, Artificial Sequence
  chemically synthesized
aactcctgccttccaggttc

SEQ ID NO: 12149 - DNA, 20 bp, Artificial Sequence
  chemically synthesized
ttcaagcaattctccttcct

SEQ ID NO: 12150 - DNA, 20 bp, Artificial Sequence
  chemically synthesized
ttctccttcctcagcctccc

SEQ ID NO: 12151 - DNA, 20 bp, Artificial Sequence
  chemically synthesized
tccttcctcagcctcccaag

SEQ ID NO: 12152 - DNA, 20 bp, Artificial Sequence
  chemically synthesized
tcctcagcctcccaagtagc

SEQ ID NO: 12153 - DNA, 20 bp, Artificial Sequence
  chemically synthesized
cctcagcctcccaagtagct

SEQ ID NO: 12154 - DNA, 20 bp, Artificial Sequence
  chemically synthesized
ctcccaagtagctgggatta

SEQ ID NO: 12155 - DNA, 20 bp, Artificial Sequence
  chemically synthesized
tcccaagtagctgggattac

SEQ ID NO: 12156 - DNA, 20 bp, Artificial Sequence
  chemically synthesized
gtctaatttttgtatttttg

SEQ ID NO: 12157 - DNA, 20 bp, Artificial Sequence
  chemically synthesized
ctaatttttgtatttttgta

SEQ ID NO: 12158 - DNA, 20 bp, Artificial Sequence
  chemically synthesized
tttttgtatttttgtagaga

SEQ ID NO: 12159 - DNA, 20 bp, Artificial Sequence
  chemically synthesized
ttttgtatttttgtagagat

SEQ ID NO: 12160 - DNA, 20 bp, Artificial Sequence
  chemically synthesized
gagatgggatttcaccatgt

SEQ ID NO: 12161 - DNA, 20 bp, Artificial Sequence
  chemically synthesized
tgggatttcaccatgttggc

SEQ ID NO: 12162 - DNA, 20 bp, Artificial Sequence
  chemically synthesized
gggatttcaccatgttggcc

SEQ ID NO: 12163 - DNA, 20 bp, Artificial Sequence
  chemically synthesized
tttcaccatgttggccaggt

SEQ ID NO: 12164 - DNA, 20 bp, Artificial Sequence
  chemically synthesized
tggtcttgaactcttgacct

SEQ ID NO: 12165 - DNA, 20 bp, Artificial Sequence
  chemically synthesized
ggtcttgaactcttgacctc

SEQ ID NO: 12166 - DNA, 20 bp, Artificial Sequence
  chemically synthesized
ctcaggtgatctgcctgcct

SEQ ID NO: 12167 - DNA, 20 bp, Artificial Sequence
  chemically synthesized
gccttggcctcccaaaattc

SEQ ID NO: 12168 - DNA, 20 bp, Artificial Sequence
  chemically synthesized
ccttggcctcccaaaattct

SEQ ID NO: 12169 - DNA, 20 bp, Artificial Sequence
  chemically synthesized
ctcccaaaattctgggatta

SEQ ID NO: 12170 - DNA, 20 bp, Artificial Sequence
  chemically synthesized
tcccaaaattctgggattac

SEQ ID NO: 12171 - DNA, 20 bp, Artificial Sequence
  chemically synthesized
aattctgggattacaggcgt

SEQ ID NO: 12172 - DNA, 20 bp, Artificial Sequence
  chemically synthesized
caggcgtgagccaccactcc

SEQ ID NO: 12173 - DNA, 20 bp, Artificial Sequence
  chemically synthesized
accactcccagcctctaaac

SEQ ID NO: 12174 - DNA, 20 bp, Artificial Sequence
  chemically synthesized
gaatcttaattgctcctcct

SEQ ID NO: 12175 - DNA, 20 bp, Artificial Sequence
  chemically synthesized
taattgctcctcctcagact

SEQ ID NO: 12176 - DNA, 20 bp, Artificial Sequence
  chemically synthesized
aattgctcctcctcagacta

SEQ ID NO: 12177 - DNA, 20 bp, Artificial Sequence
  chemically synthesized
tcctcagactaaggaatatc

SEQ ID NO: 12178 - DNA, 20 bp, Artificial Sequence
  chemically synthesized
cctcagactaaggaatatct

SEQ ID NO: 12179 - DNA, 20 bp, Artificial Sequence
  chemically synthesized
tccccatttatccaaaaacc

SEQ ID NO: 12180 - DNA, 20 bp, Artificial Sequence
  chemically synthesized
ccccatttatccaaaaacca

SEQ ID NO: 12181 - DNA, 20 bp, Artificial Sequence
  chemically synthesized
catttatccaaaaaccaagg

SEQ ID NO: 12182 - DNA, 20 bp, Artificial Sequence
  chemically synthesized
aaaccaaggcagtgttctaa

SEQ ID NO: 12183 - DNA, 20 bp, Artificial Sequence
  chemically synthesized
ttatttcctcttatgctttt

SEQ ID NO: 12184 - DNA, 20 bp, Artificial Sequence
  chemically synthesized
tatttcctcttatgcttttg

SEQ ID NO: 12185 - DNA, 20 bp, Artificial Sequence
  chemically synthesized
cttttgaggcaatatctttt

SEQ ID NO: 12186 - DNA, 20 bp, Artificial Sequence
  chemically synthesized
tttgaggcaatatcttttaa

SEQ ID NO: 12187 - DNA, 20 bp, Artificial Sequence
  chemically synthesized
ataaaactgtttctttacac

SEQ ID NO: 12188 - DNA, 20 bp, Artificial Sequence
  chemically synthesized
ttctttacacaagcaatttc

SEQ ID NO: 12189 - DNA, 20 bp, Artificial Sequence
  chemically synthesized
aagcaatttcaagtgttttc

SEQ ID NO: 12190 - DNA, 20 bp, Artificial Sequence
  chemically synthesized
tgtattttcaaacatttgtt

SEQ ID NO: 12191 - DNA, 20 bp, Artificial Sequence
  chemically synthesized
aataaatgtcataattttta

SEQ ID NO: 12192 - DNA, 20 bp, Artificial Sequence
  chemically synthesized
aaatgtcataatttttaaag

SEQ ID NO: 12193 - DNA, 20 bp, Artificial Sequence
  chemically synthesized
tgtcataatttttaaagtag

SEQ ID NO: 12194 - DNA, 20 bp, Artificial Sequence
  chemically synthesized
gtcataatttttaaagtagt

SEQ ID NO: 12195 - DNA, 20 bp, Artificial Sequence
  chemically synthesized
ttttaaagtagtgggcattt

SEQ ID NO: 12196 - DNA, 20 bp, Artificial Sequence
  chemically synthesized
agtgggcatttaagttaaat

SEQ ID NO: 12197 - DNA, 20 bp, Artificial Sequence
  chemically synthesized
ggcatttaagttaaataagt

SEQ ID NO: 12198 - DNA, 20 bp, Artificial Sequence
  chemically synthesized
catttaagttaaataagtca

SEQ ID NO: 12199 - DNA, 20 bp, Artificial Sequence
  chemically synthesized
gagaataaaactttcctctg

SEQ ID NO: 12200 - DNA, 20 bp, Artificial Sequence
  chemically synthesized
ttcctctgaagattataatc

SEQ ID NO: 12201 - DNA, 20 bp, Artificial Sequence
  chemically synthesized
tcctctgaagattataatct

SEQ ID NO: 12202 - DNA, 20 bp, Artificial Sequence
  chemically synthesized
tctgaagattataatctagg

SEQ ID NO: 12203 - DNA, 20 bp, Artificial Sequence
  chemically synthesized
catacataaaattaataatt

SEQ ID NO: 12204 - DNA, 20 bp, Artificial Sequence
  chemically synthesized
gttaaacaacaaaataattt

SEQ ID NO: 12205 - DNA, 20 bp, Artificial Sequence
  chemically synthesized
aatttcagatattattaact

SEQ ID NO: 12206 - DNA, 20 bp, Artificial Sequence
  chemically synthesized
tattaactaagaatgaaatt

SEQ ID NO: 12207 - DNA, 20 bp, Artificial Sequence
  chemically synthesized
attaactaagaatgaaatta

SEQ ID NO: 12208 - DNA, 20 bp, Artificial Sequence
  chemically synthesized
taactaagaatgaaattaag

SEQ ID NO: 12209 - DNA, 20 bp, Artificial Sequence
  chemically synthesized
taagaatgaaattaaggaga

SEQ ID NO: 12210 - DNA, 20 bp, Artificial Sequence
  chemically synthesized
ttaaggagaaagtattcgaa

SEQ ID NO: 12211 - DNA, 20 bp, Artificial Sequence
  chemically synthesized
aaggagaaagtattcgaaca

SEQ ID NO: 12212 - DNA, 20 bp, Artificial Sequence
  chemically synthesized
aggagaaagtattcgaacag

SEQ ID NO: 12213 - DNA, 20 bp, Artificial Sequence
  chemically synthesized
ttcgaacagaggcaaaatga

SEQ ID NO: 12214 - DNA, 20 bp, Artificial Sequence
  chemically synthesized
gaacagaggcaaaatgacag

SEQ ID NO: 12215 - DNA, 20 bp, Artificial Sequence
  chemically synthesized
aacagaggcaaaatgacaga

SEQ ID NO: 12216 - DNA, 20 bp, Artificial Sequence
  chemically synthesized
atgacagaaggaatctgcca

SEQ ID NO: 12217 - DNA, 20 bp, Artificial Sequence
  chemically synthesized
tgacagaaggaatctgccat

SEQ ID NO: 12218 - DNA, 20 bp, Artificial Sequence
  chemically synthesized
cagaaggaatctgccatggg

SEQ ID NO: 12219 - DNA, 20 bp, Artificial Sequence
  chemically synthesized
agaaggaatctgccatggga

SEQ ID NO: 12220 - DNA, 20 bp, Artificial Sequence
  chemically synthesized
tgggaaggcattgccaaata

SEQ ID NO: 12221 - DNA, 20 bp, Artificial Sequence
  chemically synthesized
aggcattgccaaataaagtt

SEQ ID NO: 12222 - DNA, 20 bp, Artificial Sequence
  chemically synthesized
cattgccaaataaagtttag

SEQ ID NO: 12223 - DNA, 20 bp, Artificial Sequence
  chemically synthesized
ataaagtttagaagctgaaa

SEQ ID NO: 12224 - DNA, 20 bp, Artificial Sequence
  chemically synthesized
aagctgaaatagtaaattca

SEQ ID NO: 12225 - DNA, 20 bp, Artificial Sequence
  chemically synthesized
atagtaaattcaaagctctg

SEQ ID NO: 12226 - DNA, 20 bp, Artificial Sequence
  chemically synthesized
gtaaattcaaagctctgaag

SEQ ID NO: 12227 - DNA, 20 bp, Artificial Sequence
  chemically synthesized
aattcaaagctctgaagcag

SEQ ID NO: 12228 - DNA, 20 bp, Artificial Sequence
  chemically synthesized
aaaacaaactcctgctgtgc

SEQ ID NO: 12229 - DNA, 20 bp, Artificial Sequence
  chemically synthesized
aacaaactcctgctgtgcca

SEQ ID NO: 12230 - DNA, 20 bp, Artificial Sequence
  chemically synthesized
caaactcctgctgtgccaga

SEQ ID NO: 12231 - DNA, 20 bp, Artificial Sequence
  chemically synthesized
ctcctgctgtgccagagagt

SEQ ID NO: 12232 - DNA, 20 bp, Artificial Sequence
  chemically synthesized
ctgtgccagagagttagata

SEQ ID NO: 12233 - DNA, 20 bp, Artificial Sequence
  chemically synthesized
cagagagttagataaagaac

SEQ ID NO: 12234 - DNA, 20 bp, Artificial Sequence
  chemically synthesized
accagtgccgttgatatgta

SEQ ID NO: 12235 - DNA, 20 bp, Artificial Sequence
  chemically synthesized
agtgccgttgatatgtaaag

SEQ ID NO: 12236 - DNA, 20 bp, Artificial Sequence
  chemically synthesized
tgccgttgatatgtaaagtg

SEQ ID NO: 12237 - DNA, 20 bp, Artificial Sequence
  chemically synthesized
ttgatatgtaaagtggagaa

SEQ ID NO: 12238 - DNA, 20 bp, Artificial Sequence
  chemically synthesized
atatgtaaagtggagaatag

SEQ ID NO: 12239 - DNA, 20 bp, Artificial Sequence
  chemically synthesized
tatgtaaagtggagaatagc

SEQ ID NO: 12240 - DNA, 20 bp, Artificial Sequence
  chemically synthesized
gtaaagtggagaatagcagg

SEQ ID NO: 12241 - DNA, 20 bp, Artificial Sequence
  chemically synthesized
aatagcaggtggtattgttt

SEQ ID NO: 12242 - DNA, 20 bp, Artificial Sequence
  chemically synthesized
atagcaggtggtattgtttc

SEQ ID NO: 12243 - DNA, 20 bp, Artificial Sequence
  chemically synthesized
tagcaggtggtattgtttca

SEQ ID NO: 12244 - DNA, 20 bp, Artificial Sequence
  chemically synthesized
caggtggtattgtttcaggg

SEQ ID NO: 12245 - DNA, 20 bp, Artificial Sequence
  chemically synthesized
tttcagggaagcataaacct

SEQ ID NO: 12246 - DNA, 20 bp, Artificial Sequence
  chemically synthesized
ttcagggaagcataaaccta

SEQ ID NO: 12247 - DNA, 20 bp, Artificial Sequence
  chemically synthesized
taaggacataaacttgtcct

SEQ ID NO: 12248 - DNA, 20 bp, Artificial Sequence
  chemically synthesized
ggacataaacttgtcctcag

SEQ ID NO: 12249 - DNA, 20 bp, Artificial Sequence
  chemically synthesized
cataaacttgtcctcagtgg

SEQ ID NO: 12250 - DNA, 20 bp, Artificial Sequence
  chemically synthesized
ataaacttgtcctcagtggt

SEQ ID NO: 12251 - DNA, 20 bp, Artificial Sequence
  chemically synthesized
taaacttgtcctcagtggta

SEQ ID NO: 12252 - DNA, 20 bp, Artificial Sequence
  chemically synthesized
aacttgtcctcagtggtagg

SEQ ID NO: 12253 - DNA, 20 bp, Artificial Sequence
  chemically synthesized
tgtcctcagtggtagggagt

SEQ ID NO: 12254 - DNA, 20 bp, Artificial Sequence
  chemically synthesized
cctcagtggtagggagtgag

SEQ ID NO: 12255 - DNA, 20 bp, Artificial Sequence
  chemically synthesized
tagggagtgagaagccatta

SEQ ID NO: 12256 - DNA, 20 bp, Artificial Sequence
  chemically synthesized
ccattatagaattttaactc

SEQ ID NO: 12257 - DNA, 20 bp, Artificial Sequence
  chemically synthesized
ctggtaatgacataatctct

SEQ ID NO: 12258 - DNA, 20 bp, Artificial Sequence
  chemically synthesized
ctctaagcaacctgtactat

SEQ ID NO: 12259 - DNA, 20 bp, Artificial Sequence
  chemically synthesized
aagcaacctgtactattggc

SEQ ID NO: 12260 - DNA, 20 bp, Artificial Sequence
  chemically synthesized
attggctggattactattct

SEQ ID NO: 12261 - DNA, 20 bp, Artificial Sequence
  chemically synthesized
tcacaactgttttgcttaaa

SEQ ID NO: 12262 - DNA, 20 bp, Artificial Sequence
  chemically synthesized
taaaaagcccttattgcctg

SEQ ID NO: 12263 - DNA, 20 bp, Artificial Sequence
  chemically synthesized
tattgcctgtggacaattat

SEQ ID NO: 12264 - DNA, 20 bp, Artificial Sequence
  chemically synthesized
ctattaaaaatcttgtcatg

SEQ ID NO: 12265 - DNA, 20 bp, Artificial Sequence
  chemically synthesized
ttatgaatttgctttcaatt

SEQ ID NO: 12266 - DNA, 20 bp, Artificial Sequence
  chemically synthesized
tcaattaagttatcttgaat

SEQ ID NO: 12267 - DNA, 20 bp, Artificial Sequence
  chemically synthesized
gaattggcaatatctaaatc

SEQ ID NO: 12268 - DNA, 20 bp, Artificial Sequence
  chemically synthesized
gcaatatctaaatctagata

SEQ ID NO: 12269 - DNA, 20 bp, Artificial Sequence
  chemically synthesized
aaatctagatatagctccct

SEQ ID NO: 12270 - DNA, 20 bp, Artificial Sequence
  chemically synthesized
aatctagatatagctcccta

SEQ ID NO: 12271 - DNA, 20 bp, Artificial Sequence
  chemically synthesized
atctagatatagctccctaa

SEQ ID NO: 12272 - DNA, 20 bp, Artificial Sequence
  chemically synthesized
tctagatatagctccctaag

SEQ ID NO: 12273 - DNA, 20 bp, Artificial Sequence
  chemically synthesized
atatagctccctaaggggta

SEQ ID NO: 12274 - DNA, 20 bp, Artificial Sequence
  chemically synthesized
atagctccctaaggggtaaa

SEQ ID NO: 12275 - DNA, 20 bp, Artificial Sequence
  chemically synthesized
tccttgattccttgatatca

SEQ ID NO: 12276 - DNA, 20 bp, Artificial Sequence
  chemically synthesized
ccttgattccttgatatcaa

SEQ ID NO: 12277 - DNA, 20 bp, Artificial Sequence
  chemically synthesized
cttgattccttgatatcaaa

SEQ ID NO: 12278 - DNA, 20 bp, Artificial Sequence
  chemically synthesized
gattccttgatatcaaaggg

SEQ ID NO: 12279 - DNA, 20 bp, Artificial Sequence
  chemically synthesized
cttgatatcaaagggcagta

SEQ ID NO: 12280 - DNA, 20 bp, Artificial Sequence
  chemically synthesized
atcaaagggcagtatagttt

SEQ ID NO: 12281 - DNA, 20 bp, Artificial Sequence
  chemically synthesized
tcaaagggcagtatagtttt

SEQ ID NO: 12282 - DNA, 20 bp, Artificial Sequence
  chemically synthesized
caaagggcagtatagttttg

SEQ ID NO: 12283 - DNA, 20 bp, Artificial Sequence
  chemically synthesized
aaagggcagtatagttttgg

SEQ ID NO: 12284 - DNA, 20 bp, Artificial Sequence
  chemically synthesized
agggcagtatagttttgggg

SEQ ID NO: 12285 - DNA, 20 bp, Artificial Sequence
  chemically synthesized
gcagtatagttttgggggag

SEQ ID NO: 12286 - DNA, 20 bp, Artificial Sequence
  chemically synthesized
tagttttgggggagaagaaa

SEQ ID NO: 12287 - DNA, 20 bp, Artificial Sequence
  chemically synthesized
gttttgggggagaagaaaaa

SEQ ID NO: 12288 - DNA, 20 bp, Artificial Sequence
  chemically synthesized
tttgggggagaagaaaaaga

SEQ ID NO: 12289 - DNA, 20 bp, Artificial Sequence
  chemically synthesized
tgggggagaagaaaaagaga

SEQ ID NO: 12290 - DNA, 20 bp, Artificial Sequence
  chemically synthesized
ggggagaagaaaaagagaga

SEQ ID NO: 12291 - DNA, 20 bp, Artificial Sequence
  chemically synthesized
ggagaagaaaaagagagaga

SEQ ID NO: 12292 - DNA, 20 bp, Artificial Sequence
  chemically synthesized
aaaagagagagagagaaaaa

SEQ ID NO: 12293 - DNA, 20 bp, Artificial Sequence
  chemically synthesized
aatgcatattaccgacaaat

SEQ ID NO: 12294 - DNA, 20 bp, Artificial Sequence
  chemically synthesized
tgcatattaccgacaaatta

SEQ ID NO: 12295 - DNA, 20 bp, Artificial Sequence
  chemically synthesized
gcatattaccgacaaattag

SEQ ID NO: 12296 - DNA, 20 bp, Artificial Sequence
  chemically synthesized
catattaccgacaaattaga

SEQ ID NO: 12297 - DNA, 20 bp, Artificial Sequence
  chemically synthesized
accgacaaattagagggtga

SEQ ID NO: 12298 - DNA, 20 bp, Artificial Sequence
  chemically synthesized
gacaaattagagggtgatgg

SEQ ID NO: 12299 - DNA, 20 bp, Artificial Sequence
  chemically synthesized
aattagagggtgatggcaga

SEQ ID NO: 12300 - DNA, 20 bp, Artificial Sequence
  chemically synthesized
attagagggtgatggcagat

SEQ ID NO: 12301 - DNA, 20 bp, Artificial Sequence
  chemically synthesized
tagagggtgatggcagatgg

SEQ ID NO: 12302 - DNA, 20 bp, Artificial Sequence
  chemically synthesized
agagggtgatggcagatggg

SEQ ID NO: 12303 - DNA, 20 bp, Artificial Sequence
  chemically synthesized
gggtgatggcagatgggagg

SEQ ID NO: 12304 - DNA, 20 bp, Artificial Sequence
  chemically synthesized
tgatggcagatgggaggcag

SEQ ID NO: 12305 - DNA, 20 bp, Artificial Sequence
  chemically synthesized
tggcagatgggaggcagcag

SEQ ID NO: 12306 - DNA, 20 bp, Artificial Sequence
  chemically synthesized
gaggcagcagaagtacattg

SEQ ID NO: 12307 - DNA, 20 bp, Artificial Sequence
  chemically synthesized
agtacattgcagctcccact

SEQ ID NO: 12308 - DNA, 20 bp, Artificial Sequence
  chemically synthesized
gcagctcccactcggatgca

SEQ ID NO: 12309 - DNA, 20 bp, Artificial Sequence
  chemically synthesized
agctcccactcggatgcaca

SEQ ID NO: 12310 - DNA, 20 bp, Artificial Sequence
  chemically synthesized
tcccactcggatgcacagag

SEQ ID NO: 12311 - DNA, 20 bp, Artificial Sequence
  chemically synthesized
gatgcacagagcagcatgtg

SEQ ID NO: 12312 - DNA, 20 bp, Artificial Sequence
  chemically synthesized
cagcatgtgaagtctcccat

SEQ ID NO: 12313 - DNA, 20 bp, Artificial Sequence
  chemically synthesized
agcatgtgaagtctcccatc

SEQ ID NO: 12314 - DNA, 20 bp, Artificial Sequence
  chemically synthesized
cccatcaggaattttttttg

SEQ ID NO: 12315 - DNA, 20 bp, Artificial Sequence
  chemically synthesized
tttttttgcagaaccacctg

SEQ ID NO: 12316 - DNA, 20 bp, Artificial Sequence
  chemically synthesized
accacctgcagaaataaatc

SEQ ID NO: 12317 - DNA, 20 bp, Artificial Sequence
  chemically synthesized
cctgcagaaataaatcaaga

SEQ ID NO: 12318 - DNA, 20 bp, Artificial Sequence
  chemically synthesized
agaaataaatcaagaaagct

SEQ ID NO: 12319 - DNA, 20 bp, Artificial Sequence
  chemically synthesized
aaataaatcaagaaagctga

SEQ ID NO: 12320 - DNA, 20 bp, Artificial Sequence
  chemically synthesized
agaacgcacacaccctctga

SEQ ID NO: 12321 - DNA, 20 bp, Artificial Sequence
  chemically synthesized
acgcacacaccctctgaaag

SEQ ID NO: 12322 - DNA, 20 bp, Artificial Sequence
  chemically synthesized
cacacaccctctgaaagaag

SEQ ID NO: 12323 - DNA, 20 bp, Artificial Sequence
  chemically synthesized
aaagaagcagattgctcctg

SEQ ID NO: 12324 - DNA, 20 bp, Artificial Sequence
  chemically synthesized
aagaagcagattgctcctgc

SEQ ID NO: 12325 - DNA, 20 bp, Artificial Sequence
  chemically synthesized
cagattgctcctgcaggacc

SEQ ID NO: 12326 - DNA, 20 bp, Artificial Sequence
  chemically synthesized
agattgctcctgcaggaccc

SEQ ID NO: 12327 - DNA, 20 bp, Artificial Sequence
  chemically synthesized
ggaaacaccccaaatattgt

SEQ ID NO: 12328 - DNA, 20 bp, Artificial Sequence
  chemically synthesized
tattgtgagtgcccaaactg

SEQ ID NO: 12329 - DNA, 20 bp, Artificial Sequence
  chemically synthesized
tgtgagtgcccaaactgtgg

SEQ ID NO: 12330 - DNA, 20 bp, Artificial Sequence
  chemically synthesized
gagtgcccaaactgtggaag

SEQ ID NO: 12331 - DNA, 20 bp, Artificial Sequence
  chemically synthesized
cccaaactgtggaagtggaa

SEQ ID NO: 12332 - DNA, 20 bp, Artificial Sequence
  chemically synthesized
ccaaactgtggaagtggaaa

SEQ ID NO: 12333 - DNA, 20 bp, Artificial Sequence
  chemically synthesized
caaactgtggaagtggaaaa

SEQ ID NO: 12334 - DNA, 20 bp, Artificial Sequence
  chemically synthesized
aaactgtggaagtggaaaag

SEQ ID NO: 12335 - DNA, 20 bp, Artificial Sequence
  chemically synthesized
aactgtggaagtggaaaagg

SEQ ID NO: 12336 - DNA, 20 bp, Artificial Sequence
  chemically synthesized
ccccaaacacacatcctcac

SEQ ID NO: 12337 - DNA, 20 bp, Artificial Sequence
  chemically synthesized
cccaaacacacatcctcact

SEQ ID NO: 12338 - DNA, 20 bp, Artificial Sequence
  chemically synthesized
ccaaacacacatcctcactg

SEQ ID NO: 12339 - DNA, 20 bp, Artificial Sequence
  chemically synthesized
catcctcactggggaacctg

SEQ ID NO: 12340 - DNA, 20 bp, Artificial Sequence
  chemically synthesized
cactggggaacctgaagatc

SEQ ID NO: 12341 - DNA, 20 bp, Artificial Sequence
  chemically synthesized
gaacctgaagatctagacca

SEQ ID NO: 12342 - DNA, 20 bp, Artificial Sequence
  chemically synthesized
aacctgaagatctagaccac

SEQ ID NO: 12343 - DNA, 20 bp, Artificial Sequence
  chemically synthesized
cctgaagatctagaccacag

SEQ ID NO: 12344 - DNA, 20 bp, Artificial Sequence
  chemically synthesized
gaagatctagaccacaggag

SEQ ID NO: 12345 - DNA, 20 bp, Artificial Sequence
  chemically synthesized
gagaagattctgaccttacc

SEQ ID NO: 12346 - DNA, 20 bp, Artificial Sequence
  chemically synthesized
gaagattctgaccttacctg

SEQ ID NO: 12347 - DNA, 20 bp, Artificial Sequence
  chemically synthesized
ttctgaccttacctggagct

SEQ ID NO: 12348 - DNA, 20 bp, Artificial Sequence
  chemically synthesized
tacctggagctgagtcaatt

SEQ ID NO: 12349 - DNA, 20 bp, Artificial Sequence
  chemically synthesized
cctggagctgagtcaattta

SEQ ID NO: 12350 - DNA, 20 bp, Artificial Sequence
  chemically synthesized
ctggagctgagtcaatttag

SEQ ID NO: 12351 - DNA, 20 bp, Artificial Sequence
  chemically synthesized
tggagctgagtcaatttaga

SEQ ID NO: 12352 - DNA, 20 bp, Artificial Sequence
  chemically synthesized
ctgagtcaatttagagggcc

SEQ ID NO: 12353 - DNA, 20 bp, Artificial Sequence
  chemically synthesized
ttagagggccaagcaaaata

SEQ ID NO: 12354 - DNA, 20 bp, Artificial Sequence
  chemically synthesized
tagagggccaagcaaaatac

SEQ ID NO: 12355 - DNA, 20 bp, Artificial Sequence
  chemically synthesized
agagggccaagcaaaataca

SEQ ID NO: 12356 - DNA, 20 bp, Artificial Sequence
  chemically synthesized
gagggccaagcaaaatacag

SEQ ID NO: 12357 - DNA, 20 bp, Artificial Sequence
  chemically synthesized
ggccaagcaaaatacagggg

SEQ ID NO: 12358 - DNA, 20 bp, Artificial Sequence
  chemically synthesized
ccaagcaaaatacaggggta

SEQ ID NO: 12359 - DNA, 20 bp, Artificial Sequence
  chemically synthesized
caagcaaaatacaggggtag

SEQ ID NO: 12360 - DNA, 20 bp, Artificial Sequence
  chemically synthesized
gcaaaatacaggggtagagg

SEQ ID NO: 12361 - DNA, 20 bp, Artificial Sequence
  chemically synthesized
aaatacaggggtagaggaag

SEQ ID NO: 12362 - DNA, 20 bp, Artificial Sequence
  chemically synthesized
tacaggggtagaggaagcag

SEQ ID NO: 12363 - DNA, 20 bp, Artificial Sequence
  chemically synthesized
acaggggtagaggaagcagc

SEQ ID NO: 12364 - DNA, 20 bp, Artificial Sequence
  chemically synthesized
ggtagaggaagcagcgggaa

SEQ ID NO: 12365 - DNA, 20 bp, Artificial Sequence
  chemically synthesized
aagcagcgggaaaagccctg

SEQ ID NO: 12366 - DNA, 20 bp, Artificial Sequence
  chemically synthesized
agcagcgggaaaagccctgt

SEQ ID NO: 12367 - DNA, 20 bp, Artificial Sequence
  chemically synthesized
gaaaagccctgtgggctctc

SEQ ID NO: 12368 - DNA, 20 bp, Artificial Sequence
  chemically synthesized
aaaagccctgtgggctctct

SEQ ID NO: 12369 - DNA, 20 bp, Artificial Sequence
  chemically synthesized
tgtgggctctctgggtcccc

SEQ ID NO: 12370 - DNA, 20 bp, Artificial Sequence
  chemically synthesized
gtgggctctctgggtcccct

SEQ ID NO: 12371 - DNA, 20 bp, Artificial Sequence
  chemically synthesized
ggctctctgggtcccctagg

SEQ ID NO: 12372 - DNA, 20 bp, Artificial Sequence
  chemically synthesized
gccatttctgccttgcctca

SEQ ID NO: 12373 - DNA, 20 bp, Artificial Sequence
  chemically synthesized
ccatttctgccttgcctcac

SEQ ID NO: 12374 - DNA, 20 bp, Artificial Sequence
  chemically synthesized
catttctgccttgcctcaca

SEQ ID NO: 12375 - DNA, 20 bp, Artificial Sequence
  chemically synthesized
atttctgccttgcctcacag

SEQ ID NO: 12376 - DNA, 20 bp, Artificial Sequence
  chemically synthesized
cttgcctcacaggggtcatt

SEQ ID NO: 12377 - DNA, 20 bp, Artificial Sequence
  chemically synthesized
ttgcctcacaggggtcattt

SEQ ID NO: 12378 - DNA, 20 bp, Artificial Sequence
  chemically synthesized
gcctcacaggggtcatttgg

SEQ ID NO: 12379 - DNA, 20 bp, Artificial Sequence
  chemically synthesized
cctcacaggggtcatttggg

SEQ ID NO: 12380 - DNA, 20 bp, Artificial Sequence
  chemically synthesized
ctcacaggggtcatttggga

SEQ ID NO: 12381 - DNA, 20 bp, Artificial Sequence
  chemically synthesized
gggtcatttgggagggctgc

SEQ ID NO: 12382 - DNA, 20 bp, Artificial Sequence
  chemically synthesized
gtcatttgggagggctgcca

SEQ ID NO: 12383 - DNA, 20 bp, Artificial Sequence
  chemically synthesized
tcatttgggagggctgccag

SEQ ID NO: 12384 - DNA, 20 bp, Artificial Sequence
  chemically synthesized
gggagggctgccagaggaac

SEQ ID NO: 12385 - DNA, 20 bp, Artificial Sequence
  chemically synthesized
ggagggctgccagaggaact

SEQ ID NO: 12386 - DNA, 20 bp, Artificial Sequence
  chemically synthesized
gctgccagaggaactgggaa

SEQ ID NO: 12387 - DNA, 20 bp, Artificial Sequence
  chemically synthesized
gaggaactgggaaaagatga

SEQ ID NO: 12388 - DNA, 20 bp, Artificial Sequence
  chemically synthesized
aggaactgggaaaagatgac

SEQ ID NO: 12389 - DNA, 20 bp, Artificial Sequence
  chemically synthesized
tgggaaaagatgacaggaaa

SEQ ID NO: 12390 - DNA, 20 bp, Artificial Sequence
  chemically synthesized
ggaaaaagaaaatctccacc

SEQ ID NO: 12391 - DNA, 20 bp, Artificial Sequence
  chemically synthesized
aaagaaaatctccacctggc

SEQ ID NO: 12392 - DNA, 20 bp, Artificial Sequence
  chemically synthesized
aatctccacctggccagatc

SEQ ID NO: 12393 - DNA, 20 bp, Artificial Sequence
  chemically synthesized
atctccacctggccagatct

SEQ ID NO: 12394 - DNA, 20 bp, Artificial Sequence
  chemically synthesized
tctccacctggccagatcta

SEQ ID NO: 12395 - DNA, 20 bp, Artificial Sequence
  chemically synthesized
ctccacctggccagatctag

SEQ ID NO: 12396 - DNA, 20 bp, Artificial Sequence
  chemically synthesized
acctggccagatctaggggc

SEQ ID NO: 12397 - DNA, 20 bp, Artificial Sequence
  chemically synthesized
cctggccagatctaggggct

SEQ ID NO: 12398 - DNA, 20 bp, Artificial Sequence
  chemically synthesized
ggccagatctaggggctggg

SEQ ID NO: 12399 - DNA, 20 bp, Artificial Sequence
  chemically synthesized
cagatctaggggctgggcag

SEQ ID NO: 12400 - DNA, 20 bp, Artificial Sequence
  chemically synthesized
agatctaggggctgggcagt

SEQ ID NO: 12401 - DNA, 20 bp, Artificial Sequence
  chemically synthesized
gatctaggggctgggcagtg

SEQ ID NO: 12402 - DNA, 20 bp, Artificial Sequence
  chemically synthesized
atctaggggctgggcagtgg

SEQ ID NO: 12403 - DNA, 20 bp, Artificial Sequence
  chemically synthesized
tctaggggctgggcagtggg

SEQ ID NO: 12404 - DNA, 20 bp, Artificial Sequence
  chemically synthesized
ctaggggctgggcagtgggg

SEQ ID NO: 12405 - DNA, 20 bp, Artificial Sequence
  chemically synthesized
gggctgggcagtgggggggt

SEQ ID NO: 12406 - DNA, 20 bp, Artificial Sequence
  chemically synthesized
ctgggcagtgggggggttgg

SEQ ID NO: 12407 - DNA, 20 bp, Artificial Sequence
  chemically synthesized
tgggcagtgggggggttggt

SEQ ID NO: 12408 - DNA, 20 bp, Artificial Sequence
  chemically synthesized
gggcagtgggggggttggtg

SEQ ID NO: 12409 - DNA, 20 bp, Artificial Sequence
  chemically synthesized
ggcagtgggggggttggtgg

SEQ ID NO: 12410 - DNA, 20 bp, Artificial Sequence
  chemically synthesized
gcagtgggggggttggtggg

SEQ ID NO: 12411 - DNA, 20 bp, Artificial Sequence
  chemically synthesized
ttggtggggggacatgaatt

SEQ ID NO: 12412 - DNA, 20 bp, Artificial Sequence
  chemically synthesized
ggggacatgaatttggtgtg

SEQ ID NO: 12413 - DNA, 20 bp, Artificial Sequence
  chemically synthesized
atttggtgtgcagactccac

SEQ ID NO: 12414 - DNA, 20 bp, Artificial Sequence
  chemically synthesized
tggtgtgcagactccactgg

SEQ ID NO: 12415 - DNA, 20 bp, Artificial Sequence
  chemically synthesized
ggtgtgcagactccactggc

SEQ ID NO: 12416 - DNA, 20 bp, Artificial Sequence
  chemically synthesized
gtgtgcagactccactggca

SEQ ID NO: 12417 - DNA, 20 bp, Artificial Sequence
  chemically synthesized
tgcagactccactggcaggg

SEQ ID NO: 12418 - DNA, 20 bp, Artificial Sequence
  chemically synthesized
agactccactggcagggaag

SEQ ID NO: 12419 - DNA, 20 bp, Artificial Sequence
  chemically synthesized
gactccactggcagggaagt

SEQ ID NO: 12420 - DNA, 20 bp, Artificial Sequence
  chemically synthesized
ccactggcagggaagtagga

SEQ ID NO: 12421 - DNA, 20 bp, Artificial Sequence
  chemically synthesized
ggaagtaggacagccctact

SEQ ID NO: 12422 - DNA, 20 bp, Artificial Sequence
  chemically synthesized
gacagccctacttggtttcg

SEQ ID NO: 12423 - DNA, 20 bp, Artificial Sequence
  chemically synthesized
gccctacttggtttcgcagc

SEQ ID NO: 12424 - DNA, 20 bp, Artificial Sequence
  chemically synthesized
ctacttggtttcgcagctgg

SEQ ID NO: 12425 - DNA, 20 bp, Artificial Sequence
  chemically synthesized
tggtttcgcagctggtagcc

SEQ ID NO: 12426 - DNA, 20 bp, Artificial Sequence
  chemically synthesized
ggtttcgcagctggtagcct

SEQ ID NO: 12427 - DNA, 20 bp, Artificial Sequence
  chemically synthesized
gtttcgcagctggtagcctg

SEQ ID NO: 12428 - DNA, 20 bp, Artificial Sequence
  chemically synthesized
cgcagctggtagcctggggc

SEQ ID NO: 12429 - DNA, 20 bp, Artificial Sequence
  chemically synthesized
ggtagcctggggcaagttct

SEQ ID NO: 12430 - DNA, 20 bp, Artificial Sequence
  chemically synthesized
agccttgctcactgactgca

SEQ ID NO: 12431 - DNA, 20 bp, Artificial Sequence
  chemically synthesized
gctcactgactgcatggaaa

SEQ ID NO: 12432 - DNA, 20 bp, Artificial Sequence
  chemically synthesized
tgactgcatggaaacagatt

SEQ ID NO: 12433 - DNA, 20 bp, Artificial Sequence
  chemically synthesized
aaacagattcggtgctgttg

SEQ ID NO: 12434 - DNA, 20 bp, Artificial Sequence
  chemically synthesized
aacagattcggtgctgttgc

SEQ ID NO: 12435 - DNA, 20 bp, Artificial Sequence
  chemically synthesized
acagattcggtgctgttgcg

SEQ ID NO: 12436 - DNA, 20 bp, Artificial Sequence
  chemically synthesized
cagattcggtgctgttgcgg

SEQ ID NO: 12437 - DNA, 20 bp, Artificial Sequence
  chemically synthesized
gattcggtgctgttgcgggg

SEQ ID NO: 12438 - DNA, 20 bp, Artificial Sequence
  chemically synthesized
attcggtgctgttgcggggg

SEQ ID NO: 12439 - DNA, 20 bp, Artificial Sequence
  chemically synthesized
ttcggtgctgttgcggggga

SEQ ID NO: 12440 - DNA, 20 bp, Artificial Sequence
  chemically synthesized
ttgcgggggagggtgcacgc

SEQ ID NO: 12441 - DNA, 20 bp, Artificial Sequence
  chemically synthesized
cgggggagggtgcacgctgg

SEQ ID NO: 12442 - DNA, 20 bp, Artificial Sequence
  chemically synthesized
ggagggtgcacgctggaagt

SEQ ID NO: 12443 - DNA, 20 bp, Artificial Sequence
  chemically synthesized
ggaagtgagaccaacctttt

SEQ ID NO: 12444 - DNA, 20 bp, Artificial Sequence
  chemically synthesized
gaccaaccttttgagttgca

SEQ ID NO: 12445 - DNA, 20 bp, Artificial Sequence
  chemically synthesized
accaaccttttgagttgcat

SEQ ID NO: 12446 - DNA, 20 bp, Artificial Sequence
  chemically synthesized
caaccttttgagttgcatgg

SEQ ID NO: 12447 - DNA, 20 bp, Artificial Sequence
  chemically synthesized
cttttgagttgcatgggagc

SEQ ID NO: 12448 - DNA, 20 bp, Artificial Sequence
  chemically synthesized
ttttgagttgcatgggagct

SEQ ID NO: 12449 - DNA, 20 bp, Artificial Sequence
  chemically synthesized
gagttgcatgggagctgggc

SEQ ID NO: 12450 - DNA, 20 bp, Artificial Sequence
  chemically synthesized
tcctgatgacctgcatgaca

SEQ ID NO: 12451 - DNA, 20 bp, Artificial Sequence
  chemically synthesized
tgatgacctgcatgacacag

SEQ ID NO: 12452 - DNA, 20 bp, Artificial Sequence
  chemically synthesized
atgacctgcatgacacagca

SEQ ID NO: 12453 - DNA, 20 bp, Artificial Sequence
  chemically synthesized
tgacctgcatgacacagcag

SEQ ID NO: 12454 - DNA, 20 bp, Artificial Sequence
  chemically synthesized
cctgcatgacacagcagagg

SEQ ID NO: 12455 - DNA, 20 bp, Artificial Sequence
  chemically synthesized
agaggcagccataattgtcc

SEQ ID NO: 12456 - DNA, 20 bp, Artificial Sequence
  chemically synthesized
gaggcagccataattgtcct

SEQ ID NO: 12457 - DNA, 20 bp, Artificial Sequence
  chemically synthesized
ggaacataaatccattgacc

SEQ ID NO: 12458 - DNA, 20 bp, Artificial Sequence
  chemically synthesized
actacacccccatcctccca

SEQ ID NO: 12459 - DNA, 20 bp, Artificial Sequence
  chemically synthesized
acacccccatcctcccacag

SEQ ID NO: 12460 - DNA, 20 bp, Artificial Sequence
  chemically synthesized
ccatcctcccacagtagcca

SEQ ID NO: 12461 - DNA, 20 bp, Artificial Sequence
  chemically synthesized
cctcccacagtagccacaga

SEQ ID NO: 12462 - DNA, 20 bp, Artificial Sequence
  chemically synthesized
agccacagaaagacctgccc

SEQ ID NO: 12463 - DNA, 20 bp, Artificial Sequence
  chemically synthesized
gccacagaaagacctgccca

SEQ ID NO: 12464 - DNA, 20 bp, Artificial Sequence
  chemically synthesized
cacagaaagacctgcccaag

SEQ ID NO: 12465 - DNA, 20 bp, Artificial Sequence
  chemically synthesized
gacctgcccaaggagactct

SEQ ID NO: 12466 - DNA, 20 bp, Artificial Sequence
  chemically synthesized
gcccaaggagactctgagct

SEQ ID NO: 12467 - DNA, 20 bp, Artificial Sequence
  chemically synthesized
actctgagctcagacacgac

SEQ ID NO: 12468 - DNA, 20 bp, Artificial Sequence
  chemically synthesized
ctagtcctgcccccacctga

SEQ ID NO: 12469 - DNA, 20 bp, Artificial Sequence
  chemically synthesized
tggtccttccttactcaccc

SEQ ID NO: 12470 - DNA, 20 bp, Artificial Sequence
  chemically synthesized
tccttccttactcaccctgg

SEQ ID NO: 12471 - DNA, 20 bp, Artificial Sequence
  chemically synthesized
cttactcaccctggtagctg

SEQ ID NO: 12472 - DNA, 20 bp, Artificial Sequence
  chemically synthesized
caccctggtagctgaagaca

SEQ ID NO: 12473 - DNA, 20 bp, Artificial Sequence
  chemically synthesized
accctggtagctgaagacaa

SEQ ID NO: 12474 - DNA, 20 bp, Artificial Sequence
  chemically synthesized
ccctggtagctgaagacaaa

SEQ ID NO: 12475 - DNA, 20 bp, Artificial Sequence
  chemically synthesized
agacaaagggcatatattct

SEQ ID NO: 12476 - DNA, 20 bp, Artificial Sequence
  chemically synthesized
gacaaagggcatatattctt

SEQ ID NO: 12477 - DNA, 20 bp, Artificial Sequence
  chemically synthesized
caaagggcatatattcttgg

SEQ ID NO: 12478 - DNA, 20 bp, Artificial Sequence
  chemically synthesized
gcatatattcttgggagttc

SEQ ID NO: 12479 - DNA, 20 bp, Artificial Sequence
  chemically synthesized
catatattcttgggagttct

SEQ ID NO: 12480 - DNA, 20 bp, Artificial Sequence
  chemically synthesized
atatattcttgggagttcta

SEQ ID NO: 12481 - DNA, 20 bp, Artificial Sequence
  chemically synthesized
ttgggagttctagggtgccc

SEQ ID NO: 12482 - DNA, 20 bp, Artificial Sequence
  chemically synthesized
ctagggtgccccagcccccc

SEQ ID NO: 12483 - DNA, 20 bp, Artificial Sequence
  chemically synthesized
ctgcctctgctgatgctttc

SEQ ID NO: 12484 - DNA, 20 bp, Artificial Sequence
  chemically synthesized
ctctgctgatgctttctaga

SEQ ID NO: 12485 - DNA, 20 bp, Artificial Sequence
  chemically synthesized
ttctagaaagtgccacctcc

SEQ ID NO: 12486 - DNA, 20 bp, Artificial Sequence
  chemically synthesized
tagaaagtgccacctcctgg

SEQ ID NO: 12487 - DNA, 20 bp, Artificial Sequence
  chemically synthesized
agaaagtgccacctcctggc

SEQ ID NO: 12488 - DNA, 20 bp, Artificial Sequence
  chemically synthesized
aaagtgccacctcctggcag

SEQ ID NO: 12489 - DNA, 20 bp, Artificial Sequence
  chemically synthesized
aagtgccacctcctggcagg

SEQ ID NO: 12490 - DNA, 20 bp, Artificial Sequence
  chemically synthesized
cctcctggcaggaggccaac

SEQ ID NO: 12491 - DNA, 20 bp, Artificial Sequence
  chemically synthesized
gaggccaaccagcacaaaaa

SEQ ID NO: 12492 - DNA, 20 bp, Artificial Sequence
  chemically synthesized
atagtgcattgaacaaccaa

SEQ ID NO: 12493 - DNA, 20 bp, Artificial Sequence
  chemically synthesized
tgcattgaacaaccaaaagt

SEQ ID NO: 12494 - DNA, 20 bp, Artificial Sequence
  chemically synthesized
gcattgaacaaccaaaagta

SEQ ID NO: 12495 - DNA, 20 bp, Artificial Sequence
  chemically synthesized
accaaaagtaaggaccctca

SEQ ID NO: 12496 - DNA, 20 bp, Artificial Sequence
  chemically synthesized
caaaagtaaggaccctcaca

SEQ ID NO: 12497 - DNA, 20 bp, Artificial Sequence
  chemically synthesized
tcatcctctgccacctccat

SEQ ID NO: 12498 - DNA, 20 bp, Artificial Sequence
  chemically synthesized
atcctctgccacctccattg

SEQ ID NO: 12499 - DNA, 20 bp, Artificial Sequence
  chemically synthesized
ctctgccacctccattggag

SEQ ID NO: 12500 - DNA, 20 bp, Artificial Sequence
  chemically synthesized
tctgccacctccattggagc

SEQ ID NO: 12501 - DNA, 20 bp, Artificial Sequence
  chemically synthesized
gccacctccattggagcagg

SEQ ID NO: 12502 - DNA, 20 bp, Artificial Sequence
  chemically synthesized
ggagcaggtggttgtatcta

SEQ ID NO: 12503 - DNA, 20 bp, Artificial Sequence
  chemically synthesized
aggtggttgtatctatggct

SEQ ID NO: 12504 - DNA, 20 bp, Artificial Sequence
  chemically synthesized
gtggttgtatctatggctga

SEQ ID NO: 12505 - DNA, 20 bp, Artificial Sequence
  chemically synthesized
atctatggctgagagaccca

SEQ ID NO: 12506 - DNA, 20 bp, Artificial Sequence
  chemically synthesized
atggctgagagacccacaga

SEQ ID NO: 12507 - DNA, 20 bp, Artificial Sequence
  chemically synthesized
ccacagatggttcacgtcac

SEQ ID NO: 12508 - DNA, 20 bp, Artificial Sequence
  chemically synthesized
tcacgtcacaagactctgtg

SEQ ID NO: 12509 - DNA, 20 bp, Artificial Sequence
  chemically synthesized
gactctgtgcagacaaaccc

SEQ ID NO: 12510 - DNA, 20 bp, Artificial Sequence
  chemically synthesized
gtgcagacaaaccccagtac

SEQ ID NO: 12511 - DNA, 20 bp, Artificial Sequence
  chemically synthesized
gacaaaccccagtaccagcc

SEQ ID NO: 12512 - DNA, 20 bp, Artificial Sequence
  chemically synthesized
caaaccccagtaccagcctg

SEQ ID NO: 12513 - DNA, 20 bp, Artificial Sequence
  chemically synthesized
cccagtaccagcctggagtc

SEQ ID NO: 12514 - DNA, 20 bp, Artificial Sequence
  chemically synthesized
agtaccagcctggagtctgg

SEQ ID NO: 12515 - DNA, 20 bp, Artificial Sequence
  chemically synthesized
ctggagtctggtagacctga

SEQ ID NO: 12516 - DNA, 20 bp, Artificial Sequence
  chemically synthesized
tggagtctggtagacctgat

SEQ ID NO: 12517 - DNA, 20 bp, Artificial Sequence
  chemically synthesized
agtctggtagacctgatggg

SEQ ID NO: 12518 - DNA, 20 bp, Artificial Sequence
  chemically synthesized
tggtagacctgatgggtggc

SEQ ID NO: 12519 - DNA, 20 bp, Artificial Sequence
  chemically synthesized
acctgatgggtggctagatc

SEQ ID NO: 12520 - DNA, 20 bp, Artificial Sequence
  chemically synthesized
tgatgggtggctagatccag

SEQ ID NO: 12521 - DNA, 20 bp, Artificial Sequence
  chemically synthesized
atgggtggctagatccagaa

SEQ ID NO: 12522 - DNA, 20 bp, Artificial Sequence
  chemically synthesized
gggtggctagatccagaaga

SEQ ID NO: 12523 - DNA, 20 bp, Artificial Sequence
  chemically synthesized
aagagagataacaatcacta

SEQ ID NO: 12524 - DNA, 20 bp, Artificial Sequence
  chemically synthesized
agataacaatcactacagtt

SEQ ID NO: 12525 - DNA, 20 bp, Artificial Sequence
  chemically synthesized
aatcactacagttcggctct

SEQ ID NO: 12526 - DNA, 20 bp, Artificial Sequence
  chemically synthesized
atcactacagttcggctctc

SEQ ID NO: 12527 - DNA, 20 bp, Artificial Sequence
  chemically synthesized
actacagttcggctctcagg

SEQ ID NO: 12528 - DNA, 20 bp, Artificial Sequence
  chemically synthesized
ctctcaggaagccccacgcc

SEQ ID NO: 12529 - DNA, 20 bp, Artificial Sequence
  chemically synthesized
tctcaggaagccccacgcct

SEQ ID NO: 12530 - DNA, 20 bp, Artificial Sequence
  chemically synthesized
ggaagccccacgcctaggaa

SEQ ID NO: 12531 - DNA, 20 bp, Artificial Sequence
  chemically synthesized
gaagccccacgcctaggaaa

SEQ ID NO: 12532 - DNA, 20 bp, Artificial Sequence
  chemically synthesized
aagccccacgcctaggaaaa

SEQ ID NO: 12533 - DNA, 20 bp, Artificial Sequence
  chemically synthesized
agccccacgcctaggaaaag

SEQ ID NO: 12534 - DNA, 20 bp, Artificial Sequence
  chemically synthesized
gccccacgcctaggaaaagg

SEQ ID NO: 12535 - DNA, 20 bp, Artificial Sequence
  chemically synthesized
aagggggactgtgctacatc

SEQ ID NO: 12536 - DNA, 20 bp, Artificial Sequence
  chemically synthesized
agggggactgtgctacatca

SEQ ID NO: 12537 - DNA, 20 bp, Artificial Sequence
  chemically synthesized
gggggactgtgctacatcaa

SEQ ID NO: 12538 - DNA, 20 bp, Artificial Sequence
  chemically synthesized
tacatcaagggaacacctca

SEQ ID NO: 12539 - DNA, 20 bp, Artificial Sequence
  chemically synthesized
acatcaagggaacacctcat

SEQ ID NO: 12540 - DNA, 20 bp, Artificial Sequence
  chemically synthesized
gggaacacctcatgggacaa

SEQ ID NO: 12541 - DNA, 20 bp, Artificial Sequence
  chemically synthesized
acctcatgggacaaaagtct

SEQ ID NO: 12542 - DNA, 20 bp, Artificial Sequence
  chemically synthesized
gggacaaaagtctcagcctt

SEQ ID NO: 12543 - DNA, 20 bp, Artificial Sequence
  chemically synthesized
ggacaaaagtctcagccttg

SEQ ID NO: 12544 - DNA, 20 bp, Artificial Sequence
  chemically synthesized
aaagtctcagccttgaggcc

SEQ ID NO: 12545 - DNA, 20 bp, Artificial Sequence
  chemically synthesized
ggcctagactttccctctga

SEQ ID NO: 12546 - DNA, 20 bp, Artificial Sequence
  chemically synthesized
cctagactttccctctgaca

SEQ ID NO: 12547 - DNA, 20 bp, Artificial Sequence
  chemically synthesized
ccctctgacagagcctaccc

SEQ ID NO: 12548 - DNA, 20 bp, Artificial Sequence
  chemically synthesized
ctgacagagcctacccaagt

SEQ ID NO: 12549 - DNA, 20 bp, Artificial Sequence
  chemically synthesized
acagagcctacccaagtgag

SEQ ID NO: 12550 - DNA, 20 bp, Artificial Sequence
  chemically synthesized
cagagcctacccaagtgaga

SEQ ID NO: 12551 - DNA, 20 bp, Artificial Sequence
  chemically synthesized
ctacccaagtgagaaggaac

SEQ ID NO: 12552 - DNA, 20 bp, Artificial Sequence
  chemically synthesized
aggaaccagaaaactaactc

SEQ ID NO: 12553 - DNA, 20 bp, Artificial Sequence
  chemically synthesized
actctggtaatatgaaaaac

SEQ ID NO: 12554 - DNA, 20 bp, Artificial Sequence
  chemically synthesized
ctctggtaatatgaaaaaca

SEQ ID NO: 12555 - DNA, 20 bp, Artificial Sequence
  chemically synthesized
caccccccaaaaaatcatac

SEQ ID NO: 12556 - DNA, 20 bp, Artificial Sequence
  chemically synthesized
aaaaaatcatactagctcac

SEQ ID NO: 12557 - DNA, 20 bp, Artificial Sequence
  chemically synthesized
accagcaatgcatccaaacc

SEQ ID NO: 12558 - DNA, 20 bp, Artificial Sequence
  chemically synthesized
agcaatgcatccaaaccaag

SEQ ID NO: 12559 - DNA, 20 bp, Artificial Sequence
  chemically synthesized
gatttacctgaaaaataatt

SEQ ID NO: 12560 - DNA, 20 bp, Artificial Sequence
  chemically synthesized
ttacctgaaaaataattcag

SEQ ID NO: 12561 - DNA, 20 bp, Artificial Sequence
  chemically synthesized
tacctgaaaaataattcaga

SEQ ID NO: 12562 - DNA, 20 bp, Artificial Sequence
  chemically synthesized
tgaaaaataattcagaaggt

SEQ ID NO: 12563 - DNA, 20 bp, Artificial Sequence
  chemically synthesized
aattcagaaggtcagttatt

SEQ ID NO: 12564 - DNA, 20 bp, Artificial Sequence
  chemically synthesized
ggtcagttattaagctaatc

SEQ ID NO: 12565 - DNA, 20 bp, Artificial Sequence
  chemically synthesized
gtcagttattaagctaatca

SEQ ID NO: 12566 - DNA, 20 bp, Artificial Sequence
  chemically synthesized
cagttattaagctaatcaag

SEQ ID NO: 12567 - DNA, 20 bp, Artificial Sequence
  chemically synthesized
agttattaagctaatcaagg

SEQ ID NO: 12568 - DNA, 20 bp, Artificial Sequence
  chemically synthesized
agctaatcaaggaggcatcc

SEQ ID NO: 12569 - DNA, 20 bp, Artificial Sequence
  chemically synthesized
gctaatcaaggaggcatccg

SEQ ID NO: 12570 - DNA, 20 bp, Artificial Sequence
  chemically synthesized
aatcaaggaggcatccgagg

SEQ ID NO: 12571 - DNA, 20 bp, Artificial Sequence
  chemically synthesized
atcaaggaggcatccgagga

SEQ ID NO: 12572 - DNA, 20 bp, Artificial Sequence
  chemically synthesized
ggaggcatccgaggaaggtg

SEQ ID NO: 12573 - DNA, 20 bp, Artificial Sequence
  chemically synthesized
aaaaaccaaaaatatgatac

SEQ ID NO: 12574 - DNA, 20 bp, Artificial Sequence
  chemically synthesized
aaaaatatgatacaagaaat

SEQ ID NO: 12575 - DNA, 20 bp, Artificial Sequence
  chemically synthesized
aaaatatgatacaagaaatg

SEQ ID NO: 12576 - DNA, 20 bp, Artificial Sequence
  chemically synthesized
aaatatgatacaagaaatga

SEQ ID NO: 12577 - DNA, 20 bp, Artificial Sequence
  chemically synthesized
aatatgatacaagaaatgag

SEQ ID NO: 12578 - DNA, 20 bp, Artificial Sequence
  chemically synthesized
tatgatacaagaaatgaggg

SEQ ID NO: 12579 - DNA, 20 bp, Artificial Sequence
  chemically synthesized
gaaatgaggggagaaatctt

SEQ ID NO: 12580 - DNA, 20 bp, Artificial Sequence
  chemically synthesized
aggggagaaatcttcagtta

SEQ ID NO: 12581 - DNA, 20 bp, Artificial Sequence
  chemically synthesized
gggagaaatcttcagttaaa

SEQ ID NO: 12582 - DNA, 20 bp, Artificial Sequence
  chemically synthesized
gaaatcttcagttaaagaga

SEQ ID NO: 12583 - DNA, 20 bp, Artificial Sequence
  chemically synthesized
ataaaaaacattcaaaactt

SEQ ID NO: 12584 - DNA, 20 bp, Artificial Sequence
  chemically synthesized
taaaaaacattcaaaacttc

SEQ ID NO: 12585 - DNA, 20 bp, Artificial Sequence
  chemically synthesized
ttcaaaacttcaggaaacaa

SEQ ID NO: 12586 - DNA, 20 bp, Artificial Sequence
  chemically synthesized
ttcaggaaacaatggatgaa

SEQ ID NO: 12587 - DNA, 20 bp, Artificial Sequence
  chemically synthesized
tggatgaatggatgcactta

SEQ ID NO: 12588 - DNA, 20 bp, Artificial Sequence
  chemically synthesized
tatagaaatgcaaaatgctc

SEQ ID NO: 12589 - DNA, 20 bp, Artificial Sequence
  chemically synthesized
gaaatgcaaaatgctctaga

SEQ ID NO: 12590 - DNA, 20 bp, Artificial Sequence
  chemically synthesized
caaaatgctctagaaagtct

SEQ ID NO: 12591 - DNA, 20 bp, Artificial Sequence
  chemically synthesized
gctctagaaagtctcagcaa

SEQ ID NO: 12592 - DNA, 20 bp, Artificial Sequence
  chemically synthesized
aagtctcagcaatagaatcc

SEQ ID NO: 12593 - DNA, 20 bp, Artificial Sequence
  chemically synthesized
tctcagcaatagaatccaag

SEQ ID NO: 12594 - DNA, 20 bp, Artificial Sequence
  chemically synthesized
cagcaatagaatccaagcag

SEQ ID NO: 12595 - DNA, 20 bp, Artificial Sequence
  chemically synthesized
gaatccaagcagaagaaatt

SEQ ID NO: 12596 - DNA, 20 bp, Artificial Sequence
  chemically synthesized
atccaagcagaagaaattca

SEQ ID NO: 12597 - DNA, 20 bp, Artificial Sequence
  chemically synthesized
cagaagaaattcagagcttg

SEQ ID NO: 12598 - DNA, 20 bp, Artificial Sequence
  chemically synthesized
aaattcagagcttgaagaca

SEQ ID NO: 12599 - DNA, 20 bp, Artificial Sequence
  chemically synthesized
tgaattaacccaatccaaca

SEQ ID NO: 12600 - DNA, 20 bp, Artificial Sequence
  chemically synthesized
aacccaatccaacaaagaca

SEQ ID NO: 12601 - DNA, 20 bp, Artificial Sequence
  chemically synthesized
tccaacaaagacaaagaaaa

SEQ ID NO: 12602 - DNA, 20 bp, Artificial Sequence
  chemically synthesized
aaagacaaagaaaaaagaat

SEQ ID NO: 12603 - DNA, 20 bp, Artificial Sequence
  chemically synthesized
agaataagaaaatatgaaca

SEQ ID NO: 12604 - DNA, 20 bp, Artificial Sequence
  chemically synthesized
aaaatatgaacaaagcctcc

SEQ ID NO: 12605 - DNA, 20 bp, Artificial Sequence
  chemically synthesized
aacaaagcctccaagaaatc

SEQ ID NO: 12606 - DNA, 20 bp, Artificial Sequence
  chemically synthesized
acaaagcctccaagaaatct

SEQ ID NO: 12607 - DNA, 20 bp, Artificial Sequence
  chemically synthesized
tatgttaaacaatcaaacct

SEQ ID NO: 12608 - DNA, 20 bp, Artificial Sequence
  chemically synthesized
caatcaaacctaagaataat

SEQ ID NO: 12609 - DNA, 20 bp, Artificial Sequence
  chemically synthesized
taagaataatcagcattcct

SEQ ID NO: 12610 - DNA, 20 bp, Artificial Sequence
  chemically synthesized
aataatcagcattcctgaga

SEQ ID NO: 12611 - DNA, 20 bp, Artificial Sequence
  chemically synthesized
aatcagcattcctgagaaag

SEQ ID NO: 12612 - DNA, 20 bp, Artificial Sequence
  chemically synthesized
tcagcattcctgagaaagaa

SEQ ID NO: 12613 - DNA, 20 bp, Artificial Sequence
  chemically synthesized
gagaaagaagagaaatctaa

SEQ ID NO: 12614 - DNA, 20 bp, Artificial Sequence
  chemically synthesized
agaagagaaatctaaaagtt

SEQ ID NO: 12615 - DNA, 20 bp, Artificial Sequence
  chemically synthesized
aaaagtttggaaaacttatc

SEQ ID NO: 12616 - DNA, 20 bp, Artificial Sequence
  chemically synthesized
aaagtttggaaaacttatcc

SEQ ID NO: 12617 - DNA, 20 bp, Artificial Sequence
  chemically synthesized
aagtttggaaaacttatcca

SEQ ID NO: 12618 - DNA, 20 bp, Artificial Sequence
  chemically synthesized
acttatccagggaaataatc

SEQ ID NO: 12619 - DNA, 20 bp, Artificial Sequence
  chemically synthesized
cttatccagggaaataatca

SEQ ID NO: 12620 - DNA, 20 bp, Artificial Sequence
  chemically synthesized
gaaaacttcccccaccttgc

SEQ ID NO: 12621 - DNA, 20 bp, Artificial Sequence
  chemically synthesized
aaacttcccccaccttgcta

SEQ ID NO: 12622 - DNA, 20 bp, Artificial Sequence
  chemically synthesized
cccccaccttgctagagacc

SEQ ID NO: 12623 - DNA, 20 bp, Artificial Sequence
  chemically synthesized
agacctagatatccaaatac

SEQ ID NO: 12624 - DNA, 20 bp, Artificial Sequence
  chemically synthesized
cctagatatccaaatacaag

SEQ ID NO: 12625 - DNA, 20 bp, Artificial Sequence
  chemically synthesized
caagaagctcaataaacacc

SEQ ID NO: 12626 - DNA, 20 bp, Artificial Sequence
  chemically synthesized
aagaagctcaataaacacct

SEQ ID NO: 12627 - DNA, 20 bp, Artificial Sequence
  chemically synthesized
attgcaaaaatatcattgcc

SEQ ID NO: 12628 - DNA, 20 bp, Artificial Sequence
  chemically synthesized
ttgcaaaaatatcattgcct

SEQ ID NO: 12629 - DNA, 20 bp, Artificial Sequence
  chemically synthesized
ttgcctaggtacattgtcat

SEQ ID NO: 12630 - DNA, 20 bp, Artificial Sequence
  chemically synthesized
gcctaggtacattgtcatca

SEQ ID NO: 12631 - DNA, 20 bp, Artificial Sequence
  chemically synthesized
cattgtcatcagagtatcca

SEQ ID NO: 12632 - DNA, 20 bp, Artificial Sequence
  chemically synthesized
agagtatccaaagttatcta

SEQ ID NO: 12633 - DNA, 20 bp, Artificial Sequence
  chemically synthesized
tccaaagttatctaaagaca

SEQ ID NO: 12634 - DNA, 20 bp, Artificial Sequence
  chemically synthesized
caaagttatctaaagacaaa

SEQ ID NO: 12635 - DNA, 20 bp, Artificial Sequence
  chemically synthesized
ctaaagacaaagagaatctt

SEQ ID NO: 12636 - DNA, 20 bp, Artificial Sequence
  chemically synthesized
aaagacaaagagaatcttaa

SEQ ID NO: 12637 - DNA, 20 bp, Artificial Sequence
  chemically synthesized
aagagaatcttaagagctgt

SEQ ID NO: 12638 - DNA, 20 bp, Artificial Sequence
  chemically synthesized
agagaatcttaagagctgtg

SEQ ID NO: 12639 - DNA, 20 bp, Artificial Sequence
  chemically synthesized
gagctgtgaggtgaaactac

SEQ ID NO: 12640 - DNA, 20 bp, Artificial Sequence
  chemically synthesized
agctgtgaggtgaaactacc

SEQ ID NO: 12641 - DNA, 20 bp, Artificial Sequence
  chemically synthesized
aactaccaggtaacctatga

SEQ ID NO: 12642 - DNA, 20 bp, Artificial Sequence
  chemically synthesized
acctatgaaagaaaacctat

SEQ ID NO: 12643 - DNA, 20 bp, Artificial Sequence
  chemically synthesized
aagaaaacctatcagattaa

SEQ ID NO: 12644 - DNA, 20 bp, Artificial Sequence
  chemically synthesized
aaaacctatcagattaacag

SEQ ID NO: 12645 - DNA, 20 bp, Artificial Sequence
  chemically synthesized
cagattaacagcagatttct

SEQ ID NO: 12646 - DNA, 20 bp, Artificial Sequence
  chemically synthesized
attaacagcagatttctcag

SEQ ID NO: 12647 - DNA, 20 bp, Artificial Sequence
  chemically synthesized
tttctcagcagaaaccgtaa

SEQ ID NO: 12648 - DNA, 20 bp, Artificial Sequence
  chemically synthesized
tcagcagaaaccgtaaaagc

SEQ ID NO: 12649 - DNA, 20 bp, Artificial Sequence
  chemically synthesized
gcagaaaccgtaaaagctag

SEQ ID NO: 12650 - DNA, 20 bp, Artificial Sequence
  chemically synthesized
gtaaaagctagaagtgaata

SEQ ID NO: 12651 - DNA, 20 bp, Artificial Sequence
  chemically synthesized
agtgaatatggccctatctt

SEQ ID NO: 12652 - DNA, 20 bp, Artificial Sequence
  chemically synthesized
ttcttaaacaaaacaattat

SEQ ID NO: 12653 - DNA, 20 bp, Artificial Sequence
  chemically synthesized
aaacaaaacaattatcagcc

SEQ ID NO: 12654 - DNA, 20 bp, Artificial Sequence
  chemically synthesized
tcagccaagaattttatatc

SEQ ID NO: 12655 - DNA, 20 bp, Artificial Sequence
  chemically synthesized
attttatatccagtgaaact

SEQ ID NO: 12656 - DNA, 20 bp, Artificial Sequence
  chemically synthesized
gaaactaagcttcacaaatg

SEQ ID NO: 12657 - DNA, 20 bp, Artificial Sequence
  chemically synthesized
tcacaaatgaagaaaataca

SEQ ID NO: 12658 - DNA, 20 bp, Artificial Sequence
  chemically synthesized
agaaaatacacagtgttttt

SEQ ID NO: 12659 - DNA, 20 bp, Artificial Sequence
  chemically synthesized
ttttcagaaaaacaaatgct

SEQ ID NO: 12660 - DNA, 20 bp, Artificial Sequence
  chemically synthesized
ttcagaaaaacaaatgctga

SEQ ID NO: 12661 - DNA, 20 bp, Artificial Sequence
  chemically synthesized
aaacaaatgctgagagaatt

SEQ ID NO: 12662 - DNA, 20 bp, Artificial Sequence
  chemically synthesized
tgagagaattcggcactacc

SEQ ID NO: 12663 - DNA, 20 bp, Artificial Sequence
  chemically synthesized
cactaccaagccaacactac

SEQ ID NO: 12664 - DNA, 20 bp, Artificial Sequence
  chemically synthesized
aacactacaagaactgataa

SEQ ID NO: 12665 - DNA, 20 bp, Artificial Sequence
  chemically synthesized
acactacaagaactgataaa

SEQ ID NO: 12666 - DNA, 20 bp, Artificial Sequence
  chemically synthesized
actacaagaactgataaaag

SEQ ID NO: 12667 - DNA, 20 bp, Artificial Sequence
  chemically synthesized
ctaaatcttgaaataaaccc

SEQ ID NO: 12668 - DNA, 20 bp, Artificial Sequence
  chemically synthesized
aatcttgaaataaaccctgg

SEQ ID NO: 12669 - DNA, 20 bp, Artificial Sequence
  chemically synthesized
accctggaagcacatcaaaa

SEQ ID NO: 12670 - DNA, 20 bp, Artificial Sequence
  chemically synthesized
atcaaaacagaacctcttta

SEQ ID NO: 12671 - DNA, 20 bp, Artificial Sequence
  chemically synthesized
tctttaaagcataaatccca

SEQ ID NO: 12672 - DNA, 20 bp, Artificial Sequence
  chemically synthesized
ctttaaagcataaatcccat

SEQ ID NO: 12673 - DNA, 20 bp, Artificial Sequence
  chemically synthesized
ggacatatacaacaaaaata

SEQ ID NO: 12674 - DNA, 20 bp, Artificial Sequence
  chemically synthesized
acaacaaaaatacagataaa

SEQ ID NO: 12675 - DNA, 20 bp, Artificial Sequence
  chemically synthesized
aatacagataaaaagataca

SEQ ID NO: 12676 - DNA, 20 bp, Artificial Sequence
  chemically synthesized
atacagataaaaagatacac

SEQ ID NO: 12677 - DNA, 20 bp, Artificial Sequence
  chemically synthesized
cacaggcaacaaataccacg

SEQ ID NO: 12678 - DNA, 20 bp, Artificial Sequence
  chemically synthesized
gcaacaaataccacgaagaa

SEQ ID NO: 12679 - DNA, 20 bp, Artificial Sequence
  chemically synthesized
aaataccacgaagaatggaa

SEQ ID NO: 12680 - DNA, 20 bp, Artificial Sequence
  chemically synthesized
atactgatgttgaatgtaaa

SEQ ID NO: 12681 - DNA, 20 bp, Artificial Sequence
  chemically synthesized
ggactaaatgctccacttaa

SEQ ID NO: 12682 - DNA, 20 bp, Artificial Sequence
  chemically synthesized
aatgctccacttaaaagata

SEQ ID NO: 12683 - DNA, 20 bp, Artificial Sequence
  chemically synthesized
acttaaaagatacagaattg

SEQ ID NO: 12684 - DNA, 20 bp, Artificial Sequence
  chemically synthesized
tacagaattgcagaatgaat

SEQ ID NO: 12685 - DNA, 20 bp, Artificial Sequence
  chemically synthesized
atgaataagaattcaccaac

SEQ ID NO: 12686 - DNA, 20 bp, Artificial Sequence
  chemically synthesized
aaccagttatctgccgcctt

SEQ ID NO: 12687 - DNA, 20 bp, Artificial Sequence
  chemically synthesized
accagttatctgccgccttc

SEQ ID NO: 12688 - DNA, 20 bp, Artificial Sequence
  chemically synthesized
cagttatctgccgccttcag

SEQ ID NO: 12689 - DNA, 20 bp, Artificial Sequence
  chemically synthesized
aggagactcacctaacacat

SEQ ID NO: 12690 - DNA, 20 bp, Artificial Sequence
  chemically synthesized
ggagactcacctaacacata

SEQ ID NO: 12691 - DNA, 20 bp, Artificial Sequence
  chemically synthesized
ataaggactcacataaactt

SEQ ID NO: 12692 - DNA, 20 bp, Artificial Sequence
  chemically synthesized
taaggactcacataaactta

SEQ ID NO: 12693 - DNA, 20 bp, Artificial Sequence
  chemically synthesized
actcacataaacttaaggta

SEQ ID NO: 12694 - DNA, 20 bp, Artificial Sequence
  chemically synthesized
ctcacataaacttaaggtaa

SEQ ID NO: 12695 - DNA, 20 bp, Artificial Sequence
  chemically synthesized
tcacataaacttaaggtaaa

SEQ ID NO: 12696 - DNA, 20 bp, Artificial Sequence
  chemically synthesized
cacataaacttaaggtaaag

SEQ ID NO: 12697 - DNA, 20 bp, Artificial Sequence
  chemically synthesized
ataaacttaaggtaaagggg

SEQ ID NO: 12698 - DNA, 20 bp, Artificial Sequence
  chemically synthesized
aaaatgacattccacacaaa

SEQ ID NO: 12699 - DNA, 20 bp, Artificial Sequence
  chemically synthesized
tccacacaaatggacaccaa

SEQ ID NO: 12700 - DNA, 20 bp, Artificial Sequence
  chemically synthesized
cacaaatggacaccaaaagc

SEQ ID NO: 12701 - DNA, 20 bp, Artificial Sequence
  chemically synthesized
tggacaccaaaagcgagcca

SEQ ID NO: 12702 - DNA, 20 bp, Artificial Sequence
  chemically synthesized
acaccaaaagcgagccaaag

SEQ ID NO: 12703 - DNA, 20 bp, Artificial Sequence
  chemically synthesized
caaagcagctattcttatgt

SEQ ID NO: 12704 - DNA, 20 bp, Artificial Sequence
  chemically synthesized
gtcagacaaaacaaacttta

SEQ ID NO: 12705 - DNA, 20 bp, Artificial Sequence
  chemically synthesized
caaaacaaactttaaagaaa

SEQ ID NO: 12706 - DNA, 20 bp, Artificial Sequence
  chemically synthesized
aacaaactttaaagaaacag

SEQ ID NO: 12707 - DNA, 20 bp, Artificial Sequence
  chemically synthesized
taaagaaacagcagttaaaa

SEQ ID NO: 12708 - DNA, 20 bp, Artificial Sequence
  chemically synthesized
aacagcagttaaaaaagaca

SEQ ID NO: 12709 - DNA, 20 bp, Artificial Sequence
  chemically synthesized
cagcagttaaaaaagacaaa

SEQ ID NO: 12710 - DNA, 20 bp, Artificial Sequence
  chemically synthesized
agcagttaaaaaagacaaag

SEQ ID NO: 12711 - DNA, 20 bp, Artificial Sequence
  chemically synthesized
gcagttaaaaaagacaaaga

SEQ ID NO: 12712 - DNA, 20 bp, Artificial Sequence
  chemically synthesized
gggacatcatataatgataa

SEQ ID NO: 12713 - DNA, 20 bp, Artificial Sequence
  chemically synthesized
tgataaaagcccttgtccaa

SEQ ID NO: 12714 - DNA, 20 bp, Artificial Sequence
  chemically synthesized
gataaaagcccttgtccaat

SEQ ID NO: 12715 - DNA, 20 bp, Artificial Sequence
  chemically synthesized
taaaagcccttgtccaatgg

SEQ ID NO: 12716 - DNA, 20 bp, Artificial Sequence
  chemically synthesized
aatatatatgcatctaatac

SEQ ID NO: 12717 - DNA, 20 bp, Artificial Sequence
  chemically synthesized
tatatatgcatctaatactg

SEQ ID NO: 12718 - DNA, 20 bp, Artificial Sequence
  chemically synthesized
atttataaaacaattactac

SEQ ID NO: 12719 - DNA, 20 bp, Artificial Sequence
  chemically synthesized
taaaacaattactactagac

SEQ ID NO: 12720 - DNA, 20 bp, Artificial Sequence
  chemically synthesized
acaattactactagactaga

SEQ ID NO: 12721 - DNA, 20 bp, Artificial Sequence
  chemically synthesized
actagacagcaacataataa

SEQ ID NO: 12722 - DNA, 20 bp, Artificial Sequence
  chemically synthesized
agacagcaacataataatag

SEQ ID NO: 12723 - DNA, 20 bp, Artificial Sequence
  chemically synthesized
gacagcaacataataatagt

SEQ ID NO: 12724 - DNA, 20 bp, Artificial Sequence
  chemically synthesized
acagcaacataataatagtg

SEQ ID NO: 12725 - DNA, 20 bp, Artificial Sequence
  chemically synthesized
cagcaacataataatagtgg

SEQ ID NO: 12726 - DNA, 20 bp, Artificial Sequence
  chemically synthesized
caatactccactgactgcac

SEQ ID NO: 12727 - DNA, 20 bp, Artificial Sequence
  chemically synthesized
aatactccactgactgcact

SEQ ID NO: 12728 - DNA, 20 bp, Artificial Sequence
  chemically synthesized
actccactgactgcactagg

SEQ ID NO: 12729 - DNA, 20 bp, Artificial Sequence
  chemically synthesized
ctccactgactgcactaggc

SEQ ID NO: 12730 - DNA, 20 bp, Artificial Sequence
  chemically synthesized
actgcactaggcaggtcatc

SEQ ID NO: 12731 - DNA, 20 bp, Artificial Sequence
  chemically synthesized
cactaggcaggtcatcaaga

SEQ ID NO: 12732 - DNA, 20 bp, Artificial Sequence
  chemically synthesized
ggtcatcaagacagtctaca

SEQ ID NO: 12733 - DNA, 20 bp, Artificial Sequence
  chemically synthesized
gacagtctacaaagaaacaa

SEQ ID NO: 12734 - DNA, 20 bp, Artificial Sequence
  chemically synthesized
acaaagaaacaatggattta

SEQ ID NO: 12735 - DNA, 20 bp, Artificial Sequence
  chemically synthesized
caatggatttaaagaacaaa

SEQ ID NO: 12736 - DNA, 20 bp, Artificial Sequence
  chemically synthesized
taaagaacaaatggacttaa

SEQ ID NO: 12737 - DNA, 20 bp, Artificial Sequence
  chemically synthesized
atggacttaacagatattta

SEQ ID NO: 12738 - DNA, 20 bp, Artificial Sequence
  chemically synthesized
tggacttaacagatatttac

SEQ ID NO: 12739 - DNA, 20 bp, Artificial Sequence
  chemically synthesized
gacattctacccaacaactg

SEQ ID NO: 12740 - DNA, 20 bp, Artificial Sequence
  chemically synthesized
agaatacacattctattcat

SEQ ID NO: 12741 - DNA, 20 bp, Artificial Sequence
  chemically synthesized
acattctattcatcagcaca

SEQ ID NO: 12742 - DNA, 20 bp, Artificial Sequence
  chemically synthesized
cagcacatggaactttctcc

SEQ ID NO: 12743 - DNA, 20 bp, Artificial Sequence
  chemically synthesized
acatggaactttctccaaga

SEQ ID NO: 12744 - DNA, 20 bp, Artificial Sequence
  chemically synthesized
catggaactttctccaagat

SEQ ID NO: 12745 - DNA, 20 bp, Artificial Sequence
  chemically synthesized
catatgatatgccacaaaac

SEQ ID NO: 12746 - DNA, 20 bp, Artificial Sequence
  chemically synthesized
ttaaaaattgaaattatatc

SEQ ID NO: 12747 - DNA, 20 bp, Artificial Sequence
  chemically synthesized
aattatatcaagcactctct

SEQ ID NO: 12748 - DNA, 20 bp, Artificial Sequence
  chemically synthesized
tcaagcactctctcagacca

SEQ ID NO: 12749 - DNA, 20 bp, Artificial Sequence
  chemically synthesized
agcactctctcagaccacag

SEQ ID NO: 12750 - DNA, 20 bp, Artificial Sequence
  chemically synthesized
agaccacagtagaataaaat

SEQ ID NO: 12751 - DNA, 20 bp, Artificial Sequence
  chemically synthesized
aaattggaaatcaactacaa

SEQ ID NO: 12752 - DNA, 20 bp, Artificial Sequence
  chemically synthesized
aattggaaatcaactacaaa

SEQ ID NO: 12753 - DNA, 20 bp, Artificial Sequence
  chemically synthesized
ccttcaaaaccatgcaaata

SEQ ID NO: 12754 - DNA, 20 bp, Artificial Sequence
  chemically synthesized
cttcaaaaccatgcaaatac

SEQ ID NO: 12755 - DNA, 20 bp, Artificial Sequence
  chemically synthesized
ttcaaaaccatgcaaataca

SEQ ID NO: 12756 - DNA, 20 bp, Artificial Sequence
  chemically synthesized
acctgctcctgaatgatcat

SEQ ID NO: 12757 - DNA, 20 bp, Artificial Sequence
  chemically synthesized
cctgctcctgaatgatcatt

SEQ ID NO: 12758 - DNA, 20 bp, Artificial Sequence
  chemically synthesized
attgggtcaacaatgaaatc

SEQ ID NO: 12759 - DNA, 20 bp, Artificial Sequence
  chemically synthesized
ggtcaacaatgaaatcaaga

SEQ ID NO: 12760 - DNA, 20 bp, Artificial Sequence
  chemically synthesized
aaatcatttgctttgaaaac

SEQ ID NO: 12761 - DNA, 20 bp, Artificial Sequence
  chemically synthesized
tttgctttgaaaaccggcac

SEQ ID NO: 12762 - DNA, 20 bp, Artificial Sequence
  chemically synthesized
tttgaaaaccggcacaagac

SEQ ID NO: 12763 - DNA, 20 bp, Artificial Sequence
  chemically synthesized
ttgaaaaccggcacaagaca

SEQ ID NO: 12764 - DNA, 20 bp, Artificial Sequence
  chemically synthesized
ctcgccactcttactcaaca

SEQ ID NO: 12765 - DNA, 20 bp, Artificial Sequence
  chemically synthesized
actcttactcaacatagtat

SEQ ID NO: 12766 - DNA, 20 bp, Artificial Sequence
  chemically synthesized
cttactcaacatagtattgg

SEQ ID NO: 12767 - DNA, 20 bp, Artificial Sequence
  chemically synthesized
atagtattggaagttctcgc

SEQ ID NO: 12768 - DNA, 20 bp, Artificial Sequence
  chemically synthesized
tagtattggaagttctcgcc

SEQ ID NO: 12769 - DNA, 20 bp, Artificial Sequence
  chemically synthesized
gaagttctcgccaggacaat

SEQ ID NO: 12770 - DNA, 20 bp, Artificial Sequence
  chemically synthesized
aagttctcgccaggacaatc

SEQ ID NO: 12771 - DNA, 20 bp, Artificial Sequence
  chemically synthesized
tctcgccaggacaatcaggc

SEQ ID NO: 12772 - DNA, 20 bp, Artificial Sequence
  chemically synthesized
tcgccaggacaatcaggcaa

SEQ ID NO: 12773 - DNA, 20 bp, Artificial Sequence
  chemically synthesized
caggacaatcaggcaagaga

SEQ ID NO: 12774 - DNA, 20 bp, Artificial Sequence
  chemically synthesized
tcaggcaagagaaagaaata

SEQ ID NO: 12775 - DNA, 20 bp, Artificial Sequence
  chemically synthesized
agaaataaagcatattcaaa

SEQ ID NO: 12776 - DNA, 20 bp, Artificial Sequence
  chemically synthesized
gaaataaagcatattcaaat

SEQ ID NO: 12777 - DNA, 20 bp, Artificial Sequence
  chemically synthesized
ataaagcatattcaaatagg

SEQ ID NO: 12778 - DNA, 20 bp, Artificial Sequence
  chemically synthesized
aaagcatattcaaataggaa

SEQ ID NO: 12779 - DNA, 20 bp, Artificial Sequence
  chemically synthesized
agcatattcaaataggaaga

SEQ ID NO: 12780 - DNA, 20 bp, Artificial Sequence
  chemically synthesized
gcatattcaaataggaagag

SEQ ID NO: 12781 - DNA, 20 bp, Artificial Sequence
  chemically synthesized
tattcaaataggaagagagg

SEQ ID NO: 12782 - DNA, 20 bp, Artificial Sequence
  chemically synthesized
agtcaaattgtctctgtttg

SEQ ID NO: 12783 - DNA, 20 bp, Artificial Sequence
  chemically synthesized
agatgacatgattgtatatt

SEQ ID NO: 12784 - DNA, 20 bp, Artificial Sequence
  chemically synthesized
tgacatgattgtatatttag

SEQ ID NO: 12785 - DNA, 20 bp, Artificial Sequence
  chemically synthesized
tttagaagaccctgtcatct

SEQ ID NO: 12786 - DNA, 20 bp, Artificial Sequence
  chemically synthesized
tcatctcagcccaaaatctt

SEQ ID NO: 12787 - DNA, 20 bp, Artificial Sequence
  chemically synthesized
caaaatcttaagctgataaa

SEQ ID NO: 12788 - DNA, 20 bp, Artificial Sequence
  chemically synthesized
cttaagctgataaacagctt

SEQ ID NO: 12789 - DNA, 20 bp, Artificial Sequence
  chemically synthesized
gctgataaacagcttcagca

SEQ ID NO: 12790 - DNA, 20 bp, Artificial Sequence
  chemically synthesized
aacagcttcagcaaagtctc

SEQ ID NO: 12791 - DNA, 20 bp, Artificial Sequence
  chemically synthesized
aaagtctcaagatacaaaat

SEQ ID NO: 12792 - DNA, 20 bp, Artificial Sequence
  chemically synthesized
caagatacaaaatcagtgtg

SEQ ID NO: 12793 - DNA, 20 bp, Artificial Sequence
  chemically synthesized
aatcagtgtgcagaaatcac

SEQ ID NO: 12794 - DNA, 20 bp, Artificial Sequence
  chemically synthesized
gcgttcctatacaccaataa

SEQ ID NO: 12795 - DNA, 20 bp, Artificial Sequence
  chemically synthesized
cctatacaccaataatagac

SEQ ID NO: 12796 - DNA, 20 bp, Artificial Sequence
  chemically synthesized
atacaccaataatagacaag

SEQ ID NO: 12797 - DNA, 20 bp, Artificial Sequence
  chemically synthesized
acaccaataatagacaagca

SEQ ID NO: 12798 - DNA, 20 bp, Artificial Sequence
  chemically synthesized
accaataatagacaagcaga

SEQ ID NO: 12799 - DNA, 20 bp, Artificial Sequence
  chemically synthesized
acaagcagagagccaaatca

SEQ ID NO: 12800 - DNA, 20 bp, Artificial Sequence
  chemically synthesized
caagcagagagccaaatcat

SEQ ID NO: 12801 - DNA, 20 bp, Artificial Sequence
  chemically synthesized
tcccattcacaattgctgca

SEQ ID NO: 12802 - DNA, 20 bp, Artificial Sequence
  chemically synthesized
ccattcacaattgctgcaaa

SEQ ID NO: 12803 - DNA, 20 bp, Artificial Sequence
  chemically synthesized
agagaataaaataaaatacc

SEQ ID NO: 12804 - DNA, 20 bp, Artificial Sequence
  chemically synthesized
tacctagaaatacaacttct

SEQ ID NO: 12805 - DNA, 20 bp, Artificial Sequence
  chemically synthesized
acctagaaatacaacttcta

SEQ ID NO: 12806 - DNA, 20 bp, Artificial Sequence
  chemically synthesized
cctagaaatacaacttctaa

SEQ ID NO: 12807 - DNA, 20 bp, Artificial Sequence
  chemically synthesized
tacaacttctaagggatgtg

SEQ ID NO: 12808 - DNA, 20 bp, Artificial Sequence
  chemically synthesized
gggatgtgaagaacctcttc

SEQ ID NO: 12809 - DNA, 20 bp, Artificial Sequence
  chemically synthesized
ggatgtgaagaacctcttca

SEQ ID NO: 12810 - DNA, 20 bp, Artificial Sequence
  chemically synthesized
atgtgaagaacctcttcaag

SEQ ID NO: 12811 - DNA, 20 bp, Artificial Sequence
  chemically synthesized
gtgaagaacctcttcaagga

SEQ ID NO: 12812 - DNA, 20 bp, Artificial Sequence
  chemically synthesized
ctacaaaccactcactgctc

SEQ ID NO: 12813 - DNA, 20 bp, Artificial Sequence
  chemically synthesized
tacaaaccactcactgctca

SEQ ID NO: 12814 - DNA, 20 bp, Artificial Sequence
  chemically synthesized
cactcactgctcaaggaaat

SEQ ID NO: 12815 - DNA, 20 bp, Artificial Sequence
  chemically synthesized
ctcactgctcaaggaaataa

SEQ ID NO: 12816 - DNA, 20 bp, Artificial Sequence
  chemically synthesized
cactgctcaaggaaataaga

SEQ ID NO: 12817 - DNA, 20 bp, Artificial Sequence
  chemically synthesized
actgctcaaggaaataagag

SEQ ID NO: 12818 - DNA, 20 bp, Artificial Sequence
  chemically synthesized
taagagaggacacaaacaaa

SEQ ID NO: 12819 - DNA, 20 bp, Artificial Sequence
  chemically synthesized
ggaaaaacattccatgctca

SEQ ID NO: 12820 - DNA, 20 bp, Artificial Sequence
  chemically synthesized
aaacattccatgctcataga

SEQ ID NO: 12821 - DNA, 20 bp, Artificial Sequence
  chemically synthesized
attccatgctcatagataga

SEQ ID NO: 12822 - DNA, 20 bp, Artificial Sequence
  chemically synthesized
aagaatcaatatctttaaaa

SEQ ID NO: 12823 - DNA, 20 bp, Artificial Sequence
  chemically synthesized
taaaatggccatactgccca

SEQ ID NO: 12824 - DNA, 20 bp, Artificial Sequence
  chemically synthesized
atactgcccaaagtaattta

SEQ ID NO: 12825 - DNA, 20 bp, Artificial Sequence
  chemically synthesized
gattcaatgctatccccatc

SEQ ID NO: 12826 - DNA, 20 bp, Artificial Sequence
  chemically synthesized
gctaccactgacttttttca

SEQ ID NO: 12827 - DNA, 20 bp, Artificial Sequence
  chemically synthesized
actgacttttttcaaagaat

SEQ ID NO: 12828 - DNA, 20 bp, Artificial Sequence
  chemically synthesized
aaactactttaaatgtcata

SEQ ID NO: 12829 - DNA, 20 bp, Artificial Sequence
  chemically synthesized
aatgtcatatggaatcaaaa

SEQ ID NO: 12830 - DNA, 20 bp, Artificial Sequence
  chemically synthesized
tgtcatatggaatcaaaaaa

SEQ ID NO: 12831 - DNA, 20 bp, Artificial Sequence
  chemically synthesized
gaatcaaaaaagagcccata

SEQ ID NO: 12832 - DNA, 20 bp, Artificial Sequence
  chemically synthesized
aaaaaagagcccatatagcc

SEQ ID NO: 12833 - DNA, 20 bp, Artificial Sequence
  chemically synthesized
ccaagacaatcctaaacaaa

SEQ ID NO: 12834 - DNA, 20 bp, Artificial Sequence
  chemically synthesized
aatcctaaacaaaaagaaca

SEQ ID NO: 12835 - DNA, 20 bp, Artificial Sequence
  chemically synthesized
ctaaacaaaaagaacaaagc

SEQ ID NO: 12836 - DNA, 20 bp, Artificial Sequence
  chemically synthesized
aaacaaaaagaacaaagctg

SEQ ID NO: 12837 - DNA, 20 bp, Artificial Sequence
  chemically synthesized
aacaaaaagaacaaagctgg

SEQ ID NO: 12838 - DNA, 20 bp, Artificial Sequence
  chemically synthesized
ctgacttcaaactatactac

SEQ ID NO: 12839 - DNA, 20 bp, Artificial Sequence
  chemically synthesized
tgacttcaaactatactaca

SEQ ID NO: 12840 - DNA, 20 bp, Artificial Sequence
  chemically synthesized
caaactatactacaaggcta

SEQ ID NO: 12841 - DNA, 20 bp, Artificial Sequence
  chemically synthesized
caaggctacagtaacaaaaa

SEQ ID NO: 12842 - DNA, 20 bp, Artificial Sequence
  chemically synthesized
ctacagtaacaaaaacagca

SEQ ID NO: 12843 - DNA, 20 bp, Artificial Sequence
  chemically synthesized
taacaaaaacagcatggtac

SEQ ID NO: 12844 - DNA, 20 bp, Artificial Sequence
  chemically synthesized
gcatggtactggtaccaaaa

SEQ ID NO: 12845 - DNA, 20 bp, Artificial Sequence
  chemically synthesized
ctggtaccaaaacagatata

SEQ ID NO: 12846 - DNA, 20 bp, Artificial Sequence
  chemically synthesized
accaaaacagatatatagac

SEQ ID NO: 12847 - DNA, 20 bp, Artificial Sequence
  chemically synthesized
aaaacagatatatagaccag

SEQ ID NO: 12848 - DNA, 20 bp, Artificial Sequence
  chemically synthesized
agatatatagaccagtggaa

SEQ ID NO: 12849 - DNA, 20 bp, Artificial Sequence
  chemically synthesized
tatagaccagtggaacagaa

SEQ ID NO: 12850 - DNA, 20 bp, Artificial Sequence
  chemically synthesized
agaccagtggaacagaacag

SEQ ID NO: 12851 - DNA, 20 bp, Artificial Sequence
  chemically synthesized
gtggaacagaacagaagcct

SEQ ID NO: 12852 - DNA, 20 bp, Artificial Sequence
  chemically synthesized
atctttgacaaacatcacaa

SEQ ID NO: 12853 - DNA, 20 bp, Artificial Sequence
  chemically synthesized
gacaaacatcacaaaagcaa

SEQ ID NO: 12854 - DNA, 20 bp, Artificial Sequence
  chemically synthesized
caaacatcacaaaagcaatg

SEQ ID NO: 12855 - DNA, 20 bp, Artificial Sequence
  chemically synthesized
catcacaaaagcaatggaga

SEQ ID NO: 12856 - DNA, 20 bp, Artificial Sequence
  chemically synthesized
agaattccctatttaataaa

SEQ ID NO: 12857 - DNA, 20 bp, Artificial Sequence
  chemically synthesized
ccctatttaataaatggtgc

SEQ ID NO: 12858 - DNA, 20 bp, Artificial Sequence
  chemically synthesized
ataaatggtgctggaaaaac

SEQ ID NO: 12859 - DNA, 20 bp, Artificial Sequence
  chemically synthesized
atggtgctggaaaaactggc

SEQ ID NO: 12860 - DNA, 20 bp, Artificial Sequence
  chemically synthesized
ccttatacaaaaattaactc

SEQ ID NO: 12861 - DNA, 20 bp, Artificial Sequence
  chemically synthesized
cttatacaaaaattaactca

SEQ ID NO: 12862 - DNA, 20 bp, Artificial Sequence
  chemically synthesized
atacaaaaattaactcaagg

SEQ ID NO: 12863 - DNA, 20 bp, Artificial Sequence
  chemically synthesized
aattaactcaaggtggatta

SEQ ID NO: 12864 - DNA, 20 bp, Artificial Sequence
  chemically synthesized
acctaaaaccataaaaatcc

SEQ ID NO: 12865 - DNA, 20 bp, Artificial Sequence
  chemically synthesized
taaaaccataaaaatcctag

SEQ ID NO: 12866 - DNA, 20 bp, Artificial Sequence
  chemically synthesized
aaaaatcctagaagataacc

SEQ ID NO: 12867 - DNA, 20 bp, Artificial Sequence
  chemically synthesized
aaaatcctagaagataacct

SEQ ID NO: 12868 - DNA, 20 bp, Artificial Sequence
  chemically synthesized
ataacctaggcaataccatt

SEQ ID NO: 12869 - DNA, 20 bp, Artificial Sequence
  chemically synthesized
taacctaggcaataccattc

SEQ ID NO: 12870 - DNA, 20 bp, Artificial Sequence
  chemically synthesized
aggcaataccattcaggaca

SEQ ID NO: 12871 - DNA, 20 bp, Artificial Sequence
  chemically synthesized
ggcaataccattcaggacat

SEQ ID NO: 12872 - DNA, 20 bp, Artificial Sequence
  chemically synthesized
taccattcaggacataggca

SEQ ID NO: 12873 - DNA, 20 bp, Artificial Sequence
  chemically synthesized
accattcaggacataggcat

SEQ ID NO: 12874 - DNA, 20 bp, Artificial Sequence
  chemically synthesized
attcacgactaaaacatcaa

SEQ ID NO: 12875 - DNA, 20 bp, Artificial Sequence
  chemically synthesized
catcaaaagcaatgacaaca

SEQ ID NO: 12876 - DNA, 20 bp, Artificial Sequence
  chemically synthesized
atcaaaagcaatgacaacaa

SEQ ID NO: 12877 - DNA, 20 bp, Artificial Sequence
  chemically synthesized
caaaggccaaaattgacata

SEQ ID NO: 12878 - DNA, 20 bp, Artificial Sequence
  chemically synthesized
aaaggccaaaattgacatat

SEQ ID NO: 12879 - DNA, 20 bp, Artificial Sequence
  chemically synthesized
tatgggatctaattaaacta

SEQ ID NO: 12880 - DNA, 20 bp, Artificial Sequence
  chemically synthesized
tgggatctaattaaactaaa

SEQ ID NO: 12881 - DNA, 20 bp, Artificial Sequence
  chemically synthesized
taaactaaagagcttctgca

SEQ ID NO: 12882 - DNA, 20 bp, Artificial Sequence
  chemically synthesized
aaagagcttctgcacagcaa

SEQ ID NO: 12883 - DNA, 20 bp, Artificial Sequence
  chemically synthesized
gcacagcaaaagactatcat

SEQ ID NO: 12884 - DNA, 20 bp, Artificial Sequence
  chemically synthesized
acagcaaaagactatcatca

SEQ ID NO: 12885 - DNA, 20 bp, Artificial Sequence
  chemically synthesized
aagactatcatcagagtgaa

SEQ ID NO: 12886 - DNA, 20 bp, Artificial Sequence
  chemically synthesized
agactatcatcagagtgaac

SEQ ID NO: 12887 - DNA, 20 bp, Artificial Sequence
  chemically synthesized
cagagtgaacaggcaaccta

SEQ ID NO: 12888 - DNA, 20 bp, Artificial Sequence
  chemically synthesized
tgaacaggcaacctacagaa

SEQ ID NO: 12889 - DNA, 20 bp, Artificial Sequence
  chemically synthesized
gaacaggcaacctacagaat

SEQ ID NO: 12890 - DNA, 20 bp, Artificial Sequence
  chemically synthesized
acaggcaacctacagaatgg

SEQ ID NO: 12891 - DNA, 20 bp, Artificial Sequence
  chemically synthesized
tgcaatctatccatctgaca

SEQ ID NO: 12892 - DNA, 20 bp, Artificial Sequence
  chemically synthesized
gcaatctatccatctgacaa

SEQ ID NO: 12893 - DNA, 20 bp, Artificial Sequence
  chemically synthesized
caatctatccatctgacaaa

SEQ ID NO: 12894 - DNA, 20 bp, Artificial Sequence
  chemically synthesized
gctaacatccaaaatctaca

SEQ ID NO: 12895 - DNA, 20 bp, Artificial Sequence
  chemically synthesized
aagaacttcaacaaatttac

SEQ ID NO: 12896 - DNA, 20 bp, Artificial Sequence
  chemically synthesized
aacctaacgaccccatcaaa

SEQ ID NO: 12897 - DNA, 20 bp, Artificial Sequence
  chemically synthesized
ctaacgaccccatcaaaaag

SEQ ID NO: 12898 - DNA, 20 bp, Artificial Sequence
  chemically synthesized
accccatcaaaaagtggaca

SEQ ID NO: 12899 - DNA, 20 bp, Artificial Sequence
  chemically synthesized
ccccatcaaaaagtggacaa

SEQ ID NO: 12900 - DNA, 20 bp, Artificial Sequence
  chemically synthesized
aagtggacaaaggatatgaa

SEQ ID NO: 12901 - DNA, 20 bp, Artificial Sequence
  chemically synthesized
tatgaacagatgcttctcta

SEQ ID NO: 12902 - DNA, 20 bp, Artificial Sequence
  chemically synthesized
gaacagatgcttctctaaag

SEQ ID NO: 12903 - DNA, 20 bp, Artificial Sequence
  chemically synthesized
ctctaaagaagtcatttatg

SEQ ID NO: 12904 - DNA, 20 bp, Artificial Sequence
  chemically synthesized
aagaagtcatttatgtggcc

SEQ ID NO: 12905 - DNA, 20 bp, Artificial Sequence
  chemically synthesized
gtggccaagaaacacatgaa

SEQ ID NO: 12906 - DNA, 20 bp, Artificial Sequence
  chemically synthesized
gccaagaaacacatgaaaag

SEQ ID NO: 12907 - DNA, 20 bp, Artificial Sequence
  chemically synthesized
gaaaagaagctcatcatcac

SEQ ID NO: 12908 - DNA, 20 bp, Artificial Sequence
  chemically synthesized
agctcatcatcactggtcat

SEQ ID NO: 12909 - DNA, 20 bp, Artificial Sequence
  chemically synthesized
ctcatcatcactggtcatta

SEQ ID NO: 12910 - DNA, 20 bp, Artificial Sequence
  chemically synthesized
atgcaaatcaaaaccacaat

SEQ ID NO: 12911 - DNA, 20 bp, Artificial Sequence
  chemically synthesized
aatgagataccatctcatgc

SEQ ID NO: 12912 - DNA, 20 bp, Artificial Sequence
  chemically synthesized
agataccatctcatgccagt

SEQ ID NO: 12913 - DNA, 20 bp, Artificial Sequence
  chemically synthesized
ccatctcatgccagttagaa

SEQ ID NO: 12914 - DNA, 20 bp, Artificial Sequence
  chemically synthesized
ttagaatggcaattattaaa

SEQ ID NO: 12915 - DNA, 20 bp, Artificial Sequence
  chemically synthesized
aatggcaattattaaaaagt

SEQ ID NO: 12916 - DNA, 20 bp, Artificial Sequence
  chemically synthesized
atggcaattattaaaaagtc

SEQ ID NO: 12917 - DNA, 20 bp, Artificial Sequence
  chemically synthesized
attaaaaagtcaggaaacaa

SEQ ID NO: 12918 - DNA, 20 bp, Artificial Sequence
  chemically synthesized
ttaaaaagtcaggaaacaaa

SEQ ID NO: 12919 - DNA, 20 bp, Artificial Sequence
  chemically synthesized
agtcaggaaacaaaaggtgc

SEQ ID NO: 12920 - DNA, 20 bp, Artificial Sequence
  chemically synthesized
tcaggaaacaaaaggtgctg

SEQ ID NO: 12921 - DNA, 20 bp, Artificial Sequence
  chemically synthesized
aggaaacaaaaggtgctgga

SEQ ID NO: 12922 - DNA, 20 bp, Artificial Sequence
  chemically synthesized
ggaaacaaaaggtgctggag

SEQ ID NO: 12923 - DNA, 20 bp, Artificial Sequence
  chemically synthesized
aaaaggtgctggagaggatg

SEQ ID NO: 12924 - DNA, 20 bp, Artificial Sequence
  chemically synthesized
aggtgctggagaggatgtgg

SEQ ID NO: 12925 - DNA, 20 bp, Artificial Sequence
  chemically synthesized
ctggagaggatgtggaagaa

SEQ ID NO: 12926 - DNA, 20 bp, Artificial Sequence
  chemically synthesized
tggagaggatgtggaagaat

SEQ ID NO: 12927 - DNA, 20 bp, Artificial Sequence
  chemically synthesized
gaaaaattttacactgttga

SEQ ID NO: 12928 - DNA, 20 bp, Artificial Sequence
  chemically synthesized
aaaaattttacactgttgat

SEQ ID NO: 12929 - DNA, 20 bp, Artificial Sequence
  chemically synthesized
ctgttgatgggtgtgtaaat

SEQ ID NO: 12930 - DNA, 20 bp, Artificial Sequence
  chemically synthesized
gtaaattagttcaaccattg

SEQ ID NO: 12931 - DNA, 20 bp, Artificial Sequence
  chemically synthesized
aattagttcaaccattgtgg

SEQ ID NO: 12932 - DNA, 20 bp, Artificial Sequence
  chemically synthesized
agttcaaccattgtggaaga

SEQ ID NO: 12933 - DNA, 20 bp, Artificial Sequence
  chemically synthesized
aaccattgtggaagacagtg

SEQ ID NO: 12934 - DNA, 20 bp, Artificial Sequence
  chemically synthesized
agacagtgtggcgattcctc

SEQ ID NO: 12935 - DNA, 20 bp, Artificial Sequence
  chemically synthesized
gacagtgtggcgattcctca

SEQ ID NO: 12936 - DNA, 20 bp, Artificial Sequence
  chemically synthesized
gtggcgattcctcaaggatc

SEQ ID NO: 12937 - DNA, 20 bp, Artificial Sequence
  chemically synthesized
attcctcaaggatctagaac

SEQ ID NO: 12938 - DNA, 20 bp, Artificial Sequence
  chemically synthesized
accagaaatactgtttgacc

SEQ ID NO: 12939 - DNA, 20 bp, Artificial Sequence
  chemically synthesized
tgacccagcaatcccattac

SEQ ID NO: 12940 - DNA, 20 bp, Artificial Sequence
  chemically synthesized
gacccagcaatcccattact

SEQ ID NO: 12941 - DNA, 20 bp, Artificial Sequence
  chemically synthesized
cattactgggtatataccca

SEQ ID NO: 12942 - DNA, 20 bp, Artificial Sequence
  chemically synthesized
tgggtatatacccaaagaat

SEQ ID NO: 12943 - DNA, 20 bp, Artificial Sequence
  chemically synthesized
ttagaaatcattctactata

SEQ ID NO: 12944 - DNA, 20 bp, Artificial Sequence
  chemically synthesized
gtgcacacgtatgtttattg

SEQ ID NO: 12945 - DNA, 20 bp, Artificial Sequence
  chemically synthesized
tattgtggcactattcacaa

SEQ ID NO: 12946 - DNA, 20 bp, Artificial Sequence
  chemically synthesized
tggcactattcacaatagca

SEQ ID NO: 12947 - DNA, 20 bp, Artificial Sequence
  chemically synthesized
tattcacaatagcaaagact

SEQ ID NO: 12948 - DNA, 20 bp, Artificial Sequence
  chemically synthesized
agacttggaaccaacccaaa

SEQ ID NO: 12949 - DNA, 20 bp, Artificial Sequence
  chemically synthesized
gaaccaacccaaatggccat

SEQ ID NO: 12950 - DNA, 20 bp, Artificial Sequence
  chemically synthesized
aatggccatcagcgatataa

SEQ ID NO: 12951 - DNA, 20 bp, Artificial Sequence
  chemically synthesized
catcagcgatataatggata

SEQ ID NO: 12952 - DNA, 20 bp, Artificial Sequence
  chemically synthesized
tataatggataaagaaaatg

SEQ ID NO: 12953 - DNA, 20 bp, Artificial Sequence
  chemically synthesized
aatgtggcacatatacacca

SEQ ID NO: 12954 - DNA, 20 bp, Artificial Sequence
  chemically synthesized
atacaccatggaatactatg

SEQ ID NO: 12955 - DNA, 20 bp, Artificial Sequence
  chemically synthesized
tatgcagccataaaaatgat

SEQ ID NO: 12956 - DNA, 20 bp, Artificial Sequence
  chemically synthesized
atgatgagttcatgtctttg

SEQ ID NO: 12957 - DNA, 20 bp, Artificial Sequence
  chemically synthesized
tgatgagttcatgtctttgc

SEQ ID NO: 12958 - DNA, 20 bp, Artificial Sequence
  chemically synthesized
gatgagttcatgtctttgca

SEQ ID NO: 12959 - DNA, 20 bp, Artificial Sequence
  chemically synthesized
ttcatgtctttgcagggaca

SEQ ID NO: 12960 - DNA, 20 bp, Artificial Sequence
  chemically synthesized
tctttgcagggacatggatg

SEQ ID NO: 12961 - DNA, 20 bp, Artificial Sequence
  chemically synthesized
ctttgcagggacatggatga

SEQ ID NO: 12962 - DNA, 20 bp, Artificial Sequence
  chemically synthesized
tgcagggacatggatgaagg

SEQ ID NO: 12963 - DNA, 20 bp, Artificial Sequence
  chemically synthesized
aaggtggaaaccatcattct

SEQ ID NO: 12964 - DNA, 20 bp, Artificial Sequence
  chemically synthesized
tcattctgagcaaactaaca

SEQ ID NO: 12965 - DNA, 20 bp, Artificial Sequence
  chemically synthesized
cattctgagcaaactaacac

SEQ ID NO: 12966 - DNA, 20 bp, Artificial Sequence
  chemically synthesized
tgagcaaactaacacaggaa

SEQ ID NO: 12967 - DNA, 20 bp, Artificial Sequence
  chemically synthesized
agcaaactaacacaggaaca

SEQ ID NO: 12968 - DNA, 20 bp, Artificial Sequence
  chemically synthesized
caccacacgttctcactcat

SEQ ID NO: 12969 - DNA, 20 bp, Artificial Sequence
  chemically synthesized
cacacgttctcactcataag

SEQ ID NO: 12970 - DNA, 20 bp, Artificial Sequence
  chemically synthesized
acacgttctcactcataagt

SEQ ID NO: 12971 - DNA, 20 bp, Artificial Sequence
  chemically synthesized
acgttctcactcataagtgg

SEQ ID NO: 12972 - DNA, 20 bp, Artificial Sequence
  chemically synthesized
ataagtgggagttgaacaat

SEQ ID NO: 12973 - DNA, 20 bp, Artificial Sequence
  chemically synthesized
agttgaacaatgagaacaca

SEQ ID NO: 12974 - DNA, 20 bp, Artificial Sequence
  chemically synthesized
acaatgagaacacatggaca

SEQ ID NO: 12975 - DNA, 20 bp, Artificial Sequence
  chemically synthesized
caatgagaacacatggacac

SEQ ID NO: 12976 - DNA, 20 bp, Artificial Sequence
  chemically synthesized
aatgagaacacatggacaca

SEQ ID NO: 12977 - DNA, 20 bp, Artificial Sequence
  chemically synthesized
tgagaacacatggacacagg

SEQ ID NO: 12978 - DNA, 20 bp, Artificial Sequence
  chemically synthesized
gagaacacatggacacaggg

SEQ ID NO: 12979 - DNA, 20 bp, Artificial Sequence
  chemically synthesized
agaacacatggacacaggga

SEQ ID NO: 12980 - DNA, 20 bp, Artificial Sequence
  chemically synthesized
gaacacatggacacagggag

SEQ ID NO: 12981 - DNA, 20 bp, Artificial Sequence
  chemically synthesized
gggaggggaacatcacacac

SEQ ID NO: 12982 - DNA, 20 bp, Artificial Sequence
  chemically synthesized
ggaggggaacatcacacacc

SEQ ID NO: 12983 - DNA, 20 bp, Artificial Sequence
  chemically synthesized
gaggggaacatcacacacca

SEQ ID NO: 12984 - DNA, 20 bp, Artificial Sequence
  chemically synthesized
catcacacaccagggcctgt

SEQ ID NO: 12985 - DNA, 20 bp, Artificial Sequence
  chemically synthesized
atcacacaccagggcctgtc

SEQ ID NO: 12986 - DNA, 20 bp, Artificial Sequence
  chemically synthesized
tcacacaccagggcctgtcg

SEQ ID NO: 12987 - DNA, 20 bp, Artificial Sequence
  chemically synthesized
cacacaccagggcctgtcgg

SEQ ID NO: 12988 - DNA, 20 bp, Artificial Sequence
  chemically synthesized
acacaccagggcctgtcggg

SEQ ID NO: 12989 - DNA, 20 bp, Artificial Sequence
  chemically synthesized
accagggcctgtcggggggt

SEQ ID NO: 12990 - DNA, 20 bp, Artificial Sequence
  chemically synthesized
ccagggcctgtcggggggtg

SEQ ID NO: 12991 - DNA, 20 bp, Artificial Sequence
  chemically synthesized
cagggcctgtcggggggtga

SEQ ID NO: 12992 - DNA, 20 bp, Artificial Sequence
  chemically synthesized
agggcctgtcggggggtgag

SEQ ID NO: 12993 - DNA, 20 bp, Artificial Sequence
  chemically synthesized
gggcctgtcggggggtgagg

SEQ ID NO: 12994 - DNA, 20 bp, Artificial Sequence
  chemically synthesized
ctgtcggggggtgagggggt

SEQ ID NO: 12995 - DNA, 20 bp, Artificial Sequence
  chemically synthesized
tgtcggggggtgagggggtt

SEQ ID NO: 12996 - DNA, 20 bp, Artificial Sequence
  chemically synthesized
tcggggggtgagggggttag

SEQ ID NO: 12997 - DNA, 20 bp, Artificial Sequence
  chemically synthesized
ggggggtgagggggttagga

SEQ ID NO: 12998 - DNA, 20 bp, Artificial Sequence
  chemically synthesized
gggggtgagggggttaggag

SEQ ID NO: 12999 - DNA, 20 bp, Artificial Sequence
  chemically synthesized
ggggtgagggggttaggaga

SEQ ID NO: 13000 - DNA, 20 bp, Artificial Sequence
  chemically synthesized
taggagagggataacattaa

SEQ ID NO: 13001 - DNA, 20 bp, Artificial Sequence
  chemically synthesized
attaaaagaaatacctaatg

SEQ ID NO: 13002 - DNA, 20 bp, Artificial Sequence
  chemically synthesized
gaaatacctaatgtagatga

SEQ ID NO: 13003 - DNA, 20 bp, Artificial Sequence
  chemically synthesized
aaatacctaatgtagatgac

SEQ ID NO: 13004 - DNA, 20 bp, Artificial Sequence
  chemically synthesized
taatgtagatgacaggttga

SEQ ID NO: 13005 - DNA, 20 bp, Artificial Sequence
  chemically synthesized
aatgtagatgacaggttgat

SEQ ID NO: 13006 - DNA, 20 bp, Artificial Sequence
  chemically synthesized
agatgacaggttgatgggtg

SEQ ID NO: 13007 - DNA, 20 bp, Artificial Sequence
  chemically synthesized
atgggtgcagcaaaccacca

SEQ ID NO: 13008 - DNA, 20 bp, Artificial Sequence
  chemically synthesized
cacattctgcacatgtatcc

SEQ ID NO: 13009 - DNA, 20 bp, Artificial Sequence
  chemically synthesized
cacatgtatcccagaactta

SEQ ID NO: 13010 - DNA, 20 bp, Artificial Sequence
  chemically synthesized
cccagaacttaaagtataat

SEQ ID NO: 13011 - DNA, 20 bp, Artificial Sequence
  chemically synthesized
ttacttgaactgaccgacaa

SEQ ID NO: 13012 - DNA, 20 bp, Artificial Sequence
  chemically synthesized
acacaacctatcaaaacctc

SEQ ID NO: 13013 - DNA, 20 bp, Artificial Sequence
  chemically synthesized
cacaacctatcaaaacctct

SEQ ID NO: 13014 - DNA, 20 bp, Artificial Sequence
  chemically synthesized
ctatcaaaacctctaggata

SEQ ID NO: 13015 - DNA, 20 bp, Artificial Sequence
  chemically synthesized
aaaacctctaggatacagca

SEQ ID NO: 13016 - DNA, 20 bp, Artificial Sequence
  chemically synthesized
cctctaggatacagcaaaga

SEQ ID NO: 13017 - DNA, 20 bp, Artificial Sequence
  chemically synthesized
tacagcaaagatggtgctaa

SEQ ID NO: 13018 - DNA, 20 bp, Artificial Sequence
  chemically synthesized
acagcaaagatggtgctaaa

SEQ ID NO: 13019 - DNA, 20 bp, Artificial Sequence
  chemically synthesized
caaagatggtgctaaaagga

SEQ ID NO: 13020 - DNA, 20 bp, Artificial Sequence
  chemically synthesized
ggtgctaaaaggaaagttca

SEQ ID NO: 13021 - DNA, 20 bp, Artificial Sequence
  chemically synthesized
agccctaaatgtcgatgtca

SEQ ID NO: 13022 - DNA, 20 bp, Artificial Sequence
  chemically synthesized
ccctaaatgtcgatgtcaaa

SEQ ID NO: 13023 - DNA, 20 bp, Artificial Sequence
  chemically synthesized
gtcgatgtcaaagagtctga

SEQ ID NO: 13024 - DNA, 20 bp, Artificial Sequence
  chemically synthesized
cgatgtcaaagagtctgaaa

SEQ ID NO: 13025 - DNA, 20 bp, Artificial Sequence
  chemically synthesized
gatgtcaaagagtctgaaag

SEQ ID NO: 13026 - DNA, 20 bp, Artificial Sequence
  chemically synthesized
tcaaagagtctgaaagagga

SEQ ID NO: 13027 - DNA, 20 bp, Artificial Sequence
  chemically synthesized
agagtctgaaagaggacaga

SEQ ID NO: 13028 - DNA, 20 bp, Artificial Sequence
  chemically synthesized
agaggacagacagacaatat

SEQ ID NO: 13029 - DNA, 20 bp, Artificial Sequence
  chemically synthesized
gaggacagacagacaatata

SEQ ID NO: 13030 - DNA, 20 bp, Artificial Sequence
  chemically synthesized
acaatataaggtcacaccac

SEQ ID NO: 13031 - DNA, 20 bp, Artificial Sequence
  chemically synthesized
aaggtcacaccacaagaaac

SEQ ID NO: 13032 - DNA, 20 bp, Artificial Sequence
  chemically synthesized
ggtcacaccacaagaaacta

SEQ ID NO: 13033 - DNA, 20 bp, Artificial Sequence
  chemically synthesized
actagagaaacaaaaacaaa

SEQ ID NO: 13034 - DNA, 20 bp, Artificial Sequence
  chemically synthesized
aaacaaacagaaccaaaacc

SEQ ID NO: 13035 - DNA, 20 bp, Artificial Sequence
  chemically synthesized
acagaaccaaaacccagcaa

SEQ ID NO: 13036 - DNA, 20 bp, Artificial Sequence
  chemically synthesized
aaccaaaacccagcaaaaga

SEQ ID NO: 13037 - DNA, 20 bp, Artificial Sequence
  chemically synthesized
accaaaacccagcaaaagaa

SEQ ID NO: 13038 - DNA, 20 bp, Artificial Sequence
  chemically synthesized
ccaaaacccagcaaaagaaa

SEQ ID NO: 13039 - DNA, 20 bp, Artificial Sequence
  chemically synthesized
gcaaaagaaagggaataact

SEQ ID NO: 13040 - DNA, 20 bp, Artificial Sequence
  chemically synthesized
agaaagggaataactaagat

SEQ ID NO: 13041 - DNA, 20 bp, Artificial Sequence
  chemically synthesized
aaagggaataactaagataa

SEQ ID NO: 13042 - DNA, 20 bp, Artificial Sequence
  chemically synthesized
aagggaataactaagataag

SEQ ID NO: 13043 - DNA, 20 bp, Artificial Sequence
  chemically synthesized
gggaataactaagataagag

SEQ ID NO: 13044 - DNA, 20 bp, Artificial Sequence
  chemically synthesized
acaactgcaaaaaaatacaa

SEQ ID NO: 13045 - DNA, 20 bp, Artificial Sequence
  chemically synthesized
caaaagctaaatgaaataaa

SEQ ID NO: 13046 - DNA, 20 bp, Artificial Sequence
  chemically synthesized
agctaaatgaaataaaaagc

SEQ ID NO: 13047 - DNA, 20 bp, Artificial Sequence
  chemically synthesized
taaaaagctggttctttgaa

SEQ ID NO: 13048 - DNA, 20 bp, Artificial Sequence
  chemically synthesized
gaaaagataaataaaactga

SEQ ID NO: 13049 - DNA, 20 bp, Artificial Sequence
  chemically synthesized
aaataaaactgatagaccat

SEQ ID NO: 13050 - DNA, 20 bp, Artificial Sequence
  chemically synthesized
aaaactgatagaccattagc

SEQ ID NO: 13051 - DNA, 20 bp, Artificial Sequence
  chemically synthesized
gaccattagcaagattaacc

SEQ ID NO: 13052 - DNA, 20 bp, Artificial Sequence
  chemically synthesized
ttagcaagattaaccaagaa

SEQ ID NO: 13053 - DNA, 20 bp, Artificial Sequence
  chemically synthesized
agcaagattaaccaagaaaa

SEQ ID NO: 13054 - DNA, 20 bp, Artificial Sequence
  chemically synthesized
gcaagattaaccaagaaaag

SEQ ID NO: 13055 - DNA, 20 bp, Artificial Sequence
  chemically synthesized
aagattaaccaagaaaagag

SEQ ID NO: 13056 - DNA, 20 bp, Artificial Sequence
  chemically synthesized
gattaaccaagaaaagagga

SEQ ID NO: 13057 - DNA, 20 bp, Artificial Sequence
  chemically synthesized
taaccaagaaaagaggagag

SEQ ID NO: 13058 - DNA, 20 bp, Artificial Sequence
  chemically synthesized
gaagtgcaaataaactcaat

SEQ ID NO: 13059 - DNA, 20 bp, Artificial Sequence
  chemically synthesized
aaactcaattagaaacaaaa

SEQ ID NO: 13060 - DNA, 20 bp, Artificial Sequence
  chemically synthesized
aactcaattagaaacaaaac

SEQ ID NO: 13061 - DNA, 20 bp, Artificial Sequence
  chemically synthesized
ctcaattagaaacaaaacag

SEQ ID NO: 13062 - DNA, 20 bp, Artificial Sequence
  chemically synthesized
agatactattactgatacca

SEQ ID NO: 13063 - DNA, 20 bp, Artificial Sequence
  chemically synthesized
ctgataccacagaaatacaa

SEQ ID NO: 13064 - DNA, 20 bp, Artificial Sequence
  chemically synthesized
agaaatacaaaagattattc

SEQ ID NO: 13065 - DNA, 20 bp, Artificial Sequence
  chemically synthesized
gaaatacaaaagattattca

SEQ ID NO: 13066 - DNA, 20 bp, Artificial Sequence
  chemically synthesized
acacctttacatgcataaac

SEQ ID NO: 13067 - DNA, 20 bp, Artificial Sequence
  chemically synthesized
tgcataaactagaaaaccta

SEQ ID NO: 13068 - DNA, 20 bp, Artificial Sequence
  chemically synthesized
gcataaactagaaaacctaa

SEQ ID NO: 13069 - DNA, 20 bp, Artificial Sequence
  chemically synthesized
ataaactagaaaacctaaag

SEQ ID NO: 13070 - DNA, 20 bp, Artificial Sequence
  chemically synthesized
aaaggagacgttcgaattcc

SEQ ID NO: 13071 - DNA, 20 bp, Artificial Sequence
  chemically synthesized
gagacgttcgaattcctgga

SEQ ID NO: 13072 - DNA, 20 bp, Artificial Sequence
  chemically synthesized
ttcgaattcctggaaagata

SEQ ID NO: 13073 - DNA, 20 bp, Artificial Sequence
  chemically synthesized
tcgaattcctggaaagatac

SEQ ID NO: 13074 - DNA, 20 bp, Artificial Sequence
  chemically synthesized
cgaattcctggaaagataca

SEQ ID NO: 13075 - DNA, 20 bp, Artificial Sequence
  chemically synthesized
cctggaaagatacagggctc

SEQ ID NO: 13076 - DNA, 20 bp, Artificial Sequence
  chemically synthesized
aagatacagggctctagctt

SEQ ID NO: 13077 - DNA, 20 bp, Artificial Sequence
  chemically synthesized
tacagggctctagcttaagt

SEQ ID NO: 13078 - DNA, 20 bp, Artificial Sequence
  chemically synthesized
acagggctctagcttaagtc

SEQ ID NO: 13079 - DNA, 20 bp, Artificial Sequence
  chemically synthesized
gggctctagcttaagtcagg

SEQ ID NO: 13080 - DNA, 20 bp, Artificial Sequence
  chemically synthesized
tagcttaagtcaggaagaat

SEQ ID NO: 13081 - DNA, 20 bp, Artificial Sequence
  chemically synthesized
gaagaattagataccctgaa

SEQ ID NO: 13082 - DNA, 20 bp, Artificial Sequence
  chemically synthesized
attagataccctgaacagac

SEQ ID NO: 13083 - DNA, 20 bp, Artificial Sequence
  chemically synthesized
accctgaacagaccagtaat

SEQ ID NO: 13084 - DNA, 20 bp, Artificial Sequence
  chemically synthesized
ctgaacagaccagtaataag

SEQ ID NO: 13085 - DNA, 20 bp, Artificial Sequence
  chemically synthesized
acagaccagtaataagcagc

SEQ ID NO: 13086 - DNA, 20 bp, Artificial Sequence
  chemically synthesized
aaaatttaccaacaacaaaa

SEQ ID NO: 13087 - DNA, 20 bp, Artificial Sequence
  chemically synthesized
ttaccaacaacaaaaaagtc

SEQ ID NO: 13088 - DNA, 20 bp, Artificial Sequence
  chemically synthesized
taccaacaacaaaaaagtcc

SEQ ID NO: 13089 - DNA, 20 bp, Artificial Sequence
  chemically synthesized
acaacaaaaaagtccaggac

SEQ ID NO: 13090 - DNA, 20 bp, Artificial Sequence
  chemically synthesized
caaaaaagtccaggaccaga

SEQ ID NO: 13091 - DNA, 20 bp, Artificial Sequence
  chemically synthesized
tccaggaccagatagattca

SEQ ID NO: 13092 - DNA, 20 bp, Artificial Sequence
  chemically synthesized
gattcacagctgaattctac

SEQ ID NO: 13093 - DNA, 20 bp, Artificial Sequence
  chemically synthesized
tgaattctaccagacattca

SEQ ID NO: 13094 - DNA, 20 bp, Artificial Sequence
  chemically synthesized
attctaccagacattcaaag

SEQ ID NO: 13095 - DNA, 20 bp, Artificial Sequence
  chemically synthesized
attgataccaatcctattga

SEQ ID NO: 13096 - DNA, 20 bp, Artificial Sequence
  chemically synthesized
tcctattgacagtattctac

SEQ ID NO: 13097 - DNA, 20 bp, Artificial Sequence
  chemically synthesized
attgacagtattctacaaga

SEQ ID NO: 13098 - DNA, 20 bp, Artificial Sequence
  chemically synthesized
tgacagtattctacaagata

SEQ ID NO: 13099 - DNA, 20 bp, Artificial Sequence
  chemically synthesized
agtattctacaagatagaga

SEQ ID NO: 13100 - DNA, 20 bp, Artificial Sequence
  chemically synthesized
tattctacaagatagagaaa

SEQ ID NO: 13101 - DNA, 20 bp, Artificial Sequence
  chemically synthesized
ttctacaagatagagaaaga

SEQ ID NO: 13102 - DNA, 20 bp, Artificial Sequence
  chemically synthesized
cctccctaaatcattctatg

SEQ ID NO: 13103 - DNA, 20 bp, Artificial Sequence
  chemically synthesized
cctaaatcattctatgaagc

SEQ ID NO: 13104 - DNA, 20 bp, Artificial Sequence
  chemically synthesized
tatcaccttaataccaaaac

SEQ ID NO: 13105 - DNA, 20 bp, Artificial Sequence
  chemically synthesized
atcaccttaataccaaaact

SEQ ID NO: 13106 - DNA, 20 bp, Artificial Sequence
  chemically synthesized
ccttaataccaaaactggga

SEQ ID NO: 13107 - DNA, 20 bp, Artificial Sequence
  chemically synthesized
accaaaaaaaaaaaacacta

SEQ ID NO: 13108 - DNA, 20 bp, Artificial Sequence
  chemically synthesized
atcaatatccctgatgaaca

SEQ ID NO: 13109 - DNA, 20 bp, Artificial Sequence
  chemically synthesized
caacatccttgacaaaatac

SEQ ID NO: 13110 - DNA, 20 bp, Artificial Sequence
  chemically synthesized
cttgacaaaatactagctaa

SEQ ID NO: 13111 - DNA, 20 bp, Artificial Sequence
  chemically synthesized
tactagctaatagcatccga

SEQ ID NO: 13112 - DNA, 20 bp, Artificial Sequence
  chemically synthesized
gcatatcaaaacccatgatc

SEQ ID NO: 13113 - DNA, 20 bp, Artificial Sequence
  chemically synthesized
tatcaaaacccatgatcaag

SEQ ID NO: 13114 - DNA, 20 bp, Artificial Sequence
  chemically synthesized
atcaaaacccatgatcaagt

SEQ ID NO: 13115 - DNA, 20 bp, Artificial Sequence
  chemically synthesized
tgatcaagtgggtttcatgc

SEQ ID NO: 13116 - DNA, 20 bp, Artificial Sequence
  chemically synthesized
gatcaagtgggtttcatgcg

SEQ ID NO: 13117 - DNA, 20 bp, Artificial Sequence
  chemically synthesized
atcaagtgggtttcatgcga

SEQ ID NO: 13118 - DNA, 20 bp, Artificial Sequence
  chemically synthesized
ggtttcatgcgagggatgca

SEQ ID NO: 13119 - DNA, 20 bp, Artificial Sequence
  chemically synthesized
tcatgcgagggatgcacgga

SEQ ID NO: 13120 - DNA, 20 bp, Artificial Sequence
  chemically synthesized
acggatggtttaacatacgc

SEQ ID NO: 13121 - DNA, 20 bp, Artificial Sequence
  chemically synthesized
tttaacatacgcaagtcaat

SEQ ID NO: 13122 - DNA, 20 bp, Artificial Sequence
  chemically synthesized
taagtgtgatacacaacata

SEQ ID NO: 13123 - DNA, 20 bp, Artificial Sequence
  chemically synthesized
agtgtgatacacaacataaa

SEQ ID NO: 13124 - DNA, 20 bp, Artificial Sequence
  chemically synthesized
atacacaacataaagagaat

SEQ ID NO: 13125 - DNA, 20 bp, Artificial Sequence
  chemically synthesized
aaatcatgtgattatctcaa

SEQ ID NO: 13126 - DNA, 20 bp, Artificial Sequence
  chemically synthesized
tgtgattatctcaatagcca

SEQ ID NO: 13127 - DNA, 20 bp, Artificial Sequence
  chemically synthesized
atcactttatgactaaaact

SEQ ID NO: 13128 - DNA, 20 bp, Artificial Sequence
  chemically synthesized
tgactaaaactcagcaaaat

SEQ ID NO: 13129 - DNA, 20 bp, Artificial Sequence
  chemically synthesized
ctcagcaaaatcggtttaca

SEQ ID NO: 13130 - DNA, 20 bp, Artificial Sequence
  chemically synthesized
tcagcaaaatcggtttacaa

SEQ ID NO: 13131 - DNA, 20 bp, Artificial Sequence
  chemically synthesized
gacatacctcaatgtaataa

SEQ ID NO: 13132 - DNA, 20 bp, Artificial Sequence
  chemically synthesized
tacctcaatgtaataaaagc

SEQ ID NO: 13133 - DNA, 20 bp, Artificial Sequence
  chemically synthesized
aatgtaataaaagccagcta

SEQ ID NO: 13134 - DNA, 20 bp, Artificial Sequence
  chemically synthesized
agccagctatggtaaacaca

SEQ ID NO: 13135 - DNA, 20 bp, Artificial Sequence
  chemically synthesized
acagccaacattatattgaa

SEQ ID NO: 13136 - DNA, 20 bp, Artificial Sequence
  chemically synthesized
cagccaacattatattgaat

SEQ ID NO: 13137 - DNA, 20 bp, Artificial Sequence
  chemically synthesized
acattatattgaatgggaaa

SEQ ID NO: 13138 - DNA, 20 bp, Artificial Sequence
  chemically synthesized
attgaatgggaaaaagttaa

SEQ ID NO: 13139 - DNA, 20 bp, Artificial Sequence
  chemically synthesized
aaagcattctgtctgaaaac

SEQ ID NO: 13140 - DNA, 20 bp, Artificial Sequence
  chemically synthesized
ttctgtctgaaaactggaat

SEQ ID NO: 13141 - DNA, 20 bp, Artificial Sequence
  chemically synthesized
tctgaaaactggaatgagac

SEQ ID NO: 13142 - DNA, 20 bp, Artificial Sequence
  chemically synthesized
ctgaaaactggaatgagaca

SEQ ID NO: 13143 - DNA, 20 bp, Artificial Sequence
  chemically synthesized
acttctctttaacatattac

SEQ ID NO: 13144 - DNA, 20 bp, Artificial Sequence
  chemically synthesized
tctctttaacatattactgg

SEQ ID NO: 13145 - DNA, 20 bp, Artificial Sequence
  chemically synthesized
taacatattactggaagtcc

SEQ ID NO: 13146 - DNA, 20 bp, Artificial Sequence
  chemically synthesized
atattactggaagtcctagc

SEQ ID NO: 13147 - DNA, 20 bp, Artificial Sequence
  chemically synthesized
attactggaagtcctagcaa

SEQ ID NO: 13148 - DNA, 20 bp, Artificial Sequence
  chemically synthesized
gaagtcctagcaagagcaat

SEQ ID NO: 13149 - DNA, 20 bp, Artificial Sequence
  chemically synthesized
cctagcaagagcaatcagac

SEQ ID NO: 13150 - DNA, 20 bp, Artificial Sequence
  chemically synthesized
tagcaagagcaatcagacaa

SEQ ID NO: 13151 - DNA, 20 bp, Artificial Sequence
  chemically synthesized
agcaatcagacaagagaaac

SEQ ID NO: 13152 - DNA, 20 bp, Artificial Sequence
  chemically synthesized
tcagacaagagaaacaagta

SEQ ID NO: 13153 - DNA, 20 bp, Artificial Sequence
  chemically synthesized
aaagcacatccaaattgtta

SEQ ID NO: 13154 - DNA, 20 bp, Artificial Sequence
  chemically synthesized
agcacatccaaattgttaaa

SEQ ID NO: 13155 - DNA, 20 bp, Artificial Sequence
  chemically synthesized
catccaaattgttaaagaga

SEQ ID NO: 13156 - DNA, 20 bp, Artificial Sequence
  chemically synthesized
tgatgatatgattgtgtatg

SEQ ID NO: 13157 - DNA, 20 bp, Artificial Sequence
  chemically synthesized
tgtgtatgtagaaaactcta

SEQ ID NO: 13158 - DNA, 20 bp, Artificial Sequence
  chemically synthesized
aagactcctccaaaaccccc

SEQ ID NO: 13159 - DNA, 20 bp, Artificial Sequence
  chemically synthesized
ctagaactgataaaataatt

SEQ ID NO: 13160 - DNA, 20 bp, Artificial Sequence
  chemically synthesized
actgataaaataattcagca

SEQ ID NO: 13161 - DNA, 20 bp, Artificial Sequence
  chemically synthesized
aaataattcagcaaagtttc

SEQ ID NO: 13162 - DNA, 20 bp, Artificial Sequence
  chemically synthesized
caaaattaacgtacaccaat

SEQ ID NO: 13163 - DNA, 20 bp, Artificial Sequence
  chemically synthesized
tgagttgctttcttacatac

SEQ ID NO: 13164 - DNA, 20 bp, Artificial Sequence
  chemically synthesized
cttacataccagcaatgacc

SEQ ID NO: 13165 - DNA, 20 bp, Artificial Sequence
  chemically synthesized
ataccagcaatgaccaagct

SEQ ID NO: 13166 - DNA, 20 bp, Artificial Sequence
  chemically synthesized
accaagctgagaataaaatc

SEQ ID NO: 13167 - DNA, 20 bp, Artificial Sequence
  chemically synthesized
gaactcaaccccttttacaa

SEQ ID NO: 13168 - DNA, 20 bp, Artificial Sequence
  chemically synthesized
aacaaaacaaaacaaaaact

SEQ ID NO: 13169 - DNA, 20 bp, Artificial Sequence
  chemically synthesized
acaaaacaaaacaaaaactt

SEQ ID NO: 13170 - DNA, 20 bp, Artificial Sequence
  chemically synthesized
ttaggaatatatacctaacc

SEQ ID NO: 13171 - DNA, 20 bp, Artificial Sequence
  chemically synthesized
taggaatatatacctaacca

SEQ ID NO: 13172 - DNA, 20 bp, Artificial Sequence
  chemically synthesized
ggaatatatacctaaccaag

SEQ ID NO: 13173 - DNA, 20 bp, Artificial Sequence
  chemically synthesized
gaatatatacctaaccaagg

SEQ ID NO: 13174 - DNA, 20 bp, Artificial Sequence
  chemically synthesized
atacctaaccaaggaggtga

SEQ ID NO: 13175 - DNA, 20 bp, Artificial Sequence
  chemically synthesized
aggaggtgaaagacatctac

SEQ ID NO: 13176 - DNA, 20 bp, Artificial Sequence
  chemically synthesized
ggaggtgaaagacatctaca

SEQ ID NO: 13177 - DNA, 20 bp, Artificial Sequence
  chemically synthesized
acaaggaaaactacaaaaca

SEQ ID NO: 13178 - DNA, 20 bp, Artificial Sequence
  chemically synthesized
aaactacaaaacacggctga

SEQ ID NO: 13179 - DNA, 20 bp, Artificial Sequence
  chemically synthesized
acggctgaaagtaatcatat

SEQ ID NO: 13180 - DNA, 20 bp, Artificial Sequence
  chemically synthesized
tcatataagacacaaacaaa

SEQ ID NO: 13181 - DNA, 20 bp, Artificial Sequence
  chemically synthesized
ggaaacacatgccattctca

SEQ ID NO: 13182 - DNA, 20 bp, Artificial Sequence
  chemically synthesized
acacatgccattctcataga

SEQ ID NO: 13183 - DNA, 20 bp, Artificial Sequence
  chemically synthesized
cacatgccattctcatagat

SEQ ID NO: 13184 - DNA, 20 bp, Artificial Sequence
  chemically synthesized
atgccattctcatagatggg

SEQ ID NO: 13185 - DNA, 20 bp, Artificial Sequence
  chemically synthesized
tagaatcaatattgtgaaaa

SEQ ID NO: 13186 - DNA, 20 bp, Artificial Sequence
  chemically synthesized
tgtgaaaatggccataatgc

SEQ ID NO: 13187 - DNA, 20 bp, Artificial Sequence
  chemically synthesized
gaaaatggccataatgccag

SEQ ID NO: 13188 - DNA, 20 bp, Artificial Sequence
  chemically synthesized
tcccatcaaaataccaccat

SEQ ID NO: 13189 - DNA, 20 bp, Artificial Sequence
  chemically synthesized
aataccaccattagtcttca

SEQ ID NO: 13190 - DNA, 20 bp, Artificial Sequence
  chemically synthesized
accattagtcttcacagaac

SEQ ID NO: 13191 - DNA, 20 bp, Artificial Sequence
  chemically synthesized
aaacaatcctaaaattctta

SEQ ID NO: 13192 - DNA, 20 bp, Artificial Sequence
  chemically synthesized
aaattcttatggaaccaaaa

SEQ ID NO: 13193 - DNA, 20 bp, Artificial Sequence
  chemically synthesized
attcttatggaaccaaaaaa

SEQ ID NO: 13194 - DNA, 20 bp, Artificial Sequence
  chemically synthesized
caaaaaagagcccaataaac

SEQ ID NO: 13195 - DNA, 20 bp, Artificial Sequence
  chemically synthesized
aaagagcccaataaacaagc

SEQ ID NO: 13196 - DNA, 20 bp, Artificial Sequence
  chemically synthesized
aaacaagcaagtctaaaaaa

SEQ ID NO: 13197 - DNA, 20 bp, Artificial Sequence
  chemically synthesized
taaaaaaaagaacaaatctg

SEQ ID NO: 13198 - DNA, 20 bp, Artificial Sequence
  chemically synthesized
aaaaaaaagaacaaatctga

SEQ ID NO: 13199 - DNA, 20 bp, Artificial Sequence
  chemically synthesized
ctcatttcaaactatacaat

SEQ ID NO: 13200 - DNA, 20 bp, Artificial Sequence
  chemically synthesized
tcatttcaaactatacaata

SEQ ID NO: 13201 - DNA, 20 bp, Artificial Sequence
  chemically synthesized
caaactatacaataaggcca

SEQ ID NO: 13202 - DNA, 20 bp, Artificial Sequence
  chemically synthesized
taaggccatagtcaccaaaa

SEQ ID NO: 13203 - DNA, 20 bp, Artificial Sequence
  chemically synthesized
tcaccaaaacagcatgatgc

SEQ ID NO: 13204 - DNA, 20 bp, Artificial Sequence
  chemically synthesized
gcatgatgctggtgtacaaa

SEQ ID NO: 13205 - DNA, 20 bp, Artificial Sequence
  chemically synthesized
catgatgctggtgtacaaat

SEQ ID NO: 13206 - DNA, 20 bp, Artificial Sequence
  chemically synthesized
caaataggcacatcgaccaa

SEQ ID NO: 13207 - DNA, 20 bp, Artificial Sequence
  chemically synthesized
aggcacatcgaccaatggaa

SEQ ID NO: 13208 - DNA, 20 bp, Artificial Sequence
  chemically synthesized
catcgaccaatggaacagaa

SEQ ID NO: 13209 - DNA, 20 bp, Artificial Sequence
  chemically synthesized
tcgaccaatggaacagaata

SEQ ID NO: 13210 - DNA, 20 bp, Artificial Sequence
  chemically synthesized
atggaacagaatagagaacc

SEQ ID NO: 13211 - DNA, 20 bp, Artificial Sequence
  chemically synthesized
catccaactgatctttgaca

SEQ ID NO: 13212 - DNA, 20 bp, Artificial Sequence
  chemically synthesized
acaaagcaaacaaaaacata

SEQ ID NO: 13213 - DNA, 20 bp, Artificial Sequence
  chemically synthesized
aagcaaacaaaaacataaag

SEQ ID NO: 13214 - DNA, 20 bp, Artificial Sequence
  chemically synthesized
agcaaacaaaaacataaagt

SEQ ID NO: 13215 - DNA, 20 bp, Artificial Sequence
  chemically synthesized
gcaaacaaaaacataaagtg

SEQ ID NO: 13216 - DNA, 20 bp, Artificial Sequence
  chemically synthesized
acaaaaacataaagtgggga

SEQ ID NO: 13217 - DNA, 20 bp, Artificial Sequence
  chemically synthesized
caaaaacataaagtggggaa

SEQ ID NO: 13218 - DNA, 20 bp, Artificial Sequence
  chemically synthesized
aaaaacataaagtggggaaa

SEQ ID NO: 13219 - DNA, 20 bp, Artificial Sequence
  chemically synthesized
agggcaccctattcaacaaa

SEQ ID NO: 13220 - DNA, 20 bp, Artificial Sequence
  chemically synthesized
accctattcaacaaatggtg

SEQ ID NO: 13221 - DNA, 20 bp, Artificial Sequence
  chemically synthesized
ccctattcaacaaatggtgc

SEQ ID NO: 13222 - DNA, 20 bp, Artificial Sequence
  chemically synthesized
cctattcaacaaatggtgcg

SEQ ID NO: 13223 - DNA, 20 bp, Artificial Sequence
  chemically synthesized
ttcaacaaatggtgcgggga

SEQ ID NO: 13224 - DNA, 20 bp, Artificial Sequence
  chemically synthesized
acaaatggtgcggggatagc

SEQ ID NO: 13225 - DNA, 20 bp, Artificial Sequence
  chemically synthesized
atggtgcggggatagctggc

SEQ ID NO: 13226 - DNA, 20 bp, Artificial Sequence
  chemically synthesized
gatagctggcaagctacatg

SEQ ID NO: 13227 - DNA, 20 bp, Artificial Sequence
  chemically synthesized
atagctggcaagctacatgt

SEQ ID NO: 13228 - DNA, 20 bp, Artificial Sequence
  chemically synthesized
agctggcaagctacatgtag

SEQ ID NO: 13229 - DNA, 20 bp, Artificial Sequence
  chemically synthesized
tacatgtaggagaatgaaac

SEQ ID NO: 13230 - DNA, 20 bp, Artificial Sequence
  chemically synthesized
ccttatacaaaaatcaactc

SEQ ID NO: 13231 - DNA, 20 bp, Artificial Sequence
  chemically synthesized
atacaaaaatcaactcaaga

SEQ ID NO: 13232 - DNA, 20 bp, Artificial Sequence
  chemically synthesized
aaatcaactcaagatggatc

SEQ ID NO: 13233 - DNA, 20 bp, Artificial Sequence
  chemically synthesized
aatcaactcaagatggatca

SEQ ID NO: 13234 - DNA, 20 bp, Artificial Sequence
  chemically synthesized
tggatcaaggacttaaatct

SEQ ID NO: 13235 - DNA, 20 bp, Artificial Sequence
  chemically synthesized
ccctgaaactgtaacaattc

SEQ ID NO: 13236 - DNA, 20 bp, Artificial Sequence
  chemically synthesized
acaattctagaaaataacat

SEQ ID NO: 13237 - DNA, 20 bp, Artificial Sequence
  chemically synthesized
ggaaaaacccttctacacat

SEQ ID NO: 13238 - DNA, 20 bp, Artificial Sequence
  chemically synthesized
aacccttctacacattggct

SEQ ID NO: 13239 - DNA, 20 bp, Artificial Sequence
  chemically synthesized
acccttctacacattggctt

SEQ ID NO: 13240 - DNA, 20 bp, Artificial Sequence
  chemically synthesized
ttctacacattggcttagga

SEQ ID NO: 13241 - DNA, 20 bp, Artificial Sequence
  chemically synthesized
tctacacattggcttaggaa

SEQ ID NO: 13242 - DNA, 20 bp, Artificial Sequence
  chemically synthesized
taggaaaggatttcatgacc

SEQ ID NO: 13243 - DNA, 20 bp, Artificial Sequence
  chemically synthesized
aatgcaaatacataaaaaca

SEQ ID NO: 13244 - DNA, 20 bp, Artificial Sequence
  chemically synthesized
ataaaaacaaagaaaatatc

SEQ ID NO: 13245 - DNA, 20 bp, Artificial Sequence
  chemically synthesized
taaaaacaaagaaaatatct

SEQ ID NO: 13246 - DNA, 20 bp, Artificial Sequence
  chemically synthesized
tctgggactaaattaaacta

SEQ ID NO: 13247 - DNA, 20 bp, Artificial Sequence
  chemically synthesized
tgggactaaattaaactaaa

SEQ ID NO: 13248 - DNA, 20 bp, Artificial Sequence
  chemically synthesized
taaactaaagagcttttgca

SEQ ID NO: 13249 - DNA, 20 bp, Artificial Sequence
  chemically synthesized
aaagagcttttgcatggcaa

SEQ ID NO: 13250 - DNA, 20 bp, Artificial Sequence
  chemically synthesized
aagagcttttgcatggcaaa

SEQ ID NO: 13251 - DNA, 20 bp, Artificial Sequence
  chemically synthesized
agcttttgcatggcaaaagg

SEQ ID NO: 13252 - DNA, 20 bp, Artificial Sequence
  chemically synthesized
cttttgcatggcaaaaggaa

SEQ ID NO: 13253 - DNA, 20 bp, Artificial Sequence
  chemically synthesized
atggcaaaaggaagagtctg

SEQ ID NO: 13254 - DNA, 20 bp, Artificial Sequence
  chemically synthesized
ggaagagtctgcagaataaa

SEQ ID NO: 13255 - DNA, 20 bp, Artificial Sequence
  chemically synthesized
cagaataaacagacaaccca

SEQ ID NO: 13256 - DNA, 20 bp, Artificial Sequence
  chemically synthesized
gaataaacagacaacccaca

SEQ ID NO: 13257 - DNA, 20 bp, Artificial Sequence
  chemically synthesized
taaacagacaacccacagag

SEQ ID NO: 13258 - DNA, 20 bp, Artificial Sequence
  chemically synthesized
aaacagacaacccacagagt

SEQ ID NO: 13259 - DNA, 20 bp, Artificial Sequence
  chemically synthesized
acagacaacccacagagtgg

SEQ ID NO: 13260 - DNA, 20 bp, Artificial Sequence
  chemically synthesized
acaatctatacatctgacaa

SEQ ID NO: 13261 - DNA, 20 bp, Artificial Sequence
  chemically synthesized
tctgacaaaagaataatatc

SEQ ID NO: 13262 - DNA, 20 bp, Artificial Sequence
  chemically synthesized
ctgacaaaagaataatatcc

SEQ ID NO: 13263 - DNA, 20 bp, Artificial Sequence
  chemically synthesized
ggctctaaaatgaacacaaa

SEQ ID NO: 13264 - DNA, 20 bp, Artificial Sequence
  chemically synthesized
atgaacacaaatagattatc

SEQ ID NO: 13265 - DNA, 20 bp, Artificial Sequence
  chemically synthesized
taacaaacaatcccaataaa

SEQ ID NO: 13266 - DNA, 20 bp, Artificial Sequence
  chemically synthesized
caaacaatcccaataaaaag

SEQ ID NO: 13267 - DNA, 20 bp, Artificial Sequence
  chemically synthesized
aaacaatcccaataaaaagt

SEQ ID NO: 13268 - DNA, 20 bp, Artificial Sequence
  chemically synthesized
atcccaataaaaagtaggct

SEQ ID NO: 13269 - DNA, 20 bp, Artificial Sequence
  chemically synthesized
tcccaataaaaagtaggcta

SEQ ID NO: 13270 - DNA, 20 bp, Artificial Sequence
  chemically synthesized
aagtaggctaaggacatgaa

SEQ ID NO: 13271 - DNA, 20 bp, Artificial Sequence
  chemically synthesized
ggacatgaacagacaattct

SEQ ID NO: 13272 - DNA, 20 bp, Artificial Sequence
  chemically synthesized
gaacagacaattctcagaaa

SEQ ID NO: 13273 - DNA, 20 bp, Artificial Sequence
  chemically synthesized
ttctcaacatcactaatgat

SEQ ID NO: 13274 - DNA, 20 bp, Artificial Sequence
  chemically synthesized
tctcaacatcactaatgatc

SEQ ID NO: 13275 - DNA, 20 bp, Artificial Sequence
  chemically synthesized
ctcaacatcactaatgatca

SEQ ID NO: 13276 - DNA, 20 bp, Artificial Sequence
  chemically synthesized
atgcaaatcaaaactacaat

SEQ ID NO: 13277 - DNA, 20 bp, Artificial Sequence
  chemically synthesized
aatgagatatctacttactc

SEQ ID NO: 13278 - DNA, 20 bp, Artificial Sequence
  chemically synthesized
tctacttactctagttaaaa

SEQ ID NO: 13279 - DNA, 20 bp, Artificial Sequence
  chemically synthesized
taaaacggctattaacaaaa

SEQ ID NO: 13280 - DNA, 20 bp, Artificial Sequence
  chemically synthesized
acaaaaaagacaaaaaataa

SEQ ID NO: 13281 - DNA, 20 bp, Artificial Sequence
  chemically synthesized
aaaaaataacagatccttgt

SEQ ID NO: 13282 - DNA, 20 bp, Artificial Sequence
  chemically synthesized
aaaaataacagatccttgtg

SEQ ID NO: 13283 - DNA, 20 bp, Artificial Sequence
  chemically synthesized
aacagatccttgtgaggata

SEQ ID NO: 13284 - DNA, 20 bp, Artificial Sequence
  chemically synthesized
cagatccttgtgaggatatg

SEQ ID NO: 13285 - DNA, 20 bp, Artificial Sequence
  chemically synthesized
ccttgtgaggatatggagaa

SEQ ID NO: 13286 - DNA, 20 bp, Artificial Sequence
  chemically synthesized
cttgtgaggatatggagaaa

SEQ ID NO: 13287 - DNA, 20 bp, Artificial Sequence
  chemically synthesized
ttgtgaggatatggagaaaa

SEQ ID NO: 13288 - DNA, 20 bp, Artificial Sequence
  chemically synthesized
aactctttcttacacactgt

SEQ ID NO: 13289 - DNA, 20 bp, Artificial Sequence
  chemically synthesized
tctttcttacacactgttgg

SEQ ID NO: 13290 - DNA, 20 bp, Artificial Sequence
  chemically synthesized
ctttcttacacactgttggt

SEQ ID NO: 13291 - DNA, 20 bp, Artificial Sequence
  chemically synthesized
ctgttggtgggaatgtaaaa

SEQ ID NO: 13292 - DNA, 20 bp, Artificial Sequence
  chemically synthesized
gtaaaatagtacaaccatta

SEQ ID NO: 13293 - DNA, 20 bp, Artificial Sequence
  chemically synthesized
agtacaaccattatggaaaa

SEQ ID NO: 13294 - DNA, 20 bp, Artificial Sequence
  chemically synthesized
ccattatggaaaacagtatg

SEQ ID NO: 13295 - DNA, 20 bp, Artificial Sequence
  chemically synthesized
aaaacagtatgaagatttct

SEQ ID NO: 13296 - DNA, 20 bp, Artificial Sequence
  chemically synthesized
atttctcagtaaactaaaaa

SEQ ID NO: 13297 - DNA, 20 bp, Artificial Sequence
  chemically synthesized
aacagaactatcatacaatc

SEQ ID NO: 13298 - DNA, 20 bp, Artificial Sequence
  chemically synthesized
atacaatccagcaatctcac

SEQ ID NO: 13299 - DNA, 20 bp, Artificial Sequence
  chemically synthesized
caatccagcaatctcactag

SEQ ID NO: 13300 - DNA, 20 bp, Artificial Sequence
  chemically synthesized
actagtggttatttatccaa

SEQ ID NO: 13301 - DNA, 20 bp, Artificial Sequence
  chemically synthesized
gtggttatttatccaaaaga

SEQ ID NO: 13302 - DNA, 20 bp, Artificial Sequence
  chemically synthesized
tggttatttatccaaaagaa

SEQ ID NO: 13303 - DNA, 20 bp, Artificial Sequence
  chemically synthesized
ttatccaaaagaaaggaaat

SEQ ID NO: 13304 - DNA, 20 bp, Artificial Sequence
  chemically synthesized
aaggaaatcagtatatccaa

SEQ ID NO: 13305 - DNA, 20 bp, Artificial Sequence
  chemically synthesized
cattacactcatgtttattg

SEQ ID NO: 13306 - DNA, 20 bp, Artificial Sequence
  chemically synthesized
tattgaagcactattcacaa

SEQ ID NO: 13307 - DNA, 20 bp, Artificial Sequence
  chemically synthesized
aagcactattcacaatagtt

SEQ ID NO: 13308 - DNA, 20 bp, Artificial Sequence
  chemically synthesized
agcactattcacaatagtta

SEQ ID NO: 13309 - DNA, 20 bp, Artificial Sequence
  chemically synthesized
tattcacaatagttaaggtt

SEQ ID NO: 13310 - DNA, 20 bp, Artificial Sequence
  chemically synthesized
attcacaatagttaaggttt

SEQ ID NO: 13311 - DNA, 20 bp, Artificial Sequence
  chemically synthesized
ttaaggtttgggatcaacct

SEQ ID NO: 13312 - DNA, 20 bp, Artificial Sequence
  chemically synthesized
tcaacctaagtgtctatcaa

SEQ ID NO: 13313 - DNA, 20 bp, Artificial Sequence
  chemically synthesized
agtgtctatcaacagatgaa

SEQ ID NO: 13314 - DNA, 20 bp, Artificial Sequence
  chemically synthesized
taaaaaattgtatttttgca

SEQ ID NO: 13315 - DNA, 20 bp, Artificial Sequence
  chemically synthesized
agtactattttgccatgaaa

SEQ ID NO: 13316 - DNA, 20 bp, Artificial Sequence
  chemically synthesized
gaatgaaatcttgtcatttg

SEQ ID NO: 13317 - DNA, 20 bp, Artificial Sequence
  chemically synthesized
tcttgtcatttgtagcaaca

SEQ ID NO: 13318 - DNA, 20 bp, Artificial Sequence
  chemically synthesized
gtcatttgtagcaacatgga

SEQ ID NO: 13319 - DNA, 20 bp, Artificial Sequence
  chemically synthesized
tgtagcaacatggatggaac

SEQ ID NO: 13320 - DNA, 20 bp, Artificial Sequence
  chemically synthesized
tagcaacatggatggaacca

SEQ ID NO: 13321 - DNA, 20 bp, Artificial Sequence
  chemically synthesized
agcaacatggatggaaccag

SEQ ID NO: 13322 - DNA, 20 bp, Artificial Sequence
  chemically synthesized
gaggtcattatgttaattga

SEQ ID NO: 13323 - DNA, 20 bp, Artificial Sequence
  chemically synthesized
tatgttaattgaaagccctg

SEQ ID NO: 13324 - DNA, 20 bp, Artificial Sequence
  chemically synthesized
gttaattgaaagccctgaag

SEQ ID NO: 13325 - DNA, 20 bp, Artificial Sequence
  chemically synthesized
gcagaacaaaaacaaactct

SEQ ID NO: 13326 - DNA, 20 bp, Artificial Sequence
  chemically synthesized
aacaaactcttggtatgcca

SEQ ID NO: 13327 - DNA, 20 bp, Artificial Sequence
  chemically synthesized
caaactcttggtatgccaaa

SEQ ID NO: 13328 - DNA, 20 bp, Artificial Sequence
  chemically synthesized
ctcttggtatgccaaagaga

SEQ ID NO: 13329 - DNA, 20 bp, Artificial Sequence
  chemically synthesized
aaagagatagataataaaat

SEQ ID NO: 13330 - DNA, 20 bp, Artificial Sequence
  chemically synthesized
agatagataataaaataagc

SEQ ID NO: 13331 - DNA, 20 bp, Artificial Sequence
  chemically synthesized
ataataaaataagccagata

SEQ ID NO: 13332 - DNA, 20 bp, Artificial Sequence
  chemically synthesized
taaaataagccagatacaga

SEQ ID NO: 13333 - DNA, 20 bp, Artificial Sequence
  chemically synthesized
cacatgtttttattcatctg

SEQ ID NO: 13334 - DNA, 20 bp, Artificial Sequence
  chemically synthesized
acatgtttttattcatctgt

SEQ ID NO: 13335 - DNA, 20 bp, Artificial Sequence
  chemically synthesized
atgtttttattcatctgtgg

SEQ ID NO: 13336 - DNA, 20 bp, Artificial Sequence
  chemically synthesized
ttcatctgtgggagctaaaa

SEQ ID NO: 13337 - DNA, 20 bp, Artificial Sequence
  chemically synthesized
atctgtgggagctaaaaaag

SEQ ID NO: 13338 - DNA, 20 bp, Artificial Sequence
  chemically synthesized
tctgtgggagctaaaaaagt

SEQ ID NO: 13339 - DNA, 20 bp, Artificial Sequence
  chemically synthesized
agctaaaaaagtgggtctca

SEQ ID NO: 13340 - DNA, 20 bp, Artificial Sequence
  chemically synthesized
taaaaaagtgggtctcatgg

SEQ ID NO: 13341 - DNA, 20 bp, Artificial Sequence
  chemically synthesized
aaaagtgggtctcatggtgg

SEQ ID NO: 13342 - DNA, 20 bp, Artificial Sequence
  chemically synthesized
aagtgggtctcatggtggta

SEQ ID NO: 13343 - DNA, 20 bp, Artificial Sequence
  chemically synthesized
gtgggtctcatggtggtaga

SEQ ID NO: 13344 - DNA, 20 bp, Artificial Sequence
  chemically synthesized
ggtctcatggtggtagagag

SEQ ID NO: 13345 - DNA, 20 bp, Artificial Sequence
  chemically synthesized
ggtggtagagagtagaatga

SEQ ID NO: 13346 - DNA, 20 bp, Artificial Sequence
  chemically synthesized
gagagtagaatgatagttat

SEQ ID NO: 13347 - DNA, 20 bp, Artificial Sequence
  chemically synthesized
gagtagaatgatagttatca

SEQ ID NO: 13348 - DNA, 20 bp, Artificial Sequence
  chemically synthesized
agtagaatgatagttatcag

SEQ ID NO: 13349 - DNA, 20 bp, Artificial Sequence
  chemically synthesized
gaatgatagttatcagaggc

SEQ ID NO: 13350 - DNA, 20 bp, Artificial Sequence
  chemically synthesized
tagttatcagaggctggaaa

SEQ ID NO: 13351 - DNA, 20 bp, Artificial Sequence
  chemically synthesized
tcagaggctggaaaaagtgt

SEQ ID NO: 13352 - DNA, 20 bp, Artificial Sequence
  chemically synthesized
ggaaaaagtgtgagtgtgta

SEQ ID NO: 13353 - DNA, 20 bp, Artificial Sequence
  chemically synthesized
gaaaaagtgtgagtgtgtat

SEQ ID NO: 13354 - DNA, 20 bp, Artificial Sequence
  chemically synthesized
aaaagtgtgagtgtgtatgg

SEQ ID NO: 13355 - DNA, 20 bp, Artificial Sequence
  chemically synthesized
aaagtgtgagtgtgtatggg

SEQ ID NO: 13356 - DNA, 20 bp, Artificial Sequence
  chemically synthesized
aagtgtgagtgtgtatggga

SEQ ID NO: 13357 - DNA, 20 bp, Artificial Sequence
  chemically synthesized
agtgtgagtgtgtatgggag

SEQ ID NO: 13358 - DNA, 20 bp, Artificial Sequence
  chemically synthesized
gtgtgtatgggaggggattt

SEQ ID NO: 13359 - DNA, 20 bp, Artificial Sequence
  chemically synthesized
gtgtatgggaggggatttaa

SEQ ID NO: 13360 - DNA, 20 bp, Artificial Sequence
  chemically synthesized
ggaggggatttaagagatgt

SEQ ID NO: 13361 - DNA, 20 bp, Artificial Sequence
  chemically synthesized
atttaagagatgttggttaa

SEQ ID NO: 13362 - DNA, 20 bp, Artificial Sequence
  chemically synthesized
tttaagagatgttggttaat

SEQ ID NO: 13363 - DNA, 20 bp, Artificial Sequence
  chemically synthesized
ttggttaataggtacaaaca

SEQ ID NO: 13364 - DNA, 20 bp, Artificial Sequence
  chemically synthesized
ttaataggtacaaacacagt

SEQ ID NO: 13365 - DNA, 20 bp, Artificial Sequence
  chemically synthesized
taggtacaaacacagttgga

SEQ ID NO: 13366 - DNA, 20 bp, Artificial Sequence
  chemically synthesized
gtacaaacacagttggatag

SEQ ID NO: 13367 - DNA, 20 bp, Artificial Sequence
  chemically synthesized
tacaaacacagttggataga

SEQ ID NO: 13368 - DNA, 20 bp, Artificial Sequence
  chemically synthesized
cacagttggatagaaggatt

SEQ ID NO: 13369 - DNA, 20 bp, Artificial Sequence
  chemically synthesized
agccataatgtttgatattt

SEQ ID NO: 13370 - DNA, 20 bp, Artificial Sequence
  chemically synthesized
cataatgtttgatatttgag

SEQ ID NO: 13371 - DNA, 20 bp, Artificial Sequence
  chemically synthesized
ataatgtttgatatttgagt

SEQ ID NO: 13372 - DNA, 20 bp, Artificial Sequence
  chemically synthesized
taatgtttgatatttgagta

SEQ ID NO: 13373 - DNA, 20 bp, Artificial Sequence
  chemically synthesized
atatttgagtagggtgacta

SEQ ID NO: 13374 - DNA, 20 bp, Artificial Sequence
  chemically synthesized
atttattatatatttcaaaa

SEQ ID NO: 13375 - DNA, 20 bp, Artificial Sequence
  chemically synthesized
attatatatttcaaaatggc

SEQ ID NO: 13376 - DNA, 20 bp, Artificial Sequence
  chemically synthesized
atttcaaaatggctagaaat

SEQ ID NO: 13377 - DNA, 20 bp, Artificial Sequence
  chemically synthesized
tttcaaaatggctagaaatg

SEQ ID NO: 13378 - DNA, 20 bp, Artificial Sequence
  chemically synthesized
tttgaaattttctcaataca

SEQ ID NO: 13379 - DNA, 20 bp, Artificial Sequence
  chemically synthesized
atagaaatgataaatgctca

SEQ ID NO: 13380 - DNA, 20 bp, Artificial Sequence
  chemically synthesized
atgataaatgctcaaagcaa

SEQ ID NO: 13381 - DNA, 20 bp, Artificial Sequence
  chemically synthesized
caatggatatcctaaatatc

SEQ ID NO: 13382 - DNA, 20 bp, Artificial Sequence
  chemically synthesized
gacttaatcatcacatgttc

SEQ ID NO: 13383 - DNA, 20 bp, Artificial Sequence
  chemically synthesized
acttaatcatcacatgttct

SEQ ID NO: 13384 - DNA, 20 bp, Artificial Sequence
  chemically synthesized
atcacatgttctaggcatgt

SEQ ID NO: 13385 - DNA, 20 bp, Artificial Sequence
  chemically synthesized
gctcccatttgttgactgac

SEQ ID NO: 13386 - DNA, 20 bp, Artificial Sequence
  chemically synthesized
ctcccatttgttgactgact

SEQ ID NO: 13387 - DNA, 20 bp, Artificial Sequence
  chemically synthesized
actgactaggtgaaaatatt

SEQ ID NO: 13388 - DNA, 20 bp, Artificial Sequence
  chemically synthesized
atccctgtttactctgttta

SEQ ID NO: 13389 - DNA, 20 bp, Artificial Sequence
  chemically synthesized
tccctgtttactctgtttat

SEQ ID NO: 13390 - DNA, 20 bp, Artificial Sequence
  chemically synthesized
tctgtttatgggcatattga

SEQ ID NO: 13391 - DNA, 20 bp, Artificial Sequence
  chemically synthesized
ctgtttatgggcatattgaa

SEQ ID NO: 13392 - DNA, 20 bp, Artificial Sequence
  chemically synthesized
tgggcatattgaaaggttat

SEQ ID NO: 13393 - DNA, 20 bp, Artificial Sequence
  chemically synthesized
gggcatattgaaaggttata

SEQ ID NO: 13394 - DNA, 20 bp, Artificial Sequence
  chemically synthesized
tattgaaaggttataaggct

SEQ ID NO: 13395 - DNA, 20 bp, Artificial Sequence
  chemically synthesized
ttgaaaggttataaggctca

SEQ ID NO: 13396 - DNA, 20 bp, Artificial Sequence
  chemically synthesized
gaaaggttataaggctcaga

SEQ ID NO: 13397 - DNA, 20 bp, Artificial Sequence
  chemically synthesized
gttataaggctcagagagac

SEQ ID NO: 13398 - DNA, 20 bp, Artificial Sequence
  chemically synthesized
agagagaccagtattgttga

SEQ ID NO: 13399 - DNA, 20 bp, Artificial Sequence
  chemically synthesized
tttgtctctctcccatattc

SEQ ID NO: 13400 - DNA, 20 bp, Artificial Sequence
  chemically synthesized
tcccatattctggatatata

SEQ ID NO: 13401 - DNA, 20 bp, Artificial Sequence
  chemically synthesized
atatatacagccaaattcaa

SEQ ID NO: 13402 - DNA, 20 bp, Artificial Sequence
  chemically synthesized
ccaaattcaaaagtaattca

SEQ ID NO: 13403 - DNA, 20 bp, Artificial Sequence
  chemically synthesized
caaattcaaaagtaattcac

SEQ ID NO: 13404 - DNA, 20 bp, Artificial Sequence
  chemically synthesized
caaaagtaattcacaggaaa

SEQ ID NO: 13405 - DNA, 20 bp, Artificial Sequence
  chemically synthesized
ggaaaaagtctgatcaatgt

SEQ ID NO: 13406 - DNA, 20 bp, Artificial Sequence
  chemically synthesized
aaaaagtctgatcaatgtga

SEQ ID NO: 13407 - DNA, 20 bp, Artificial Sequence
  chemically synthesized
gcactataaaattactaata

SEQ ID NO: 13408 - DNA, 20 bp, Artificial Sequence
  chemically synthesized
aagttatatttgccaaaata

SEQ ID NO: 13409 - DNA, 20 bp, Artificial Sequence
  chemically synthesized
caaaatatggcactctaact

SEQ ID NO: 13410 - DNA, 20 bp, Artificial Sequence
  chemically synthesized
actctaacttggaaaatgca

SEQ ID NO: 13411 - DNA, 20 bp, Artificial Sequence
  chemically synthesized
ctctaacttggaaaatgcaa

SEQ ID NO: 13412 - DNA, 20 bp, Artificial Sequence
  chemically synthesized
gcaaaggttccttgatatga

SEQ ID NO: 13413 - DNA, 20 bp, Artificial Sequence
  chemically synthesized
ttccttgatatgaaagacac

SEQ ID NO: 13414 - DNA, 20 bp, Artificial Sequence
  chemically synthesized
tatgaaagacacaagacctg

SEQ ID NO: 13415 - DNA, 20 bp, Artificial Sequence
  chemically synthesized
atgaaagacacaagacctga

SEQ ID NO: 13416 - DNA, 20 bp, Artificial Sequence
  chemically synthesized
tcaaaactccctgaccaatc

SEQ ID NO: 13417 - DNA, 20 bp, Artificial Sequence
  chemically synthesized
ccaatctagcacttcctaaa

SEQ ID NO: 13418 - DNA, 20 bp, Artificial Sequence
  chemically synthesized
tccctctacccttcacacat

SEQ ID NO: 13419 - DNA, 20 bp, Artificial Sequence
  chemically synthesized
cctctacccttcacacatga

SEQ ID NO: 13420 - DNA, 20 bp, Artificial Sequence
  chemically synthesized
ccttcacacatgagagtcac

SEQ ID NO: 13421 - DNA, 20 bp, Artificial Sequence
  chemically synthesized
cttcacacatgagagtcacc

SEQ ID NO: 13422 - DNA, 20 bp, Artificial Sequence
  chemically synthesized
acacatgagagtcaccaggt

SEQ ID NO: 13423 - DNA, 20 bp, Artificial Sequence
  chemically synthesized
agagtcaccaggtcagtgca

SEQ ID NO: 13424 - DNA, 20 bp, Artificial Sequence
  chemically synthesized
tttcctcctgttatcttcac

SEQ ID NO: 13425 - DNA, 20 bp, Artificial Sequence
  chemically synthesized
tcctgttatcttcaccagtc

SEQ ID NO: 13426 - DNA, 20 bp, Artificial Sequence
  chemically synthesized
cctgttatcttcaccagtct

SEQ ID NO: 13427 - DNA, 20 bp, Artificial Sequence
  chemically synthesized
tgttatcttcaccagtctgg

SEQ ID NO: 13428 - DNA, 20 bp, Artificial Sequence
  chemically synthesized
ttcaccagtctgggagcttt

SEQ ID NO: 13429 - DNA, 20 bp, Artificial Sequence
  chemically synthesized
ttcttccttctcatctccca

SEQ ID NO: 13430 - DNA, 20 bp, Artificial Sequence
  chemically synthesized
tccttctcatctcccacagt

SEQ ID NO: 13431 - DNA, 20 bp, Artificial Sequence
  chemically synthesized
tgtccatccttcaaattcca

SEQ ID NO: 13432 - DNA, 20 bp, Artificial Sequence
  chemically synthesized
cacagactcactgctcctct

SEQ ID NO: 13433 - DNA, 20 bp, Artificial Sequence
  chemically synthesized
acagactcactgctcctctt

SEQ ID NO: 13434 - DNA, 20 bp, Artificial Sequence
  chemically synthesized
tgaatccattttgtgcacat

SEQ ID NO: 13435 - DNA, 20 bp, Artificial Sequence
  chemically synthesized
atccattttgtgcacataag

SEQ ID NO: 13436 - DNA, 20 bp, Artificial Sequence
  chemically synthesized
ttcccaaaatcttatttcct

SEQ ID NO: 13437 - DNA, 20 bp, Artificial Sequence
  chemically synthesized
acatcctaatgcttatcgtt

SEQ ID NO: 13438 - DNA, 20 bp, Artificial Sequence
  chemically synthesized
cttatcgtttagtattgcaa

SEQ ID NO: 13439 - DNA, 20 bp, Artificial Sequence
  chemically synthesized
cgtttagtattgcaatagca

SEQ ID NO: 13440 - DNA, 20 bp, Artificial Sequence
  chemically synthesized
gtattgcaatagcatagtaa

SEQ ID NO: 13441 - DNA, 20 bp, Artificial Sequence
  chemically synthesized
agtaaaagcttgtatttttg

SEQ ID NO: 13442 - DNA, 20 bp, Artificial Sequence
  chemically synthesized
aaagcttgtatttttgtagc

SEQ ID NO: 13443 - DNA, 20 bp, Artificial Sequence
  chemically synthesized
aagcttgtatttttgtagcc

SEQ ID NO: 13444 - DNA, 20 bp, Artificial Sequence
  chemically synthesized
tagccaggccctgtactatc

SEQ ID NO: 13445 - DNA, 20 bp, Artificial Sequence
  chemically synthesized
ctgtactatctggtctttcc

SEQ ID NO: 13446 - DNA, 20 bp, Artificial Sequence
  chemically synthesized
cttactctcccttctacttc

SEQ ID NO: 13447 - DNA, 20 bp, Artificial Sequence
  chemically synthesized
tactctcccttctacttcca

SEQ ID NO: 13448 - DNA, 20 bp, Artificial Sequence
  chemically synthesized
ctctcccttctacttccaga

SEQ ID NO: 13449 - DNA, 20 bp, Artificial Sequence
  chemically synthesized
cccttctacttccagagagc

SEQ ID NO: 13450 - DNA, 20 bp, Artificial Sequence
  chemically synthesized
ccagagagccagtttcatgc

SEQ ID NO: 13451 - DNA, 20 bp, Artificial Sequence
  chemically synthesized
ccagtttcatgcaagtcacg

SEQ ID NO: 13452 - DNA, 20 bp, Artificial Sequence
  chemically synthesized
tcatgcaagtcacgaagccc

SEQ ID NO: 13453 - DNA, 20 bp, Artificial Sequence
  chemically synthesized
gtcacgaagccctagcttgc

SEQ ID NO: 13454 - DNA, 20 bp, Artificial Sequence
  chemically synthesized
aagccctagcttgctggttt

SEQ ID NO: 13455 - DNA, 20 bp, Artificial Sequence
  chemically synthesized
gcttgctggttttagaattt

SEQ ID NO: 13456 - DNA, 20 bp, Artificial Sequence
  chemically synthesized
tttagaatttaagcctttat

SEQ ID NO: 13457 - DNA, 20 bp, Artificial Sequence
  chemically synthesized
tattagtattctatctccca

SEQ ID NO: 13458 - DNA, 20 bp, Artificial Sequence
  chemically synthesized
agtattctatctcccacgga

SEQ ID NO: 13459 - DNA, 20 bp, Artificial Sequence
  chemically synthesized
tctccaaaaactttcccact

SEQ ID NO: 13460 - DNA, 20 bp, Artificial Sequence
  chemically synthesized
ctccaaaaactttcccactc

SEQ ID NO: 13461 - DNA, 20 bp, Artificial Sequence
  chemically synthesized
tcctaactctaactttattt

SEQ ID NO: 13462 - DNA, 20 bp, Artificial Sequence
  chemically synthesized
tagtgcatgttacattctat

SEQ ID NO: 13463 - DNA, 20 bp, Artificial Sequence
  chemically synthesized
tgcatgttacattctatcag

SEQ ID NO: 13464 - DNA, 20 bp, Artificial Sequence
  chemically synthesized
cacaatgatatcatgtgtct

SEQ ID NO: 13465 - DNA, 20 bp, Artificial Sequence
  chemically synthesized
gatatcatgtgtcttagctt

SEQ ID NO: 13466 - DNA, 20 bp, Artificial Sequence
  chemically synthesized
tcagctaacccatgaaataa

SEQ ID NO: 13467 - DNA, 20 bp, Artificial Sequence
  chemically synthesized
tgaaataatggaatccttca

SEQ ID NO: 13468 - DNA, 20 bp, Artificial Sequence
  chemically synthesized
ataatggaatccttcatgga

SEQ ID NO: 13469 - DNA, 20 bp, Artificial Sequence
  chemically synthesized
aatggaatccttcatggaaa

SEQ ID NO: 13470 - DNA, 20 bp, Artificial Sequence
  chemically synthesized
ggaatccttcatggaaagag

SEQ ID NO: 13471 - DNA, 20 bp, Artificial Sequence
  chemically synthesized
gaatccttcatggaaagagc

SEQ ID NO: 13472 - DNA, 20 bp, Artificial Sequence
  chemically synthesized
aatttcataaaacatgtgac

SEQ ID NO: 13473 - DNA, 20 bp, Artificial Sequence
  chemically synthesized
tcataaaacatgtgacaagc

SEQ ID NO: 13474 - DNA, 20 bp, Artificial Sequence
  chemically synthesized
agctacttcaaaatgtaaat

SEQ ID NO: 13475 - DNA, 20 bp, Artificial Sequence
  chemically synthesized
ctacttcaaaatgtaaataa

SEQ ID NO: 13476 - DNA, 20 bp, Artificial Sequence
  chemically synthesized
taaataagagtaaattaaaa

SEQ ID NO: 13477 - DNA, 20 bp, Artificial Sequence
  chemically synthesized
gtaaattaaaatagtaattc

SEQ ID NO: 13478 - DNA, 20 bp, Artificial Sequence
  chemically synthesized
agtaattctagcctatatct

SEQ ID NO: 13479 - DNA, 20 bp, Artificial Sequence
  chemically synthesized
ctatatcttggatatctatg

SEQ ID NO: 13480 - DNA, 20 bp, Artificial Sequence
  chemically synthesized
ttgtttttgtttttaatgaa

SEQ ID NO: 13481 - DNA, 20 bp, Artificial Sequence
  chemically synthesized
gtaccacaaatctgctttct

SEQ ID NO: 13482 - DNA, 20 bp, Artificial Sequence
  chemically synthesized
taccacaaatctgctttctc

SEQ ID NO: 13483 - DNA, 20 bp, Artificial Sequence
  chemically synthesized
gctttctcaggtaccactaa

SEQ ID NO: 13484 - DNA, 20 bp, Artificial Sequence
  chemically synthesized
ctaacagctccttctttccc

SEQ ID NO: 13485 - DNA, 20 bp, Artificial Sequence
  chemically synthesized
agctccttctttccccggtg

SEQ ID NO: 13486 - DNA, 20 bp, Artificial Sequence
  chemically synthesized
ccggtgcagtaaaaactgcc

SEQ ID NO: 13487 - DNA, 20 bp, Artificial Sequence
  chemically synthesized
cggtgcagtaaaaactgcct

SEQ ID NO: 13488 - DNA, 20 bp, Artificial Sequence
  chemically synthesized
gtgcagtaaaaactgcctag

SEQ ID NO: 13489 - DNA, 20 bp, Artificial Sequence
  chemically synthesized
accattttcccaccccgata

SEQ ID NO: 13490 - DNA, 20 bp, Artificial Sequence
  chemically synthesized
ctccatcatatcatcctcct

SEQ ID NO: 13491 - DNA, 20 bp, Artificial Sequence
  chemically synthesized
tatcatcctccttggaatcc

SEQ ID NO: 13492 - DNA, 20 bp, Artificial Sequence
  chemically synthesized
aacatccacattaattttac

SEQ ID NO: 13493 - DNA, 20 bp, Artificial Sequence
  chemically synthesized
caagcccccatacatttctt

SEQ ID NO: 13494 - DNA, 20 bp, Artificial Sequence
  chemically synthesized
aagcccccatacatttctta

SEQ ID NO: 13495 - DNA, 20 bp, Artificial Sequence
  chemically synthesized
cccccatacatttcttaagg

SEQ ID NO: 13496 - DNA, 20 bp, Artificial Sequence
  chemically synthesized
acatttcttaaggaagctct

SEQ ID NO: 13497 - DNA, 20 bp, Artificial Sequence
  chemically synthesized
ctatgtttctctccatccct

SEQ ID NO: 13498 - DNA, 20 bp, Artificial Sequence
  chemically synthesized
acactttttccttttaacac

SEQ ID NO: 13499 - DNA, 20 bp, Artificial Sequence
  chemically synthesized
actttttccttttaacacaa

SEQ ID NO: 13500 - DNA, 20 bp, Artificial Sequence
  chemically synthesized
tccttttaacacaagagtaa

SEQ ID NO: 13501 - DNA, 20 bp, Artificial Sequence
  chemically synthesized
tttaacacaagagtaaaaga

SEQ ID NO: 13502 - DNA, 20 bp, Artificial Sequence
  chemically synthesized
taacacaagagtaaaagatg

SEQ ID NO: 13503 - DNA, 20 bp, Artificial Sequence
  chemically synthesized
cacaagagtaaaagatggag

SEQ ID NO: 13504 - DNA, 20 bp, Artificial Sequence
  chemically synthesized
attgcaatttttgattactg

SEQ ID NO: 13505 - DNA, 20 bp, Artificial Sequence
  chemically synthesized
agaaaatgtactttattaaa

SEQ ID NO: 13506 - DNA, 20 bp, Artificial Sequence
  chemically synthesized
aaatgtactttattaaacag

SEQ ID NO: 13507 - DNA, 20 bp, Artificial Sequence
  chemically synthesized
aatgtactttattaaacaga

SEQ ID NO: 13508 - DNA, 20 bp, Artificial Sequence
  chemically synthesized
taaacagaaggctttctctc

SEQ ID NO: 13509 - DNA, 20 bp, Artificial Sequence
  chemically synthesized
aaacagaaggctttctctca

SEQ ID NO: 13510 - DNA, 20 bp, Artificial Sequence
  chemically synthesized
gaaggctttctctcaaggcc

SEQ ID NO: 13511 - DNA, 20 bp, Artificial Sequence
  chemically synthesized
ctttctctcaaggccaagcc

SEQ ID NO: 13512 - DNA, 20 bp, Artificial Sequence
  chemically synthesized
ccaagcccagtccccatgtg

SEQ ID NO: 13513 - DNA, 20 bp, Artificial Sequence
  chemically synthesized
agcccagtccccatgtgcag

SEQ ID NO: 13514 - DNA, 20 bp, Artificial Sequence
  chemically synthesized
gcccagtccccatgtgcaga

SEQ ID NO: 13515 - DNA, 20 bp, Artificial Sequence
  chemically synthesized
ccagtccccatgtgcagaag

SEQ ID NO: 13516 - DNA, 20 bp, Artificial Sequence
  chemically synthesized
cagtccccatgtgcagaagg

SEQ ID NO: 13517 - DNA, 20 bp, Artificial Sequence
  chemically synthesized
agtccccatgtgcagaagga

SEQ ID NO: 13518 - DNA, 20 bp, Artificial Sequence
  chemically synthesized
catgtgcagaaggagggtgt

SEQ ID NO: 13519 - DNA, 20 bp, Artificial Sequence
  chemically synthesized
atgtgcagaaggagggtgtc

SEQ ID NO: 13520 - DNA, 20 bp, Artificial Sequence
  chemically synthesized
tgtgcagaaggagggtgtca

SEQ ID NO: 13521 - DNA, 20 bp, Artificial Sequence
  chemically synthesized
gaaggagggtgtcagggtca

SEQ ID NO: 13522 - DNA, 20 bp, Artificial Sequence
  chemically synthesized
aaggagggtgtcagggtcac

SEQ ID NO: 13523 - DNA, 20 bp, Artificial Sequence
  chemically synthesized
tcacaggaacacctgcaaac

SEQ ID NO: 13524 - DNA, 20 bp, Artificial Sequence
  chemically synthesized
caggaacacctgcaaactgg

SEQ ID NO: 13525 - DNA, 20 bp, Artificial Sequence
  chemically synthesized
ggaacacctgcaaactggaa

SEQ ID NO: 13526 - DNA, 20 bp, Artificial Sequence
  chemically synthesized
ctgcaaactggaagagaact

SEQ ID NO: 13527 - DNA, 20 bp, Artificial Sequence
  chemically synthesized
caaactggaagagaactcag

SEQ ID NO: 13528 - DNA, 20 bp, Artificial Sequence
  chemically synthesized
agagaactcagtggtactta

SEQ ID NO: 13529 - DNA, 20 bp, Artificial Sequence
  chemically synthesized
gagaactcagtggtacttat

SEQ ID NO: 13530 - DNA, 20 bp, Artificial Sequence
  chemically synthesized
actcagtggtacttatgggc

SEQ ID NO: 13531 - DNA, 20 bp, Artificial Sequence
  chemically synthesized
ctcagtggtacttatgggcc

SEQ ID NO: 13532 - DNA, 20 bp, Artificial Sequence
  chemically synthesized
tcagtggtacttatgggcca

SEQ ID NO: 13533 - DNA, 20 bp, Artificial Sequence
  chemically synthesized
gtacttatgggccagggcaa

SEQ ID NO: 13534 - DNA, 20 bp, Artificial Sequence
  chemically synthesized
atgggccagggcaatggcga

SEQ ID NO: 13535 - DNA, 20 bp, Artificial Sequence
  chemically synthesized
ggccagggcaatggcgacag

SEQ ID NO: 13536 - DNA, 20 bp, Artificial Sequence
  chemically synthesized
gcaatggcgacagcagacac

SEQ ID NO: 13537 - DNA, 20 bp, Artificial Sequence
  chemically synthesized
cagcagacaccagcttctgc

SEQ ID NO: 13538 - DNA, 20 bp, Artificial Sequence
  chemically synthesized
agcagacaccagcttctgcc

SEQ ID NO: 13539 - DNA, 20 bp, Artificial Sequence
  chemically synthesized
agacaccagcttctgccagg

SEQ ID NO: 13540 - DNA, 20 bp, Artificial Sequence
  chemically synthesized
ctgccaggcagcctgcactt

SEQ ID NO: 13541 - DNA, 20 bp, Artificial Sequence
  chemically synthesized
tgccaggcagcctgcacttc

SEQ ID NO: 13542 - DNA, 20 bp, Artificial Sequence
  chemically synthesized
gccaggcagcctgcacttca

SEQ ID NO: 13543 - DNA, 20 bp, Artificial Sequence
  chemically synthesized
ccaggcagcctgcacttcag

SEQ ID NO: 13544 - DNA, 20 bp, Artificial Sequence
  chemically synthesized
caggggtgaactccttgcca

SEQ ID NO: 13545 - DNA, 20 bp, Artificial Sequence
  chemically synthesized
ggtgaactccttgccaaagt

SEQ ID NO: 13546 - DNA, 20 bp, Artificial Sequence
  chemically synthesized
gaactccttgccaaagtgag

SEQ ID NO: 13547 - DNA, 20 bp, Artificial Sequence
  chemically synthesized
tccttgccaaagtgagtagc

SEQ ID NO: 13548 - DNA, 20 bp, Artificial Sequence
  chemically synthesized
ataatcaccatcacgttacc

SEQ ID NO: 13549 - DNA, 20 bp, Artificial Sequence
  chemically synthesized
taatcaccatcacgttaccc

SEQ ID NO: 13550 - DNA, 20 bp, Artificial Sequence
  chemically synthesized
atcaccatcacgttacccag

SEQ ID NO: 13551 - DNA, 20 bp, Artificial Sequence
  chemically synthesized
tcacgttacccaggagctgt

SEQ ID NO: 13552 - DNA, 20 bp, Artificial Sequence
  chemically synthesized
cacgttacccaggagctgtt

SEQ ID NO: 13553 - DNA, 20 bp, Artificial Sequence
  chemically synthesized
acccaggagctgttaggcaa

SEQ ID NO: 13554 - DNA, 20 bp, Artificial Sequence
  chemically synthesized
gcaaaagacaaaataacaca

SEQ ID NO: 13555 - DNA, 20 bp, Artificial Sequence
  chemically synthesized
caaaagacaaaataacacac

SEQ ID NO: 13556 - DNA, 20 bp, Artificial Sequence
  chemically synthesized
aaataacacacaggcatgtt

SEQ ID NO: 13557 - DNA, 20 bp, Artificial Sequence
  chemically synthesized
taacacacaggcatgttgag

SEQ ID NO: 13558 - DNA, 20 bp, Artificial Sequence
  chemically synthesized
cacacaggcatgttgagtag

SEQ ID NO: 13559 - DNA, 20 bp, Artificial Sequence
  chemically synthesized
aacaaacaaacaaacaaaaa

SEQ ID NO: 13560 - DNA, 20 bp, Artificial Sequence
  chemically synthesized
cggctttatacctacattcc

SEQ ID NO: 13561 - DNA, 20 bp, Artificial Sequence
  chemically synthesized
ccctgacctcaaactgttcc

SEQ ID NO: 13562 - DNA, 20 bp, Artificial Sequence
  chemically synthesized
cctgacctcaaactgttcca

SEQ ID NO: 13563 - DNA, 20 bp, Artificial Sequence
  chemically synthesized
ttgtgcccacccaaaaaatt

SEQ ID NO: 13564 - DNA, 20 bp, Artificial Sequence
  chemically synthesized
cccacccaaaaaattcagat

SEQ ID NO: 13565 - DNA, 20 bp, Artificial Sequence
  chemically synthesized
ccaaaaaattcagatgagct

SEQ ID NO: 13566 - DNA, 20 bp, Artificial Sequence
  chemically synthesized
caaaaaattcagatgagctt

SEQ ID NO: 13567 - DNA, 20 bp, Artificial Sequence
  chemically synthesized
taggttcaattttattctat

SEQ ID NO: 13568 - DNA, 20 bp, Artificial Sequence
  chemically synthesized
cacccccttccccattttac

SEQ ID NO: 13569 - DNA, 20 bp, Artificial Sequence
  chemically synthesized
ccccattttaccagtattat

SEQ ID NO: 13570 - DNA, 20 bp, Artificial Sequence
  chemically synthesized
cccattttaccagtattatt

SEQ ID NO: 13571 - DNA, 20 bp, Artificial Sequence
  chemically synthesized
ctctctccctgtttttcttt

SEQ ID NO: 13572 - DNA, 20 bp, Artificial Sequence
  chemically synthesized
ttgtctaatttttgtaaatg

SEQ ID NO: 13573 - DNA, 20 bp, Artificial Sequence
  chemically synthesized
tttttgtaaatgtagaatgt

SEQ ID NO: 13574 - DNA, 20 bp, Artificial Sequence
  chemically synthesized
atgtagaatgtgagtgctgc

SEQ ID NO: 13575 - DNA, 20 bp, Artificial Sequence
  chemically synthesized
gtagaatgtgagtgctgcaa

SEQ ID NO: 13576 - DNA, 20 bp, Artificial Sequence
  chemically synthesized
gtgagtgctgcaagagttct

SEQ ID NO: 13577 - DNA, 20 bp, Artificial Sequence
  chemically synthesized
agtgctgcaagagttctcag

SEQ ID NO: 13578 - DNA, 20 bp, Artificial Sequence
  chemically synthesized
gtgctgcaagagttctcagc

SEQ ID NO: 13579 - DNA, 20 bp, Artificial Sequence
  chemically synthesized
gctgcaagagttctcagcgg

SEQ ID NO: 13580 - DNA, 20 bp, Artificial Sequence
  chemically synthesized
tttaaaatccccaacaaatt

SEQ ID NO: 13581 - DNA, 20 bp, Artificial Sequence
  chemically synthesized
tccccaacaaattcggaaac

SEQ ID NO: 13582 - DNA, 20 bp, Artificial Sequence
  chemically synthesized
ttcggaaacaagccttcact

SEQ ID NO: 13583 - DNA, 20 bp, Artificial Sequence
  chemically synthesized
tcacttggtcacaatactga

SEQ ID NO: 13584 - DNA, 20 bp, Artificial Sequence
  chemically synthesized
cacttggtcacaatactgat

SEQ ID NO: 13585 - DNA, 20 bp, Artificial Sequence
  chemically synthesized
atgggaaatttaacatattt

SEQ ID NO: 13586 - DNA, 20 bp, Artificial Sequence
  chemically synthesized
aatgtgtcttatttttcttt

SEQ ID NO: 13587 - DNA, 20 bp, Artificial Sequence
  chemically synthesized
tatcatgacccacataaaat

SEQ ID NO: 13588 - DNA, 20 bp, Artificial Sequence
  chemically synthesized
atcatgacccacataaaata

SEQ ID NO: 13589 - DNA, 20 bp, Artificial Sequence
  chemically synthesized
gcatttctatttccttgaaa

SEQ ID NO: 13590 - DNA, 20 bp, Artificial Sequence
  chemically synthesized
aatggactttcatctaccaa

SEQ ID NO: 13591 - DNA, 20 bp, Artificial Sequence
  chemically synthesized
aaatttcattcttctttcac

SEQ ID NO: 13592 - DNA, 20 bp, Artificial Sequence
  chemically synthesized
aattctataatacaattctc

SEQ ID NO: 13593 - DNA, 20 bp, Artificial Sequence
  chemically synthesized
attctataatacaattctct

SEQ ID NO: 13594 - DNA, 20 bp, Artificial Sequence
  chemically synthesized
ttctctgggataaacacatc

SEQ ID NO: 13595 - DNA, 20 bp, Artificial Sequence
  chemically synthesized
gggataaacacatcaagttc

SEQ ID NO: 13596 - DNA, 20 bp, Artificial Sequence
  chemically synthesized
taaacacatcaagttctggc

SEQ ID NO: 13597 - DNA, 20 bp, Artificial Sequence
  chemically synthesized
ttctggcaagatttcctgaa

SEQ ID NO: 13598 - DNA, 20 bp, Artificial Sequence
  chemically synthesized
gcaagatttcctgaaaagtt

SEQ ID NO: 13599 - DNA, 20 bp, Artificial Sequence
  chemically synthesized
cctgaaaagttaagccaatt

SEQ ID NO: 13600 - DNA, 20 bp, Artificial Sequence
  chemically synthesized
ctgaaaagttaagccaattc

SEQ ID NO: 13601 - DNA, 20 bp, Artificial Sequence
  chemically synthesized
gttaagccaattcaggctgt

SEQ ID NO: 13602 - DNA, 20 bp, Artificial Sequence
  chemically synthesized
aagccaattcaggctgttag

SEQ ID NO: 13603 - DNA, 20 bp, Artificial Sequence
  chemically synthesized
tagtagtcctttactgtcac

SEQ ID NO: 13604 - DNA, 20 bp, Artificial Sequence
  chemically synthesized
tcactagttctgaatcatgt

SEQ ID NO: 13605 - DNA, 20 bp, Artificial Sequence
  chemically synthesized
gttctgaatcatgtaagttt

SEQ ID NO: 13606 - DNA, 20 bp, Artificial Sequence
  chemically synthesized
taagttttggttatgctcac

SEQ ID NO: 13607 - DNA, 20 bp, Artificial Sequence
  chemically synthesized
gttttggttatgctcactag

SEQ ID NO: 13608 - DNA, 20 bp, Artificial Sequence
  chemically synthesized
aagtctgctgttctaacatc

SEQ ID NO: 13609 - DNA, 20 bp, Artificial Sequence
  chemically synthesized
aagctcgacccatgatttct

SEQ ID NO: 13610 - DNA, 20 bp, Artificial Sequence
  chemically synthesized
atgatttctgagatctttgt

SEQ ID NO: 13611 - DNA, 20 bp, Artificial Sequence
  chemically synthesized
tctttgttggtctttccaat

SEQ ID NO: 13612 - DNA, 20 bp, Artificial Sequence
  chemically synthesized
ggtctttccaataagattat

SEQ ID NO: 13613 - DNA, 20 bp, Artificial Sequence
  chemically synthesized
tcaattaatgtcaaaatata

SEQ ID NO: 13614 - DNA, 20 bp, Artificial Sequence
  chemically synthesized
aagccaaaaaatcacatcac

SEQ ID NO: 13615 - DNA, 20 bp, Artificial Sequence
  chemically synthesized
cagcacctgaactcaccttg

SEQ ID NO: 13616 - DNA, 20 bp, Artificial Sequence
  chemically synthesized
tgaactcaccttgaagttct

SEQ ID NO: 13617 - DNA, 20 bp, Artificial Sequence
  chemically synthesized
gaactcaccttgaagttctc

SEQ ID NO: 13618 - DNA, 20 bp, Artificial Sequence
  chemically synthesized
aagttctcaggatccacatg

SEQ ID NO: 13619 - DNA, 20 bp, Artificial Sequence
  chemically synthesized
gatccacatgcagcttgtca

SEQ ID NO: 13620 - DNA, 20 bp, Artificial Sequence
  chemically synthesized
acatgcagcttgtcacagtg

SEQ ID NO: 13621 - DNA, 20 bp, Artificial Sequence
  chemically synthesized
ttgtcacagtgcagctcact

SEQ ID NO: 13622 - DNA, 20 bp, Artificial Sequence
  chemically synthesized
acagtgcagctcactcagct

SEQ ID NO: 13623 - DNA, 20 bp, Artificial Sequence
  chemically synthesized
gcagctcactcagcttagca

SEQ ID NO: 13624 - DNA, 20 bp, Artificial Sequence
  chemically synthesized
cagctcactcagcttagcaa

SEQ ID NO: 13625 - DNA, 20 bp, Artificial Sequence
  chemically synthesized
ctcactcagcttagcaaagg

SEQ ID NO: 13626 - DNA, 20 bp, Artificial Sequence
  chemically synthesized
tcactcagcttagcaaaggc

SEQ ID NO: 13627 - DNA, 20 bp, Artificial Sequence
  chemically synthesized
agcttagcaaaggcgggctt

SEQ ID NO: 13628 - DNA, 20 bp, Artificial Sequence
  chemically synthesized
gcttagcaaaggcgggcttg

SEQ ID NO: 13629 - DNA, 20 bp, Artificial Sequence
  chemically synthesized
gaggttgtccatgtttttaa

SEQ ID NO: 13630 - DNA, 20 bp, Artificial Sequence
  chemically synthesized
tgtttttaatagcatctcca

SEQ ID NO: 13631 - DNA, 20 bp, Artificial Sequence
  chemically synthesized
gtttttaatagcatctccaa

SEQ ID NO: 13632 - DNA, 20 bp, Artificial Sequence
  chemically synthesized
tttaatagcatctccaaagg

SEQ ID NO: 13633 - DNA, 20 bp, Artificial Sequence
  chemically synthesized
atagcatctccaaaggaagt

SEQ ID NO: 13634 - DNA, 20 bp, Artificial Sequence
  chemically synthesized
aagtcagcaccttcttgcca

SEQ ID NO: 13635 - DNA, 20 bp, Artificial Sequence
  chemically synthesized
agtcagcaccttcttgccat

SEQ ID NO: 13636 - DNA, 20 bp, Artificial Sequence
  chemically synthesized
cttgccatgggccttgacct

SEQ ID NO: 13637 - DNA, 20 bp, Artificial Sequence
  chemically synthesized
ttgccatgggccttgacctt

SEQ ID NO: 13638 - DNA, 20 bp, Artificial Sequence
  chemically synthesized
tgccatgggccttgaccttg

SEQ ID NO: 13639 - DNA, 20 bp, Artificial Sequence
  chemically synthesized
gccttgaccttggggttgcc

SEQ ID NO: 13640 - DNA, 20 bp, Artificial Sequence
  chemically synthesized
ccttgaccttggggttgccc

SEQ ID NO: 13641 - DNA, 20 bp, Artificial Sequence
  chemically synthesized
gaccttggggttgcccagga

SEQ ID NO: 13642 - DNA, 20 bp, Artificial Sequence
  chemically synthesized
cttggggttgcccaggatgg

SEQ ID NO: 13643 - DNA, 20 bp, Artificial Sequence
  chemically synthesized
tggggttgcccaggatggca

SEQ ID NO: 13644 - DNA, 20 bp, Artificial Sequence
  chemically synthesized
ggggttgcccaggatggcag

SEQ ID NO: 13645 - DNA, 20 bp, Artificial Sequence
  chemically synthesized
gggttgcccaggatggcaga

SEQ ID NO: 13646 - DNA, 20 bp, Artificial Sequence
  chemically synthesized
gttgcccaggatggcagagg

SEQ ID NO: 13647 - DNA, 20 bp, Artificial Sequence
  chemically synthesized
aggatggcagagggagacga

SEQ ID NO: 13648 - DNA, 20 bp, Artificial Sequence
  chemically synthesized
ggatggcagagggagacgac

SEQ ID NO: 13649 - DNA, 20 bp, Artificial Sequence
  chemically synthesized
agggagacgacaggtttcca

SEQ ID NO: 13650 - DNA, 20 bp, Artificial Sequence
  chemically synthesized
caaagctgtcaaaaaatctc

SEQ ID NO: 13651 - DNA, 20 bp, Artificial Sequence
  chemically synthesized
aaagctgtcaaaaaatctct

SEQ ID NO: 13652 - DNA, 20 bp, Artificial Sequence
  chemically synthesized
tgtcaaaaaatctctgggtc

SEQ ID NO: 13653 - DNA, 20 bp, Artificial Sequence
  chemically synthesized
gtcaaaaaatctctgggtcc

SEQ ID NO: 13654 - DNA, 20 bp, Artificial Sequence
  chemically synthesized
tcaaaaaatctctgggtcca

SEQ ID NO: 13655 - DNA, 20 bp, Artificial Sequence
  chemically synthesized
caaaaaatctctgggtccag

SEQ ID NO: 13656 - DNA, 20 bp, Artificial Sequence
  chemically synthesized
tgggtccaggggtaaacaac

SEQ ID NO: 13657 - DNA, 20 bp, Artificial Sequence
  chemically synthesized
gggtccaggggtaaacaacg

SEQ ID NO: 13658 - DNA, 20 bp, Artificial Sequence
  chemically synthesized
gtccaggggtaaacaacgag

SEQ ID NO: 13659 - DNA, 20 bp, Artificial Sequence
  chemically synthesized
tctatgaaatgacaccatat

SEQ ID NO: 13660 - DNA, 20 bp, Artificial Sequence
  chemically synthesized
caccatatcagatacaaaat

SEQ ID NO: 13661 - DNA, 20 bp, Artificial Sequence
  chemically synthesized
ccatatcagatacaaaatta

SEQ ID NO: 13662 - DNA, 20 bp, Artificial Sequence
  chemically synthesized
ttagagatgcaaaaaatctt

SEQ ID NO: 13663 - DNA, 20 bp, Artificial Sequence
  chemically synthesized
tagagatgcaaaaaatcttg

SEQ ID NO: 13664 - DNA, 20 bp, Artificial Sequence
  chemically synthesized
gactttcccaatcaacttgc

SEQ ID NO: 13665 - DNA, 20 bp, Artificial Sequence
  chemically synthesized
actttcccaatcaacttgct

SEQ ID NO: 13666 - DNA, 20 bp, Artificial Sequence
  chemically synthesized
ctttcccaatcaacttgcta

SEQ ID NO: 13667 - DNA, 20 bp, Artificial Sequence
  chemically synthesized
acccttcattcccatgcatt

SEQ ID NO: 13668 - DNA, 20 bp, Artificial Sequence
  chemically synthesized
gaaccaatgcttacctgccc

SEQ ID NO: 13669 - DNA, 20 bp, Artificial Sequence
  chemically synthesized
aaccaatgcttacctgccca

SEQ ID NO: 13670 - DNA, 20 bp, Artificial Sequence
  chemically synthesized
cctgcccaaggcttcacctc

SEQ ID NO: 13671 - DNA, 20 bp, Artificial Sequence
  chemically synthesized
tccacattcatcttgctcca

SEQ ID NO: 13672 - DNA, 20 bp, Artificial Sequence
  chemically synthesized
ccacattcatcttgctccac

SEQ ID NO: 13673 - DNA, 20 bp, Artificial Sequence
  chemically synthesized
attcatcttgctccacaggc

SEQ ID NO: 13674 - DNA, 20 bp, Artificial Sequence
  chemically synthesized
cttgctccacaggctagtga

SEQ ID NO: 13675 - DNA, 20 bp, Artificial Sequence
  chemically synthesized
gctccacaggctagtgacgg

SEQ ID NO: 13676 - DNA, 20 bp, Artificial Sequence
  chemically synthesized
agtgacggcagccttctcct

SEQ ID NO: 13677 - DNA, 20 bp, Artificial Sequence
  chemically synthesized
gacggcagccttctcctcag

SEQ ID NO: 13678 - DNA, 20 bp, Artificial Sequence
  chemically synthesized
agtaaaatgcaccatgatgc

SEQ ID NO: 13679 - DNA, 20 bp, Artificial Sequence
  chemically synthesized
gtaaaatgcaccatgatgcc

SEQ ID NO: 13680 - DNA, 20 bp, Artificial Sequence
  chemically synthesized
tgcaccatgatgccaggcct

SEQ ID NO: 13681 - DNA, 20 bp, Artificial Sequence
  chemically synthesized
caccatgatgccaggcctga

SEQ ID NO: 13682 - DNA, 20 bp, Artificial Sequence
  chemically synthesized
tgccaggcctgagagcttgc

SEQ ID NO: 13683 - DNA, 20 bp, Artificial Sequence
  chemically synthesized
tgagagcttgctagtgattg

SEQ ID NO: 13684 - DNA, 20 bp, Artificial Sequence
  chemically synthesized
gctagtgattgcagctgtgt

SEQ ID NO: 13685 - DNA, 20 bp, Artificial Sequence
  chemically synthesized
agtgattgcagctgtgtcgg

SEQ ID NO: 13686 - DNA, 20 bp, Artificial Sequence
  chemically synthesized
gattgcagctgtgtcggaag

SEQ ID NO: 13687 - DNA, 20 bp, Artificial Sequence
  chemically synthesized
tgtgctgctgcctctctgtc

SEQ ID NO: 13688 - DNA, 20 bp, Artificial Sequence
  chemically synthesized
ccttttattctttactgccg

SEQ ID NO: 13689 - DNA, 20 bp, Artificial Sequence
  chemically synthesized
attctttactgccgaagttc

SEQ ID NO: 13690 - DNA, 20 bp, Artificial Sequence
  chemically synthesized
ttctggccccctgttctcca

SEQ ID NO: 13691 - DNA, 20 bp, Artificial Sequence
  chemically synthesized
ctgttctccatggtacttaa

SEQ ID NO: 13692 - DNA, 20 bp, Artificial Sequence
  chemically synthesized
ccatggtacttaaaagtcat

SEQ ID NO: 13693 - DNA, 20 bp, Artificial Sequence
  chemically synthesized
gtacttaaaagtcattggtc

SEQ ID NO: 13694 - DNA, 20 bp, Artificial Sequence
  chemically synthesized
tacttaaaagtcattggtca

SEQ ID NO: 13695 - DNA, 20 bp, Artificial Sequence
  chemically synthesized
caaggctgacctgtgtccct

SEQ ID NO: 13696 - DNA, 20 bp, Artificial Sequence
  chemically synthesized
aaggctgacctgtgtccctc

SEQ ID NO: 13697 - DNA, 20 bp, Artificial Sequence
  chemically synthesized
aggctgacctgtgtccctca

SEQ ID NO: 13698 - DNA, 20 bp, Artificial Sequence
  chemically synthesized
ggctgacctgtgtccctcag

SEQ ID NO: 13699 - DNA, 20 bp, Artificial Sequence
  chemically synthesized
tgacctgtgtccctcagggg

SEQ ID NO: 13700 - DNA, 20 bp, Artificial Sequence
  chemically synthesized
acctgtgtccctcaggggtg

SEQ ID NO: 13701 - DNA, 20 bp, Artificial Sequence
  chemically synthesized
gtgtccctcaggggtggagt

SEQ ID NO: 13702 - DNA, 20 bp, Artificial Sequence
  chemically synthesized
tgtccctcaggggtggagtc

SEQ ID NO: 13703 - DNA, 20 bp, Artificial Sequence
  chemically synthesized
ctcaggggtggagtcaggtc

SEQ ID NO: 13704 - DNA, 20 bp, Artificial Sequence
  chemically synthesized
caggggtggagtcaggtccg

SEQ ID NO: 13705 - DNA, 20 bp, Artificial Sequence
  chemically synthesized
ggggtggagtcaggtccgga

SEQ ID NO: 13706 - DNA, 20 bp, Artificial Sequence
  chemically synthesized
gggtggagtcaggtccggag

SEQ ID NO: 13707 - DNA, 20 bp, Artificial Sequence
  chemically synthesized
ggtggagtcaggtccggaga

SEQ ID NO: 13708 - DNA, 20 bp, Artificial Sequence
  chemically synthesized
gagtcaggtccggagagggt

SEQ ID NO: 13709 - DNA, 20 bp, Artificial Sequence
  chemically synthesized
tcaggtccggagagggtcag

SEQ ID NO: 13710 - DNA, 20 bp, Artificial Sequence
  chemically synthesized
ccggagagggtcagcagtga

SEQ ID NO: 13711 - DNA, 20 bp, Artificial Sequence
  chemically synthesized
agagggtcagcagtgatgga

SEQ ID NO: 13712 - DNA, 20 bp, Artificial Sequence
  chemically synthesized
agcagtgatggatggacact

SEQ ID NO: 13713 - DNA, 20 bp, Artificial Sequence
  chemically synthesized
aagtttgtgataatgtgtgc

SEQ ID NO: 13714 - DNA, 20 bp, Artificial Sequence
  chemically synthesized
gataatgtgtgctggatcct

SEQ ID NO: 13715 - DNA, 20 bp, Artificial Sequence
  chemically synthesized
ataatgtgtgctggatcctg

SEQ ID NO: 13716 - DNA, 20 bp, Artificial Sequence
  chemically synthesized
atcctgaggctcttttttgt

SEQ ID NO: 13717 - DNA, 20 bp, Artificial Sequence
  chemically synthesized
ctctcccattctccttttcc

SEQ ID NO: 13718 - DNA, 20 bp, Artificial Sequence
  chemically synthesized
cccattctccttttccaaga

SEQ ID NO: 13719 - DNA, 20 bp, Artificial Sequence
  chemically synthesized
ttccaagaaagcctcatata

SEQ ID NO: 13720 - DNA, 20 bp, Artificial Sequence
  chemically synthesized
tccaagaaagcctcatataa

SEQ ID NO: 13721 - DNA, 20 bp, Artificial Sequence
  chemically synthesized
caagaaagcctcatataaag

SEQ ID NO: 13722 - DNA, 20 bp, Artificial Sequence
  chemically synthesized
taaaggagcaaatctcaaaa

SEQ ID NO: 13723 - DNA, 20 bp, Artificial Sequence
  chemically synthesized
aaaggagcaaatctcaaaat

SEQ ID NO: 13724 - DNA, 20 bp, Artificial Sequence
  chemically synthesized
aaatctcaaaataggaaaaa

SEQ ID NO: 13725 - DNA, 20 bp, Artificial Sequence
  chemically synthesized
caaaataggaaaaaaagttt

SEQ ID NO: 13726 - DNA, 20 bp, Artificial Sequence
  chemically synthesized
aggaaaaaaagtttcagcca

SEQ ID NO: 13727 - DNA, 20 bp, Artificial Sequence
  chemically synthesized
cgcatttaacatttgcctta

SEQ ID NO: 13728 - DNA, 20 bp, Artificial Sequence
  chemically synthesized
gcatttaacatttgccttaa

SEQ ID NO: 13729 - DNA, 20 bp, Artificial Sequence
  chemically synthesized
tttaacatttgccttaaagg

SEQ ID NO: 13730 - DNA, 20 bp, Artificial Sequence
  chemically synthesized
atttgccttaaaggtggtga

SEQ ID NO: 13731 - DNA, 20 bp, Artificial Sequence
  chemically synthesized
ggtggtgacagtgacaaaaa

SEQ ID NO: 13732 - DNA, 20 bp, Artificial Sequence
  chemically synthesized
gtggtgacagtgacaaaaac

SEQ ID NO: 13733 - DNA, 20 bp, Artificial Sequence
  chemically synthesized
tggtgacagtgacaaaaaca

SEQ ID NO: 13734 - DNA, 20 bp, Artificial Sequence
  chemically synthesized
acagtgacaaaaacagggcc

SEQ ID NO: 13735 - DNA, 20 bp, Artificial Sequence
  chemically synthesized
cagtgacaaaaacagggcca

SEQ ID NO: 13736 - DNA, 20 bp, Artificial Sequence
  chemically synthesized
acaaaaacagggccaaggaa

SEQ ID NO: 13737 - DNA, 20 bp, Artificial Sequence
  chemically synthesized
gggccaaggaaaagaaaata

SEQ ID NO: 13738 - DNA, 20 bp, Artificial Sequence
  chemically synthesized
agaaaataaagctgttaaaa

SEQ ID NO: 13739 - DNA, 20 bp, Artificial Sequence
  chemically synthesized
tgttaaaacagaatctcacc

SEQ ID NO: 13740 - DNA, 20 bp, Artificial Sequence
  chemically synthesized
aacagaatctcacccagttc

SEQ ID NO: 13741 - DNA, 20 bp, Artificial Sequence
  chemically synthesized
cacccagttctagctctctt

SEQ ID NO: 13742 - DNA, 20 bp, Artificial Sequence
  chemically synthesized
acccagttctagctctctta

SEQ ID NO: 13743 - DNA, 20 bp, Artificial Sequence
  chemically synthesized
ccagttctagctctcttaag

SEQ ID NO: 13744 - DNA, 20 bp, Artificial Sequence
  chemically synthesized
taaacaaaacttctgtacct

SEQ ID NO: 13745 - DNA, 20 bp, Artificial Sequence
  chemically synthesized
cttctgtaccttagtttctc

SEQ ID NO: 13746 - DNA, 20 bp, Artificial Sequence
  chemically synthesized
ttctgtaccttagtttctct

SEQ ID NO: 13747 - DNA, 20 bp, Artificial Sequence
  chemically synthesized
tctgtaccttagtttctcta

SEQ ID NO: 13748 - DNA, 20 bp, Artificial Sequence
  chemically synthesized
tgtaccttagtttctctagg

SEQ ID NO: 13749 - DNA, 20 bp, Artificial Sequence
  chemically synthesized
agggagacaaaaaccgtaca

SEQ ID NO: 13750 - DNA, 20 bp, Artificial Sequence
  chemically synthesized
aaaccgtacatagttccttc

SEQ ID NO: 13751 - DNA, 20 bp, Artificial Sequence
  chemically synthesized
agttccttctagaaactgaa

SEQ ID NO: 13752 - DNA, 20 bp, Artificial Sequence
  chemically synthesized
cttctagaaactgaacagaa

SEQ ID NO: 13753 - DNA, 20 bp, Artificial Sequence
  chemically synthesized
tagaaactgaacagaatagc

SEQ ID NO: 13754 - DNA, 20 bp, Artificial Sequence
  chemically synthesized
aaactgaacagaatagcaag

SEQ ID NO: 13755 - DNA, 20 bp, Artificial Sequence
  chemically synthesized
acagaatagcaagtagtcca

SEQ ID NO: 13756 - DNA, 20 bp, Artificial Sequence
  chemically synthesized
gaatagcaagtagtccacag

SEQ ID NO: 13757 - DNA, 20 bp, Artificial Sequence
  chemically synthesized
aatagcaagtagtccacagt

SEQ ID NO: 13758 - DNA, 20 bp, Artificial Sequence
  chemically synthesized
agtagtccacagtgggacta

SEQ ID NO: 13759 - DNA, 20 bp, Artificial Sequence
  chemically synthesized
ggactaaagccttaatccca

SEQ ID NO: 13760 - DNA, 20 bp, Artificial Sequence
  chemically synthesized
aaagccttaatcccaaagta

SEQ ID NO: 13761 - DNA, 20 bp, Artificial Sequence
  chemically synthesized
aatcccaaagtacagtacct

SEQ ID NO: 13762 - DNA, 20 bp, Artificial Sequence
  chemically synthesized
atcccaaagtacagtacctt

SEQ ID NO: 13763 - DNA, 20 bp, Artificial Sequence
  chemically synthesized
tcccaaagtacagtaccttg

SEQ ID NO: 13764 - DNA, 20 bp, Artificial Sequence
  chemically synthesized
agtaccttggggtgattccc

SEQ ID NO: 13765 - DNA, 20 bp, Artificial Sequence
  chemically synthesized
taccttggggtgattcccta

SEQ ID NO: 13766 - DNA, 20 bp, Artificial Sequence
  chemically synthesized
ccttggggtgattccctaga

SEQ ID NO: 13767 - DNA, 20 bp, Artificial Sequence
  chemically synthesized
cttggggtgattccctagag

SEQ ID NO: 13768 - DNA, 20 bp, Artificial Sequence
  chemically synthesized
gggtgattccctagagagga

SEQ ID NO: 13769 - DNA, 20 bp, Artificial Sequence
  chemically synthesized
gattccctagagaggacaga

SEQ ID NO: 13770 - DNA, 20 bp, Artificial Sequence
  chemically synthesized
cctagagaggacagacagaa

SEQ ID NO: 13771 - DNA, 20 bp, Artificial Sequence
  chemically synthesized
cagacagaaaagattacatc

SEQ ID NO: 13772 - DNA, 20 bp, Artificial Sequence
  chemically synthesized
aagattacatccagtgcttc

SEQ ID NO: 13773 - DNA, 20 bp, Artificial Sequence
  chemically synthesized
gattacatccagtgcttcca

SEQ ID NO: 13774 - DNA, 20 bp, Artificial Sequence
  chemically synthesized
ttttcatttctctatgacca

SEQ ID NO: 13775 - DNA, 20 bp, Artificial Sequence
  chemically synthesized
tttcatttctctatgaccac

SEQ ID NO: 13776 - DNA, 20 bp, Artificial Sequence
  chemically synthesized
ttcatttctctatgaccaca

SEQ ID NO: 13777 - DNA, 20 bp, Artificial Sequence
  chemically synthesized
tcatttctctatgaccacag

SEQ ID NO: 13778 - DNA, 20 bp, Artificial Sequence
  chemically synthesized
tctatgaccacaggggacat

SEQ ID NO: 13779 - DNA, 20 bp, Artificial Sequence
  chemically synthesized
ggggacattggctactttgt

SEQ ID NO: 13780 - DNA, 20 bp, Artificial Sequence
  chemically synthesized
gctactttgtgagtattgcc

SEQ ID NO: 13781 - DNA, 20 bp, Artificial Sequence
  chemically synthesized
ctactttgtgagtattgcct

SEQ ID NO: 13782 - DNA, 20 bp, Artificial Sequence
  chemically synthesized
tactttgtgagtattgcctg

SEQ ID NO: 13783 - DNA, 20 bp, Artificial Sequence
  chemically synthesized
gtcctgcttatacttctcac

SEQ ID NO: 13784 - DNA, 20 bp, Artificial Sequence
  chemically synthesized
tcctgcttatacttctcact

SEQ ID NO: 13785 - DNA, 20 bp, Artificial Sequence
  chemically synthesized
tgcttatacttctcactggg

SEQ ID NO: 13786 - DNA, 20 bp, Artificial Sequence
  chemically synthesized
gcttatacttctcactggga

SEQ ID NO: 13787 - DNA, 20 bp, Artificial Sequence
  chemically synthesized
cttatacttctcactgggaa

SEQ ID NO: 13788 - DNA, 20 bp, Artificial Sequence
  chemically synthesized
tatacttctcactgggaagg

SEQ ID NO: 13789 - DNA, 20 bp, Artificial Sequence
  chemically synthesized
ttctcactgggaagggagct

SEQ ID NO: 13790 - DNA, 20 bp, Artificial Sequence
  chemically synthesized
tcactgggaagggagctgag

SEQ ID NO: 13791 - DNA, 20 bp, Artificial Sequence
  chemically synthesized
taaaatcctaaaattattta

SEQ ID NO: 13792 - DNA, 20 bp, Artificial Sequence
  chemically synthesized
atcctaaaattatttaaagc

SEQ ID NO: 13793 - DNA, 20 bp, Artificial Sequence
  chemically synthesized
agccagaatttgtcatcaaa

SEQ ID NO: 13794 - DNA, 20 bp, Artificial Sequence
  chemically synthesized
ccagaatttgtcatcaaaca

SEQ ID NO: 13795 - DNA, 20 bp, Artificial Sequence
  chemically synthesized
ttgtcatcaaacagagaaaa

SEQ ID NO: 13796 - DNA, 20 bp, Artificial Sequence
  chemically synthesized
aagtgaatcgatatattaat

SEQ ID NO: 13797 - DNA, 20 bp, Artificial Sequence
  chemically synthesized
agtgaatcgatatattaatc

SEQ ID NO: 13798 - DNA, 20 bp, Artificial Sequence
  chemically synthesized
aatcgatatattaatcaggc

SEQ ID NO: 13799 - DNA, 20 bp, Artificial Sequence
  chemically synthesized
atcgatatattaatcaggct

SEQ ID NO: 13800 - DNA, 20 bp, Artificial Sequence
  chemically synthesized
cgatatattaatcaggctag

SEQ ID NO: 13801 - DNA, 20 bp, Artificial Sequence
  chemically synthesized
atattaatcaggctaggagt

SEQ ID NO: 13802 - DNA, 20 bp, Artificial Sequence
  chemically synthesized
tattaatcaggctaggagtc

SEQ ID NO: 13803 - DNA, 20 bp, Artificial Sequence
  chemically synthesized
attaatcaggctaggagtca

SEQ ID NO: 13804 - DNA, 20 bp, Artificial Sequence
  chemically synthesized
gtcagggtatattattcctc

SEQ ID NO: 13805 - DNA, 20 bp, Artificial Sequence
  chemically synthesized
tccccattttgatgacttgc

SEQ ID NO: 13806 - DNA, 20 bp, Artificial Sequence
  chemically synthesized
tgacttgctagctctttact

SEQ ID NO: 13807 - DNA, 20 bp, Artificial Sequence
  chemically synthesized
cttgctagctctttacttgg

SEQ ID NO: 13808 - DNA, 20 bp, Artificial Sequence
  chemically synthesized
tgctagctctttacttggta

SEQ ID NO: 13809 - DNA, 20 bp, Artificial Sequence
  chemically synthesized
ttacttggtagagctgaaac

SEQ ID NO: 13810 - DNA, 20 bp, Artificial Sequence
  chemically synthesized
cttggtagagctgaaactgg

SEQ ID NO: 13811 - DNA, 20 bp, Artificial Sequence
  chemically synthesized
gtagagctgaaactggaagt

SEQ ID NO: 13812 - DNA, 20 bp, Artificial Sequence
  chemically synthesized
tagagctgaaactggaagtt

SEQ ID NO: 13813 - DNA, 20 bp, Artificial Sequence
  chemically synthesized
aaactggaagttgggattta

SEQ ID NO: 13814 - DNA, 20 bp, Artificial Sequence
  chemically synthesized
caattcgatccatgtgcctg

SEQ ID NO: 13815 - DNA, 20 bp, Artificial Sequence
  chemically synthesized
ttgtcattatcctcatattt

SEQ ID NO: 13816 - DNA, 20 bp, Artificial Sequence
  chemically synthesized
tatcctcatattttagaatc

SEQ ID NO: 13817 - DNA, 20 bp, Artificial Sequence
  chemically synthesized
atcctcatattttagaatca

SEQ ID NO: 13818 - DNA, 20 bp, Artificial Sequence
  chemically synthesized
agaatcaaggaataaattca

SEQ ID NO: 13819 - DNA, 20 bp, Artificial Sequence
  chemically synthesized
ttatttaactatcaatgtga

SEQ ID NO: 13820 - DNA, 20 bp, Artificial Sequence
  chemically synthesized
tttaactatcaatgtgacag

SEQ ID NO: 13821 - DNA, 20 bp, Artificial Sequence
  chemically synthesized
aatgtgacagaagtaatgat

SEQ ID NO: 13822 - DNA, 20 bp, Artificial Sequence
  chemically synthesized
atgtgacagaagtaatgatt

SEQ ID NO: 13823 - DNA, 20 bp, Artificial Sequence
  chemically synthesized
tgtgacagaagtaatgattg

SEQ ID NO: 13824 - DNA, 20 bp, Artificial Sequence
  chemically synthesized
gtgacagaagtaatgattgg

SEQ ID NO: 13825 - DNA, 20 bp, Artificial Sequence
  chemically synthesized
agtaatgattgggggaataa

SEQ ID NO: 13826 - DNA, 20 bp, Artificial Sequence
  chemically synthesized
aatgattgggggaataatag

SEQ ID NO: 13827 - DNA, 20 bp, Artificial Sequence
  chemically synthesized
gattgggggaataatagaag

SEQ ID NO: 13828 - DNA, 20 bp, Artificial Sequence
  chemically synthesized
ttgggggaataatagaagca

SEQ ID NO: 13829 - DNA, 20 bp, Artificial Sequence
  chemically synthesized
aagcagagttccacaaattc

SEQ ID NO: 13830 - DNA, 20 bp, Artificial Sequence
  chemically synthesized
cagcattgttaattctataa

SEQ ID NO: 13831 - DNA, 20 bp, Artificial Sequence
  chemically synthesized
tcaccataatctcattgccc

SEQ ID NO: 13832 - DNA, 20 bp, Artificial Sequence
  chemically synthesized
ataatctcattgccccagcc

SEQ ID NO: 13833 - DNA, 20 bp, Artificial Sequence
  chemically synthesized
cccagcccagttcctccttc

SEQ ID NO: 13834 - DNA, 20 bp, Artificial Sequence
  chemically synthesized
tttctttttttttttttttt

SEQ ID NO: 13835 - DNA, 20 bp, Artificial Sequence
  chemically synthesized
ttttttttttttttttgaga

SEQ ID NO: 13836 - DNA, 20 bp, Artificial Sequence
  chemically synthesized
ttttttttttttttgagacg

SEQ ID NO: 13837 - DNA, 20 bp, Artificial Sequence
  chemically synthesized
acggagtctcactctgttgc

SEQ ID NO: 13838 - DNA, 20 bp, Artificial Sequence
  chemically synthesized
gtctcactctgttgccagac

SEQ ID NO: 13839 - DNA, 20 bp, Artificial Sequence
  chemically synthesized
ctcactctgttgccagactg

SEQ ID NO: 13840 - DNA, 20 bp, Artificial Sequence
  chemically synthesized
gttgccagactggagtgcaa

SEQ ID NO: 13841 - DNA, 20 bp, Artificial Sequence
  chemically synthesized
ggagtgcaatggcactatct

SEQ ID NO: 13842 - DNA, 20 bp, Artificial Sequence
  chemically synthesized
tcactgcaaccttcgcctcc

SEQ ID NO: 13843 - DNA, 20 bp, Artificial Sequence
  chemically synthesized
cactgcaaccttcgcctcct

SEQ ID NO: 13844 - DNA, 20 bp, Artificial Sequence
  chemically synthesized
ttcaaacgattctcctgcct

SEQ ID NO: 13845 - DNA, 20 bp, Artificial Sequence
  chemically synthesized
ttctcctgcctcagcctccc

SEQ ID NO: 13846 - DNA, 20 bp, Artificial Sequence
  chemically synthesized
tcctgcctcagcctcccgag

SEQ ID NO: 13847 - DNA, 20 bp, Artificial Sequence
  chemically synthesized
gcctcagcctcccgagcagc

SEQ ID NO: 13848 - DNA, 20 bp, Artificial Sequence
  chemically synthesized
cctcagcctcccgagcagct

SEQ ID NO: 13849 - DNA, 20 bp, Artificial Sequence
  chemically synthesized
ctcccgagcagctgggacta

SEQ ID NO: 13850 - DNA, 20 bp, Artificial Sequence
  chemically synthesized
tcccgagcagctgggactac

SEQ ID NO: 13851 - DNA, 20 bp, Artificial Sequence
  chemically synthesized
caggcgcatgccaccatgcc

SEQ ID NO: 13852 - DNA, 20 bp, Artificial Sequence
  chemically synthesized
ccagctaatttttttatttt

SEQ ID NO: 13853 - DNA, 20 bp, Artificial Sequence
  chemically synthesized
gctaatttttttatttttag

SEQ ID NO: 13854 - DNA, 20 bp, Artificial Sequence
  chemically synthesized
taatttttttatttttagta

SEQ ID NO: 13855 - DNA, 20 bp, Artificial Sequence
  chemically synthesized
ttttttatttttagtagaga

SEQ ID NO: 13856 - DNA, 20 bp, Artificial Sequence
  chemically synthesized
tttttatttttagtagagac

SEQ ID NO: 13857 - DNA, 20 bp, Artificial Sequence
  chemically synthesized
cgggatttcaccatgtttgc

SEQ ID NO: 13858 - DNA, 20 bp, Artificial Sequence
  chemically synthesized
gggatttcaccatgtttgcc

SEQ ID NO: 13859 - DNA, 20 bp, Artificial Sequence
  chemically synthesized
tttcaccatgtttgccagga

SEQ ID NO: 13860 - DNA, 20 bp, Artificial Sequence
  chemically synthesized
tctaccatttctttctccta

SEQ ID NO: 13861 - DNA, 20 bp, Artificial Sequence
  chemically synthesized
tatggctccccttgccccac

SEQ ID NO: 13862 - DNA, 20 bp, Artificial Sequence
  chemically synthesized
tccccttgccccaccagatc

SEQ ID NO: 13863 - DNA, 20 bp, Artificial Sequence
  chemically synthesized
ccccttgccccaccagatct

SEQ ID NO: 13864 - DNA, 20 bp, Artificial Sequence
  chemically synthesized
cctacaatttcctgtatgtt

SEQ ID NO: 13865 - DNA, 20 bp, Artificial Sequence
  chemically synthesized
ctacaatttcctgtatgttc

SEQ ID NO: 13866 - DNA, 20 bp, Artificial Sequence
  chemically synthesized
tttcctgtatgttcaggccc

SEQ ID NO: 13867 - DNA, 20 bp, Artificial Sequence
  chemically synthesized
tcctgtatgttcaggcccta

SEQ ID NO: 13868 - DNA, 20 bp, Artificial Sequence
  chemically synthesized
cctgtatgttcaggccctag

SEQ ID NO: 13869 - DNA, 20 bp, Artificial Sequence
  chemically synthesized
ggttcttcgtctttttcact

SEQ ID NO: 13870 - DNA, 20 bp, Artificial Sequence
  chemically synthesized
tcttcgtctttttcacttag

SEQ ID NO: 13871 - DNA, 20 bp, Artificial Sequence
  chemically synthesized
gtctttttcacttagcagta

SEQ ID NO: 13872 - DNA, 20 bp, Artificial Sequence
  chemically synthesized
cagtatggctcctgtctccc

SEQ ID NO: 13873 - DNA, 20 bp, Artificial Sequence
  chemically synthesized
tggctcctgtctcccaagtc

SEQ ID NO: 13874 - DNA, 20 bp, Artificial Sequence
  chemically synthesized
tctcccaagtcaagtgcctt

SEQ ID NO: 13875 - DNA, 20 bp, Artificial Sequence
  chemically synthesized
ctcccaagtcaagtgccttt

SEQ ID NO: 13876 - DNA, 20 bp, Artificial Sequence
  chemically synthesized
tcccaagtcaagtgcctttg

SEQ ID NO: 13877 - DNA, 20 bp, Artificial Sequence
  chemically synthesized
ctttggggattccatattcc

SEQ ID NO: 13878 - DNA, 20 bp, Artificial Sequence
  chemically synthesized
ttccatattccaagtttact

SEQ ID NO: 13879 - DNA, 20 bp, Artificial Sequence
  chemically synthesized
ccatattccaagtttactaa

SEQ ID NO: 13880 - DNA, 20 bp, Artificial Sequence
  chemically synthesized
aaaaaaaaaaaaaacacttg

SEQ ID NO: 13881 - DNA, 20 bp, Artificial Sequence
  chemically synthesized
aaaaaaaaaacacttgtggc

SEQ ID NO: 13882 - DNA, 20 bp, Artificial Sequence
  chemically synthesized
aaaaaacacttgtggcaagt

SEQ ID NO: 13883 - DNA, 20 bp, Artificial Sequence
  chemically synthesized
ttgcttttctcccatgattc

SEQ ID NO: 13884 - DNA, 20 bp, Artificial Sequence
  chemically synthesized
cttttctcccatgattccag

SEQ ID NO: 13885 - DNA, 20 bp, Artificial Sequence
  chemically synthesized
tgcccaaattgttattattc

SEQ ID NO: 13886 - DNA, 20 bp, Artificial Sequence
  chemically synthesized
gcccaaattgttattattcc

SEQ ID NO: 13887 - DNA, 20 bp, Artificial Sequence
  chemically synthesized
atttctactccattttcttt

SEQ ID NO: 13888 - DNA, 20 bp, Artificial Sequence
  chemically synthesized
ttcttttagctattaaccaa

SEQ ID NO: 13889 - DNA, 20 bp, Artificial Sequence
  chemically synthesized
ttaaccaatggtatctttct

SEQ ID NO: 13890 - DNA, 20 bp, Artificial Sequence
  chemically synthesized
tgagcatatattctaaccat

SEQ ID NO: 13891 - DNA, 20 bp, Artificial Sequence
  chemically synthesized
attctaaccattggctaaca

SEQ ID NO: 13892 - DNA, 20 bp, Artificial Sequence
  chemically synthesized
ttggctaacacagacaaaac

SEQ ID NO: 13893 - DNA, 20 bp, Artificial Sequence
  chemically synthesized
tggctaacacagacaaaacc

SEQ ID NO: 13894 - DNA, 20 bp, Artificial Sequence
  chemically synthesized
cctaaactttttttgtgtca

SEQ ID NO: 13895 - DNA, 20 bp, Artificial Sequence
  chemically synthesized
ctaaactttttttgtgtcac

SEQ ID NO: 13896 - DNA, 20 bp, Artificial Sequence
  chemically synthesized
actttttttgtgtcacaggc

SEQ ID NO: 13897 - DNA, 20 bp, Artificial Sequence
  chemically synthesized
ttttgtgtcacaggccagtt

SEQ ID NO: 13898 - DNA, 20 bp, Artificial Sequence
  chemically synthesized
tgtgtcacaggccagtttgg

SEQ ID NO: 13899 - DNA, 20 bp, Artificial Sequence
  chemically synthesized
aggccagtttggcagactgt

SEQ ID NO: 13900 - DNA, 20 bp, Artificial Sequence
  chemically synthesized
attgcatcaaataatataca

SEQ ID NO: 13901 - DNA, 20 bp, Artificial Sequence
  chemically synthesized
ttgcatcaaataatatacat

SEQ ID NO: 13902 - DNA, 20 bp, Artificial Sequence
  chemically synthesized
gcatcaaataatatacatag

SEQ ID NO: 13903 - DNA, 20 bp, Artificial Sequence
  chemically synthesized
ataatatacataggagtgct

SEQ ID NO: 13904 - DNA, 20 bp, Artificial Sequence
  chemically synthesized
ttacactgaaatatcattat

SEQ ID NO: 13905 - DNA, 20 bp, Artificial Sequence
  chemically synthesized
gacatcaaacattacatttg

SEQ ID NO: 13906 - DNA, 20 bp, Artificial Sequence
  chemically synthesized
caaacattacatttgtggta

SEQ ID NO: 13907 - DNA, 20 bp, Artificial Sequence
  chemically synthesized
ttatatttgcttctttatga

SEQ ID NO: 13908 - DNA, 20 bp, Artificial Sequence
  chemically synthesized
ttgcttctttatgaaagcat

SEQ ID NO: 13909 - DNA, 20 bp, Artificial Sequence
  chemically synthesized
ctttatgaaagcattagatc

SEQ ID NO: 13910 - DNA, 20 bp, Artificial Sequence
  chemically synthesized
tttatgaaagcattagatct

SEQ ID NO: 13911 - DNA, 20 bp, Artificial Sequence
  chemically synthesized
gaaagcattagatctaggat

SEQ ID NO: 13912 - DNA, 20 bp, Artificial Sequence
  chemically synthesized
aaagcattagatctaggatt

SEQ ID NO: 13913 - DNA, 20 bp, Artificial Sequence
  chemically synthesized
tagatctaggattgggtcta

SEQ ID NO: 13914 - DNA, 20 bp, Artificial Sequence
  chemically synthesized
attgggtctacagctacctt

SEQ ID NO: 13915 - DNA, 20 bp, Artificial Sequence
  chemically synthesized
ctacagctaccttaagatcc

SEQ ID NO: 13916 - DNA, 20 bp, Artificial Sequence
  chemically synthesized
cagctaccttaagatccaag

SEQ ID NO: 13917 - DNA, 20 bp, Artificial Sequence
  chemically synthesized
ttaagatccaagtagtgatg

SEQ ID NO: 13918 - DNA, 20 bp, Artificial Sequence
  chemically synthesized
tgaattaaaaatatctgcaa

SEQ ID NO: 13919 - DNA, 20 bp, Artificial Sequence
  chemically synthesized
gaattaaaaatatctgcaat

SEQ ID NO: 13920 - DNA, 20 bp, Artificial Sequence
  chemically synthesized
taaaaatatctgcaatgggc

SEQ ID NO: 13921 - DNA, 20 bp, Artificial Sequence
  chemically synthesized
aaaaatatctgcaatgggcc

SEQ ID NO: 13922 - DNA, 20 bp, Artificial Sequence
  chemically synthesized
tatctgcaatgggccaggcg

SEQ ID NO: 13923 - DNA, 20 bp, Artificial Sequence
  chemically synthesized
ctgcaatgggccaggcgtgg

SEQ ID NO: 13924 - DNA, 20 bp, Artificial Sequence
  chemically synthesized
gtggctcacacctataatcc

SEQ ID NO: 13925 - DNA, 20 bp, Artificial Sequence
  chemically synthesized
cacctataatcccagcactt

SEQ ID NO: 13926 - DNA, 20 bp, Artificial Sequence
  chemically synthesized
acctataatcccagcacttc

SEQ ID NO: 13927 - DNA, 20 bp, Artificial Sequence
  chemically synthesized
ctataatcccagcacttcag

SEQ ID NO: 13928 - DNA, 20 bp, Artificial Sequence
  chemically synthesized
tataatcccagcacttcagg

SEQ ID NO: 13929 - DNA, 20 bp, Artificial Sequence
  chemically synthesized
tcccagcacttcaggaggcc

SEQ ID NO: 13930 - DNA, 20 bp, Artificial Sequence
  chemically synthesized
cccagcacttcaggaggcca

SEQ ID NO: 13931 - DNA, 20 bp, Artificial Sequence
  chemically synthesized
agcacttcaggaggccaagg

SEQ ID NO: 13932 - DNA, 20 bp, Artificial Sequence
  chemically synthesized
gcacttcaggaggccaaggc

SEQ ID NO: 13933 - DNA, 20 bp, Artificial Sequence
  chemically synthesized
cttcaggaggccaaggcggg

SEQ ID NO: 13934 - DNA, 20 bp, Artificial Sequence
  chemically synthesized
ccaaggcgggcagatcatct

SEQ ID NO: 13935 - DNA, 20 bp, Artificial Sequence
  chemically synthesized
caaggcgggcagatcatctg

SEQ ID NO: 13936 - DNA, 20 bp, Artificial Sequence
  chemically synthesized
gcgggcagatcatctgaggt

SEQ ID NO: 13937 - DNA, 20 bp, Artificial Sequence
  chemically synthesized
cgggcagatcatctgaggtc

SEQ ID NO: 13938 - DNA, 20 bp, Artificial Sequence
  chemically synthesized
ggcagatcatctgaggtcag

SEQ ID NO: 13939 - DNA, 20 bp, Artificial Sequence
  chemically synthesized
tcatctgaggtcaggagttc

SEQ ID NO: 13940 - DNA, 20 bp, Artificial Sequence
  chemically synthesized
tgaggtcaggagttcaagac

SEQ ID NO: 13941 - DNA, 20 bp, Artificial Sequence
  chemically synthesized
tcaggagttcaagaccagcc

SEQ ID NO: 13942 - DNA, 20 bp, Artificial Sequence
  chemically synthesized
caagaccagcctggccaaca

SEQ ID NO: 13943 - DNA, 20 bp, Artificial Sequence
  chemically synthesized
tctactaaaaatacaaaaat

SEQ ID NO: 13944 - DNA, 20 bp, Artificial Sequence
  chemically synthesized
taaaaatacaaaaattagac

SEQ ID NO: 13945 - DNA, 20 bp, Artificial Sequence
  chemically synthesized
atacaaaaattagactggca

SEQ ID NO: 13946 - DNA, 20 bp, Artificial Sequence
  chemically synthesized
caaaaattagactggcatgg

SEQ ID NO: 13947 - DNA, 20 bp, Artificial Sequence
  chemically synthesized
aaattagactggcatggtgg

SEQ ID NO: 13948 - DNA, 20 bp, Artificial Sequence
  chemically synthesized
aattagactggcatggtggc

SEQ ID NO: 13949 - DNA, 20 bp, Artificial Sequence
  chemically synthesized
tggcaggtgcctgtaatccc

SEQ ID NO: 13950 - DNA, 20 bp, Artificial Sequence
  chemically synthesized
gcctgtaatccccagctact

SEQ ID NO: 13951 - DNA, 20 bp, Artificial Sequence
  chemically synthesized
cctgtaatccccagctactc

SEQ ID NO: 13952 - DNA, 20 bp, Artificial Sequence
  chemically synthesized
tgtaatccccagctactcag

SEQ ID NO: 13953 - DNA, 20 bp, Artificial Sequence
  chemically synthesized
gtaatccccagctactcagg

SEQ ID NO: 13954 - DNA, 20 bp, Artificial Sequence
  chemically synthesized
ccccagctactcaggaggcc

SEQ ID NO: 13955 - DNA, 20 bp, Artificial Sequence
  chemically synthesized
cccagctactcaggaggcca

SEQ ID NO: 13956 - DNA, 20 bp, Artificial Sequence
  chemically synthesized
agctactcaggaggccaagg

SEQ ID NO: 13957 - DNA, 20 bp, Artificial Sequence
  chemically synthesized
gctactcaggaggccaaggc

SEQ ID NO: 13958 - DNA, 20 bp, Artificial Sequence
  chemically synthesized
tactcaggaggccaaggcag

SEQ ID NO: 13959 - DNA, 20 bp, Artificial Sequence
  chemically synthesized
gcaggagaattgcttgaatg

SEQ ID NO: 13960 - DNA, 20 bp, Artificial Sequence
  chemically synthesized
caggagaattgcttgaatgc

SEQ ID NO: 13961 - DNA, 20 bp, Artificial Sequence
  chemically synthesized
gagaattgcttgaatgcagg

SEQ ID NO: 13962 - DNA, 20 bp, Artificial Sequence
  chemically synthesized
agaattgcttgaatgcagga

SEQ ID NO: 13963 - DNA, 20 bp, Artificial Sequence
  chemically synthesized
gaattgcttgaatgcaggaa

SEQ ID NO: 13964 - DNA, 20 bp, Artificial Sequence
  chemically synthesized
aattgcttgaatgcaggaag

SEQ ID NO: 13965 - DNA, 20 bp, Artificial Sequence
  chemically synthesized
ttgcttgaatgcaggaaggg

SEQ ID NO: 13966 - DNA, 20 bp, Artificial Sequence
  chemically synthesized
tgcttgaatgcaggaagggg

SEQ ID NO: 13967 - DNA, 20 bp, Artificial Sequence
  chemically synthesized
aatgcaggaaggggaggttg

SEQ ID NO: 13968 - DNA, 20 bp, Artificial Sequence
  chemically synthesized
caggaaggggaggttgcagt

SEQ ID NO: 13969 - DNA, 20 bp, Artificial Sequence
  chemically synthesized
gaaatcatgccactgcactc

SEQ ID NO: 13970 - DNA, 20 bp, Artificial Sequence
  chemically synthesized
catgccactgcactccagcc

SEQ ID NO: 13971 - DNA, 20 bp, Artificial Sequence
  chemically synthesized
atgccactgcactccagcct

SEQ ID NO: 13972 - DNA, 20 bp, Artificial Sequence
  chemically synthesized
tgcactccagcctgggcaat

SEQ ID NO: 13973 - DNA, 20 bp, Artificial Sequence
  chemically synthesized
cactccagcctgggcaataa

SEQ ID NO: 13974 - DNA, 20 bp, Artificial Sequence
  chemically synthesized
caaacaaaaacaaaaacaaa

SEQ ID NO: 13975 - DNA, 20 bp, Artificial Sequence
  chemically synthesized
aaaaagatctgcaataccta

SEQ ID NO: 13976 - DNA, 20 bp, Artificial Sequence
  chemically synthesized
gatctgcaatacctatggtg

SEQ ID NO: 13977 - DNA, 20 bp, Artificial Sequence
  chemically synthesized
gtgtagtatgaaaatatctg

SEQ ID NO: 13978 - DNA, 20 bp, Artificial Sequence
  chemically synthesized
ttctctttataactatgcaa

SEQ ID NO: 13979 - DNA, 20 bp, Artificial Sequence
  chemically synthesized
tctctttataactatgcaat

SEQ ID NO: 13980 - DNA, 20 bp, Artificial Sequence
  chemically synthesized
aggtactgatgatgtcattc

SEQ ID NO: 13981 - DNA, 20 bp, Artificial Sequence
  chemically synthesized
tagtttgtcctttgcattca

SEQ ID NO: 13982 - DNA, 20 bp, Artificial Sequence
  chemically synthesized
tttgtcctttgcattcaaag

SEQ ID NO: 13983 - DNA, 20 bp, Artificial Sequence
  chemically synthesized
gtcctttgcattcaaagtag

SEQ ID NO: 13984 - DNA, 20 bp, Artificial Sequence
  chemically synthesized
tagaagaaaatgctaaattt

SEQ ID NO: 13985 - DNA, 20 bp, Artificial Sequence
  chemically synthesized
gctaaatttcagttacatgt

SEQ ID NO: 13986 - DNA, 20 bp, Artificial Sequence
  chemically synthesized
gttacatgtaagtaaaaata

SEQ ID NO: 13987 - DNA, 20 bp, Artificial Sequence
  chemically synthesized
tttttttctataaacttcac

SEQ ID NO: 13988 - DNA, 20 bp, Artificial Sequence
  chemically synthesized
tataaacttcaccagccccc

SEQ ID NO: 13989 - DNA, 20 bp, Artificial Sequence
  chemically synthesized
accagccccctagtgttctg

SEQ ID NO: 13990 - DNA, 20 bp, Artificial Sequence
  chemically synthesized
ccctagtgttctgtggaccc

SEQ ID NO: 13991 - DNA, 20 bp, Artificial Sequence
  chemically synthesized
tgttctgtggaccccagatt

SEQ ID NO: 13992 - DNA, 20 bp, Artificial Sequence
  chemically synthesized
gaccccagattaagacttcc

SEQ ID NO: 13993 - DNA, 20 bp, Artificial Sequence
  chemically synthesized
accccagattaagacttcct

SEQ ID NO: 13994 - DNA, 20 bp, Artificial Sequence
  chemically synthesized
acttcctgggacaaaatata

SEQ ID NO: 13995 - DNA, 20 bp, Artificial Sequence
  chemically synthesized
ctgggacaaaatatatagcc

SEQ ID NO: 13996 - DNA, 20 bp, Artificial Sequence
  chemically synthesized
tgggacaaaatatatagcct

SEQ ID NO: 13997 - DNA, 20 bp, Artificial Sequence
  chemically synthesized
gacaaaatatatagcctagg

SEQ ID NO: 13998 - DNA, 20 bp, Artificial Sequence
  chemically synthesized
aatatatagcctaggaagac

SEQ ID NO: 13999 - DNA, 20 bp, Artificial Sequence
  chemically synthesized
agcctaggaagacaagatcc

SEQ ID NO: 14000 - DNA, 20 bp, Artificial Sequence
  chemically synthesized
gcctaggaagacaagatcct

SEQ ID NO: 14001 - DNA, 20 bp, Artificial Sequence
  chemically synthesized
ggaagacaagatcctaggtt

SEQ ID NO: 14002 - DNA, 20 bp, Artificial Sequence
  chemically synthesized
gacaagatcctaggtttgga

SEQ ID NO: 14003 - DNA, 20 bp, Artificial Sequence
  chemically synthesized
tatttgatccactgaaataa

SEQ ID NO: 14004 - DNA, 20 bp, Artificial Sequence
  chemically synthesized
tgaaataaaagaacaatgac

SEQ ID NO: 14005 - DNA, 20 bp, Artificial Sequence
  chemically synthesized
aagaacaatgactagacaaa

SEQ ID NO: 14006 - DNA, 20 bp, Artificial Sequence
  chemically synthesized
aacaatgactagacaaaaag

SEQ ID NO: 14007 - DNA, 20 bp, Artificial Sequence
  chemically synthesized
tgactagacaaaaagcagct

SEQ ID NO: 14008 - DNA, 20 bp, Artificial Sequence
  chemically synthesized
aaaagcagctcagctgcttg

SEQ ID NO: 14009 - DNA, 20 bp, Artificial Sequence
  chemically synthesized
agctgcttgtagcttgaacc

SEQ ID NO: 14010 - DNA, 20 bp, Artificial Sequence
  chemically synthesized
cttgtagcttgaaccaagct

SEQ ID NO: 14011 - DNA, 20 bp, Artificial Sequence
  chemically synthesized
agcttgaaccaagctgagct

SEQ ID NO: 14012 - DNA, 20 bp, Artificial Sequence
  chemically synthesized
ccaagctgagcttggctact

SEQ ID NO: 14013 - DNA, 20 bp, Artificial Sequence
  chemically synthesized
aagctgagcttggctactca

SEQ ID NO: 14014 - DNA, 20 bp, Artificial Sequence
  chemically synthesized
ctgagcttggctactcagag

SEQ ID NO: 14015 - DNA, 20 bp, Artificial Sequence
  chemically synthesized
cttggctactcagagaagaa

SEQ ID NO: 14016 - DNA, 20 bp, Artificial Sequence
  chemically synthesized
ctcagagaagaacagtcgtt

SEQ ID NO: 14017 - DNA, 20 bp, Artificial Sequence
  chemically synthesized
ataattttttttaaccaatt

SEQ ID NO: 14018 - DNA, 20 bp, Artificial Sequence
  chemically synthesized
ttttttaaccaattaagata

SEQ ID NO: 14019 - DNA, 20 bp, Artificial Sequence
  chemically synthesized
aaccaattaagatacagctc

SEQ ID NO: 14020 - DNA, 20 bp, Artificial Sequence
  chemically synthesized
accaattaagatacagctct

SEQ ID NO: 14021 - DNA, 20 bp, Artificial Sequence
  chemically synthesized
aagatacagctctgggtttt

SEQ ID NO: 14022 - DNA, 20 bp, Artificial Sequence
  chemically synthesized
agatacagctctgggttttc

SEQ ID NO: 14023 - DNA, 20 bp, Artificial Sequence
  chemically synthesized
gatacagctctgggttttca

SEQ ID NO: 14024 - DNA, 20 bp, Artificial Sequence
  chemically synthesized
atacagctctgggttttcag

SEQ ID NO: 14025 - DNA, 20 bp, Artificial Sequence
  chemically synthesized
tacagctctgggttttcagg

SEQ ID NO: 14026 - DNA, 20 bp, Artificial Sequence
  chemically synthesized
ttttcagggggaatttgcta

SEQ ID NO: 14027 - DNA, 20 bp, Artificial Sequence
  chemically synthesized
gggaatttgctacagatcca

SEQ ID NO: 14028 - DNA, 20 bp, Artificial Sequence
  chemically synthesized
tgctacagatccacagtatg

SEQ ID NO: 14029 - DNA, 20 bp, Artificial Sequence
  chemically synthesized
gctacagatccacagtatga

SEQ ID NO: 14030 - DNA, 20 bp, Artificial Sequence
  chemically synthesized
acagatccacagtatgaagg

SEQ ID NO: 14031 - DNA, 20 bp, Artificial Sequence
  chemically synthesized
gatccacagtatgaaggcag

SEQ ID NO: 14032 - DNA, 20 bp, Artificial Sequence
  chemically synthesized
tgaaggcagtggcccttcct

SEQ ID NO: 14033 - DNA, 20 bp, Artificial Sequence
  chemically synthesized
cttcctcagaacttgaatgt

SEQ ID NO: 14034 - DNA, 20 bp, Artificial Sequence
  chemically synthesized
ttcctcagaacttgaatgtg

SEQ ID NO: 14035 - DNA, 20 bp, Artificial Sequence
  chemically synthesized
tcctcagaacttgaatgtga

SEQ ID NO: 14036 - DNA, 20 bp, Artificial Sequence
  chemically synthesized
cagaacttgaatgtgagggt

SEQ ID NO: 14037 - DNA, 20 bp, Artificial Sequence
  chemically synthesized
gtgagggtcagacattgcca

SEQ ID NO: 14038 - DNA, 20 bp, Artificial Sequence
  chemically synthesized
gtcagacattgccaaagtcc

SEQ ID NO: 14039 - DNA, 20 bp, Artificial Sequence
  chemically synthesized
tcagacattgccaaagtcca

SEQ ID NO: 14040 - DNA, 20 bp, Artificial Sequence
  chemically synthesized
attgccaaagtccaaggaat

SEQ ID NO: 14041 - DNA, 20 bp, Artificial Sequence
  chemically synthesized
ttgccaaagtccaaggaata

SEQ ID NO: 14042 - DNA, 20 bp, Artificial Sequence
  chemically synthesized
aaagtccaaggaataaggac

SEQ ID NO: 14043 - DNA, 20 bp, Artificial Sequence
  chemically synthesized
aagtccaaggaataaggacc

SEQ ID NO: 14044 - DNA, 20 bp, Artificial Sequence
  chemically synthesized
gaataaggaccaggtatctc

SEQ ID NO: 14045 - DNA, 20 bp, Artificial Sequence
  chemically synthesized
aataaggaccaggtatctca

SEQ ID NO: 14046 - DNA, 20 bp, Artificial Sequence
  chemically synthesized
ggaccaggtatctcaaggcc

SEQ ID NO: 14047 - DNA, 20 bp, Artificial Sequence
  chemically synthesized
accaggtatctcaaggccaa

SEQ ID NO: 14048 - DNA, 20 bp, Artificial Sequence
  chemically synthesized
gtatctcaaggccaagagtt

SEQ ID NO: 14049 - DNA, 20 bp, Artificial Sequence
  chemically synthesized
atctcaaggccaagagtttg

SEQ ID NO: 14050 - DNA, 20 bp, Artificial Sequence
  chemically synthesized
aaggccaagagtttggagaa

SEQ ID NO: 14051 - DNA, 20 bp, Artificial Sequence
  chemically synthesized
aggccaagagtttggagaac

SEQ ID NO: 14052 - DNA, 20 bp, Artificial Sequence
  chemically synthesized
aacaggtttctccctaaaac

SEQ ID NO: 14053 - DNA, 20 bp, Artificial Sequence
  chemically synthesized
tctccctaaaacaagcccta

SEQ ID NO: 14054 - DNA, 20 bp, Artificial Sequence
  chemically synthesized
ctccctaaaacaagccctat

SEQ ID NO: 14055 - DNA, 20 bp, Artificial Sequence
  chemically synthesized
atcccatcattcttcccatt

SEQ ID NO: 14056 - DNA, 20 bp, Artificial Sequence
  chemically synthesized
cccatcattcttcccattca

SEQ ID NO: 14057 - DNA, 20 bp, Artificial Sequence
  chemically synthesized
cattcttcccattcagagta

SEQ ID NO: 14058 - DNA, 20 bp, Artificial Sequence
  chemically synthesized
cccattcagagtatggacac

SEQ ID NO: 14059 - DNA, 20 bp, Artificial Sequence
  chemically synthesized
tatggacaccagtcttctct

SEQ ID NO: 14060 - DNA, 20 bp, Artificial Sequence
  chemically synthesized
caccagtcttctcttagatt

SEQ ID NO: 14061 - DNA, 20 bp, Artificial Sequence
  chemically synthesized
ccagtcttctcttagattca

SEQ ID NO: 14062 - DNA, 20 bp, Artificial Sequence
  chemically synthesized
cttctcttagattcagagta

SEQ ID NO: 14063 - DNA, 20 bp, Artificial Sequence
  chemically synthesized
ttctcttagattcagagtat

SEQ ID NO: 14064 - DNA, 20 bp, Artificial Sequence
  chemically synthesized
tctcttagattcagagtatg

SEQ ID NO: 14065 - DNA, 20 bp, Artificial Sequence
  chemically synthesized
ttgatcctctcctgctccct

SEQ ID NO: 14066 - DNA, 20 bp, Artificial Sequence
  chemically synthesized
gatcctctcctgctccctcg

SEQ ID NO: 14067 - DNA, 20 bp, Artificial Sequence
  chemically synthesized
ctctcctgctccctcggagc

SEQ ID NO: 14068 - DNA, 20 bp, Artificial Sequence
  chemically synthesized
tgctccctcggagccagttg

SEQ ID NO: 14069 - DNA, 20 bp, Artificial Sequence
  chemically synthesized
ctccctcggagccagttgca

SEQ ID NO: 14070 - DNA, 20 bp, Artificial Sequence
  chemically synthesized
tcttctctccttactgccta

SEQ ID NO: 14071 - DNA, 20 bp, Artificial Sequence
  chemically synthesized
ctccttactgcctatggttc

SEQ ID NO: 14072 - DNA, 20 bp, Artificial Sequence
  chemically synthesized
actgcctatggttccagacc

SEQ ID NO: 14073 - DNA, 20 bp, Artificial Sequence
  chemically synthesized
ttccagacctggcttgcatc

SEQ ID NO: 14074 - DNA, 20 bp, Artificial Sequence
  chemically synthesized
tccagacctggcttgcatcc

SEQ ID NO: 14075 - DNA, 20 bp, Artificial Sequence
  chemically synthesized
ccagacctggcttgcatcca

SEQ ID NO: 14076 - DNA, 20 bp, Artificial Sequence
  chemically synthesized
acccattccatgtttcctta

SEQ ID NO: 14077 - DNA, 20 bp, Artificial Sequence
  chemically synthesized
tccatgtttccttatggcta

SEQ ID NO: 14078 - DNA, 20 bp, Artificial Sequence
  chemically synthesized
ccatgtttccttatggctaa

SEQ ID NO: 14079 - DNA, 20 bp, Artificial Sequence
  chemically synthesized
tgtttccttatggctaaagg

SEQ ID NO: 14080 - DNA, 20 bp, Artificial Sequence
  chemically synthesized
ttccttatggctaaaggtgg

SEQ ID NO: 14081 - DNA, 20 bp, Artificial Sequence
  chemically synthesized
tccttatggctaaaggtggt

SEQ ID NO: 14082 - DNA, 20 bp, Artificial Sequence
  chemically synthesized
ccttatggctaaaggtggta

SEQ ID NO: 14083 - DNA, 20 bp, Artificial Sequence
  chemically synthesized
ttatggctaaaggtggtagg

SEQ ID NO: 14084 - DNA, 20 bp, Artificial Sequence
  chemically synthesized
tatggctaaaggtggtaggg

SEQ ID NO: 14085 - DNA, 20 bp, Artificial Sequence
  chemically synthesized
tggctaaaggtggtagggag

SEQ ID NO: 14086 - DNA, 20 bp, Artificial Sequence
  chemically synthesized
aggtggtagggaggagcttc

SEQ ID NO: 14087 - DNA, 20 bp, Artificial Sequence
  chemically synthesized
ggtagggaggagcttcaaga

SEQ ID NO: 14088 - DNA, 20 bp, Artificial Sequence
  chemically synthesized
gtagggaggagcttcaagaa

SEQ ID NO: 14089 - DNA, 20 bp, Artificial Sequence
  chemically synthesized
aggagcttcaagaaaggtta

SEQ ID NO: 14090 - DNA, 20 bp, Artificial Sequence
  chemically synthesized
aagaaaggttatagcattga

SEQ ID NO: 14091 - DNA, 20 bp, Artificial Sequence
  chemically synthesized
agaaaggttatagcattgaa

SEQ ID NO: 14092 - DNA, 20 bp, Artificial Sequence
  chemically synthesized
ggttatagcattgaaaggcc

SEQ ID NO: 14093 - DNA, 20 bp, Artificial Sequence
  chemically synthesized
gttatagcattgaaaggccc

SEQ ID NO: 14094 - DNA, 20 bp, Artificial Sequence
  chemically synthesized
aaaggcccaggtttgtgtct

SEQ ID NO: 14095 - DNA, 20 bp, Artificial Sequence
  chemically synthesized
caggtttgtgtctcagtaac

SEQ ID NO: 14096 - DNA, 20 bp, Artificial Sequence
  chemically synthesized
aggtttgtgtctcagtaaca

SEQ ID NO: 14097 - DNA, 20 bp, Artificial Sequence
  chemically synthesized
aaggcttataaatcctgact

SEQ ID NO: 14098 - DNA, 20 bp, Artificial Sequence
  chemically synthesized
gcttataaatcctgactcag

SEQ ID NO: 14099 - DNA, 20 bp, Artificial Sequence
  chemically synthesized
ataaatcctgactcagaagt

SEQ ID NO: 14100 - DNA, 20 bp, Artificial Sequence
  chemically synthesized
taaatcctgactcagaagtc

SEQ ID NO: 14101 - DNA, 20 bp, Artificial Sequence
  chemically synthesized
atcctgactcagaagtcagg

SEQ ID NO: 14102 - DNA, 20 bp, Artificial Sequence
  chemically synthesized
tcctgactcagaagtcaggt

SEQ ID NO: 14103 - DNA, 20 bp, Artificial Sequence
  chemically synthesized
ctcagaagtcaggtaggctg

SEQ ID NO: 14104 - DNA, 20 bp, Artificial Sequence
  chemically synthesized
tcagaagtcaggtaggctgc

SEQ ID NO: 14105 - DNA, 20 bp, Artificial Sequence
  chemically synthesized
gaagtcaggtaggctgcggg

SEQ ID NO: 14106 - DNA, 20 bp, Artificial Sequence
  chemically synthesized
attattgcttcgatgcttgt

SEQ ID NO: 14107 - DNA, 20 bp, Artificial Sequence
  chemically synthesized
gcttcgatgcttgttggttc

SEQ ID NO: 14108 - DNA, 20 bp, Artificial Sequence
  chemically synthesized
tgcttcacctgctcattttt

SEQ ID NO: 14109 - DNA, 20 bp, Artificial Sequence
  chemically synthesized
attttatttgtttatcatat

SEQ ID NO: 14110 - DNA, 20 bp, Artificial Sequence
  chemically synthesized
atatgagataccatgaaaaa

SEQ ID NO: 14111 - DNA, 20 bp, Artificial Sequence
  chemically synthesized
gcttttctttcctatattaa

SEQ ID NO: 14112 - DNA, 20 bp, Artificial Sequence
  chemically synthesized
tttcctatattaaaagccca

SEQ ID NO: 14113 - DNA, 20 bp, Artificial Sequence
  chemically synthesized
tatattaaaagcccaaagtt

SEQ ID NO: 14114 - DNA, 20 bp, Artificial Sequence
  chemically synthesized
tattaaaagcccaaagttca

SEQ ID NO: 14115 - DNA, 20 bp, Artificial Sequence
  chemically synthesized
ttaaaagcccaaagttcaga

SEQ ID NO: 14116 - DNA, 20 bp, Artificial Sequence
  chemically synthesized
agcccaaagttcagagagat

SEQ ID NO: 14117 - DNA, 20 bp, Artificial Sequence
  chemically synthesized
gttcagagagataagtgtta

SEQ ID NO: 14118 - DNA, 20 bp, Artificial Sequence
  chemically synthesized
agataagtgttatggccatc

SEQ ID NO: 14119 - DNA, 20 bp, Artificial Sequence
  chemically synthesized
gataagtgttatggccatcc

SEQ ID NO: 14120 - DNA, 20 bp, Artificial Sequence
  chemically synthesized
agtgttatggccatccagga

SEQ ID NO: 14121 - DNA, 20 bp, Artificial Sequence
  chemically synthesized
tatggccatccaggatagat

SEQ ID NO: 14122 - DNA, 20 bp, Artificial Sequence
  chemically synthesized
gccatccaggatagatcaga

SEQ ID NO: 14123 - DNA, 20 bp, Artificial Sequence
  chemically synthesized
ccaggatagatcagaaagat

SEQ ID NO: 14124 - DNA, 20 bp, Artificial Sequence
  chemically synthesized
gatagatcagaaagattaga

SEQ ID NO: 14125 - DNA, 20 bp, Artificial Sequence
  chemically synthesized
gatcagaaagattagacagt

SEQ ID NO: 14126 - DNA, 20 bp, Artificial Sequence
  chemically synthesized
aaagattagacagtcagaaa

SEQ ID NO: 14127 - DNA, 20 bp, Artificial Sequence
  chemically synthesized
agacagtcagaaaaagtaat

SEQ ID NO: 14128 - DNA, 20 bp, Artificial Sequence
  chemically synthesized
agtcagaaaaagtaatcagt

SEQ ID NO: 14129 - DNA, 20 bp, Artificial Sequence
  chemically synthesized
attgtctatataattaaaat

SEQ ID NO: 14130 - DNA, 20 bp, Artificial Sequence
  chemically synthesized
ataaaatctatgtatgtctt

SEQ ID NO: 14131 - DNA, 20 bp, Artificial Sequence
  chemically synthesized
atgtatgtcttaagacattt

SEQ ID NO: 14132 - DNA, 20 bp, Artificial Sequence
  chemically synthesized
tcttaagacatttaagtata

SEQ ID NO: 14133 - DNA, 20 bp, Artificial Sequence
  chemically synthesized
cttaagacatttaagtataa

SEQ ID NO: 14134 - DNA, 20 bp, Artificial Sequence
  chemically synthesized
atttaagtataaaggacttt

SEQ ID NO: 14135 - DNA, 20 bp, Artificial Sequence
  chemically synthesized
aagtataaaggacttttaga

SEQ ID NO: 14136 - DNA, 20 bp, Artificial Sequence
  chemically synthesized
agaaacacccaaattcgatg

SEQ ID NO: 14137 - DNA, 20 bp, Artificial Sequence
  chemically synthesized
aagattaattcctgcctgtt

SEQ ID NO: 14138 - DNA, 20 bp, Artificial Sequence
  chemically synthesized
agattaattcctgcctgttt

SEQ ID NO: 14139 - DNA, 20 bp, Artificial Sequence
  chemically synthesized
ctgcctgtttgggtttgctt

SEQ ID NO: 14140 - DNA, 20 bp, Artificial Sequence
  chemically synthesized
tttagcatttgtaatttctt

SEQ ID NO: 14141 - DNA, 20 bp, Artificial Sequence
  chemically synthesized
gtaatttcttaagttctatg

SEQ ID NO: 14142 - DNA, 20 bp, Artificial Sequence
  chemically synthesized
taatttcttaagttctatgc

SEQ ID NO: 14143 - DNA, 20 bp, Artificial Sequence
  chemically synthesized
tgcaggattctaaaaactgt

SEQ ID NO: 14144 - DNA, 20 bp, Artificial Sequence
  chemically synthesized
gtaagatgcctaatttaaac

SEQ ID NO: 14145 - DNA, 20 bp, Artificial Sequence
  chemically synthesized
taagatgcctaatttaaaca

SEQ ID NO: 14146 - DNA, 20 bp, Artificial Sequence
  chemically synthesized
aatattttcttaaatctttc

SEQ ID NO: 14147 - DNA, 20 bp, Artificial Sequence
  chemically synthesized
tatgacatatgtttaacctg

SEQ ID NO: 14148 - DNA, 20 bp, Artificial Sequence
  chemically synthesized
tgacatatgtttaacctgaa

SEQ ID NO: 14149 - DNA, 20 bp, Artificial Sequence
  chemically synthesized
gtcaaatattgtactgttct

SEQ ID NO: 14150 - DNA, 20 bp, Artificial Sequence
  chemically synthesized
gtactgttcttagatgctat

SEQ ID NO: 14151 - DNA, 20 bp, Artificial Sequence
  chemically synthesized
gtatgaaaaattatataaat

SEQ ID NO: 14152 - DNA, 20 bp, Artificial Sequence
  chemically synthesized
atataaattagattcttgtt

SEQ ID NO: 14153 - DNA, 20 bp, Artificial Sequence
  chemically synthesized
aattagattcttgttaagta

SEQ ID NO: 14154 - DNA, 20 bp, Artificial Sequence
  chemically synthesized
tagattcttgttaagtaaag

SEQ ID NO: 14155 - DNA, 20 bp, Artificial Sequence
  chemically synthesized
agattcttgttaagtaaagt

SEQ ID NO: 14156 - DNA, 20 bp, Artificial Sequence
  chemically synthesized
acttcactgaatgtttttca

SEQ ID NO: 14157 - DNA, 20 bp, Artificial Sequence
  chemically synthesized
tgtttttcatggtattatct

SEQ ID NO: 14158 - DNA, 20 bp, Artificial Sequence
  chemically synthesized
ctttatttttatttttaaaa

SEQ ID NO: 14159 - DNA, 20 bp, Artificial Sequence
  chemically synthesized
tttatttttatttttaaaat

SEQ ID NO: 14160 - DNA, 20 bp, Artificial Sequence
  chemically synthesized
aaaataggaaaaatataaac

SEQ ID NO: 14161 - DNA, 20 bp, Artificial Sequence
  chemically synthesized
aaataggaaaaatataaaca

SEQ ID NO: 14162 - DNA, 20 bp, Artificial Sequence
  chemically synthesized
caaggcttgtaaaccactga

SEQ ID NO: 14163 - DNA, 20 bp, Artificial Sequence
  chemically synthesized
aaggcttgtaaaccactgat

SEQ ID NO: 14164 - DNA, 20 bp, Artificial Sequence
  chemically synthesized
ttgtaaaccactgataggaa

SEQ ID NO: 14165 - DNA, 20 bp, Artificial Sequence
  chemically synthesized
gtaaaccactgataggaaaa

SEQ ID NO: 14166 - DNA, 20 bp, Artificial Sequence
  chemically synthesized
ctgataggaaaagagctgct

SEQ ID NO: 14167 - DNA, 20 bp, Artificial Sequence
  chemically synthesized
tgataggaaaagagctgctt

SEQ ID NO: 14168 - DNA, 20 bp, Artificial Sequence
  chemically synthesized
agctgcttaggattctaaat

SEQ ID NO: 14169 - DNA, 20 bp, Artificial Sequence
  chemically synthesized
gcttaggattctaaattagc

SEQ ID NO: 14170 - DNA, 20 bp, Artificial Sequence
  chemically synthesized
tgtatctaaatctatattct

SEQ ID NO: 14171 - DNA, 20 bp, Artificial Sequence
  chemically synthesized
ctatattctcagaacaaaaa

SEQ ID NO: 14172 - DNA, 20 bp, Artificial Sequence
  chemically synthesized
ctcagaacaaaaatagatgt

SEQ ID NO: 14173 - DNA, 20 bp, Artificial Sequence
  chemically synthesized
atgtaagcaaatgattctac

SEQ ID NO: 14174 - DNA, 20 bp, Artificial Sequence
  chemically synthesized
gattctactagattttgtgt

SEQ ID NO: 14175 - DNA, 20 bp, Artificial Sequence
  chemically synthesized
gtgttagattttgcattatc

SEQ ID NO: 14176 - DNA, 20 bp, Artificial Sequence
  chemically synthesized
tgttagattttgcattatcc

SEQ ID NO: 14177 - DNA, 20 bp, Artificial Sequence
  chemically synthesized
tgcattatccaggaatgact

SEQ ID NO: 14178 - DNA, 20 bp, Artificial Sequence
  chemically synthesized
aggaatgacttggatatcac

SEQ ID NO: 14179 - DNA, 20 bp, Artificial Sequence
  chemically synthesized
atcacaagtcataaattctg

SEQ ID NO: 14180 - DNA, 20 bp, Artificial Sequence
  chemically synthesized
taaattctgtggctgccttg

SEQ ID NO: 14181 - DNA, 20 bp, Artificial Sequence
  chemically synthesized
aaattctgtggctgccttgc

SEQ ID NO: 14182 - DNA, 20 bp, Artificial Sequence
  chemically synthesized
ttctgtggctgccttgcagg

SEQ ID NO: 14183 - DNA, 20 bp, Artificial Sequence
  chemically synthesized
gctgccttgcaggaagcctg

SEQ ID NO: 14184 - DNA, 20 bp, Artificial Sequence
  chemically synthesized
ggaagcctgtggctattttc

SEQ ID NO: 14185 - DNA, 20 bp, Artificial Sequence
  chemically synthesized
tattttctagtgtaattgta

SEQ ID NO: 14186 - DNA, 20 bp, Artificial Sequence
  chemically synthesized
ctagtgtaattgtaaagaat

SEQ ID NO: 14187 - DNA, 20 bp, Artificial Sequence
  chemically synthesized
agtgtaattgtaaagaatga

SEQ ID NO: 14188 - DNA, 20 bp, Artificial Sequence
  chemically synthesized
aattgtaaagaatgagagaa

SEQ ID NO: 14189 - DNA, 20 bp, Artificial Sequence
  chemically synthesized
atgagagaatagaccataac

SEQ ID NO: 14190 - DNA, 20 bp, Artificial Sequence
  chemically synthesized
ttgttttcaacttttatttt

SEQ ID NO: 14191 - DNA, 20 bp, Artificial Sequence
  chemically synthesized
ttcaacttttattttaagtt

SEQ ID NO: 14192 - DNA, 20 bp, Artificial Sequence
  chemically synthesized
tcaacttttattttaagttc

SEQ ID NO: 14193 - DNA, 20 bp, Artificial Sequence
  chemically synthesized
caacttttattttaagttca

SEQ ID NO: 14194 - DNA, 20 bp, Artificial Sequence
  chemically synthesized
aacttttattttaagttcag

SEQ ID NO: 14195 - DNA, 20 bp, Artificial Sequence
  chemically synthesized
taagttcaggggtacatgta

SEQ ID NO: 14196 - DNA, 20 bp, Artificial Sequence
  chemically synthesized
aagttcaggggtacatgtac

SEQ ID NO: 14197 - DNA, 20 bp, Artificial Sequence
  chemically synthesized
gggtacatgtacaggatgtg

SEQ ID NO: 14198 - DNA, 20 bp, Artificial Sequence
  chemically synthesized
ggtacatgtacaggatgtgc

SEQ ID NO: 14199 - DNA, 20 bp, Artificial Sequence
  chemically synthesized
ggatgtgcaggtttgttaca

SEQ ID NO: 14200 - DNA, 20 bp, Artificial Sequence
  chemically synthesized
tacatagataaatgaatgtc

SEQ ID NO: 14201 - DNA, 20 bp, Artificial Sequence
  chemically synthesized
acatagataaatgaatgtca

SEQ ID NO: 14202 - DNA, 20 bp, Artificial Sequence
  chemically synthesized
catagataaatgaatgtcaa

SEQ ID NO: 14203 - DNA, 20 bp, Artificial Sequence
  chemically synthesized
atagataaatgaatgtcaag

SEQ ID NO: 14204 - DNA, 20 bp, Artificial Sequence
  chemically synthesized
tagataaatgaatgtcaagg

SEQ ID NO: 14205 - DNA, 20 bp, Artificial Sequence
  chemically synthesized
tgtcaagggggtttgttgta

SEQ ID NO: 14206 - DNA, 20 bp, Artificial Sequence
  chemically synthesized
gtatagatgatctcatcact

SEQ ID NO: 14207 - DNA, 20 bp, Artificial Sequence
  chemically synthesized
tatagatgatctcatcactc

SEQ ID NO: 14208 - DNA, 20 bp, Artificial Sequence
  chemically synthesized
catcactcaggtattacgct

SEQ ID NO: 14209 - DNA, 20 bp, Artificial Sequence
  chemically synthesized
gtattacgcttagcatccat

SEQ ID NO: 14210 - DNA, 20 bp, Artificial Sequence
  chemically synthesized
tctcaccctccaccctctga

SEQ ID NO: 14211 - DNA, 20 bp, Artificial Sequence
  chemically synthesized
ctcaccctccaccctctgat

SEQ ID NO: 14212 - DNA, 20 bp, Artificial Sequence
  chemically synthesized
ctccaccctctgataggccc

SEQ ID NO: 14213 - DNA, 20 bp, Artificial Sequence
  chemically synthesized
tatgcgttgtttccctctat

SEQ ID NO: 14214 - DNA, 20 bp, Artificial Sequence
  chemically synthesized
gtccatgtgttctcatcatt

SEQ ID NO: 14215 - DNA, 20 bp, Artificial Sequence
  chemically synthesized
gcttctaactgttgctttcg

SEQ ID NO: 14216 - DNA, 20 bp, Artificial Sequence
  chemically synthesized
cctctgcctcatctctcacg

SEQ ID NO: 14217 - DNA, 20 bp, Artificial Sequence
  chemically synthesized
ctcatctctcacgaagtttg

SEQ ID NO: 14218 - DNA, 20 bp, Artificial Sequence
  chemically synthesized
tcatctctcacgaagtttgc

SEQ ID NO: 14219 - DNA, 20 bp, Artificial Sequence
  chemically synthesized
ctctcacgaagtttgcaggt

SEQ ID NO: 14220 - DNA, 20 bp, Artificial Sequence
  chemically synthesized
cgaagtttgcaggtgagttt

SEQ ID NO: 14221 - DNA, 20 bp, Artificial Sequence
  chemically synthesized
gtttgcaggtgagtttgagc

SEQ ID NO: 14222 - DNA, 20 bp, Artificial Sequence
  chemically synthesized
tttgcaggtgagtttgagcc

SEQ ID NO: 14223 - DNA, 20 bp, Artificial Sequence
  chemically synthesized
ttgcaggtgagtttgagcca

SEQ ID NO: 14224 - DNA, 20 bp, Artificial Sequence
  chemically synthesized
ggtgagtttgagccagggct

SEQ ID NO: 14225 - DNA, 20 bp, Artificial Sequence
  chemically synthesized
gtgagtttgagccagggctg

SEQ ID NO: 14226 - DNA, 20 bp, Artificial Sequence
  chemically synthesized
cagggctgaggctcattctc

SEQ ID NO: 14227 - DNA, 20 bp, Artificial Sequence
  chemically synthesized
gggctgaggctcattctcaa

SEQ ID NO: 14228 - DNA, 20 bp, Artificial Sequence
  chemically synthesized
tcaagagtaatctctctctc

SEQ ID NO: 14229 - DNA, 20 bp, Artificial Sequence
  chemically synthesized
aatctctctctctggcaact

SEQ ID NO: 14230 - DNA, 20 bp, Artificial Sequence
  chemically synthesized
tctctctctctggcaacttg

SEQ ID NO: 14231 - DNA, 20 bp, Artificial Sequence
  chemically synthesized
ctctctggcaacttggagca

SEQ ID NO: 14232 - DNA, 20 bp, Artificial Sequence
  chemically synthesized
tcctattgtgtgactgacct

SEQ ID NO: 14233 - DNA, 20 bp, Artificial Sequence
  chemically synthesized
cctattgtgtgactgacctc

SEQ ID NO: 14234 - DNA, 20 bp, Artificial Sequence
  chemically synthesized
tattgtgtgactgacctcgg

SEQ ID NO: 14235 - DNA, 20 bp, Artificial Sequence
  chemically synthesized
ctcgggagccactgtgccta

SEQ ID NO: 14236 - DNA, 20 bp, Artificial Sequence
  chemically synthesized
cactgtgcctaaagtacaac

SEQ ID NO: 14237 - DNA, 20 bp, Artificial Sequence
  chemically synthesized
ctgtgcctaaagtacaacca

SEQ ID NO: 14238 - DNA, 20 bp, Artificial Sequence
  chemically synthesized
gttacttgtgaatgttaatt

SEQ ID NO: 14239 - DNA, 20 bp, Artificial Sequence
  chemically synthesized
acttgtgaatgttaattaag

SEQ ID NO: 14240 - DNA, 20 bp, Artificial Sequence
  chemically synthesized
cttgtgaatgttaattaagc

SEQ ID NO: 14241 - DNA, 20 bp, Artificial Sequence
  chemically synthesized
tgtgaatgttaattaagcag

SEQ ID NO: 14242 - DNA, 20 bp, Artificial Sequence
  chemically synthesized
gtgaatgttaattaagcagg

SEQ ID NO: 14243 - DNA, 20 bp, Artificial Sequence
  chemically synthesized
tgaatgttaattaagcagga

SEQ ID NO: 14244 - DNA, 20 bp, Artificial Sequence
  chemically synthesized
taagcaggagggatctttaa

SEQ ID NO: 14245 - DNA, 20 bp, Artificial Sequence
  chemically synthesized
aagcaggagggatctttaat

SEQ ID NO: 14246 - DNA, 20 bp, Artificial Sequence
  chemically synthesized
gagggatctttaatgggaaa

SEQ ID NO: 14247 - DNA, 20 bp, Artificial Sequence
  chemically synthesized
agggatctttaatgggaaaa

SEQ ID NO: 14248 - DNA, 20 bp, Artificial Sequence
  chemically synthesized
ggatctttaatgggaaaaag

SEQ ID NO: 14249 - DNA, 20 bp, Artificial Sequence
  chemically synthesized
tctttaatgggaaaaaggag

SEQ ID NO: 14250 - DNA, 20 bp, Artificial Sequence
  chemically synthesized
taatgggaaaaaggagtaga

SEQ ID NO: 14251 - DNA, 20 bp, Artificial Sequence
  chemically synthesized
gggaaaaaggagtagaaagc

SEQ ID NO: 14252 - DNA, 20 bp, Artificial Sequence
  chemically synthesized
aaggagtagaaagccagaat

SEQ ID NO: 14253 - DNA, 20 bp, Artificial Sequence
  chemically synthesized
agtagaaagccagaatcagc

SEQ ID NO: 14254 - DNA, 20 bp, Artificial Sequence
  chemically synthesized
tgccacactttcctacatga

SEQ ID NO: 14255 - DNA, 20 bp, Artificial Sequence
  chemically synthesized
gccacactttcctacatgat

SEQ ID NO: 14256 - DNA, 20 bp, Artificial Sequence
  chemically synthesized
ttcctacatgatgggcactg

SEQ ID NO: 14257 - DNA, 20 bp, Artificial Sequence
  chemically synthesized
tcctacatgatgggcactga

SEQ ID NO: 14258 - DNA, 20 bp, Artificial Sequence
  chemically synthesized
ggcactgaaggttaaaactt

SEQ ID NO: 14259 - DNA, 20 bp, Artificial Sequence
  chemically synthesized
aaaacttgagtctgtcaact

SEQ ID NO: 14260 - DNA, 20 bp, Artificial Sequence
  chemically synthesized
tcccattttccgctgaaata

SEQ ID NO: 14261 - DNA, 20 bp, Artificial Sequence
  chemically synthesized
gaaatatagctttactttcc

SEQ ID NO: 14262 - DNA, 20 bp, Artificial Sequence
  chemically synthesized
tcctggtttctttgaccttt

SEQ ID NO: 14263 - DNA, 20 bp, Artificial Sequence
  chemically synthesized
cctggtttctttgacctttt

SEQ ID NO: 14264 - DNA, 20 bp, Artificial Sequence
  chemically synthesized
ctttgaccttttgggacctt

SEQ ID NO: 14265 - DNA, 20 bp, Artificial Sequence
  chemically synthesized
gaccttttgggaccttgagt

SEQ ID NO: 14266 - DNA, 20 bp, Artificial Sequence
  chemically synthesized
tttgggaccttgagtaagta

SEQ ID NO: 14267 - DNA, 20 bp, Artificial Sequence
  chemically synthesized
attttcatgattaaaattct

SEQ ID NO: 14268 - DNA, 20 bp, Artificial Sequence
  chemically synthesized
ttaaaattctaagaaattct

SEQ ID NO: 14269 - DNA, 20 bp, Artificial Sequence
  chemically synthesized
taaaattctaagaaattctt

SEQ ID NO: 14270 - DNA, 20 bp, Artificial Sequence
  chemically synthesized
gcctaatgtatttatgaact

SEQ ID NO: 14271 - DNA, 20 bp, Artificial Sequence
  chemically synthesized
gtatttatgaactaagaaca

SEQ ID NO: 14272 - DNA, 20 bp, Artificial Sequence
  chemically synthesized
agaaataaaacaatactctg

SEQ ID NO: 14273 - DNA, 20 bp, Artificial Sequence
  chemically synthesized
aataaaacaatactctgaag

SEQ ID NO: 14274 - DNA, 20 bp, Artificial Sequence
  chemically synthesized
aacaatactctgaagtagtt

SEQ ID NO: 14275 - DNA, 20 bp, Artificial Sequence
  chemically synthesized
atgtgctttcaatttatata

SEQ ID NO: 14276 - DNA, 20 bp, Artificial Sequence
  chemically synthesized
gtgctttcaatttatataaa

SEQ ID NO: 14277 - DNA, 20 bp, Artificial Sequence
  chemically synthesized
tataaagagttaattcaaat

SEQ ID NO: 14278 - DNA, 20 bp, Artificial Sequence
  chemically synthesized
aattcaaatgagactatttt

SEQ ID NO: 14279 - DNA, 20 bp, Artificial Sequence
  chemically synthesized
aaatgagactattttaagtg

SEQ ID NO: 14280 - DNA, 20 bp, Artificial Sequence
  chemically synthesized
aatgagactattttaagtgc

SEQ ID NO: 14281 - DNA, 20 bp, Artificial Sequence
  chemically synthesized
atgagactattttaagtgca

SEQ ID NO: 14282 - DNA, 20 bp, Artificial Sequence
  chemically synthesized
agggctttgaatcttatgtc

SEQ ID NO: 14283 - DNA, 20 bp, Artificial Sequence
  chemically synthesized
aaaacctctgattatatgct

SEQ ID NO: 14284 - DNA, 20 bp, Artificial Sequence
  chemically synthesized
atatgctaagattccacctc

SEQ ID NO: 14285 - DNA, 20 bp, Artificial Sequence
  chemically synthesized
taagattccacctctagtgc

SEQ ID NO: 14286 - DNA, 20 bp, Artificial Sequence
  chemically synthesized
ccacctctagtgctagaact

SEQ ID NO: 14287 - DNA, 20 bp, Artificial Sequence
  chemically synthesized
cctctagtgctagaactgag

SEQ ID NO: 14288 - DNA, 20 bp, Artificial Sequence
  chemically synthesized
gaactgagaagtccttgact

SEQ ID NO: 14289 - DNA, 20 bp, Artificial Sequence
  chemically synthesized
ttttttaaattctgaaacaa

SEQ ID NO: 14290 - DNA, 20 bp, Artificial Sequence
  chemically synthesized
tctgaaacaacagcaacata

SEQ ID NO: 14291 - DNA, 20 bp, Artificial Sequence
  chemically synthesized
aacaacagcaacataaagct

SEQ ID NO: 14292 - DNA, 20 bp, Artificial Sequence
  chemically synthesized
acaacagcaacataaagcta

SEQ ID NO: 14293 - DNA, 20 bp, Artificial Sequence
  chemically synthesized
ttgcctatgcatgctatctt

SEQ ID NO: 14294 - DNA, 20 bp, Artificial Sequence
  chemically synthesized
tcttcagtactttgattatt

SEQ ID NO: 14295 - DNA, 20 bp, Artificial Sequence
  chemically synthesized
ttagtattgaaactataaca

SEQ ID NO: 14296 - DNA, 20 bp, Artificial Sequence
  chemically synthesized
ataaaaaatgtgtatttctc

SEQ ID NO: 14297 - DNA, 20 bp, Artificial Sequence
  chemically synthesized
aaaaaatgtgtatttctctg

SEQ ID NO: 14298 - DNA, 20 bp, Artificial Sequence
  chemically synthesized
aaatgtgtatttctctggag

SEQ ID NO: 14299 - DNA, 20 bp, Artificial Sequence
  chemically synthesized
aatgtgtatttctctggaga

SEQ ID NO: 14300 - DNA, 20 bp, Artificial Sequence
  chemically synthesized
ctctggagaaggttaaaact

SEQ ID NO: 14301 - DNA, 20 bp, Artificial Sequence
  chemically synthesized
tctggagaaggttaaaactg

SEQ ID NO: 14302 - DNA, 20 bp, Artificial Sequence
  chemically synthesized
agaaggttaaaactgaggat

SEQ ID NO: 14303 - DNA, 20 bp, Artificial Sequence
  chemically synthesized
ggttaaaactgaggattggc

SEQ ID NO: 14304 - DNA, 20 bp, Artificial Sequence
  chemically synthesized
aaaactgaggattggcaagt

SEQ ID NO: 14305 - DNA, 20 bp, Artificial Sequence
  chemically synthesized
ctgaggattggcaagtgagc

SEQ ID NO: 14306 - DNA, 20 bp, Artificial Sequence
  chemically synthesized
tgaggattggcaagtgagca

SEQ ID NO: 14307 - DNA, 20 bp, Artificial Sequence
  chemically synthesized
gcaagtgagcaaggcttaaa

SEQ ID NO: 14308 - DNA, 20 bp, Artificial Sequence
  chemically synthesized
agtgagcaaggcttaaatgg

SEQ ID NO: 14309 - DNA, 20 bp, Artificial Sequence
  chemically synthesized
gagcaaggcttaaatggaag

SEQ ID NO: 14310 - DNA, 20 bp, Artificial Sequence
  chemically synthesized
ggaagaagcaatgatctcgt

SEQ ID NO: 14311 - DNA, 20 bp, Artificial Sequence
  chemically synthesized
gtcagaccaccttcattaac

SEQ ID NO: 14312 - DNA, 20 bp, Artificial Sequence
  chemically synthesized
ttaacgagatcatccatcat

SEQ ID NO: 14313 - DNA, 20 bp, Artificial Sequence
  chemically synthesized
taacgagatcatccatcatg

SEQ ID NO: 14314 - DNA, 20 bp, Artificial Sequence
  chemically synthesized
tcatccatcatgaggaaata

SEQ ID NO: 14315 - DNA, 20 bp, Artificial Sequence
  chemically synthesized
catgaggaaatatggaaaac

SEQ ID NO: 14316 - DNA, 20 bp, Artificial Sequence
  chemically synthesized
atgaggaaatatggaaaacc

SEQ ID NO: 14317 - DNA, 20 bp, Artificial Sequence
  chemically synthesized
cccctctgttttgtgtcact

SEQ ID NO: 14318 - DNA, 20 bp, Artificial Sequence
  chemically synthesized
ccctctgttttgtgtcacta

SEQ ID NO: 14319 - DNA, 20 bp, Artificial Sequence
  chemically synthesized
cctctgttttgtgtcactaa

SEQ ID NO: 14320 - DNA, 20 bp, Artificial Sequence
  chemically synthesized
tgttttgtgtcactaagggt

SEQ ID NO: 14321 - DNA, 20 bp, Artificial Sequence
  chemically synthesized
gttttgtgtcactaagggtg

SEQ ID NO: 14322 - DNA, 20 bp, Artificial Sequence
  chemically synthesized
tgaatgatttttccctcccc

SEQ ID NO: 14323 - DNA, 20 bp, Artificial Sequence
  chemically synthesized
gaatgatttttccctccccc

SEQ ID NO: 14324 - DNA, 20 bp, Artificial Sequence
  chemically synthesized
tccctcccccgggcttcttt

SEQ ID NO: 14325 - DNA, 20 bp, Artificial Sequence
  chemically synthesized
cttttagccatcaataattc

SEQ ID NO: 14326 - DNA, 20 bp, Artificial Sequence
  chemically synthesized
catcaataattctagcccca

SEQ ID NO: 14327 - DNA, 20 bp, Artificial Sequence
  chemically synthesized
atcaataattctagccccac

SEQ ID NO: 14328 - DNA, 20 bp, Artificial Sequence
  chemically synthesized
caataattctagccccacag

SEQ ID NO: 14329 - DNA, 20 bp, Artificial Sequence
  chemically synthesized
cccacaggagtttgttctga

SEQ ID NO: 14330 - DNA, 20 bp, Artificial Sequence
  chemically synthesized
aagtaaacttccacaaccgc

SEQ ID NO: 14331 - DNA, 20 bp, Artificial Sequence
  chemically synthesized
tccacaaccgcaagcttatt

SEQ ID NO: 14332 - DNA, 20 bp, Artificial Sequence
  chemically synthesized
ccacaaccgcaagcttattg

SEQ ID NO: 14333 - DNA, 20 bp, Artificial Sequence
  chemically synthesized
accgcaagcttattgaggct

SEQ ID NO: 14334 - DNA, 20 bp, Artificial Sequence
  chemically synthesized
ccgcaagcttattgaggcta

SEQ ID NO: 14335 - DNA, 20 bp, Artificial Sequence
  chemically synthesized
ttgaggctaaggcatctgtg

SEQ ID NO: 14336 - DNA, 20 bp, Artificial Sequence
  chemically synthesized
tgaggctaaggcatctgtga

SEQ ID NO: 14337 - DNA, 20 bp, Artificial Sequence
  chemically synthesized
gctaaggcatctgtgaagga

SEQ ID NO: 14338 - DNA, 20 bp, Artificial Sequence
  chemically synthesized
cctctaaaccactatgctgc

SEQ ID NO: 14339 - DNA, 20 bp, Artificial Sequence
  chemically synthesized
tctaaaccactatgctgcta

SEQ ID NO: 14340 - DNA, 20 bp, Artificial Sequence
  chemically synthesized
agagcctcttttctgtactc

SEQ ID NO: 14341 - DNA, 20 bp, Artificial Sequence
  chemically synthesized
ttctgtactcaagcctcatt

SEQ ID NO: 14342 - DNA, 20 bp, Artificial Sequence
  chemically synthesized
ctcaagcctcattcagacac

SEQ ID NO: 14343 - DNA, 20 bp, Artificial Sequence
  chemically synthesized
cattcagacactagtgtcac

SEQ ID NO: 14344 - DNA, 20 bp, Artificial Sequence
  chemically synthesized
ttgtattttcttcttcttgc

SEQ ID NO: 14345 - DNA, 20 bp, Artificial Sequence
  chemically synthesized
ttttcttcttcttgctggtt

SEQ ID NO: 14346 - DNA, 20 bp, Artificial Sequence
  chemically synthesized
gctggtttagtcatgttttc

SEQ ID NO: 14347 - DNA, 20 bp, Artificial Sequence
  chemically synthesized
ctggtttagtcatgttttct

SEQ ID NO: 14348 - DNA, 20 bp, Artificial Sequence
  chemically synthesized
ggtttagtcatgttttctgg

SEQ ID NO: 14349 - DNA, 20 bp, Artificial Sequence
  chemically synthesized
agtcatgttttctgggagct

SEQ ID NO: 14350 - DNA, 20 bp, Artificial Sequence
  chemically synthesized
gtcatgttttctgggagctt

SEQ ID NO: 14351 - DNA, 20 bp, Artificial Sequence
  chemically synthesized
tcatgttttctgggagctta

SEQ ID NO: 14352 - DNA, 20 bp, Artificial Sequence
  chemically synthesized
catgttttctgggagcttag

SEQ ID NO: 14353 - DNA, 20 bp, Artificial Sequence
  chemically synthesized
ttgttttgttttctaatcaa

SEQ ID NO: 14354 - DNA, 20 bp, Artificial Sequence
  chemically synthesized
gttttgttttctaatcaaca

SEQ ID NO: 14355 - DNA, 20 bp, Artificial Sequence
  chemically synthesized
tgttttctaatcaacagaga

SEQ ID NO: 14356 - DNA, 20 bp, Artificial Sequence
  chemically synthesized
gttttctaatcaacagagat

SEQ ID NO: 14357 - DNA, 20 bp, Artificial Sequence
  chemically synthesized
aaacccattatttttttctt

SEQ ID NO: 14358 - DNA, 20 bp, Artificial Sequence
  chemically synthesized
attatttttttctttagact

SEQ ID NO: 14359 - DNA, 20 bp, Artificial Sequence
  chemically synthesized
ttatttttttctttagactt

SEQ ID NO: 14360 - DNA, 20 bp, Artificial Sequence
  chemically synthesized
ttttttctttagacttggga

SEQ ID NO: 14361 - DNA, 20 bp, Artificial Sequence
  chemically synthesized
ctttagacttgggatggtga

SEQ ID NO: 14362 - DNA, 20 bp, Artificial Sequence
  chemically synthesized
agacttgggatggtgatagc

SEQ ID NO: 14363 - DNA, 20 bp, Artificial Sequence
  chemically synthesized
gacttgggatggtgatagct

SEQ ID NO: 14364 - DNA, 20 bp, Artificial Sequence
  chemically synthesized
ttgggatggtgatagctggg

SEQ ID NO: 14365 - DNA, 20 bp, Artificial Sequence
  chemically synthesized
tggtgatagctgggcagcgt

SEQ ID NO: 14366 - DNA, 20 bp, Artificial Sequence
  chemically synthesized
gcagcgtcagaaactgtgtg

SEQ ID NO: 14367 - DNA, 20 bp, Artificial Sequence
  chemically synthesized
tcagaaactgtgtgtggata

SEQ ID NO: 14368 - DNA, 20 bp, Artificial Sequence
  chemically synthesized
aactgtgtgtggatatagat

SEQ ID NO: 14369 - DNA, 20 bp, Artificial Sequence
  chemically synthesized
ctgtgtgtggatatagataa

SEQ ID NO: 14370 - DNA, 20 bp, Artificial Sequence
  chemically synthesized
tgtggatatagataagagct

SEQ ID NO: 14371 - DNA, 20 bp, Artificial Sequence
  chemically synthesized
gtggatatagataagagctc

SEQ ID NO: 14372 - DNA, 20 bp, Artificial Sequence
  chemically synthesized
taagagctcaggactatgct

SEQ ID NO: 14373 - DNA, 20 bp, Artificial Sequence
  chemically synthesized
ggactatgctgagctgtgat

SEQ ID NO: 14374 - DNA, 20 bp, Artificial Sequence
  chemically synthesized
gactatgctgagctgtgatg

SEQ ID NO: 14375 - DNA, 20 bp, Artificial Sequence
  chemically synthesized
actatgctgagctgtgatga

SEQ ID NO: 14376 - DNA, 20 bp, Artificial Sequence
  chemically synthesized
tatgctgagctgtgatgagg

SEQ ID NO: 14377 - DNA, 20 bp, Artificial Sequence
  chemically synthesized
atgctgagctgtgatgaggg

SEQ ID NO: 14378 - DNA, 20 bp, Artificial Sequence
  chemically synthesized
tgctgagctgtgatgaggga

SEQ ID NO: 14379 - DNA, 20 bp, Artificial Sequence
  chemically synthesized
gctgagctgtgatgagggag

SEQ ID NO: 14380 - DNA, 20 bp, Artificial Sequence
  chemically synthesized
gctgtgatgagggaggggcc

SEQ ID NO: 14381 - DNA, 20 bp, Artificial Sequence
  chemically synthesized
atgagggaggggcctagcta

SEQ ID NO: 14382 - DNA, 20 bp, Artificial Sequence
  chemically synthesized
tgagggaggggcctagctaa

SEQ ID NO: 14383 - DNA, 20 bp, Artificial Sequence
  chemically synthesized
gggaggggcctagctaaagg

SEQ ID NO: 14384 - DNA, 20 bp, Artificial Sequence
  chemically synthesized
ggggcctagctaaaggcagt

SEQ ID NO: 14385 - DNA, 20 bp, Artificial Sequence
  chemically synthesized
ggcctagctaaaggcagtga

SEQ ID NO: 14386 - DNA, 20 bp, Artificial Sequence
  chemically synthesized
tagctaaaggcagtgagagt

SEQ ID NO: 14387 - DNA, 20 bp, Artificial Sequence
  chemically synthesized
tgctcctgctattgccttct

SEQ ID NO: 14388 - DNA, 20 bp, Artificial Sequence
  chemically synthesized
gccttctcagtccccacgct

SEQ ID NO: 14389 - DNA, 20 bp, Artificial Sequence
  chemically synthesized
cccacgcttggtttctacac

SEQ ID NO: 14390 - DNA, 20 bp, Artificial Sequence
  chemically synthesized
acgcttggtttctacacaag

SEQ ID NO: 14391 - DNA, 20 bp, Artificial Sequence
  chemically synthesized
tttctacacaagtagataca

SEQ ID NO: 14392 - DNA, 20 bp, Artificial Sequence
  chemically synthesized
acacaagtagatacatagaa

SEQ ID NO: 14393 - DNA, 20 bp, Artificial Sequence
  chemically synthesized
cacaagtagatacatagaaa

SEQ ID NO: 14394 - DNA, 20 bp, Artificial Sequence
  chemically synthesized
tagatacatagaaaaggcta

SEQ ID NO: 14395 - DNA, 20 bp, Artificial Sequence
  chemically synthesized
agatacatagaaaaggctat

SEQ ID NO: 14396 - DNA, 20 bp, Artificial Sequence
  chemically synthesized
acatagaaaaggctataggt

SEQ ID NO: 14397 - DNA, 20 bp, Artificial Sequence
  chemically synthesized
aaggctataggttagtgttt

SEQ ID NO: 14398 - DNA, 20 bp, Artificial Sequence
  chemically synthesized
ggctataggttagtgtttga

SEQ ID NO: 14399 - DNA, 20 bp, Artificial Sequence
  chemically synthesized
gtttgagagtcctgcatgat

SEQ ID NO: 14400 - DNA, 20 bp, Artificial Sequence
  chemically synthesized
gtcctgcatgattagttgct

SEQ ID NO: 14401 - DNA, 20 bp, Artificial Sequence
  chemically synthesized
tgtgattatcatcaaaacgt

SEQ ID NO: 14402 - DNA, 20 bp, Artificial Sequence
  chemically synthesized
gtgattatcatcaaaacgtg

SEQ ID NO: 14403 - DNA, 20 bp, Artificial Sequence
  chemically synthesized
tgattatcatcaaaacgtga

SEQ ID NO: 14404 - DNA, 20 bp, Artificial Sequence
  chemically synthesized
tcatcaaaacgtgagggcta

SEQ ID NO: 14405 - DNA, 20 bp, Artificial Sequence
  chemically synthesized
aacgtgagggctaaagtgac

SEQ ID NO: 14406 - DNA, 20 bp, Artificial Sequence
  chemically synthesized
aaagtgaccagataacttgc

SEQ ID NO: 14407 - DNA, 20 bp, Artificial Sequence
  chemically synthesized
accagataacttgcaagtcc

SEQ ID NO: 14408 - DNA, 20 bp, Artificial Sequence
  chemically synthesized
ccagataacttgcaagtcct

SEQ ID NO: 14409 - DNA, 20 bp, Artificial Sequence
  chemically synthesized
acttgcaagtcctaggatac

SEQ ID NO: 14410 - DNA, 20 bp, Artificial Sequence
  chemically synthesized
cttgcaagtcctaggatacc

SEQ ID NO: 14411 - DNA, 20 bp, Artificial Sequence
  chemically synthesized
tacattccaaaaatttaact

SEQ ID NO: 14412 - DNA, 20 bp, Artificial Sequence
  chemically synthesized
aaaaaaaaacaaaaaaaaac

SEQ ID NO: 14413 - DNA, 20 bp, Artificial Sequence
  chemically synthesized
aaaaaaaaaccagtgatcca

SEQ ID NO: 14414 - DNA, 20 bp, Artificial Sequence
  chemically synthesized
aaaccagtgatccatggaca

SEQ ID NO: 14415 - DNA, 20 bp, Artificial Sequence
  chemically synthesized
aaccagtgatccatggacac

SEQ ID NO: 14416 - DNA, 20 bp, Artificial Sequence
  chemically synthesized
accagtgatccatggacaca

SEQ ID NO: 14417 - DNA, 20 bp, Artificial Sequence
  chemically synthesized
cagtgatccatggacacagg

SEQ ID NO: 14418 - DNA, 20 bp, Artificial Sequence
  chemically synthesized
agtgatccatggacacaggg

SEQ ID NO: 14419 - DNA, 20 bp, Artificial Sequence
  chemically synthesized
gtgatccatggacacaggga

SEQ ID NO: 14420 - DNA, 20 bp, Artificial Sequence
  chemically synthesized
tgatccatggacacagggag

SEQ ID NO: 14421 - DNA, 20 bp, Artificial Sequence
  chemically synthesized
gggaggggaacatcacacac

SEQ ID NO: 14422 - DNA, 20 bp, Artificial Sequence
  chemically synthesized
ggaggggaacatcacacact

SEQ ID NO: 14423 - DNA, 20 bp, Artificial Sequence
  chemically synthesized
gaggggaacatcacacactg

SEQ ID NO: 14424 - DNA, 20 bp, Artificial Sequence
  chemically synthesized
catcacacactggggcctgt

SEQ ID NO: 14425 - DNA, 20 bp, Artificial Sequence
  chemically synthesized
atcacacactggggcctgtt

SEQ ID NO: 14426 - DNA, 20 bp, Artificial Sequence
  chemically synthesized
tcacacactggggcctgttg

SEQ ID NO: 14427 - DNA, 20 bp, Artificial Sequence
  chemically synthesized
cacacactggggcctgttgg

SEQ ID NO: 14428 - DNA, 20 bp, Artificial Sequence
  chemically synthesized
acactggggcctgttggggg

SEQ ID NO: 14429 - DNA, 20 bp, Artificial Sequence
  chemically synthesized
cactggggcctgttgggggt

SEQ ID NO: 14430 - DNA, 20 bp, Artificial Sequence
  chemically synthesized
actggggcctgttgggggtg

SEQ ID NO: 14431 - DNA, 20 bp, Artificial Sequence
  chemically synthesized
ctggggcctgttgggggtgg

SEQ ID NO: 14432 - DNA, 20 bp, Artificial Sequence
  chemically synthesized
tggggcctgttgggggtggg

SEQ ID NO: 14433 - DNA, 20 bp, Artificial Sequence
  chemically synthesized
gcctgttgggggtggggggc

SEQ ID NO: 14434 - DNA, 20 bp, Artificial Sequence
  chemically synthesized
cctgttgggggtggggggct

SEQ ID NO: 14435 - DNA, 20 bp, Artificial Sequence
  chemically synthesized
ctgttgggggtggggggcta

SEQ ID NO: 14436 - DNA, 20 bp, Artificial Sequence
  chemically synthesized
tgttgggggtggggggctag

SEQ ID NO: 14437 - DNA, 20 bp, Artificial Sequence
  chemically synthesized
tgggggtggggggctagggg

SEQ ID NO: 14438 - DNA, 20 bp, Artificial Sequence
  chemically synthesized
gggggtggggggctagggga

SEQ ID NO: 14439 - DNA, 20 bp, Artificial Sequence
  chemically synthesized
gtggggggctaggggaagga

SEQ ID NO: 14440 - DNA, 20 bp, Artificial Sequence
  chemically synthesized
ggctaggggaaggatagcat

SEQ ID NO: 14441 - DNA, 20 bp, Artificial Sequence
  chemically synthesized
gctaggggaaggatagcatt

SEQ ID NO: 14442 - DNA, 20 bp, Artificial Sequence
  chemically synthesized
taggggaaggatagcattag

SEQ ID NO: 14443 - DNA, 20 bp, Artificial Sequence
  chemically synthesized
attaggagaaatacctaatg

SEQ ID NO: 14444 - DNA, 20 bp, Artificial Sequence
  chemically synthesized
gaaatacctaatgtagatga

SEQ ID NO: 14445 - DNA, 20 bp, Artificial Sequence
  chemically synthesized
aaatacctaatgtagatgac

SEQ ID NO: 14446 - DNA, 20 bp, Artificial Sequence
  chemically synthesized
taatgtagatgacgggttga

SEQ ID NO: 14447 - DNA, 20 bp, Artificial Sequence
  chemically synthesized
aatgtagatgacgggttgat

SEQ ID NO: 14448 - DNA, 20 bp, Artificial Sequence
  chemically synthesized
agatgacgggttgatgggtg

SEQ ID NO: 14449 - DNA, 20 bp, Artificial Sequence
  chemically synthesized
atgggtgcagcaaaccacca

SEQ ID NO: 14450 - DNA, 20 bp, Artificial Sequence
  chemically synthesized
ccaccatggcacatgtaccc

SEQ ID NO: 14451 - DNA, 20 bp, Artificial Sequence
  chemically synthesized
cacatgtaccccagaactta

SEQ ID NO: 14452 - DNA, 20 bp, Artificial Sequence
  chemically synthesized
cttaaagcatattaaaaaaa

SEQ ID NO: 14453 - DNA, 20 bp, Artificial Sequence
  chemically synthesized
taaaaaaacagtgatcataa

SEQ ID NO: 14454 - DNA, 20 bp, Artificial Sequence
  chemically synthesized
aaaaacagtgatcataaaag

SEQ ID NO: 14455 - DNA, 20 bp, Artificial Sequence
  chemically synthesized
agaagctcaaatttaactat

SEQ ID NO: 14456 - DNA, 20 bp, Artificial Sequence
  chemically synthesized
aagctcaaatttaactataa

SEQ ID NO: 14457 - DNA, 20 bp, Artificial Sequence
  chemically synthesized
tcaaatttaactataagaga

SEQ ID NO: 14458 - DNA, 20 bp, Artificial Sequence
  chemically synthesized
tttaactataagagacggaa

SEQ ID NO: 14459 - DNA, 20 bp, Artificial Sequence
  chemically synthesized
aattcttaactataatctta

SEQ ID NO: 14460 - DNA, 20 bp, Artificial Sequence
  chemically synthesized
tacagaatattctcattgaa

SEQ ID NO: 14461 - DNA, 20 bp, Artificial Sequence
  chemically synthesized
agaatattctcattgaatag

SEQ ID NO: 14462 - DNA, 20 bp, Artificial Sequence
  chemically synthesized
aatagaagtatgcttatcat

SEQ ID NO: 14463 - DNA, 20 bp, Artificial Sequence
  chemically synthesized
tagaagtatgcttatcatta

SEQ ID NO: 14464 - DNA, 20 bp, Artificial Sequence
  chemically synthesized
tatgcttatcattagagatt

SEQ ID NO: 14465 - DNA, 20 bp, Artificial Sequence
  chemically synthesized
cttatcattagagatttgga

SEQ ID NO: 14466 - DNA, 20 bp, Artificial Sequence
  chemically synthesized
tcattagagatttggacagc

SEQ ID NO: 14467 - DNA, 20 bp, Artificial Sequence
  chemically synthesized
cattagagatttggacagcc

SEQ ID NO: 14468 - DNA, 20 bp, Artificial Sequence
  chemically synthesized
agagatttggacagccagga

SEQ ID NO: 14469 - DNA, 20 bp, Artificial Sequence
  chemically synthesized
tttggacagccaggaaagca

SEQ ID NO: 14470 - DNA, 20 bp, Artificial Sequence
  chemically synthesized
gaaagcacagaaaaaaaaaa

SEQ ID NO: 14471 - DNA, 20 bp, Artificial Sequence
  chemically synthesized
aaagcacagaaaaaaaaaaa

SEQ ID NO: 14472 - DNA, 20 bp, Artificial Sequence
  chemically synthesized
agcacagaaaaaaaaaaaag

SEQ ID NO: 14473 - DNA, 20 bp, Artificial Sequence
  chemically synthesized
aaaggagctctgttgcctta

SEQ ID NO: 14474 - DNA, 20 bp, Artificial Sequence
  chemically synthesized
agctctgttgccttatagcc

SEQ ID NO: 14475 - DNA, 20 bp, Artificial Sequence
  chemically synthesized
ctctgttgccttatagccta

SEQ ID NO: 14476 - DNA, 20 bp, Artificial Sequence
  chemically synthesized
tctgttgccttatagcctag

SEQ ID NO: 14477 - DNA, 20 bp, Artificial Sequence
  chemically synthesized
cctcacataacactgatgtc

SEQ ID NO: 14478 - DNA, 20 bp, Artificial Sequence
  chemically synthesized
ctcacataacactgatgtcc

SEQ ID NO: 14479 - DNA, 20 bp, Artificial Sequence
  chemically synthesized
ataacactgatgtccaggcc

SEQ ID NO: 14480 - DNA, 20 bp, Artificial Sequence
  chemically synthesized
taacactgatgtccaggcca

SEQ ID NO: 14481 - DNA, 20 bp, Artificial Sequence
  chemically synthesized
ccaaggccatccttcccatg

SEQ ID NO: 14482 - DNA, 20 bp, Artificial Sequence
  chemically synthesized
ggccatccttcccatgaaga

SEQ ID NO: 14483 - DNA, 20 bp, Artificial Sequence
  chemically synthesized
tcccatgaagatggatgaat

SEQ ID NO: 14484 - DNA, 20 bp, Artificial Sequence
  chemically synthesized
ctatgaaataatgtttactt

SEQ ID NO: 14485 - DNA, 20 bp, Artificial Sequence
  chemically synthesized
tgaaataatgtttactttag

SEQ ID NO: 14486 - DNA, 20 bp, Artificial Sequence
  chemically synthesized
actttagtggcatattgcat

SEQ ID NO: 14487 - DNA, 20 bp, Artificial Sequence
  chemically synthesized
ctttagtggcatattgcatt

SEQ ID NO: 14488 - DNA, 20 bp, Artificial Sequence
  chemically synthesized
ttgcattaggctacctgcct

SEQ ID NO: 14489 - DNA, 20 bp, Artificial Sequence
  chemically synthesized
ttaggctacctgccttggca

SEQ ID NO: 14490 - DNA, 20 bp, Artificial Sequence
  chemically synthesized
ttaattgcttacataaacat

SEQ ID NO: 14491 - DNA, 20 bp, Artificial Sequence
  chemically synthesized
ttacataaacatgagtgctc

SEQ ID NO: 14492 - DNA, 20 bp, Artificial Sequence
  chemically synthesized
agtgctctagttataaattc

SEQ ID NO: 14493 - DNA, 20 bp, Artificial Sequence
  chemically synthesized
ttccagtgtaaaaaacaccc

SEQ ID NO: 14494 - DNA, 20 bp, Artificial Sequence
  chemically synthesized
ggtttcgatattcatctttt

SEQ ID NO: 14495 - DNA, 20 bp, Artificial Sequence
  chemically synthesized
atcttttgagccttttattt

SEQ ID NO: 14496 - DNA, 20 bp, Artificial Sequence
  chemically synthesized
tttgagccttttattttggt

SEQ ID NO: 14497 - DNA, 20 bp, Artificial Sequence
  chemically synthesized
ccttttattttggtcagaac

SEQ ID NO: 14498 - DNA, 20 bp, Artificial Sequence
  chemically synthesized
tttggtcagaacaagttttc

SEQ ID NO: 14499 - DNA, 20 bp, Artificial Sequence
  chemically synthesized
tggtcagaacaagttttcaa

SEQ ID NO: 14500 - DNA, 20 bp, Artificial Sequence
  chemically synthesized
aagttttcaagagcaaatct

SEQ ID NO: 14501 - DNA, 20 bp, Artificial Sequence
  chemically synthesized
tctcagcctacaaaacaaat

SEQ ID NO: 14502 - DNA, 20 bp, Artificial Sequence
  chemically synthesized
aaaacaaatgagtccaattc

SEQ ID NO: 14503 - DNA, 20 bp, Artificial Sequence
  chemically synthesized
atgagtccaattctagaact

SEQ ID NO: 14504 - DNA, 20 bp, Artificial Sequence
  chemically synthesized
tagaactcagtaatcccatc

SEQ ID NO: 14505 - DNA, 20 bp, Artificial Sequence
  chemically synthesized
agaactcagtaatcccatca

SEQ ID NO: 14506 - DNA, 20 bp, Artificial Sequence
  chemically synthesized
tcccatcaaggctctgcctg

SEQ ID NO: 14507 - DNA, 20 bp, Artificial Sequence
  chemically synthesized
ccatcaaggctctgcctgcg

SEQ ID NO: 14508 - DNA, 20 bp, Artificial Sequence
  chemically synthesized
catcaaggctctgcctgcgg

SEQ ID NO: 14509 - DNA, 20 bp, Artificial Sequence
  chemically synthesized
atcaaggctctgcctgcgga

SEQ ID NO: 14510 - DNA, 20 bp, Artificial Sequence
  chemically synthesized
tctgcctgcggagggctaac

SEQ ID NO: 14511 - DNA, 20 bp, Artificial Sequence
  chemically synthesized
gagggctaactagctctatg

SEQ ID NO: 14512 - DNA, 20 bp, Artificial Sequence
  chemically synthesized
agggctaactagctctatgc

SEQ ID NO: 14513 - DNA, 20 bp, Artificial Sequence
  chemically synthesized
taactagctctatgcaggct

SEQ ID NO: 14514 - DNA, 20 bp, Artificial Sequence
  chemically synthesized
ctatgcaggcttagcacttc

SEQ ID NO: 14515 - DNA, 20 bp, Artificial Sequence
  chemically synthesized
ctgatttctttgtgtgtgca

SEQ ID NO: 14516 - DNA, 20 bp, Artificial Sequence
  chemically synthesized
atttctttgtgtgtgcatag

SEQ ID NO: 14517 - DNA, 20 bp, Artificial Sequence
  chemically synthesized
tctttgtgtgtgcatagcag

SEQ ID NO: 14518 - DNA, 20 bp, Artificial Sequence
  chemically synthesized
gtgcatagcagtggatgtgt

SEQ ID NO: 14519 - DNA, 20 bp, Artificial Sequence
  chemically synthesized
agcatacatccttttaatta

SEQ ID NO: 14520 - DNA, 20 bp, Artificial Sequence
  chemically synthesized
ttcaaaattgtaaaattgct

SEQ ID NO: 14521 - DNA, 20 bp, Artificial Sequence
  chemically synthesized
ttgtaaaattgctaagaata

SEQ ID NO: 14522 - DNA, 20 bp, Artificial Sequence
  chemically synthesized
ctaagaatacagcacaaaaa

SEQ ID NO: 14523 - DNA, 20 bp, Artificial Sequence
  chemically synthesized
aatacagcacaaaaacagaa

SEQ ID NO: 14524 - DNA, 20 bp, Artificial Sequence
  chemically synthesized
tacagcacaaaaacagaata

SEQ ID NO: 14525 - DNA, 20 bp, Artificial Sequence
  chemically synthesized
acagcacaaaaacagaatag

SEQ ID NO: 14526 - DNA, 20 bp, Artificial Sequence
  chemically synthesized
aaaaacagaatagaggaata

SEQ ID NO: 14527 - DNA, 20 bp, Artificial Sequence
  chemically synthesized
gaataaagttcctgttttca

SEQ ID NO: 14528 - DNA, 20 bp, Artificial Sequence
  chemically synthesized
tcctgttttcatggacttga

SEQ ID NO: 14529 - DNA, 20 bp, Artificial Sequence
  chemically synthesized
tgttttcatggacttgatag

SEQ ID NO: 14530 - DNA, 20 bp, Artificial Sequence
  chemically synthesized
ttcatggacttgatagtgga

SEQ ID NO: 14531 - DNA, 20 bp, Artificial Sequence
  chemically synthesized
catggacttgatagtggaaa

SEQ ID NO: 14532 - DNA, 20 bp, Artificial Sequence
  chemically synthesized
gaaagagcttgacattaaat

SEQ ID NO: 14533 - DNA, 20 bp, Artificial Sequence
  chemically synthesized
gaaacatgttatataccaat

SEQ ID NO: 14534 - DNA, 20 bp, Artificial Sequence
  chemically synthesized
atgttatataccaatgagat

SEQ ID NO: 14535 - DNA, 20 bp, Artificial Sequence
  chemically synthesized
tgttatataccaatgagatt

SEQ ID NO: 14536 - DNA, 20 bp, Artificial Sequence
  chemically synthesized
accaatgagattaggtgcta

SEQ ID NO: 14537 - DNA, 20 bp, Artificial Sequence
  chemically synthesized
caatgagattaggtgctatg

SEQ ID NO: 14538 - DNA, 20 bp, Artificial Sequence
  chemically synthesized
aaaaaaaaaaaactgaaatg

SEQ ID NO: 14539 - DNA, 20 bp, Artificial Sequence
  chemically synthesized
aaaaaaaaaaactgaaatga

SEQ ID NO: 14540 - DNA, 20 bp, Artificial Sequence
  chemically synthesized
aaaaaaactgaaatgaaggc

SEQ ID NO: 14541 - DNA, 20 bp, Artificial Sequence
  chemically synthesized
aaaaactgaaatgaaggcca

SEQ ID NO: 14542 - DNA, 20 bp, Artificial Sequence
  chemically synthesized
aatgaaggccagagtgtgat

SEQ ID NO: 14543 - DNA, 20 bp, Artificial Sequence
  chemically synthesized
atgaaggccagagtgtgatt

SEQ ID NO: 14544 - DNA, 20 bp, Artificial Sequence
  chemically synthesized
aggccagagtgtgattagga

SEQ ID NO: 14545 - DNA, 20 bp, Artificial Sequence
  chemically synthesized
ggccagagtgtgattaggac

SEQ ID NO: 14546 - DNA, 20 bp, Artificial Sequence
  chemically synthesized
gccagagtgtgattaggaca

SEQ ID NO: 14547 - DNA, 20 bp, Artificial Sequence
  chemically synthesized
gtgtgattaggacagggtga

SEQ ID NO: 14548 - DNA, 20 bp, Artificial Sequence
  chemically synthesized
tgtgattaggacagggtgaa

SEQ ID NO: 14549 - DNA, 20 bp, Artificial Sequence
  chemically synthesized
gtgattaggacagggtgaaa

SEQ ID NO: 14550 - DNA, 20 bp, Artificial Sequence
  chemically synthesized
tgaaagggtatcgctacttt

SEQ ID NO: 14551 - DNA, 20 bp, Artificial Sequence
  chemically synthesized
aagggtatcgctactttaag

SEQ ID NO: 14552 - DNA, 20 bp, Artificial Sequence
  chemically synthesized
tatcgctactttaagtagta

SEQ ID NO: 14553 - DNA, 20 bp, Artificial Sequence
  chemically synthesized
cgctactttaagtagtatgg

SEQ ID NO: 14554 - DNA, 20 bp, Artificial Sequence
  chemically synthesized
gctactttaagtagtatggc

SEQ ID NO: 14555 - DNA, 20 bp, Artificial Sequence
  chemically synthesized
ctttaagtagtatggcagga

SEQ ID NO: 14556 - DNA, 20 bp, Artificial Sequence
  chemically synthesized
gcaggaaagtcctcactata

SEQ ID NO: 14557 - DNA, 20 bp, Artificial Sequence
  chemically synthesized
tcactataaagttaacacct

SEQ ID NO: 14558 - DNA, 20 bp, Artificial Sequence
  chemically synthesized
actataaagttaacacctga

SEQ ID NO: 14559 - DNA, 20 bp, Artificial Sequence
  chemically synthesized
tataaagttaacacctgaga

SEQ ID NO: 14560 - DNA, 20 bp, Artificial Sequence
  chemically synthesized
aacacctgagagagtaccca

SEQ ID NO: 14561 - DNA, 20 bp, Artificial Sequence
  chemically synthesized
agagagtacccatagatgat

SEQ ID NO: 14562 - DNA, 20 bp, Artificial Sequence
  chemically synthesized
gagagtacccatagatgatg

SEQ ID NO: 14563 - DNA, 20 bp, Artificial Sequence
  chemically synthesized
tgaaactatgattaaatatt

SEQ ID NO: 14564 - DNA, 20 bp, Artificial Sequence
  chemically synthesized
gaaactatgattaaatattt

SEQ ID NO: 14565 - DNA, 20 bp, Artificial Sequence
  chemically synthesized
aaactatgattaaatattta

SEQ ID NO: 14566 - DNA, 20 bp, Artificial Sequence
  chemically synthesized
atgattaaatatttagggca

SEQ ID NO: 14567 - DNA, 20 bp, Artificial Sequence
  chemically synthesized
tgattaaatatttagggcat

SEQ ID NO: 14568 - DNA, 20 bp, Artificial Sequence
  chemically synthesized
gattaaatatttagggcata

SEQ ID NO: 14569 - DNA, 20 bp, Artificial Sequence
  chemically synthesized
aatatttagggcatagggaa

SEQ ID NO: 14570 - DNA, 20 bp, Artificial Sequence
  chemically synthesized
tggcaaatgtaaatacccta

SEQ ID NO: 14571 - DNA, 20 bp, Artificial Sequence
  chemically synthesized
tgtaaataccctaaagatgt

SEQ ID NO: 14572 - DNA, 20 bp, Artificial Sequence
  chemically synthesized
ccctaaagatgtaagatgct

SEQ ID NO: 14573 - DNA, 20 bp, Artificial Sequence
  chemically synthesized
gtaagatgcttagaattttc

SEQ ID NO: 14574 - DNA, 20 bp, Artificial Sequence
  chemically synthesized
taagatgcttagaattttca

SEQ ID NO: 14575 - DNA, 20 bp, Artificial Sequence
  chemically synthesized
aattttcaaggaatatcaat

SEQ ID NO: 14576 - DNA, 20 bp, Artificial Sequence
  chemically synthesized
attttcaaggaatatcaata

SEQ ID NO: 14577 - DNA, 20 bp, Artificial Sequence
  chemically synthesized
gaatatcaataaggccaatg

SEQ ID NO: 14578 - DNA, 20 bp, Artificial Sequence
  chemically synthesized
aatatcaataaggccaatgt

SEQ ID NO: 14579 - DNA, 20 bp, Artificial Sequence
  chemically synthesized
caataaggccaatgtaggat

SEQ ID NO: 14580 - DNA, 20 bp, Artificial Sequence
  chemically synthesized
ggccaatgtaggatgagatt

SEQ ID NO: 14581 - DNA, 20 bp, Artificial Sequence
  chemically synthesized
atgtaggatgagattcggtg

SEQ ID NO: 14582 - DNA, 20 bp, Artificial Sequence
  chemically synthesized
tgtaggatgagattcggtga

SEQ ID NO: 14583 - DNA, 20 bp, Artificial Sequence
  chemically synthesized
gtaggatgagattcggtgaa

SEQ ID NO: 14584 - DNA, 20 bp, Artificial Sequence
  chemically synthesized
taggatgagattcggtgaag

SEQ ID NO: 14585 - DNA, 20 bp, Artificial Sequence
  chemically synthesized
ggatgagattcggtgaaggg

SEQ ID NO: 14586 - DNA, 20 bp, Artificial Sequence
  chemically synthesized
ttcggtgaaggggagaataa

SEQ ID NO: 14587 - DNA, 20 bp, Artificial Sequence
  chemically synthesized
tgaaggggagaataaaagat

SEQ ID NO: 14588 - DNA, 20 bp, Artificial Sequence
  chemically synthesized
gagaataaaagatgagatca

SEQ ID NO: 14589 - DNA, 20 bp, Artificial Sequence
  chemically synthesized
aataaaagatgagatcatag

SEQ ID NO: 14590 - DNA, 20 bp, Artificial Sequence
  chemically synthesized
aagtcctaaattataaaatt

SEQ ID NO: 14591 - DNA, 20 bp, Artificial Sequence
  chemically synthesized
agtcctaaattataaaattt

SEQ ID NO: 14592 - DNA, 20 bp, Artificial Sequence
  chemically synthesized
cactaataatacctacatca

SEQ ID NO: 14593 - DNA, 20 bp, Artificial Sequence
  chemically synthesized
ctaataatacctacatcata

SEQ ID NO: 14594 - DNA, 20 bp, Artificial Sequence
  chemically synthesized
tacctacatcatagagttgt

SEQ ID NO: 14595 - DNA, 20 bp, Artificial Sequence
  chemically synthesized
atatatatatttatttatat

SEQ ID NO: 14596 - DNA, 20 bp, Artificial Sequence
  chemically synthesized
atatatatttatttatatga

SEQ ID NO: 14597 - DNA, 20 bp, Artificial Sequence
  chemically synthesized
atatgcatgaacaactattg

SEQ ID NO: 14598 - DNA, 20 bp, Artificial Sequence
  chemically synthesized
atgcatgaacaactattgta

SEQ ID NO: 14599 - DNA, 20 bp, Artificial Sequence
  chemically synthesized
caactattgtagagaattgt

SEQ ID NO: 14600 - DNA, 20 bp, Artificial Sequence
  chemically synthesized
aactattgtagagaattgta

SEQ ID NO: 14601 - DNA, 20 bp, Artificial Sequence
  chemically synthesized
tgtagagaattgtaaggatt

SEQ ID NO: 14602 - DNA, 20 bp, Artificial Sequence
  chemically synthesized
tggttttattataaatgata

SEQ ID NO: 14603 - DNA, 20 bp, Artificial Sequence
  chemically synthesized
ggttttattataaatgatat

SEQ ID NO: 14604 - DNA, 20 bp, Artificial Sequence
  chemically synthesized
taaatgatataggaaactat

SEQ ID NO: 14605 - DNA, 20 bp, Artificial Sequence
  chemically synthesized
atgatataggaaactatcag

SEQ ID NO: 14606 - DNA, 20 bp, Artificial Sequence
  chemically synthesized
ctatcagaagactttgaaca

SEQ ID NO: 14607 - DNA, 20 bp, Artificial Sequence
  chemically synthesized
atcagaagactttgaacaaa

SEQ ID NO: 14608 - DNA, 20 bp, Artificial Sequence
  chemically synthesized
tcagaagactttgaacaaag

SEQ ID NO: 14609 - DNA, 20 bp, Artificial Sequence
  chemically synthesized
tatatgacttacattttgaa

SEQ ID NO: 14610 - DNA, 20 bp, Artificial Sequence
  chemically synthesized
acattttgaaaagactaatt

SEQ ID NO: 14611 - DNA, 20 bp, Artificial Sequence
  chemically synthesized
tttgaaaagactaatttgga

SEQ ID NO: 14612 - DNA, 20 bp, Artificial Sequence
  chemically synthesized
gactaatttggatagtatat

SEQ ID NO: 14613 - DNA, 20 bp, Artificial Sequence
  chemically synthesized
actaatttggatagtatatt

SEQ ID NO: 14614 - DNA, 20 bp, Artificial Sequence
  chemically synthesized
aatttggatagtatattggg

SEQ ID NO: 14615 - DNA, 20 bp, Artificial Sequence
  chemically synthesized
agtatattgggaagaaattg

SEQ ID NO: 14616 - DNA, 20 bp, Artificial Sequence
  chemically synthesized
atattgggaagaaattgtag

SEQ ID NO: 14617 - DNA, 20 bp, Artificial Sequence
  chemically synthesized
tattgggaagaaattgtagt

SEQ ID NO: 14618 - DNA, 20 bp, Artificial Sequence
  chemically synthesized
attgggaagaaattgtagtg

SEQ ID NO: 14619 - DNA, 20 bp, Artificial Sequence
  chemically synthesized
gggaagaaattgtagtgggg

SEQ ID NO: 14620 - DNA, 20 bp, Artificial Sequence
  chemically synthesized
aagaaattgtagtggggcag

SEQ ID NO: 14621 - DNA, 20 bp, Artificial Sequence
  chemically synthesized
aaattgtagtggggcagtgg

SEQ ID NO: 14622 - DNA, 20 bp, Artificial Sequence
  chemically synthesized
ttgtagtggggcagtggtag

SEQ ID NO: 14623 - DNA, 20 bp, Artificial Sequence
  chemically synthesized
tagtggggcagtggtagaag

SEQ ID NO: 14624 - DNA, 20 bp, Artificial Sequence
  chemically synthesized
agtggggcagtggtagaagc

SEQ ID NO: 14625 - DNA, 20 bp, Artificial Sequence
  chemically synthesized
ggggcagtggtagaagcagg

SEQ ID NO: 14626 - DNA, 20 bp, Artificial Sequence
  chemically synthesized
agaagcaggaagattgttat

SEQ ID NO: 14627 - DNA, 20 bp, Artificial Sequence
  chemically synthesized
ggaagattgttatgagtcaa

SEQ ID NO: 14628 - DNA, 20 bp, Artificial Sequence
  chemically synthesized
atgagtcaacagctataatt

SEQ ID NO: 14629 - DNA, 20 bp, Artificial Sequence
  chemically synthesized
tgagtcaacagctataattt

SEQ ID NO: 14630 - DNA, 20 bp, Artificial Sequence
  chemically synthesized
gtcaacagctataatttagg

SEQ ID NO: 14631 - DNA, 20 bp, Artificial Sequence
  chemically synthesized
aacagctataatttaggtgg

SEQ ID NO: 14632 - DNA, 20 bp, Artificial Sequence
  chemically synthesized
tataatttaggtggtggtga

SEQ ID NO: 14633 - DNA, 20 bp, Artificial Sequence
  chemically synthesized
aggtggtggtgacagtgact

SEQ ID NO: 14634 - DNA, 20 bp, Artificial Sequence
  chemically synthesized
gtggtgacagtgacttagac

SEQ ID NO: 14635 - DNA, 20 bp, Artificial Sequence
  chemically synthesized
ggtgacagtgacttagacca

SEQ ID NO: 14636 - DNA, 20 bp, Artificial Sequence
  chemically synthesized
gacagtgacttagaccagag

SEQ ID NO: 14637 - DNA, 20 bp, Artificial Sequence
  chemically synthesized
agtgacttagaccagagtgg

SEQ ID NO: 14638 - DNA, 20 bp, Artificial Sequence
  chemically synthesized
ttagaccagagtggtagcat

SEQ ID NO: 14639 - DNA, 20 bp, Artificial Sequence
  chemically synthesized
agaccagagtggtagcattg

SEQ ID NO: 14640 - DNA, 20 bp, Artificial Sequence
  chemically synthesized
gaccagagtggtagcattgg

SEQ ID NO: 14641 - DNA, 20 bp, Artificial Sequence
  chemically synthesized
gagtggtagcattggaggtg

SEQ ID NO: 14642 - DNA, 20 bp, Artificial Sequence
  chemically synthesized
agtggtagcattggaggtga

SEQ ID NO: 14643 - DNA, 20 bp, Artificial Sequence
  chemically synthesized
gtagcattggaggtgaaggc

SEQ ID NO: 14644 - DNA, 20 bp, Artificial Sequence
  chemically synthesized
tagcattggaggtgaaggca

SEQ ID NO: 14645 - DNA, 20 bp, Artificial Sequence
  chemically synthesized
agcattggaggtgaaggcaa

SEQ ID NO: 14646 - DNA, 20 bp, Artificial Sequence
  chemically synthesized
gcattggaggtgaaggcaag

SEQ ID NO: 14647 - DNA, 20 bp, Artificial Sequence
  chemically synthesized
tggaggtgaaggcaaggggt

SEQ ID NO: 14648 - DNA, 20 bp, Artificial Sequence
  chemically synthesized
atcctttcacgaaaaaccaa

SEQ ID NO: 14649 - DNA, 20 bp, Artificial Sequence
  chemically synthesized
tcctttcacgaaaaaccaac

SEQ ID NO: 14650 - DNA, 20 bp, Artificial Sequence
  chemically synthesized
aaaccaacaggattttctga

SEQ ID NO: 14651 - DNA, 20 bp, Artificial Sequence
  chemically synthesized
accaacaggattttctgaca

SEQ ID NO: 14652 - DNA, 20 bp, Artificial Sequence
  chemically synthesized
ggattttctgacagagaata

SEQ ID NO: 14653 - DNA, 20 bp, Artificial Sequence
  chemically synthesized
tctgacagagaatatggaat

SEQ ID NO: 14654 - DNA, 20 bp, Artificial Sequence
  chemically synthesized
tgttgcactcatgcacactc

SEQ ID NO: 14655 - DNA, 20 bp, Artificial Sequence
  chemically synthesized
ctctagtgcatgctaatttc

SEQ ID NO: 14656 - DNA, 20 bp, Artificial Sequence
  chemically synthesized
gcatgctaatttctggctgt

SEQ ID NO: 14657 - DNA, 20 bp, Artificial Sequence
  chemically synthesized
ttctggctgtgagtatatgt

SEQ ID NO: 14658 - DNA, 20 bp, Artificial Sequence
  chemically synthesized
ctggctgtgagtatatgtca

SEQ ID NO: 14659 - DNA, 20 bp, Artificial Sequence
  chemically synthesized
ctgtgagtatatgtcagagt

SEQ ID NO: 14660 - DNA, 20 bp, Artificial Sequence
  chemically synthesized
tgtgagtatatgtcagagta

SEQ ID NO: 14661 - DNA, 20 bp, Artificial Sequence
  chemically synthesized
atgtcagagtaaggattttg

SEQ ID NO: 14662 - DNA, 20 bp, Artificial Sequence
  chemically synthesized
cagagtaaggattttgaagc

SEQ ID NO: 14663 - DNA, 20 bp, Artificial Sequence
  chemically synthesized
agagtaaggattttgaagct

SEQ ID NO: 14664 - DNA, 20 bp, Artificial Sequence
  chemically synthesized
aaggattttgaagctaggca

SEQ ID NO: 14665 - DNA, 20 bp, Artificial Sequence
  chemically synthesized
attttgaagctaggcaaagt

SEQ ID NO: 14666 - DNA, 20 bp, Artificial Sequence
  chemically synthesized
agctaggcaaagtgagtctt

SEQ ID NO: 14667 - DNA, 20 bp, Artificial Sequence
  chemically synthesized
gctaggcaaagtgagtcttt

SEQ ID NO: 14668 - DNA, 20 bp, Artificial Sequence
  chemically synthesized
tctttgggttgaattttgtc

SEQ ID NO: 14669 - DNA, 20 bp, Artificial Sequence
  chemically synthesized
ctttgggttgaattttgtca

SEQ ID NO: 14670 - DNA, 20 bp, Artificial Sequence
  chemically synthesized
gtcaaggtgtttgttcatca

SEQ ID NO: 14671 - DNA, 20 bp, Artificial Sequence
  chemically synthesized
gttcatcacagtctctacct

SEQ ID NO: 14672 - DNA, 20 bp, Artificial Sequence
  chemically synthesized
cacagtctctacctcagaat

SEQ ID NO: 14673 - DNA, 20 bp, Artificial Sequence
  chemically synthesized
ctcagaattggctttaaaat

SEQ ID NO: 14674 - DNA, 20 bp, Artificial Sequence
  chemically synthesized
gaattggctttaaaattgga

SEQ ID NO: 14675 - DNA, 20 bp, Artificial Sequence
  chemically synthesized
tggctttaaaattggaaagc

SEQ ID NO: 14676 - DNA, 20 bp, Artificial Sequence
  chemically synthesized
ggctttaaaattggaaagct

SEQ ID NO: 14677 - DNA, 20 bp, Artificial Sequence
  chemically synthesized
tttaaaattggaaagctggg

SEQ ID NO: 14678 - DNA, 20 bp, Artificial Sequence
  chemically synthesized
ttaaaattggaaagctgggt

SEQ ID NO: 14679 - DNA, 20 bp, Artificial Sequence
  chemically synthesized
aaattggaaagctgggtggg

SEQ ID NO: 14680 - DNA, 20 bp, Artificial Sequence
  chemically synthesized
gaaagctgggtgggtggata

SEQ ID NO: 14681 - DNA, 20 bp, Artificial Sequence
  chemically synthesized
gggtgggtggatatggaaat

SEQ ID NO: 14682 - DNA, 20 bp, Artificial Sequence
  chemically synthesized
tggaaatgagaaaccatctc

SEQ ID NO: 14683 - DNA, 20 bp, Artificial Sequence
  chemically synthesized
gaaatgagaaaccatctctg

SEQ ID NO: 14684 - DNA, 20 bp, Artificial Sequence
  chemically synthesized
ttgtctacacatcatacctt

SEQ ID NO: 14685 - DNA, 20 bp, Artificial Sequence
  chemically synthesized
acacatcatacctttagcca

SEQ ID NO: 14686 - DNA, 20 bp, Artificial Sequence
  chemically synthesized
cctttagccaaagtgacatc

SEQ ID NO: 14687 - DNA, 20 bp, Artificial Sequence
  chemically synthesized
aagtgacatcaagtatttct

SEQ ID NO: 14688 - DNA, 20 bp, Artificial Sequence
  chemically synthesized
agtatttcttggatgctgac

SEQ ID NO: 14689 - DNA, 20 bp, Artificial Sequence
  chemically synthesized
tatttcttggatgctgacca

SEQ ID NO: 14690 - DNA, 20 bp, Artificial Sequence
  chemically synthesized
atttcttggatgctgaccag

SEQ ID NO: 14691 - DNA, 20 bp, Artificial Sequence
  chemically synthesized
gatgctgaccagaggcttct

SEQ ID NO: 14692 - DNA, 20 bp, Artificial Sequence
  chemically synthesized
ctgaccagaggcttctgagc

SEQ ID NO: 14693 - DNA, 20 bp, Artificial Sequence
  chemically synthesized
tgaccagaggcttctgagcc

SEQ ID NO: 14694 - DNA, 20 bp, Artificial Sequence
  chemically synthesized
gcttctgagccaggcccctc

SEQ ID NO: 14695 - DNA, 20 bp, Artificial Sequence
  chemically synthesized
gagccaggcccctctagctg

SEQ ID NO: 14696 - DNA, 20 bp, Artificial Sequence
  chemically synthesized
agccaggcccctctagctga

SEQ ID NO: 14697 - DNA, 20 bp, Artificial Sequence
  chemically synthesized
caggcccctctagctgaagg

SEQ ID NO: 14698 - DNA, 20 bp, Artificial Sequence
  chemically synthesized
ctctagctgaaggaagttca

SEQ ID NO: 14699 - DNA, 20 bp, Artificial Sequence
  chemically synthesized
aggaagttcacagtttcttt

SEQ ID NO: 14700 - DNA, 20 bp, Artificial Sequence
  chemically synthesized
ggaagttcacagtttcttta

SEQ ID NO: 14701 - DNA, 20 bp, Artificial Sequence
  chemically synthesized
aagttcacagtttctttaag

SEQ ID NO: 14702 - DNA, 20 bp, Artificial Sequence
  chemically synthesized
agttcacagtttctttaagg

SEQ ID NO: 14703 - DNA, 20 bp, Artificial Sequence
  chemically synthesized
gttcacagtttctttaagga

SEQ ID NO: 14704 - DNA, 20 bp, Artificial Sequence
  chemically synthesized
gtttctttaaggagggaaaa

SEQ ID NO: 14705 - DNA, 20 bp, Artificial Sequence
  chemically synthesized
tctttaaggagggaaaatgg

SEQ ID NO: 14706 - DNA, 20 bp, Artificial Sequence
  chemically synthesized
aaggagggaaaatggtagat

SEQ ID NO: 14707 - DNA, 20 bp, Artificial Sequence
  chemically synthesized
agggaaaatggtagataagt

SEQ ID NO: 14708 - DNA, 20 bp, Artificial Sequence
  chemically synthesized
ggaaaatggtagataagtca

SEQ ID NO: 14709 - DNA, 20 bp, Artificial Sequence
  chemically synthesized
tagataagtcagagaacaat

SEQ ID NO: 14710 - DNA, 20 bp, Artificial Sequence
  chemically synthesized
taagtcagagaacaatcaga

SEQ ID NO: 14711 - DNA, 20 bp, Artificial Sequence
  chemically synthesized
caatcagacagaattctgtt

SEQ ID NO: 14712 - DNA, 20 bp, Artificial Sequence
  chemically synthesized
cagacagaattctgttcggt

SEQ ID NO: 14713 - DNA, 20 bp, Artificial Sequence
  chemically synthesized
agacagaattctgttcggtc

SEQ ID NO: 14714 - DNA, 20 bp, Artificial Sequence
  chemically synthesized
gacagaattctgttcggtca

SEQ ID NO: 14715 - DNA, 20 bp, Artificial Sequence
  chemically synthesized
tgttcggtcagggaatttga

SEQ ID NO: 14716 - DNA, 20 bp, Artificial Sequence
  chemically synthesized
gttcggtcagggaatttgat

SEQ ID NO: 14717 - DNA, 20 bp, Artificial Sequence
  chemically synthesized
tgtttgttttcgtttttctt

SEQ ID NO: 14718 - DNA, 20 bp, Artificial Sequence
  chemically synthesized
tgttttcgtttttctttaga

SEQ ID NO: 14719 - DNA, 20 bp, Artificial Sequence
  chemically synthesized
ttttcgtttttctttagaca

SEQ ID NO: 14720 - DNA, 20 bp, Artificial Sequence
  chemically synthesized
ctttagacagagtctcgctc

SEQ ID NO: 14721 - DNA, 20 bp, Artificial Sequence
  chemically synthesized
ttagacagagtctcgctctg

SEQ ID NO: 14722 - DNA, 20 bp, Artificial Sequence
  chemically synthesized
tagacagagtctcgctctgg

SEQ ID NO: 14723 - DNA, 20 bp, Artificial Sequence
  chemically synthesized
cagagtctcgctctggaggc

SEQ ID NO: 14724 - DNA, 20 bp, Artificial Sequence
  chemically synthesized
gagtctcgctctggaggctg

SEQ ID NO: 14725 - DNA, 20 bp, Artificial Sequence
  chemically synthesized
ctctggaggctggagtgcaa

SEQ ID NO: 14726 - DNA, 20 bp, Artificial Sequence
  chemically synthesized
gcaatggcatgatctctgct

SEQ ID NO: 14727 - DNA, 20 bp, Artificial Sequence
  chemically synthesized
cagtgcaaactccacctccc

SEQ ID NO: 14728 - DNA, 20 bp, Artificial Sequence
  chemically synthesized
aaactccacctccccggttc

SEQ ID NO: 14729 - DNA, 20 bp, Artificial Sequence
  chemically synthesized
ttcaagcgattctcctgcct

SEQ ID NO: 14730 - DNA, 20 bp, Artificial Sequence
  chemically synthesized
ttctcctgcctcagcctccc

SEQ ID NO: 14731 - DNA, 20 bp, Artificial Sequence
  chemically synthesized
tcctgcctcagcctcccaag

SEQ ID NO: 14732 - DNA, 20 bp, Artificial Sequence
  chemically synthesized
gcctcagcctcccaagtagt

SEQ ID NO: 14733 - DNA, 20 bp, Artificial Sequence
  chemically synthesized
cctcccaagtagttggatta

SEQ ID NO: 14734 - DNA, 20 bp, Artificial Sequence
  chemically synthesized
ctcccaagtagttggattac

SEQ ID NO: 14735 - DNA, 20 bp, Artificial Sequence
  chemically synthesized
caggctcccgtcaccacgtc

SEQ ID NO: 14736 - DNA, 20 bp, Artificial Sequence
  chemically synthesized
cagctaatttttatattttt

SEQ ID NO: 14737 - DNA, 20 bp, Artificial Sequence
  chemically synthesized
ctaatttttatatttttaag

SEQ ID NO: 14738 - DNA, 20 bp, Artificial Sequence
  chemically synthesized
aatttttatatttttaagca

SEQ ID NO: 14739 - DNA, 20 bp, Artificial Sequence
  chemically synthesized
ttatatttttaagcagagac

SEQ ID NO: 14740 - DNA, 20 bp, Artificial Sequence
  chemically synthesized
tatatttttaagcagagacc

SEQ ID NO: 14741 - DNA, 20 bp, Artificial Sequence
  chemically synthesized
gagaccaggtttcactatgt

SEQ ID NO: 14742 - DNA, 20 bp, Artificial Sequence
  chemically synthesized
ccaggtttcactatgttggc

SEQ ID NO: 14743 - DNA, 20 bp, Artificial Sequence
  chemically synthesized
caggtttcactatgttggct

SEQ ID NO: 14744 - DNA, 20 bp, Artificial Sequence
  chemically synthesized
tttcactatgttggctgggc

SEQ ID NO: 14745 - DNA, 20 bp, Artificial Sequence
  chemically synthesized
ggtgtccaactcctgacctc

SEQ ID NO: 14746 - DNA, 20 bp, Artificial Sequence
  chemically synthesized
ctcaagtgatctgcccacct

SEQ ID NO: 14747 - DNA, 20 bp, Artificial Sequence
  chemically synthesized
gtcccaaactgctgtgatta

SEQ ID NO: 14748 - DNA, 20 bp, Artificial Sequence
  chemically synthesized
tcccaaactgctgtgattac

SEQ ID NO: 14749 - DNA, 20 bp, Artificial Sequence
  chemically synthesized
ccaaactgctgtgattacag

SEQ ID NO: 14750 - DNA, 20 bp, Artificial Sequence
  chemically synthesized
actgctgtgattacaggagt

SEQ ID NO: 14751 - DNA, 20 bp, Artificial Sequence
  chemically synthesized
ggagtgagccaccgcacctc

SEQ ID NO: 14752 - DNA, 20 bp, Artificial Sequence
  chemically synthesized
gagtgagccaccgcacctca

SEQ ID NO: 14753 - DNA, 20 bp, Artificial Sequence
  chemically synthesized
acctcaaggaatttgatgtt

SEQ ID NO: 14754 - DNA, 20 bp, Artificial Sequence
  chemically synthesized
cctcaaggaatttgatgttt

SEQ ID NO: 14755 - DNA, 20 bp, Artificial Sequence
  chemically synthesized
ttaggctgtgacctctgcac

SEQ ID NO: 14756 - DNA, 20 bp, Artificial Sequence
  chemically synthesized
taggctgtgacctctgcact

SEQ ID NO: 14757 - DNA, 20 bp, Artificial Sequence
  chemically synthesized
tgtgacctctgcactaggaa

SEQ ID NO: 14758 - DNA, 20 bp, Artificial Sequence
  chemically synthesized
gacctctgcactaggaatgg

SEQ ID NO: 14759 - DNA, 20 bp, Artificial Sequence
  chemically synthesized
acctctgcactaggaatgga

SEQ ID NO: 14760 - DNA, 20 bp, Artificial Sequence
  chemically synthesized
ctgcactaggaatggaaggt

SEQ ID NO: 14761 - DNA, 20 bp, Artificial Sequence
  chemically synthesized
caccccacccttcgtcctgc

SEQ ID NO: 14762 - DNA, 20 bp, Artificial Sequence
  chemically synthesized
gcaagtacccaatcacactg

SEQ ID NO: 14763 - DNA, 20 bp, Artificial Sequence
  chemically synthesized
aagtacccaatcacactgca

SEQ ID NO: 14764 - DNA, 20 bp, Artificial Sequence
  chemically synthesized
agagccacacctgccttcct

SEQ ID NO: 14765 - DNA, 20 bp, Artificial Sequence
  chemically synthesized
agccacacctgccttcctta

SEQ ID NO: 14766 - DNA, 20 bp, Artificial Sequence
  chemically synthesized
gccacacctgccttccttag

SEQ ID NO: 14767 - DNA, 20 bp, Artificial Sequence
  chemically synthesized
ggcgtgcctccatccctgat

SEQ ID NO: 14768 - DNA, 20 bp, Artificial Sequence
  chemically synthesized
atgagtttttcctccatgtg

SEQ ID NO: 14769 - DNA, 20 bp, Artificial Sequence
  chemically synthesized
ctccatgtgtagaattgaat

SEQ ID NO: 14770 - DNA, 20 bp, Artificial Sequence
  chemically synthesized
catgtgtagaattgaataag

SEQ ID NO: 14771 - DNA, 20 bp, Artificial Sequence
  chemically synthesized
atgtgtagaattgaataaga

SEQ ID NO: 14772 - DNA, 20 bp, Artificial Sequence
  chemically synthesized
gtagaattgaataagaagga

SEQ ID NO: 14773 - DNA, 20 bp, Artificial Sequence
  chemically synthesized
aggatagaattcaatttaac

SEQ ID NO: 14774 - DNA, 20 bp, Artificial Sequence
  chemically synthesized
aattcaatttaacaagcttt

SEQ ID NO: 14775 - DNA, 20 bp, Artificial Sequence
  chemically synthesized
caagctttgagtacttccta

SEQ ID NO: 14776 - DNA, 20 bp, Artificial Sequence
  chemically synthesized
tttgagtacttcctatagcc

SEQ ID NO: 14777 - DNA, 20 bp, Artificial Sequence
  chemically synthesized
ttgagtacttcctatagcct

SEQ ID NO: 14778 - DNA, 20 bp, Artificial Sequence
  chemically synthesized
cattgtgctgacaactatgt

SEQ ID NO: 14779 - DNA, 20 bp, Artificial Sequence
  chemically synthesized
ttgtgctgacaactatgtta

SEQ ID NO: 14780 - DNA, 20 bp, Artificial Sequence
  chemically synthesized
gtgctgacaactatgttaga

SEQ ID NO: 14781 - DNA, 20 bp, Artificial Sequence
  chemically synthesized
gctgacaactatgttagaga

SEQ ID NO: 14782 - DNA, 20 bp, Artificial Sequence
  chemically synthesized
aactatgttagagagagaaa

SEQ ID NO: 14783 - DNA, 20 bp, Artificial Sequence
  chemically synthesized
tgttagagagagaaatagac

SEQ ID NO: 14784 - DNA, 20 bp, Artificial Sequence
  chemically synthesized
acaagctataaacttttcct

SEQ ID NO: 14785 - DNA, 20 bp, Artificial Sequence
  chemically synthesized
caagctataaacttttcctc

SEQ ID NO: 14786 - DNA, 20 bp, Artificial Sequence
  chemically synthesized
aggaccatctacataatttc

SEQ ID NO: 14787 - DNA, 20 bp, Artificial Sequence
  chemically synthesized
ggaccatctacataatttct

SEQ ID NO: 14788 - DNA, 20 bp, Artificial Sequence
  chemically synthesized
caatataaaatgaaaatgaa

SEQ ID NO: 14789 - DNA, 20 bp, Artificial Sequence
  chemically synthesized
tagcccctttgtcaaaaatt

SEQ ID NO: 14790 - DNA, 20 bp, Artificial Sequence
  chemically synthesized
agcccctttgtcaaaaatta

SEQ ID NO: 14791 - DNA, 20 bp, Artificial Sequence
  chemically synthesized
aaaaattaaggatttcatgt

SEQ ID NO: 14792 - DNA, 20 bp, Artificial Sequence
  chemically synthesized
aaaattaaggatttcatgtc

SEQ ID NO: 14793 - DNA, 20 bp, Artificial Sequence
  chemically synthesized
taaggatttcatgtcaggaa

SEQ ID NO: 14794 - DNA, 20 bp, Artificial Sequence
  chemically synthesized
gatttcatgtcaggaacagc

SEQ ID NO: 14795 - DNA, 20 bp, Artificial Sequence
  chemically synthesized
atttcatgtcaggaacagca

SEQ ID NO: 14796 - DNA, 20 bp, Artificial Sequence
  chemically synthesized
aacagcaaggatgttaaacc

SEQ ID NO: 14797 - DNA, 20 bp, Artificial Sequence
  chemically synthesized
caaggatgttaaaccaagca

SEQ ID NO: 14798 - DNA, 20 bp, Artificial Sequence
  chemically synthesized
aaggatgttaaaccaagcat

SEQ ID NO: 14799 - DNA, 20 bp, Artificial Sequence
  chemically synthesized
aggatgttaaaccaagcatg

SEQ ID NO: 14800 - DNA, 20 bp, Artificial Sequence
  chemically synthesized
aaaccaagcatggggccatc

SEQ ID NO: 14801 - DNA, 20 bp, Artificial Sequence
  chemically synthesized
attcatgatacgaaaaaata

SEQ ID NO: 14802 - DNA, 20 bp, Artificial Sequence
  chemically synthesized
tcatgatacgaaaaaataaa

SEQ ID NO: 14803 - DNA, 20 bp, Artificial Sequence
  chemically synthesized
cgaaaaaataaagagtattc

SEQ ID NO: 14804 - DNA, 20 bp, Artificial Sequence
  chemically synthesized
taaagagtattctagttatt

SEQ ID NO: 14805 - DNA, 20 bp, Artificial Sequence
  chemically synthesized
gttatttagccacatatttc

SEQ ID NO: 14806 - DNA, 20 bp, Artificial Sequence
  chemically synthesized
ttagccacatatttcaagtt

SEQ ID NO: 14807 - DNA, 20 bp, Artificial Sequence
  chemically synthesized
cactcaacctaaaacaatgc

SEQ ID NO: 14808 - DNA, 20 bp, Artificial Sequence
  chemically synthesized
taaaacaatgctagtctttc

SEQ ID NO: 14809 - DNA, 20 bp, Artificial Sequence
  chemically synthesized
agtctttctagacccatcca

SEQ ID NO: 14810 - DNA, 20 bp, Artificial Sequence
  chemically synthesized
taattaatttgtgatttaaa

SEQ ID NO: 14811 - DNA, 20 bp, Artificial Sequence
  chemically synthesized
gatttaaatggctcatattc

SEQ ID NO: 14812 - DNA, 20 bp, Artificial Sequence
  chemically synthesized
tcatattccagcctgtgcca

SEQ ID NO: 14813 - DNA, 20 bp, Artificial Sequence
  chemically synthesized
ttatctgtataaatactctt

SEQ ID NO: 14814 - DNA, 20 bp, Artificial Sequence
  chemically synthesized
tatctgtataaatactcttc

SEQ ID NO: 14815 - DNA, 20 bp, Artificial Sequence
  chemically synthesized
cttaatgtttgtgtttatgt

SEQ ID NO: 14816 - DNA, 20 bp, Artificial Sequence
  chemically synthesized
tatgttagatatgcatcatg

SEQ ID NO: 14817 - DNA, 20 bp, Artificial Sequence
  chemically synthesized
aaacatacacttgaaccaaa

SEQ ID NO: 14818 - DNA, 20 bp, Artificial Sequence
  chemically synthesized
aacatacacttgaaccaaaa

SEQ ID NO: 14819 - DNA, 20 bp, Artificial Sequence
  chemically synthesized
atacacttgaaccaaaaagg

SEQ ID NO: 14820 - DNA, 20 bp, Artificial Sequence
  chemically synthesized
ccaaaaaggaagtttttaca

SEQ ID NO: 14821 - DNA, 20 bp, Artificial Sequence
  chemically synthesized
aaatcttctctctgtgctct

SEQ ID NO: 14822 - DNA, 20 bp, Artificial Sequence
  chemically synthesized
tctgtgctcttagcgaaacc

SEQ ID NO: 14823 - DNA, 20 bp, Artificial Sequence
  chemically synthesized
gtgctcttagcgaaaccaag

SEQ ID NO: 14824 - DNA, 20 bp, Artificial Sequence
  chemically synthesized
tgctcttagcgaaaccaagt

SEQ ID NO: 14825 - DNA, 20 bp, Artificial Sequence
  chemically synthesized
gcgaaaccaagtaggctgac

SEQ ID NO: 14826 - DNA, 20 bp, Artificial Sequence
  chemically synthesized
gacaagacatcattcattca

SEQ ID NO: 14827 - DNA, 20 bp, Artificial Sequence
  chemically synthesized
cattcattcacagcgaaacc

SEQ ID NO: 14828 - DNA, 20 bp, Artificial Sequence
  chemically synthesized
tcattcacagcgaaaccgag

SEQ ID NO: 14829 - DNA, 20 bp, Artificial Sequence
  chemically synthesized
gcgaaaccgagtagactgac

SEQ ID NO: 14830 - DNA, 20 bp, Artificial Sequence
  chemically synthesized
gaaaccgagtagactgacaa

SEQ ID NO: 14831 - DNA, 20 bp, Artificial Sequence
  chemically synthesized
aaaccgagtagactgacaag

SEQ ID NO: 14832 - DNA, 20 bp, Artificial Sequence
  chemically synthesized
tcacaaatgaatacaaaaaa

SEQ ID NO: 14833 - DNA, 20 bp, Artificial Sequence
  chemically synthesized
tgaatacaaaaaacagtgtc

SEQ ID NO: 14834 - DNA, 20 bp, Artificial Sequence
  chemically synthesized
aaacagtgtcaagtatacgt

SEQ ID NO: 14835 - DNA, 20 bp, Artificial Sequence
  chemically synthesized
aacagtgtcaagtatacgtg

SEQ ID NO: 14836 - DNA, 20 bp, Artificial Sequence
  chemically synthesized
gtatacgtgaggtcctgtaa

SEQ ID NO: 14837 - DNA, 20 bp, Artificial Sequence
  chemically synthesized
tatacgtgaggtcctgtaat

SEQ ID NO: 14838 - DNA, 20 bp, Artificial Sequence
  chemically synthesized
tgaggtcctgtaatgggtcc

SEQ ID NO: 14839 - DNA, 20 bp, Artificial Sequence
  chemically synthesized
gaggtcctgtaatgggtcct

SEQ ID NO: 14840 - DNA, 20 bp, Artificial Sequence
  chemically synthesized
ctgggcctgcaaaaccctca

SEQ ID NO: 14841 - DNA, 20 bp, Artificial Sequence
  chemically synthesized
ccctcacagctgctaacctc

SEQ ID NO: 14842 - DNA, 20 bp, Artificial Sequence
  chemically synthesized
tcacagctgctaacctcaag

SEQ ID NO: 14843 - DNA, 20 bp, Artificial Sequence
  chemically synthesized
gctgctaacctcaagaagct

SEQ ID NO: 14844 - DNA, 20 bp, Artificial Sequence
  chemically synthesized
gctaacctcaagaagctcag

SEQ ID NO: 14845 - DNA, 20 bp, Artificial Sequence
  chemically synthesized
taacctcaagaagctcagtg

SEQ ID NO: 14846 - DNA, 20 bp, Artificial Sequence
  chemically synthesized
taaatttgttcctttttgta

SEQ ID NO: 14847 - DNA, 20 bp, Artificial Sequence
  chemically synthesized
tcctttttgtatagttcctt

SEQ ID NO: 14848 - DNA, 20 bp, Artificial Sequence
  chemically synthesized
tttgccactgtgaactccta

SEQ ID NO: 14849 - DNA, 20 bp, Artificial Sequence
  chemically synthesized
gccactgtgaactcctacag

SEQ ID NO: 14850 - DNA, 20 bp, Artificial Sequence
  chemically synthesized
ctgtgaactcctacagaagc

SEQ ID NO: 14851 - DNA, 20 bp, Artificial Sequence
  chemically synthesized
tcctacagaagccagcttca

SEQ ID NO: 14852 - DNA, 20 bp, Artificial Sequence
  chemically synthesized
cagcttcaaagccattcttc

SEQ ID NO: 14853 - DNA, 20 bp, Artificial Sequence
  chemically synthesized
cttcaaagccattcttctgg

SEQ ID NO: 14854 - DNA, 20 bp, Artificial Sequence
  chemically synthesized
cctcctgttttttctcccac

SEQ ID NO: 14855 - DNA, 20 bp, Artificial Sequence
  chemically synthesized
cattgtttttcatcctcttg

SEQ ID NO: 14856 - DNA, 20 bp, Artificial Sequence
  chemically synthesized
catcctcttgtagtccttca

SEQ ID NO: 14857 - DNA, 20 bp, Artificial Sequence
  chemically synthesized
gtccttcacagttacccaca

SEQ ID NO: 14858 - DNA, 20 bp, Artificial Sequence
  chemically synthesized
tccttcacagttacccacac

SEQ ID NO: 14859 - DNA, 20 bp, Artificial Sequence
  chemically synthesized
cccacacaggtgaacccttt

SEQ ID NO: 14860 - DNA, 20 bp, Artificial Sequence
  chemically synthesized
gtgaacccttttagctctcc

SEQ ID NO: 14861 - DNA, 20 bp, Artificial Sequence
  chemically synthesized
gaacccttttagctctcctg

SEQ ID NO: 14862 - DNA, 20 bp, Artificial Sequence
  chemically synthesized
aacccttttagctctcctgg

SEQ ID NO: 14863 - DNA, 20 bp, Artificial Sequence
  chemically synthesized
gaggaatgtttctttcctct

SEQ ID NO: 14864 - DNA, 20 bp, Artificial Sequence
  chemically synthesized
aggaatgtttctttcctctc

SEQ ID NO: 14865 - DNA, 20 bp, Artificial Sequence
  chemically synthesized
tgtttctttcctctcaggat

SEQ ID NO: 14866 - DNA, 20 bp, Artificial Sequence
  chemically synthesized
tttctttcctctcaggatca

SEQ ID NO: 14867 - DNA, 20 bp, Artificial Sequence
  chemically synthesized
ctacatcttcctaatgcacc

SEQ ID NO: 14868 - DNA, 20 bp, Artificial Sequence
  chemically synthesized
tcttcctaatgcaccaagac

SEQ ID NO: 14869 - DNA, 20 bp, Artificial Sequence
  chemically synthesized
taatgcaccaagactggcct

SEQ ID NO: 14870 - DNA, 20 bp, Artificial Sequence
  chemically synthesized
ctggcctgagatgtatcctt

SEQ ID NO: 14871 - DNA, 20 bp, Artificial Sequence
  chemically synthesized
ctgagatgtatccttaagat

SEQ ID NO: 14872 - DNA, 20 bp, Artificial Sequence
  chemically synthesized
gagatgtatccttaagatga

SEQ ID NO: 14873 - DNA, 20 bp, Artificial Sequence
  chemically synthesized
tccttaagatgagagcttcc

SEQ ID NO: 14874 - DNA, 20 bp, Artificial Sequence
  chemically synthesized
ttaagatgagagcttcccag

SEQ ID NO: 14875 - DNA, 20 bp, Artificial Sequence
  chemically synthesized
gagcttcccagtagcacccc

SEQ ID NO: 14876 - DNA, 20 bp, Artificial Sequence
  chemically synthesized
ttcccagtagcaccccaagt

SEQ ID NO: 14877 - DNA, 20 bp, Artificial Sequence
  chemically synthesized
tcagatctgaccccgtatgt

SEQ ID NO: 14878 - DNA, 20 bp, Artificial Sequence
  chemically synthesized
tgtgagcatgtgtcctctaa

SEQ ID NO: 14879 - DNA, 20 bp, Artificial Sequence
  chemically synthesized
gcatgtgtcctctaacagca

SEQ ID NO: 14880 - DNA, 20 bp, Artificial Sequence
  chemically synthesized
catgtgtcctctaacagcac

SEQ ID NO: 14881 - DNA, 20 bp, Artificial Sequence
  chemically synthesized
agcacaggccttttgccacc

SEQ ID NO: 14882 - DNA, 20 bp, Artificial Sequence
  chemically synthesized
ccttttgccacctagctgtc

SEQ ID NO: 14883 - DNA, 20 bp, Artificial Sequence
  chemically synthesized
cttttgccacctagctgtcc

SEQ ID NO: 14884 - DNA, 20 bp, Artificial Sequence
  chemically synthesized
ttttgccacctagctgtcca

SEQ ID NO: 14885 - DNA, 20 bp, Artificial Sequence
  chemically synthesized
tttgccacctagctgtccag

SEQ ID NO: 14886 - DNA, 20 bp, Artificial Sequence
  chemically synthesized
tgtccaggggtgccttaaaa

SEQ ID NO: 14887 - DNA, 20 bp, Artificial Sequence
  chemically synthesized
ggtgccttaaaatggcaaac

SEQ ID NO: 14888 - DNA, 20 bp, Artificial Sequence
  chemically synthesized
gtgccttaaaatggcaaaca

SEQ ID NO: 14889 - DNA, 20 bp, Artificial Sequence
  chemically synthesized
ttcatattaatacatgtgta

SEQ ID NO: 14890 - DNA, 20 bp, Artificial Sequence
  chemically synthesized
tctatacacatgtattaata

SEQ ID NO: 14891 - DNA, 20 bp, Artificial Sequence
  chemically synthesized
aagcctgattctgccgcttc

SEQ ID NO: 14892 - DNA, 20 bp, Artificial Sequence
  chemically synthesized
agcctgattctgccgcttct

SEQ ID NO: 14893 - DNA, 20 bp, Artificial Sequence
  chemically synthesized
gattctgccgcttctaggta

SEQ ID NO: 14894 - DNA, 20 bp, Artificial Sequence
  chemically synthesized
ttctgccgcttctaggtata

SEQ ID NO: 14895 - DNA, 20 bp, Artificial Sequence
  chemically synthesized
tctgccgcttctaggtatag

SEQ ID NO: 14896 - DNA, 20 bp, Artificial Sequence
  chemically synthesized
taggtatagaggccacctgc

SEQ ID NO: 14897 - DNA, 20 bp, Artificial Sequence
  chemically synthesized
cacaataactaatcattcta

SEQ ID NO: 14898 - DNA, 20 bp, Artificial Sequence
  chemically synthesized
tgtatatatatatatatatt

SEQ ID NO: 14899 - DNA, 20 bp, Artificial Sequence
  chemically synthesized
gtatatatatatatatattc

SEQ ID NO: 14900 - DNA, 20 bp, Artificial Sequence
  chemically synthesized
attcaggaaataatatattc

SEQ ID NO: 14901 - DNA, 20 bp, Artificial Sequence
  chemically synthesized
gaatatgtcacattctgtct

SEQ ID NO: 14902 - DNA, 20 bp, Artificial Sequence
  chemically synthesized
aatatgtcacattctgtctc

SEQ ID NO: 14903 - DNA, 20 bp, Artificial Sequence
  chemically synthesized
ttttctttatgatgccgttt

SEQ ID NO: 14904 - DNA, 20 bp, Artificial Sequence
  chemically synthesized
tttctttatgatgccgtttg

SEQ ID NO: 14905 - DNA, 20 bp, Artificial Sequence
  chemically synthesized
ctttatgatgccgtttgagg

SEQ ID NO: 14906 - DNA, 20 bp, Artificial Sequence
  chemically synthesized
ttatgatgccgtttgaggtg

SEQ ID NO: 14907 - DNA, 20 bp, Artificial Sequence
  chemically synthesized
tgccgtttgaggtggagttt

SEQ ID NO: 14908 - DNA, 20 bp, Artificial Sequence
  chemically synthesized
gtttgaggtggagttttagt

SEQ ID NO: 14909 - DNA, 20 bp, Artificial Sequence
  chemically synthesized
tttgaggtggagttttagtc

SEQ ID NO: 14910 - DNA, 20 bp, Artificial Sequence
  chemically synthesized
gaggtggagttttagtcagg

SEQ ID NO: 14911 - DNA, 20 bp, Artificial Sequence
  chemically synthesized
tggagttttagtcaggtggt

SEQ ID NO: 14912 - DNA, 20 bp, Artificial Sequence
  chemically synthesized
ttttttgccatctgccctgt

SEQ ID NO: 14913 - DNA, 20 bp, Artificial Sequence
  chemically synthesized
ctgccctgtaagcatcctgc

SEQ ID NO: 14914 - DNA, 20 bp, Artificial Sequence
  chemically synthesized
tgccctgtaagcatcctgct

SEQ ID NO: 14915 - DNA, 20 bp, Artificial Sequence
  chemically synthesized
gccctgtaagcatcctgctg

SEQ ID NO: 14916 - DNA, 20 bp, Artificial Sequence
  chemically synthesized
taagcatcctgctggggacc

SEQ ID NO: 14917 - DNA, 20 bp, Artificial Sequence
  chemically synthesized
catcctgctggggacccaga

SEQ ID NO: 14918 - DNA, 20 bp, Artificial Sequence
  chemically synthesized
atcctgctggggacccagat

SEQ ID NO: 14919 - DNA, 20 bp, Artificial Sequence
  chemically synthesized
cctgctggggacccagatag

SEQ ID NO: 14920 - DNA, 20 bp, Artificial Sequence
  chemically synthesized
ccagataggagtcatcactc

SEQ ID NO: 14921 - DNA, 20 bp, Artificial Sequence
  chemically synthesized
cagataggagtcatcactct

SEQ ID NO: 14922 - DNA, 20 bp, Artificial Sequence
  chemically synthesized
aggagtcatcactctaggct

SEQ ID NO: 14923 - DNA, 20 bp, Artificial Sequence
  chemically synthesized
cactctaggctgagaacatc

SEQ ID NO: 14924 - DNA, 20 bp, Artificial Sequence
  chemically synthesized
actctaggctgagaacatct

SEQ ID NO: 14925 - DNA, 20 bp, Artificial Sequence
  chemically synthesized
aacatctgggcacacaccct

SEQ ID NO: 14926 - DNA, 20 bp, Artificial Sequence
  chemically synthesized
tgggcacacaccctaagcct

SEQ ID NO: 14927 - DNA, 20 bp, Artificial Sequence
  chemically synthesized
cagcatgactcatcatgact

SEQ ID NO: 14928 - DNA, 20 bp, Artificial Sequence
  chemically synthesized
gactcagcattgctgtgctt

SEQ ID NO: 14929 - DNA, 20 bp, Artificial Sequence
  chemically synthesized
cagcattgctgtgcttgagc

SEQ ID NO: 14930 - DNA, 20 bp, Artificial Sequence
  chemically synthesized
cattgctgtgcttgagccag

SEQ ID NO: 14931 - DNA, 20 bp, Artificial Sequence
  chemically synthesized
attgctgtgcttgagccaga

SEQ ID NO: 14932 - DNA, 20 bp, Artificial Sequence
  chemically synthesized
cttgagccagaaggtttgct

SEQ ID NO: 14933 - DNA, 20 bp, Artificial Sequence
  chemically synthesized
gagccagaaggtttgcttag

SEQ ID NO: 14934 - DNA, 20 bp, Artificial Sequence
  chemically synthesized
agccagaaggtttgcttaga

SEQ ID NO: 14935 - DNA, 20 bp, Artificial Sequence
  chemically synthesized
ggtttgcttagaaggttaca

SEQ ID NO: 14936 - DNA, 20 bp, Artificial Sequence
  chemically synthesized
cttagaaggttacacagaac

SEQ ID NO: 14937 - DNA, 20 bp, Artificial Sequence
  chemically synthesized
agaaggttacacagaaccag

SEQ ID NO: 14938 - DNA, 20 bp, Artificial Sequence
  chemically synthesized
gaaggttacacagaaccaga

SEQ ID NO: 14939 - DNA, 20 bp, Artificial Sequence
  chemically synthesized
ggttacacagaaccagaagg

SEQ ID NO: 14940 - DNA, 20 bp, Artificial Sequence
  chemically synthesized
gttacacagaaccagaaggc

SEQ ID NO: 14941 - DNA, 20 bp, Artificial Sequence
  chemically synthesized
ttacacagaaccagaaggcg

SEQ ID NO: 14942 - DNA, 20 bp, Artificial Sequence
  chemically synthesized
tacacagaaccagaaggcgg

SEQ ID NO: 14943 - DNA, 20 bp, Artificial Sequence
  chemically synthesized
acagaaccagaaggcggggg

SEQ ID NO: 14944 - DNA, 20 bp, Artificial Sequence
  chemically synthesized
cagaaccagaaggcgggggt

SEQ ID NO: 14945 - DNA, 20 bp, Artificial Sequence
  chemically synthesized
agaaccagaaggcgggggtg

SEQ ID NO: 14946 - DNA, 20 bp, Artificial Sequence
  chemically synthesized
gggtggggcactgaccccga

SEQ ID NO: 14947 - DNA, 20 bp, Artificial Sequence
  chemically synthesized
ggtggggcactgaccccgac

SEQ ID NO: 14948 - DNA, 20 bp, Artificial Sequence
  chemically synthesized
gtggggcactgaccccgaca

SEQ ID NO: 14949 - DNA, 20 bp, Artificial Sequence
  chemically synthesized
tggggcactgaccccgacag

SEQ ID NO: 14950 - DNA, 20 bp, Artificial Sequence
  chemically synthesized
cactgaccccgacaggggcc

SEQ ID NO: 14951 - DNA, 20 bp, Artificial Sequence
  chemically synthesized
gaccccgacaggggcctggc

SEQ ID NO: 14952 - DNA, 20 bp, Artificial Sequence
  chemically synthesized
tggccagaactgctcatgct

SEQ ID NO: 14953 - DNA, 20 bp, Artificial Sequence
  chemically synthesized
aactgctcatgcttggacta

SEQ ID NO: 14954 - DNA, 20 bp, Artificial Sequence
  chemically synthesized
actgctcatgcttggactat

SEQ ID NO: 14955 - DNA, 20 bp, Artificial Sequence
  chemically synthesized
tgctcatgcttggactatgg

SEQ ID NO: 14956 - DNA, 20 bp, Artificial Sequence
  chemically synthesized
gctcatgcttggactatggg

SEQ ID NO: 14957 - DNA, 20 bp, Artificial Sequence
  chemically synthesized
ggactatgggaggtcactaa

SEQ ID NO: 14958 - DNA, 20 bp, Artificial Sequence
  chemically synthesized
actatgggaggtcactaatg

SEQ ID NO: 14959 - DNA, 20 bp, Artificial Sequence
  chemically synthesized
aggtcactaatggagacaca

SEQ ID NO: 14960 - DNA, 20 bp, Artificial Sequence
  chemically synthesized
ggagacacacagaaatgtaa

SEQ ID NO: 14961 - DNA, 20 bp, Artificial Sequence
  chemically synthesized
gagacacacagaaatgtaac

SEQ ID NO: 14962 - DNA, 20 bp, Artificial Sequence
  chemically synthesized
acagaaatgtaacaggaact

SEQ ID NO: 14963 - DNA, 20 bp, Artificial Sequence
  chemically synthesized
cagaaatgtaacaggaacta

SEQ ID NO: 14964 - DNA, 20 bp, Artificial Sequence
  chemically synthesized
caggaactaaggaaaaactg

SEQ ID NO: 14965 - DNA, 20 bp, Artificial Sequence
  chemically synthesized
aaaactgaagcttatttaat

SEQ ID NO: 14966 - DNA, 20 bp, Artificial Sequence
  chemically synthesized
aactgaagcttatttaatca

SEQ ID NO: 14967 - DNA, 20 bp, Artificial Sequence
  chemically synthesized
aagcttatttaatcagagat

SEQ ID NO: 14968 - DNA, 20 bp, Artificial Sequence
  chemically synthesized
agcttatttaatcagagatg

SEQ ID NO: 14969 - DNA, 20 bp, Artificial Sequence
  chemically synthesized
ttaatcagagatgaggatgc

SEQ ID NO: 14970 - DNA, 20 bp, Artificial Sequence
  chemically synthesized
atcagagatgaggatgctgg

SEQ ID NO: 14971 - DNA, 20 bp, Artificial Sequence
  chemically synthesized
tcagagatgaggatgctgga

SEQ ID NO: 14972 - DNA, 20 bp, Artificial Sequence
  chemically synthesized
cagagatgaggatgctggaa

SEQ ID NO: 14973 - DNA, 20 bp, Artificial Sequence
  chemically synthesized
gatgaggatgctggaaggga

SEQ ID NO: 14974 - DNA, 20 bp, Artificial Sequence
  chemically synthesized
tgaggatgctggaagggata

SEQ ID NO: 14975 - DNA, 20 bp, Artificial Sequence
  chemically synthesized
gaggatgctggaagggatag

SEQ ID NO: 14976 - DNA, 20 bp, Artificial Sequence
  chemically synthesized
aggatgctggaagggataga

SEQ ID NO: 14977 - DNA, 20 bp, Artificial Sequence
  chemically synthesized
gatgctggaagggatagagg

SEQ ID NO: 14978 - DNA, 20 bp, Artificial Sequence
  chemically synthesized
tggaagggatagagggagct

SEQ ID NO: 14979 - DNA, 20 bp, Artificial Sequence
  chemically synthesized
gagggagctgagcttgtaaa

SEQ ID NO: 14980 - DNA, 20 bp, Artificial Sequence
  chemically synthesized
agctgagcttgtaaaaagta

SEQ ID NO: 14981 - DNA, 20 bp, Artificial Sequence
  chemically synthesized
taaaaagtatagtaatcatt

SEQ ID NO: 14982 - DNA, 20 bp, Artificial Sequence
  chemically synthesized
tatagtaatcattcagcaaa

SEQ ID NO: 14983 - DNA, 20 bp, Artificial Sequence
  chemically synthesized
tcattcagcaaatggttttg

SEQ ID NO: 14984 - DNA, 20 bp, Artificial Sequence
  chemically synthesized
aatggttttgaagcacctgc

SEQ ID NO: 14985 - DNA, 20 bp, Artificial Sequence
  chemically synthesized
tggatgctaaacactatttt

SEQ ID NO: 14986 - DNA, 20 bp, Artificial Sequence
  chemically synthesized
tcagtgcttgaatcataaat

SEQ ID NO: 14987 - DNA, 20 bp, Artificial Sequence
  chemically synthesized
acatgtatcttattccccac

SEQ ID NO: 14988 - DNA, 20 bp, Artificial Sequence
  chemically synthesized
atgtatcttattccccacaa

SEQ ID NO: 14989 - DNA, 20 bp, Artificial Sequence
  chemically synthesized
cttattccccacaagagtcc

SEQ ID NO: 14990 - DNA, 20 bp, Artificial Sequence
  chemically synthesized
agagtccaagtaaaaaataa

SEQ ID NO: 14991 - DNA, 20 bp, Artificial Sequence
  chemically synthesized
ttataatgtgctctgtcccc

SEQ ID NO: 14992 - DNA, 20 bp, Artificial Sequence
  chemically synthesized
tataatgtgctctgtccccc

SEQ ID NO: 14993 - DNA, 20 bp, Artificial Sequence
  chemically synthesized
atgtgctctgtcccccaggc

SEQ ID NO: 14994 - DNA, 20 bp, Artificial Sequence
  chemically synthesized
gtgctctgtcccccaggctg

SEQ ID NO: 14995 - DNA, 20 bp, Artificial Sequence
  chemically synthesized
ctgtcccccaggctggagtg

SEQ ID NO: 14996 - DNA, 20 bp, Artificial Sequence
  chemically synthesized
tcccccaggctggagtgcag

SEQ ID NO: 14997 - DNA, 20 bp, Artificial Sequence
  chemically synthesized
ggagtgcagtggcacgatct

SEQ ID NO: 14998 - DNA, 20 bp, Artificial Sequence
  chemically synthesized
tcactgcaacctccgcctcc

SEQ ID NO: 14999 - DNA, 20 bp, Artificial Sequence
  chemically synthesized
cactgcaacctccgcctccc

SEQ ID NO: 15000 - DNA, 20 bp, Artificial Sequence
  chemically synthesized
aacctccgcctcccgggttc

SEQ ID NO: 15001 - DNA, 20 bp, Artificial Sequence
  chemically synthesized
ttcaagcaattctcctgcct

SEQ ID NO: 15002 - DNA, 20 bp, Artificial Sequence
  chemically synthesized
tcctgcctcagccaccctaa

SEQ ID NO: 15003 - DNA, 20 bp, Artificial Sequence
  chemically synthesized
gcctcagccaccctaatagc

SEQ ID NO: 15004 - DNA, 20 bp, Artificial Sequence
  chemically synthesized
cctcagccaccctaatagct

SEQ ID NO: 15005 - DNA, 20 bp, Artificial Sequence
  chemically synthesized
caccctaatagctgggatta

SEQ ID NO: 15006 - DNA, 20 bp, Artificial Sequence
  chemically synthesized
accctaatagctgggattac

SEQ ID NO: 15007 - DNA, 20 bp, Artificial Sequence
  chemically synthesized
acaggtgcacaccaccatgc

SEQ ID NO: 15008 - DNA, 20 bp, Artificial Sequence
  chemically synthesized
caggtgcacaccaccatgcc

SEQ ID NO: 15009 - DNA, 20 bp, Artificial Sequence
  chemically synthesized
gctaatttttgtactttttg

SEQ ID NO: 15010 - DNA, 20 bp, Artificial Sequence
  chemically synthesized
taatttttgtactttttgta

SEQ ID NO: 15011 - DNA, 20 bp, Artificial Sequence
  chemically synthesized
aatttttgtactttttgtag

SEQ ID NO: 15012 - DNA, 20 bp, Artificial Sequence
  chemically synthesized
ttttgtactttttgtagagg

SEQ ID NO: 15013 - DNA, 20 bp, Artificial Sequence
  chemically synthesized
tttgtactttttgtagaggc

SEQ ID NO: 15014 - DNA, 20 bp, Artificial Sequence
  chemically synthesized
ttgtactttttgtagaggca

SEQ ID NO: 15015 - DNA, 20 bp, Artificial Sequence
  chemically synthesized
agggtatcaccatgttgtcc

SEQ ID NO: 15016 - DNA, 20 bp, Artificial Sequence
  chemically synthesized
tatcaccatgttgtccaaga

SEQ ID NO: 15017 - DNA, 20 bp, Artificial Sequence
  chemically synthesized
caagatggtcttgaactcct

SEQ ID NO: 15018 - DNA, 20 bp, Artificial Sequence
  chemically synthesized
gtcttgaactcctgagctcc

SEQ ID NO: 15019 - DNA, 20 bp, Artificial Sequence
  chemically synthesized
ttgaactcctgagctccaag

SEQ ID NO: 15020 - DNA, 20 bp, Artificial Sequence
  chemically synthesized
tccaagcagtccacccacct

SEQ ID NO: 15021 - DNA, 20 bp, Artificial Sequence
  chemically synthesized
ccacccacctcagcctccca

SEQ ID NO: 15022 - DNA, 20 bp, Artificial Sequence
  chemically synthesized
acctcagcctcccaaagtgc

SEQ ID NO: 15023 - DNA, 20 bp, Artificial Sequence
  chemically synthesized
cctcagcctcccaaagtgct

SEQ ID NO: 15024 - DNA, 20 bp, Artificial Sequence
  chemically synthesized
ctcccaaagtgctgggatta

SEQ ID NO: 15025 - DNA, 20 bp, Artificial Sequence
  chemically synthesized
tcccaaagtgctgggattac

SEQ ID NO: 15026 - DNA, 20 bp, Artificial Sequence
  chemically synthesized
agtgctgggattacaggtgt

SEQ ID NO: 15027 - DNA, 20 bp, Artificial Sequence
  chemically synthesized
caggtgtgagacaccatgcc

SEQ ID NO: 15028 - DNA, 20 bp, Artificial Sequence
  chemically synthesized
cccagattttccatatttaa

SEQ ID NO: 15029 - DNA, 20 bp, Artificial Sequence
  chemically synthesized
cagattttccatatttaata

SEQ ID NO: 15030 - DNA, 20 bp, Artificial Sequence
  chemically synthesized
agattttccatatttaatag

SEQ ID NO: 15031 - DNA, 20 bp, Artificial Sequence
  chemically synthesized
atatttaatagaggtattta

SEQ ID NO: 15032 - DNA, 20 bp, Artificial Sequence
  chemically synthesized
tatttaatagaggtatttat

SEQ ID NO: 15033 - DNA, 20 bp, Artificial Sequence
  chemically synthesized
taatagaggtatttatggga

SEQ ID NO: 15034 - DNA, 20 bp, Artificial Sequence
  chemically synthesized
aatagaggtatttatgggat

SEQ ID NO: 15035 - DNA, 20 bp, Artificial Sequence
  chemically synthesized
atagaggtatttatgggatg

SEQ ID NO: 15036 - DNA, 20 bp, Artificial Sequence
  chemically synthesized
tagaggtatttatgggatgg

SEQ ID NO: 15037 - DNA, 20 bp, Artificial Sequence
  chemically synthesized
gtatttatgggatgggggaa

SEQ ID NO: 15038 - DNA, 20 bp, Artificial Sequence
  chemically synthesized
aaagaatgtttctctcactg

SEQ ID NO: 15039 - DNA, 20 bp, Artificial Sequence
  chemically synthesized
tctctcactgtggattattt

SEQ ID NO: 15040 - DNA, 20 bp, Artificial Sequence
  chemically synthesized
tctcactgtggattatttta

SEQ ID NO: 15041 - DNA, 20 bp, Artificial Sequence
  chemically synthesized
tcactgtggattattttaga

SEQ ID NO: 15042 - DNA, 20 bp, Artificial Sequence
  chemically synthesized
ctgtggattattttagagag

SEQ ID NO: 15043 - DNA, 20 bp, Artificial Sequence
  chemically synthesized
gtggattattttagagagtg

SEQ ID NO: 15044 - DNA, 20 bp, Artificial Sequence
  chemically synthesized
ttattttagagagtggagaa

SEQ ID NO: 15045 - DNA, 20 bp, Artificial Sequence
  chemically synthesized
ttagagagtggagaatggtc

SEQ ID NO: 15046 - DNA, 20 bp, Artificial Sequence
  chemically synthesized
tcaagatttttttaaaaatt

SEQ ID NO: 15047 - DNA, 20 bp, Artificial Sequence
  chemically synthesized
tttaaaaattaagaaaacat

SEQ ID NO: 15048 - DNA, 20 bp, Artificial Sequence
  chemically synthesized
aaaattaagaaaacataagt

SEQ ID NO: 15049 - DNA, 20 bp, Artificial Sequence
  chemically synthesized
gaaaacataagttggacctt

SEQ ID NO: 15050 - DNA, 20 bp, Artificial Sequence
  chemically synthesized
atgaaaatttatttttttgt

SEQ ID NO: 15051 - DNA, 20 bp, Artificial Sequence
  chemically synthesized
gaaaatttatttttttgttg

SEQ ID NO: 15052 - DNA, 20 bp, Artificial Sequence
  chemically synthesized
aaaatttatttttttgttgg

SEQ ID NO: 15053 - DNA, 20 bp, Artificial Sequence
  chemically synthesized
acccattctctatctcccat

SEQ ID NO: 15054 - DNA, 20 bp, Artificial Sequence
  chemically synthesized
cccattctctatctcccatc

SEQ ID NO: 15055 - DNA, 20 bp, Artificial Sequence
  chemically synthesized
ccattctctatctcccatca

SEQ ID NO: 15056 - DNA, 20 bp, Artificial Sequence
  chemically synthesized
tctctatctcccatcagggc

SEQ ID NO: 15057 - DNA, 20 bp, Artificial Sequence
  chemically synthesized
ctcccatcagggcaagctgt

SEQ ID NO: 15058 - DNA, 20 bp, Artificial Sequence
  chemically synthesized
tcccatcagggcaagctgta

SEQ ID NO: 15059 - DNA, 20 bp, Artificial Sequence
  chemically synthesized
cagggcaagctgtaaggaac

SEQ ID NO: 15060 - DNA, 20 bp, Artificial Sequence
  chemically synthesized
caagctgtaaggaactggct

SEQ ID NO: 15061 - DNA, 20 bp, Artificial Sequence
  chemically synthesized
gtaaggaactggctaagaca

SEQ ID NO: 15062 - DNA, 20 bp, Artificial Sequence
  chemically synthesized
ggaactggctaagacacagt

SEQ ID NO: 15063 - DNA, 20 bp, Artificial Sequence
  chemically synthesized
ctggctaagacacagtgaga

SEQ ID NO: 15064 - DNA, 20 bp, Artificial Sequence
  chemically synthesized
ggctaagacacagtgagaca

SEQ ID NO: 15065 - DNA, 20 bp, Artificial Sequence
  chemically synthesized
cacagtgagacagagtgact

SEQ ID NO: 15066 - DNA, 20 bp, Artificial Sequence
  chemically synthesized
gagacagagtgacttagtct

SEQ ID NO: 15067 - DNA, 20 bp, Artificial Sequence
  chemically synthesized
gacagagtgacttagtctta

SEQ ID NO: 15068 - DNA, 20 bp, Artificial Sequence
  chemically synthesized
acagagtgacttagtcttag

SEQ ID NO: 15069 - DNA, 20 bp, Artificial Sequence
  chemically synthesized
cttagtcttagaggccccac

SEQ ID NO: 15070 - DNA, 20 bp, Artificial Sequence
  chemically synthesized
ttagaggccccactggtacc

SEQ ID NO: 15071 - DNA, 20 bp, Artificial Sequence
  chemically synthesized
ggccccactggtacccagat

SEQ ID NO: 15072 - DNA, 20 bp, Artificial Sequence
  chemically synthesized
cccactggtacccagatgag

SEQ ID NO: 15073 - DNA, 20 bp, Artificial Sequence
  chemically synthesized
ccactggtacccagatgaga

SEQ ID NO: 15074 - DNA, 20 bp, Artificial Sequence
  chemically synthesized
ggcaccttcatcactcatca

SEQ ID NO: 15075 - DNA, 20 bp, Artificial Sequence
  chemically synthesized
ccttcatcactcatcacagt

SEQ ID NO: 15076 - DNA, 20 bp, Artificial Sequence
  chemically synthesized
tctcctctctcctttctcat

SEQ ID NO: 15077 - DNA, 20 bp, Artificial Sequence
  chemically synthesized
tttctcatcagaaatttcat

SEQ ID NO: 15078 - DNA, 20 bp, Artificial Sequence
  chemically synthesized
cagaaatttcataagtctac

SEQ ID NO: 15079 - DNA, 20 bp, Artificial Sequence
  chemically synthesized
agaaatttcataagtctact

SEQ ID NO: 15080 - DNA, 20 bp, Artificial Sequence
  chemically synthesized
gaaatttcataagtctacta

SEQ ID NO: 15081 - DNA, 20 bp, Artificial Sequence
  chemically synthesized
tttcataagtctactagggt

SEQ ID NO: 15082 - DNA, 20 bp, Artificial Sequence
  chemically synthesized
ttcataagtctactagggtc

SEQ ID NO: 15083 - DNA, 20 bp, Artificial Sequence
  chemically synthesized
ataagtctactagggtcagg

SEQ ID NO: 15084 - DNA, 20 bp, Artificial Sequence
  chemically synthesized
tagggtcaggcagatcacat

SEQ ID NO: 15085 - DNA, 20 bp, Artificial Sequence
  chemically synthesized
tcaggcagatcacataagaa

SEQ ID NO: 15086 - DNA, 20 bp, Artificial Sequence
  chemically synthesized
aggcagatcacataagaaaa

SEQ ID NO: 15087 - DNA, 20 bp, Artificial Sequence
  chemically synthesized
ggcagatcacataagaaaag

SEQ ID NO: 15088 - DNA, 20 bp, Artificial Sequence
  chemically synthesized
cacataagaaaagaggatgc

SEQ ID NO: 15089 - DNA, 20 bp, Artificial Sequence
  chemically synthesized
aagaaaagaggatgccagtt

SEQ ID NO: 15090 - DNA, 20 bp, Artificial Sequence
  chemically synthesized
agaaaagaggatgccagtta

SEQ ID NO: 15091 - DNA, 20 bp, Artificial Sequence
  chemically synthesized
aggatgccagttaaggtctg

SEQ ID NO: 15092 - DNA, 20 bp, Artificial Sequence
  chemically synthesized
tgccagttaaggtctgcagt

SEQ ID NO: 15093 - DNA, 20 bp, Artificial Sequence
  chemically synthesized
ttaaggtctgcagtgagtat

SEQ ID NO: 15094 - DNA, 20 bp, Artificial Sequence
  chemically synthesized
gagcccatccctgatgaatt

SEQ ID NO: 15095 - DNA, 20 bp, Artificial Sequence
  chemically synthesized
agcccatccctgatgaatta

SEQ ID NO: 15096 - DNA, 20 bp, Artificial Sequence
  chemically synthesized
aattaaggcaatcaacactt

SEQ ID NO: 15097 - DNA, 20 bp, Artificial Sequence
  chemically synthesized
attaaggcaatcaacacttt

SEQ ID NO: 15098 - DNA, 20 bp, Artificial Sequence
  chemically synthesized
aaggcaatcaacactttagg

SEQ ID NO: 15099 - DNA, 20 bp, Artificial Sequence
  chemically synthesized
ttaggcagccatgttgccat

SEQ ID NO: 15100 - DNA, 20 bp, Artificial Sequence
  chemically synthesized
aggcagccatgttgccatga

SEQ ID NO: 15101 - DNA, 20 bp, Artificial Sequence
  chemically synthesized
gccatgttgccatgagagat

SEQ ID NO: 15102 - DNA, 20 bp, Artificial Sequence
  chemically synthesized
ccatgttgccatgagagatt

SEQ ID NO: 15103 - DNA, 20 bp, Artificial Sequence
  chemically synthesized
atgttgccatgagagattag

SEQ ID NO: 15104 - DNA, 20 bp, Artificial Sequence
  chemically synthesized
tgttgccatgagagattagg

SEQ ID NO: 15105 - DNA, 20 bp, Artificial Sequence
  chemically synthesized
gttgccatgagagattagga

SEQ ID NO: 15106 - DNA, 20 bp, Artificial Sequence
  chemically synthesized
ttgccatgagagattaggag

SEQ ID NO: 15107 - DNA, 20 bp, Artificial Sequence
  chemically synthesized
gagattaggaggggccaaat

SEQ ID NO: 15108 - DNA, 20 bp, Artificial Sequence
  chemically synthesized
taggaggggccaaatgagcc

SEQ ID NO: 15109 - DNA, 20 bp, Artificial Sequence
  chemically synthesized
cagaaataccacctacttct

SEQ ID NO: 15110 - DNA, 20 bp, Artificial Sequence
  chemically synthesized
cctacttcttagatgatctt

SEQ ID NO: 15111 - DNA, 20 bp, Artificial Sequence
  chemically synthesized
cttcttagatgatcttgagc

SEQ ID NO: 15112 - DNA, 20 bp, Artificial Sequence
  chemically synthesized
gcaagttgcttaacttcttg

SEQ ID NO: 15113 - DNA, 20 bp, Artificial Sequence
  chemically synthesized
ttcttgaagtctctgaaata

SEQ ID NO: 15114 - DNA, 20 bp, Artificial Sequence
  chemically synthesized
tcttgaagtctctgaaatat

SEQ ID NO: 15115 - DNA, 20 bp, Artificial Sequence
  chemically synthesized
tataggatgataatatgtat

SEQ ID NO: 15116 - DNA, 20 bp, Artificial Sequence
  chemically synthesized
tgataatatgtattagctaa

SEQ ID NO: 15117 - DNA, 20 bp, Artificial Sequence
  chemically synthesized
gtattagctaatagaattat

SEQ ID NO: 15118 - DNA, 20 bp, Artificial Sequence
  chemically synthesized
tattagctaatagaattatg

SEQ ID NO: 15119 - DNA, 20 bp, Artificial Sequence
  chemically synthesized
gctaatagaattatgaggat

SEQ ID NO: 15120 - DNA, 20 bp, Artificial Sequence
  chemically synthesized
tagaattatgaggatgagat

SEQ ID NO: 15121 - DNA, 20 bp, Artificial Sequence
  chemically synthesized
tgagattagtttattgtgta

SEQ ID NO: 15122 - DNA, 20 bp, Artificial Sequence
  chemically synthesized
tagtttattgtgtaaagaac

SEQ ID NO: 15123 - DNA, 20 bp, Artificial Sequence
  chemically synthesized
agtttattgtgtaaagaact

SEQ ID NO: 15124 - DNA, 20 bp, Artificial Sequence
  chemically synthesized
gtttattgtgtaaagaacta

SEQ ID NO: 15125 - DNA, 20 bp, Artificial Sequence
  chemically synthesized
tgtgtaaagaactagggaca

SEQ ID NO: 15126 - DNA, 20 bp, Artificial Sequence
  chemically synthesized
ctagggacacagtatatatt

SEQ ID NO: 15127 - DNA, 20 bp, Artificial Sequence
  chemically synthesized
ggacacagtatatattcagt

SEQ ID NO: 15128 - DNA, 20 bp, Artificial Sequence
  chemically synthesized
tcagtaagtgttttctgtta

SEQ ID NO: 15129 - DNA, 20 bp, Artificial Sequence
  chemically synthesized
atatatacatgcaactatta

SEQ ID NO: 15130 - DNA, 20 bp, Artificial Sequence
  chemically synthesized
tacagttgcatgctacctta

SEQ ID NO: 15131 - DNA, 20 bp, Artificial Sequence
  chemically synthesized
atgctaccttaaagaataat

SEQ ID NO: 15132 - DNA, 20 bp, Artificial Sequence
  chemically synthesized
gctaccttaaagaataattg

SEQ ID NO: 15133 - DNA, 20 bp, Artificial Sequence
  chemically synthesized
ctaccttaaagaataattgg

SEQ ID NO: 15134 - DNA, 20 bp, Artificial Sequence
  chemically synthesized
ttaaagaataattggaggta

SEQ ID NO: 15135 - DNA, 20 bp, Artificial Sequence
  chemically synthesized
taattggaggtacagttatt

SEQ ID NO: 15136 - DNA, 20 bp, Artificial Sequence
  chemically synthesized
attggaggtacagttattcg

SEQ ID NO: 15137 - DNA, 20 bp, Artificial Sequence
  chemically synthesized
ttggaggtacagttattcgg

SEQ ID NO: 15138 - DNA, 20 bp, Artificial Sequence
  chemically synthesized
tatttcttgactgttaatgt

SEQ ID NO: 15139 - DNA, 20 bp, Artificial Sequence
  chemically synthesized
ttcttgactgttaatgttgg

SEQ ID NO: 15140 - DNA, 20 bp, Artificial Sequence
  chemically synthesized
ttgactgttaatgttggcag

SEQ ID NO: 15141 - DNA, 20 bp, Artificial Sequence
  chemically synthesized
gttaatgttggcagcagatt

SEQ ID NO: 15142 - DNA, 20 bp, Artificial Sequence
  chemically synthesized
gcttattttacaacactatt

SEQ ID NO: 15143 - DNA, 20 bp, Artificial Sequence
  chemically synthesized
gacctctcacaataattccc

SEQ ID NO: 15144 - DNA, 20 bp, Artificial Sequence
  chemically synthesized
acctctcacaataattccct

SEQ ID NO: 15145 - DNA, 20 bp, Artificial Sequence
  chemically synthesized
ctctcacaataattccctag

SEQ ID NO: 15146 - DNA, 20 bp, Artificial Sequence
  chemically synthesized
ataattccctaggagatatt

SEQ ID NO: 15147 - DNA, 20 bp, Artificial Sequence
  chemically synthesized
ctaggagatatttagacaac

SEQ ID NO: 15148 - DNA, 20 bp, Artificial Sequence
  chemically synthesized
tttgctctctgttcctgtga

SEQ ID NO: 15149 - DNA, 20 bp, Artificial Sequence
  chemically synthesized
tgtgaaagtacccttctact

SEQ ID NO: 15150 - DNA, 20 bp, Artificial Sequence
  chemically synthesized
ctacttagcctacttttgac

SEQ ID NO: 15151 - DNA, 20 bp, Artificial Sequence
  chemically synthesized
ttgaccagtgtgcatgtcac

SEQ ID NO: 15152 - DNA, 20 bp, Artificial Sequence
  chemically synthesized
tgaccagtgtgcatgtcact

SEQ ID NO: 15153 - DNA, 20 bp, Artificial Sequence
  chemically synthesized
tgcatgtcactgggcaatac

SEQ ID NO: 15154 - DNA, 20 bp, Artificial Sequence
  chemically synthesized
ctgggcaatacaagacctct

SEQ ID NO: 15155 - DNA, 20 bp, Artificial Sequence
  chemically synthesized
aatacaagacctctgagctt

SEQ ID NO: 15156 - DNA, 20 bp, Artificial Sequence
  chemically synthesized
aagacctctgagctttggct

SEQ ID NO: 15157 - DNA, 20 bp, Artificial Sequence
  chemically synthesized
acctctgagctttggcttag

SEQ ID NO: 15158 - DNA, 20 bp, Artificial Sequence
  chemically synthesized
cctctgagctttggcttaga

SEQ ID NO: 15159 - DNA, 20 bp, Artificial Sequence
  chemically synthesized
cttagaaggaaatacaataa

SEQ ID NO: 15160 - DNA, 20 bp, Artificial Sequence
  chemically synthesized
tacaataatggctaattttt

SEQ ID NO: 15161 - DNA, 20 bp, Artificial Sequence
  chemically synthesized
ataatggctaatttttgaga

SEQ ID NO: 15162 - DNA, 20 bp, Artificial Sequence
  chemically synthesized
aatggctaatttttgagaaa

SEQ ID NO: 15163 - DNA, 20 bp, Artificial Sequence
  chemically synthesized
atggctaatttttgagaaag

SEQ ID NO: 15164 - DNA, 20 bp, Artificial Sequence
  chemically synthesized
tttttgagaaagaggaactc

SEQ ID NO: 15165 - DNA, 20 bp, Artificial Sequence
  chemically synthesized
aaagaggaactctagcccat

SEQ ID NO: 15166 - DNA, 20 bp, Artificial Sequence
  chemically synthesized
aagaggaactctagcccatc

SEQ ID NO: 15167 - DNA, 20 bp, Artificial Sequence
  chemically synthesized
agaggaactctagcccatca

SEQ ID NO: 15168 - DNA, 20 bp, Artificial Sequence
  chemically synthesized
ggaactctagcccatcaggg

SEQ ID NO: 15169 - DNA, 20 bp, Artificial Sequence
  chemically synthesized
ctagcccatcagggaagaca

SEQ ID NO: 15170 - DNA, 20 bp, Artificial Sequence
  chemically synthesized
tagcccatcagggaagacat

SEQ ID NO: 15171 - DNA, 20 bp, Artificial Sequence
  chemically synthesized
agcccatcagggaagacata

SEQ ID NO: 15172 - DNA, 20 bp, Artificial Sequence
  chemically synthesized
cccatcagggaagacatagg

SEQ ID NO: 15173 - DNA, 20 bp, Artificial Sequence
  chemically synthesized
ggaagacatagggagttctg

SEQ ID NO: 15174 - DNA, 20 bp, Artificial Sequence
  chemically synthesized
gaagacatagggagttctgt

SEQ ID NO: 15175 - DNA, 20 bp, Artificial Sequence
  chemically synthesized
atagggagttctgtaggaat

SEQ ID NO: 15176 - DNA, 20 bp, Artificial Sequence
  chemically synthesized
gagttcttccattcttttta

SEQ ID NO: 15177 - DNA, 20 bp, Artificial Sequence
  chemically synthesized
cttccattctttttacagat

SEQ ID NO: 15178 - DNA, 20 bp, Artificial Sequence
  chemically synthesized
cattctttttacagatgaga

SEQ ID NO: 15179 - DNA, 20 bp, Artificial Sequence
  chemically synthesized
cagatgagaaagacaatgtg

SEQ ID NO: 15180 - DNA, 20 bp, Artificial Sequence
  chemically synthesized
tgaagccccaaatgatttta

SEQ ID NO: 15181 - DNA, 20 bp, Artificial Sequence
  chemically synthesized
agccccaaatgattttaaag

SEQ ID NO: 15182 - DNA, 20 bp, Artificial Sequence
  chemically synthesized
ccaaatgattttaaagtagt

SEQ ID NO: 15183 - DNA, 20 bp, Artificial Sequence
  chemically synthesized
attttaaagtagttagcata

SEQ ID NO: 15184 - DNA, 20 bp, Artificial Sequence
  chemically synthesized
tttaaagtagttagcatatg

SEQ ID NO: 15185 - DNA, 20 bp, Artificial Sequence
  chemically synthesized
gtagttagcatatggagaaa

SEQ ID NO: 15186 - DNA, 20 bp, Artificial Sequence
  chemically synthesized
tatggagaaatggcttgcat

SEQ ID NO: 15187 - DNA, 20 bp, Artificial Sequence
  chemically synthesized
tggcttgcattggtaaaatt

SEQ ID NO: 15188 - DNA, 20 bp, Artificial Sequence
  chemically synthesized
ggcttgcattggtaaaattt

SEQ ID NO: 15189 - DNA, 20 bp, Artificial Sequence
  chemically synthesized
gcttgcattggtaaaatttg

SEQ ID NO: 15190 - DNA, 20 bp, Artificial Sequence
  chemically synthesized
atttggggaaactttgttgt

SEQ ID NO: 15191 - DNA, 20 bp, Artificial Sequence
  chemically synthesized
ggaaactttgttgtcagacc

SEQ ID NO: 15192 - DNA, 20 bp, Artificial Sequence
  chemically synthesized
ctttgttgtcagacccggca

SEQ ID NO: 15193 - DNA, 20 bp, Artificial Sequence
  chemically synthesized
tttgttgtcagacccggcaa

SEQ ID NO: 15194 - DNA, 20 bp, Artificial Sequence
  chemically synthesized
ttgttgtcagacccggcaaa

SEQ ID NO: 15195 - DNA, 20 bp, Artificial Sequence
  chemically synthesized
gttgtcagacccggcaaagg

SEQ ID NO: 15196 - DNA, 20 bp, Artificial Sequence
  chemically synthesized
agacccggcaaagggagatg

SEQ ID NO: 15197 - DNA, 20 bp, Artificial Sequence
  chemically synthesized
acccggcaaagggagatgca

SEQ ID NO: 15198 - DNA, 20 bp, Artificial Sequence
  chemically synthesized
agggagatgcagagaatctg

SEQ ID NO: 15199 - DNA, 20 bp, Artificial Sequence
  chemically synthesized
catttcttgtgtacctatca

SEQ ID NO: 15200 - DNA, 20 bp, Artificial Sequence
  chemically synthesized
gtgtacctatcacagcacca

SEQ ID NO: 15201 - DNA, 20 bp, Artificial Sequence
  chemically synthesized
cagcaccacagcactattcc

SEQ ID NO: 15202 - DNA, 20 bp, Artificial Sequence
  chemically synthesized
ccacagcactattcctagca

SEQ ID NO: 15203 - DNA, 20 bp, Artificial Sequence
  chemically synthesized
gcactattcctagcatagtt

SEQ ID NO: 15204 - DNA, 20 bp, Artificial Sequence
  chemically synthesized
cactattcctagcatagttt

SEQ ID NO: 15205 - DNA, 20 bp, Artificial Sequence
  chemically synthesized
actattcctagcatagttta

SEQ ID NO: 15206 - DNA, 20 bp, Artificial Sequence
  chemically synthesized
ctagcatagtttagggccct

SEQ ID NO: 15207 - DNA, 20 bp, Artificial Sequence
  chemically synthesized
gggccctcagttcttgacgc

SEQ ID NO: 15208 - DNA, 20 bp, Artificial Sequence
  chemically synthesized
cctcagttcttgacgctagt

SEQ ID NO: 15209 - DNA, 20 bp, Artificial Sequence
  chemically synthesized
aatttcacacaaacttaaac

SEQ ID NO: 15210 - DNA, 20 bp, Artificial Sequence
  chemically synthesized
acaaacatatgtatgtttct

SEQ ID NO: 15211 - DNA, 20 bp, Artificial Sequence
  chemically synthesized
caaacatatgtatgtttctg

SEQ ID NO: 15212 - DNA, 20 bp, Artificial Sequence
  chemically synthesized
atgtatgtttctgaggcact

SEQ ID NO: 15213 - DNA, 20 bp, Artificial Sequence
  chemically synthesized
tgtatgtttctgaggcactg

SEQ ID NO: 15214 - DNA, 20 bp, Artificial Sequence
  chemically synthesized
ctgaggcactgaggtcactg

SEQ ID NO: 15215 - DNA, 20 bp, Artificial Sequence
  chemically synthesized
tgaggcactgaggtcactgc

SEQ ID NO: 15216 - DNA, 20 bp, Artificial Sequence
  chemically synthesized
actgaggtcactgcaggatg

SEQ ID NO: 15217 - DNA, 20 bp, Artificial Sequence
  chemically synthesized
aggtcactgcaggatgaaga

SEQ ID NO: 15218 - DNA, 20 bp, Artificial Sequence
  chemically synthesized
gtcactgcaggatgaagacg

SEQ ID NO: 15219 - DNA, 20 bp, Artificial Sequence
  chemically synthesized
caggatgaagacggagccaa

SEQ ID NO: 15220 - DNA, 20 bp, Artificial Sequence
  chemically synthesized
aggatgaagacggagccaat

SEQ ID NO: 15221 - DNA, 20 bp, Artificial Sequence
  chemically synthesized
tgaagacggagccaatgggt

SEQ ID NO: 15222 - DNA, 20 bp, Artificial Sequence
  chemically synthesized
acggagccaatgggttagac

SEQ ID NO: 15223 - DNA, 20 bp, Artificial Sequence
  chemically synthesized
gagccaatgggttagaccag

SEQ ID NO: 15224 - DNA, 20 bp, Artificial Sequence
  chemically synthesized
gccaatgggttagaccagaa

SEQ ID NO: 15225 - DNA, 20 bp, Artificial Sequence
  chemically synthesized
ataaacactccctttaacca

SEQ ID NO: 15226 - DNA, 20 bp, Artificial Sequence
  chemically synthesized
actccctttaaccaaagttg

SEQ ID NO: 15227 - DNA, 20 bp, Artificial Sequence
  chemically synthesized
accaaagttgcagcttgacc

SEQ ID NO: 15228 - DNA, 20 bp, Artificial Sequence
  chemically synthesized
ccaaagttgcagcttgacca

SEQ ID NO: 15229 - DNA, 20 bp, Artificial Sequence
  chemically synthesized
caaagttgcagcttgaccaa

SEQ ID NO: 15230 - DNA, 20 bp, Artificial Sequence
  chemically synthesized
aaagttgcagcttgaccaag

SEQ ID NO: 15231 - DNA, 20 bp, Artificial Sequence
  chemically synthesized
gcagcttgaccaaggggtca

SEQ ID NO: 15232 - DNA, 20 bp, Artificial Sequence
  chemically synthesized
cagcttgaccaaggggtcaa

SEQ ID NO: 15233 - DNA, 20 bp, Artificial Sequence
  chemically synthesized
agcttgaccaaggggtcaaa

SEQ ID NO: 15234 - DNA, 20 bp, Artificial Sequence
  chemically synthesized
caaggggtcaaagggtaatt

SEQ ID NO: 15235 - DNA, 20 bp, Artificial Sequence
  chemically synthesized
aaggggtcaaagggtaattt

SEQ ID NO: 15236 - DNA, 20 bp, Artificial Sequence
  chemically synthesized
gggtcaaagggtaatttggg

SEQ ID NO: 15237 - DNA, 20 bp, Artificial Sequence
  chemically synthesized
ggtcaaagggtaatttgggc

SEQ ID NO: 15238 - DNA, 20 bp, Artificial Sequence
  chemically synthesized
aagggtaatttgggcaggca

SEQ ID NO: 15239 - DNA, 20 bp, Artificial Sequence
  chemically synthesized
agggtaatttgggcaggcat

SEQ ID NO: 15240 - DNA, 20 bp, Artificial Sequence
  chemically synthesized
tttgggcaggcatgggcctt

SEQ ID NO: 15241 - DNA, 20 bp, Artificial Sequence
  chemically synthesized
catgggccttcagttttctc

SEQ ID NO: 15242 - DNA, 20 bp, Artificial Sequence
  chemically synthesized
tatgacaatctctgtaaccc

SEQ ID NO: 15243 - DNA, 20 bp, Artificial Sequence
  chemically synthesized
tgacaatctctgtaacccaa

SEQ ID NO: 15244 - DNA, 20 bp, Artificial Sequence
  chemically synthesized
gagaaaatctctttattctg

SEQ ID NO: 15245 - DNA, 20 bp, Artificial Sequence
  chemically synthesized
ttctccctcaaactttcctg

SEQ ID NO: 15246 - DNA, 20 bp, Artificial Sequence
  chemically synthesized
ttcctgaagaaatgcaatta

SEQ ID NO: 15247 - DNA, 20 bp, Artificial Sequence
  chemically synthesized
gaagaaatgcaattatggtt

SEQ ID NO: 15248 - DNA, 20 bp, Artificial Sequence
  chemically synthesized
aagaaatgcaattatggttg

SEQ ID NO: 15249 - DNA, 20 bp, Artificial Sequence
  chemically synthesized
aaatgcaattatggttgagg

SEQ ID NO: 15250 - DNA, 20 bp, Artificial Sequence
  chemically synthesized
caattatggttgaggaagta

SEQ ID NO: 15251 - DNA, 20 bp, Artificial Sequence
  chemically synthesized
ggaagtatggtctgcaactg

SEQ ID NO: 15252 - DNA, 20 bp, Artificial Sequence
  chemically synthesized
tatggtctgcaactgtggct

SEQ ID NO: 15253 - DNA, 20 bp, Artificial Sequence
  chemically synthesized
gaccacaacttccaatcgac

SEQ ID NO: 15254 - DNA, 20 bp, Artificial Sequence
  chemically synthesized
cacaacttccaatcgacaag

SEQ ID NO: 15255 - DNA, 20 bp, Artificial Sequence
  chemically synthesized
ttccaatcgacaagaagtaa

SEQ ID NO: 15256 - DNA, 20 bp, Artificial Sequence
  chemically synthesized
aatcgacaagaagtaaaagt

SEQ ID NO: 15257 - DNA, 20 bp, Artificial Sequence
  chemically synthesized
cgacaagaagtaaaagtaag

SEQ ID NO: 15258 - DNA, 20 bp, Artificial Sequence
  chemically synthesized
aagaagtaaaagtaagaagc

SEQ ID NO: 15259 - DNA, 20 bp, Artificial Sequence
  chemically synthesized
agaagtaaaagtaagaagca

SEQ ID NO: 15260 - DNA, 20 bp, Artificial Sequence
  chemically synthesized
gaagtaaaagtaagaagcaa

SEQ ID NO: 15261 - DNA, 20 bp, Artificial Sequence
  chemically synthesized
aaagtaagaagcaagggcca

SEQ ID NO: 15262 - DNA, 20 bp, Artificial Sequence
  chemically synthesized
aagtaagaagcaagggccac

SEQ ID NO: 15263 - DNA, 20 bp, Artificial Sequence
  chemically synthesized
agtaagaagcaagggccaca

SEQ ID NO: 15264 - DNA, 20 bp, Artificial Sequence
  chemically synthesized
aagaagcaagggccacaggg

SEQ ID NO: 15265 - DNA, 20 bp, Artificial Sequence
  chemically synthesized
agaagcaagggccacagggc

SEQ ID NO: 15266 - DNA, 20 bp, Artificial Sequence
  chemically synthesized
ttctcgcatccacaatatct

SEQ ID NO: 15267 - DNA, 20 bp, Artificial Sequence
  chemically synthesized
tctgagtttgtgttttgctg

SEQ ID NO: 15268 - DNA, 20 bp, Artificial Sequence
  chemically synthesized
tgtggaaaaaacactgtctt

SEQ ID NO: 15269 - DNA, 20 bp, Artificial Sequence
  chemically synthesized
tggaaaaaacactgtcttca

SEQ ID NO: 15270 - DNA, 20 bp, Artificial Sequence
  chemically synthesized
ggaaaaaacactgtcttcag

SEQ ID NO: 15271 - DNA, 20 bp, Artificial Sequence
  chemically synthesized
aaaaacactgtcttcagagg

SEQ ID NO: 15272 - DNA, 20 bp, Artificial Sequence
  chemically synthesized
aacactgtcttcagaggtag

SEQ ID NO: 15273 - DNA, 20 bp, Artificial Sequence
  chemically synthesized
gtcttcagaggtagcagaac

SEQ ID NO: 15274 - DNA, 20 bp, Artificial Sequence
  chemically synthesized
tcttcagaggtagcagaact

SEQ ID NO: 15275 - DNA, 20 bp, Artificial Sequence
  chemically synthesized
gcagaactgggtctacatcc

SEQ ID NO: 15276 - DNA, 20 bp, Artificial Sequence
  chemically synthesized
tacatcctagccttactact

SEQ ID NO: 15277 - DNA, 20 bp, Artificial Sequence
  chemically synthesized
atcctagccttactacttgg

SEQ ID NO: 15278 - DNA, 20 bp, Artificial Sequence
  chemically synthesized
ttactacttggtggttctgt

SEQ ID NO: 15279 - DNA, 20 bp, Artificial Sequence
  chemically synthesized
acttggtggttctgtaagct

SEQ ID NO: 15280 - DNA, 20 bp, Artificial Sequence
  chemically synthesized
atttcatgtctttgattttc

SEQ ID NO: 15281 - DNA, 20 bp, Artificial Sequence
  chemically synthesized
gtctttgattttcgagtccc

SEQ ID NO: 15282 - DNA, 20 bp, Artificial Sequence
  chemically synthesized
ttttcgagtccccagttaat

SEQ ID NO: 15283 - DNA, 20 bp, Artificial Sequence
  chemically synthesized
ttcgagtccccagttaataa

SEQ ID NO: 15284 - DNA, 20 bp, Artificial Sequence
  chemically synthesized
taataagagctcatgtaatg

SEQ ID NO: 15285 - DNA, 20 bp, Artificial Sequence
  chemically synthesized
aagagctcatgtaatgtaga

SEQ ID NO: 15286 - DNA, 20 bp, Artificial Sequence
  chemically synthesized
agctcatgtaatgtagacag

SEQ ID NO: 15287 - DNA, 20 bp, Artificial Sequence
  chemically synthesized
gctcatgtaatgtagacagt

SEQ ID NO: 15288 - DNA, 20 bp, Artificial Sequence
  chemically synthesized
tcatgtaatgtagacagtag

SEQ ID NO: 15289 - DNA, 20 bp, Artificial Sequence
  chemically synthesized
atgtaatgtagacagtagga

SEQ ID NO: 15290 - DNA, 20 bp, Artificial Sequence
  chemically synthesized
atgtagacagtaggagagct

SEQ ID NO: 15291 - DNA, 20 bp, Artificial Sequence
  chemically synthesized
attactaattgtctacttat

SEQ ID NO: 15292 - DNA, 20 bp, Artificial Sequence
  chemically synthesized
tattagcttgtgctttcaat

SEQ ID NO: 15293 - DNA, 20 bp, Artificial Sequence
  chemically synthesized
aataagttgatctacactac

SEQ ID NO: 15294 - DNA, 20 bp, Artificial Sequence
  chemically synthesized
gatctacactacaagtacat

SEQ ID NO: 15295 - DNA, 20 bp, Artificial Sequence
  chemically synthesized
atctacactacaagtacatt

SEQ ID NO: 15296 - DNA, 20 bp, Artificial Sequence
  chemically synthesized
tgggctcctcatcaataaat

SEQ ID NO: 15297 - DNA, 20 bp, Artificial Sequence
  chemically synthesized
gggctcctcatcaataaatg

SEQ ID NO: 15298 - DNA, 20 bp, Artificial Sequence
  chemically synthesized
tgaggtaataatctacttct

SEQ ID NO: 15299 - DNA, 20 bp, Artificial Sequence
  chemically synthesized
aataatctacttctgagtat

SEQ ID NO: 15300 - DNA, 20 bp, Artificial Sequence
  chemically synthesized
ctacttctgagtattggtgt

SEQ ID NO: 15301 - DNA, 20 bp, Artificial Sequence
  chemically synthesized
gtattggtgtgagtaaaact

SEQ ID NO: 15302 - DNA, 20 bp, Artificial Sequence
  chemically synthesized
aaacttcttttttttttttt

SEQ ID NO: 15303 - DNA, 20 bp, Artificial Sequence
  chemically synthesized
ttctttttttttttttgaga

SEQ ID NO: 15304 - DNA, 20 bp, Artificial Sequence
  chemically synthesized
ctttttttttttttgagatg

SEQ ID NO: 15305 - DNA, 20 bp, Artificial Sequence
  chemically synthesized
tggagtctcactctgtcgcc

SEQ ID NO: 15306 - DNA, 20 bp, Artificial Sequence
  chemically synthesized
ggagtctcactctgtcgcct

SEQ ID NO: 15307 - DNA, 20 bp, Artificial Sequence
  chemically synthesized
tctcactctgtcgcctaggc

SEQ ID NO: 15308 - DNA, 20 bp, Artificial Sequence
  chemically synthesized
tcactctgtcgcctaggctg

SEQ ID NO: 15309 - DNA, 20 bp, Artificial Sequence
  chemically synthesized
ctgtcgcctaggctggagtg

SEQ ID NO: 15310 - DNA, 20 bp, Artificial Sequence
  chemically synthesized
tcgcctaggctggagtgcag

SEQ ID NO: 15311 - DNA, 20 bp, Artificial Sequence
  chemically synthesized
ggagtgcagtggtgcaatct

SEQ ID NO: 15312 - DNA, 20 bp, Artificial Sequence
  chemically synthesized
tcactgcaacctccacctcc

SEQ ID NO: 15313 - DNA, 20 bp, Artificial Sequence
  chemically synthesized
cactgcaacctccacctcct

SEQ ID NO: 15314 - DNA, 20 bp, Artificial Sequence
  chemically synthesized
aacctccacctcctgggttc

SEQ ID NO: 15315 - DNA, 20 bp, Artificial Sequence
  chemically synthesized
ttcaagtgattctcctgcct

SEQ ID NO: 15316 - DNA, 20 bp, Artificial Sequence
  chemically synthesized
ttctcctgcctcagcctcct

SEQ ID NO: 15317 - DNA, 20 bp, Artificial Sequence
  chemically synthesized
tcctgcctcagcctcctgag

SEQ ID NO: 15318 - DNA, 20 bp, Artificial Sequence
  chemically synthesized
gcctcagcctcctgagtagc

SEQ ID NO: 15319 - DNA, 20 bp, Artificial Sequence
  chemically synthesized
cctcagcctcctgagtagct

SEQ ID NO: 15320 - DNA, 20 bp, Artificial Sequence
  chemically synthesized
ctcctgagtagctgggatta

SEQ ID NO: 15321 - DNA, 20 bp, Artificial Sequence
  chemically synthesized
tagacgcgtgccaccacacc

SEQ ID NO: 15322 - DNA, 20 bp, Artificial Sequence
  chemically synthesized
ggctgattttttgtattttt

SEQ ID NO: 15323 - DNA, 20 bp, Artificial Sequence
  chemically synthesized
tgattttttgtattttttag

SEQ ID NO: 15324 - DNA, 20 bp, Artificial Sequence
  chemically synthesized
attttttgtattttttagta

SEQ ID NO: 15325 - DNA, 20 bp, Artificial Sequence
  chemically synthesized
ttttgtattttttagtagag

SEQ ID NO: 15326 - DNA, 20 bp, Artificial Sequence
  chemically synthesized
tttgtattttttagtagaga

SEQ ID NO: 15327 - DNA, 20 bp, Artificial Sequence
  chemically synthesized
ttgtattttttagtagagaa

SEQ ID NO: 15328 - DNA, 20 bp, Artificial Sequence
  chemically synthesized
tgtattttttagtagagaag

SEQ ID NO: 15329 - DNA, 20 bp, Artificial Sequence
  chemically synthesized
gagaaggggtttcaccatgt

SEQ ID NO: 15330 - DNA, 20 bp, Artificial Sequence
  chemically synthesized
aggggtttcaccatgttggc

SEQ ID NO: 15331 - DNA, 20 bp, Artificial Sequence
  chemically synthesized
ggggtttcaccatgttggcc

SEQ ID NO: 15332 - DNA, 20 bp, Artificial Sequence
  chemically synthesized
tttcaccatgttggccaggc

SEQ ID NO: 15333 - DNA, 20 bp, Artificial Sequence
  chemically synthesized
ccatgttggccaggctggtc

SEQ ID NO: 15334 - DNA, 20 bp, Artificial Sequence
  chemically synthesized
tggtctggaactcctgacct

SEQ ID NO: 15335 - DNA, 20 bp, Artificial Sequence
  chemically synthesized
ggtctggaactcctgacctc

SEQ ID NO: 15336 - DNA, 20 bp, Artificial Sequence
  chemically synthesized
ctcaggtgatccaattgcct

SEQ ID NO: 15337 - DNA, 20 bp, Artificial Sequence
  chemically synthesized
ccaattgccttggcctccca

SEQ ID NO: 15338 - DNA, 20 bp, Artificial Sequence
  chemically synthesized
gccttggcctcccaaagtgc

SEQ ID NO: 15339 - DNA, 20 bp, Artificial Sequence
  chemically synthesized
ccttggcctcccaaagtgct

SEQ ID NO: 15340 - DNA, 20 bp, Artificial Sequence
  chemically synthesized
ctcccaaagtgctgggatta

SEQ ID NO: 15341 - DNA, 20 bp, Artificial Sequence
  chemically synthesized
tcccaaagtgctgggattac

SEQ ID NO: 15342 - DNA, 20 bp, Artificial Sequence
  chemically synthesized
aggcatgtaatcccatatat

SEQ ID NO: 15343 - DNA, 20 bp, Artificial Sequence
  chemically synthesized
catatatgagccaccgtgcc

SEQ ID NO: 15344 - DNA, 20 bp, Artificial Sequence
  chemically synthesized
gataaacttaaatttgattc

SEQ ID NO: 15345 - DNA, 20 bp, Artificial Sequence
  chemically synthesized
atttgattctagcatatact

SEQ ID NO: 15346 - DNA, 20 bp, Artificial Sequence
  chemically synthesized
ctagcatatactaagtactc

SEQ ID NO: 15347 - DNA, 20 bp, Artificial Sequence
  chemically synthesized
agcatatactaagtactcaa

SEQ ID NO: 15348 - DNA, 20 bp, Artificial Sequence
  chemically synthesized
gcatatactaagtactcaag

SEQ ID NO: 15349 - DNA, 20 bp, Artificial Sequence
  chemically synthesized
caagaggtgttacttatcat

SEQ ID NO: 15350 - DNA, 20 bp, Artificial Sequence
  chemically synthesized
cttatcattagtattaatta

SEQ ID NO: 15351 - DNA, 20 bp, Artificial Sequence
  chemically synthesized
gttcaataatacatatctca

SEQ ID NO: 15352 - DNA, 20 bp, Artificial Sequence
  chemically synthesized
acagaattaccatatgtaat

SEQ ID NO: 15353 - DNA, 20 bp, Artificial Sequence
  chemically synthesized
gattattaaatatcataaaa

SEQ ID NO: 15354 - DNA, 20 bp, Artificial Sequence
  chemically synthesized
ataaaatggcacctgacata

SEQ ID NO: 15355 - DNA, 20 bp, Artificial Sequence
  chemically synthesized
aatggcacctgacatataga

SEQ ID NO: 15356 - DNA, 20 bp, Artificial Sequence
  chemically synthesized
cctgacatatagaaagattt

SEQ ID NO: 15357 - DNA, 20 bp, Artificial Sequence
  chemically synthesized
acatatagaaagatttcagt

SEQ ID NO: 15358 - DNA, 20 bp, Artificial Sequence
  chemically synthesized
acttctctttcatttacctc

SEQ ID NO: 15359 - DNA, 20 bp, Artificial Sequence
  chemically synthesized
atttcctcgtgtctctcatg

SEQ ID NO: 15360 - DNA, 20 bp, Artificial Sequence
  chemically synthesized
cgtgtctctcatgtggtttc

SEQ ID NO: 15361 - DNA, 20 bp, Artificial Sequence
  chemically synthesized
tttccctctcaactcctgtg

SEQ ID NO: 15362 - DNA, 20 bp, Artificial Sequence
  chemically synthesized
tcctaaaaatttctcatgtt

SEQ ID NO: 15363 - DNA, 20 bp, Artificial Sequence
  chemically synthesized
atttctcatgttcagaacct

SEQ ID NO: 15364 - DNA, 20 bp, Artificial Sequence
  chemically synthesized
tttctcatgttcagaacctt

SEQ ID NO: 15365 - DNA, 20 bp, Artificial Sequence
  chemically synthesized
accttgggcttccatgtttc

SEQ ID NO: 15366 - DNA, 20 bp, Artificial Sequence
  chemically synthesized
gggcttccatgtttccagtg

SEQ ID NO: 15367 - DNA, 20 bp, Artificial Sequence
  chemically synthesized
ttccatgtttccagtgaagt

SEQ ID NO: 15368 - DNA, 20 bp, Artificial Sequence
  chemically synthesized
ccagtgaagtcagatttttt

SEQ ID NO: 15369 - DNA, 20 bp, Artificial Sequence
  chemically synthesized
tgaagtcagatttttttaga

SEQ ID NO: 15370 - DNA, 20 bp, Artificial Sequence
  chemically synthesized
tcagatttttttagatggca

SEQ ID NO: 15371 - DNA, 20 bp, Artificial Sequence
  chemically synthesized
ttagatggcaaagttgctgt

SEQ ID NO: 15372 - DNA, 20 bp, Artificial Sequence
  chemically synthesized
aatttcatctgtgccctgct

SEQ ID NO: 15373 - DNA, 20 bp, Artificial Sequence
  chemically synthesized
atttcatctgtgccctgctt

SEQ ID NO: 15374 - DNA, 20 bp, Artificial Sequence
  chemically synthesized
ttcatctgtgccctgcttag

SEQ ID NO: 15375 - DNA, 20 bp, Artificial Sequence
  chemically synthesized
aggagcttaatctttaatga

SEQ ID NO: 15376 - DNA, 20 bp, Artificial Sequence
  chemically synthesized
cttaatctttaatgaaagct

SEQ ID NO: 15377 - DNA, 20 bp, Artificial Sequence
  chemically synthesized
agctaagctttcattaaaaa

SEQ ID NO: 15378 - DNA, 20 bp, Artificial Sequence
  chemically synthesized
ttcattaaaaaaagtctaac

SEQ ID NO: 15379 - DNA, 20 bp, Artificial Sequence
  chemically synthesized
gctgcattcgactttgactg

SEQ ID NO: 15380 - DNA, 20 bp, Artificial Sequence
  chemically synthesized
gcattcgactttgactgcag

SEQ ID NO: 15381 - DNA, 20 bp, Artificial Sequence
  chemically synthesized
tcgactttgactgcagcagc

SEQ ID NO: 15382 - DNA, 20 bp, Artificial Sequence
  chemically synthesized
ctttgactgcagcagctggt

SEQ ID NO: 15383 - DNA, 20 bp, Artificial Sequence
  chemically synthesized
tgactgcagcagctggttag

SEQ ID NO: 15384 - DNA, 20 bp, Artificial Sequence
  chemically synthesized
gactgcagcagctggttaga

SEQ ID NO: 15385 - DNA, 20 bp, Artificial Sequence
  chemically synthesized
agctggttagaaggttctac

SEQ ID NO: 15386 - DNA, 20 bp, Artificial Sequence
  chemically synthesized
ctggttagaaggttctactg

SEQ ID NO: 15387 - DNA, 20 bp, Artificial Sequence
  chemically synthesized
tggttagaaggttctactgg

SEQ ID NO: 15388 - DNA, 20 bp, Artificial Sequence
  chemically synthesized
gttagaaggttctactggag

SEQ ID NO: 15389 - DNA, 20 bp, Artificial Sequence
  chemically synthesized
ttagaaggttctactggagg

SEQ ID NO: 15390 - DNA, 20 bp, Artificial Sequence
  chemically synthesized
tagaaggttctactggagga

SEQ ID NO: 15391 - DNA, 20 bp, Artificial Sequence
  chemically synthesized
gttctactggaggagggtcc

SEQ ID NO: 15392 - DNA, 20 bp, Artificial Sequence
  chemically synthesized
gcccattgctaaattaacat

SEQ ID NO: 15393 - DNA, 20 bp, Artificial Sequence
  chemically synthesized
cccattgctaaattaacatc

SEQ ID NO: 15394 - DNA, 20 bp, Artificial Sequence
  chemically synthesized
ctaaattaacatcaggctct

SEQ ID NO: 15395 - DNA, 20 bp, Artificial Sequence
  chemically synthesized
ttaacatcaggctctgagac

SEQ ID NO: 15396 - DNA, 20 bp, Artificial Sequence
  chemically synthesized
acatcaggctctgagactgg

SEQ ID NO: 15397 - DNA, 20 bp, Artificial Sequence
  chemically synthesized
gactggcagtatatctctaa

SEQ ID NO: 15398 - DNA, 20 bp, Artificial Sequence
  chemically synthesized
tggcagtatatctctaacag

SEQ ID NO: 15399 - DNA, 20 bp, Artificial Sequence
  chemically synthesized
cagtggttgatgctatcttc

SEQ ID NO: 15400 - DNA, 20 bp, Artificial Sequence
  chemically synthesized
tggaacttgcctgctacatt

SEQ ID NO: 15401 - DNA, 20 bp, Artificial Sequence
  chemically synthesized
tgagaccactgacccataca

SEQ ID NO: 15402 - DNA, 20 bp, Artificial Sequence
  chemically synthesized
gagaccactgacccatacat

SEQ ID NO: 15403 - DNA, 20 bp, Artificial Sequence
  chemically synthesized
accactgacccatacatagg

SEQ ID NO: 15404 - DNA, 20 bp, Artificial Sequence
  chemically synthesized
acccatacataggaagccca

SEQ ID NO: 15405 - DNA, 20 bp, Artificial Sequence
  chemically synthesized
atagctctgtcctgaactgt

SEQ ID NO: 15406 - DNA, 20 bp, Artificial Sequence
  chemically synthesized
tagctctgtcctgaactgtt

SEQ ID NO: 15407 - DNA, 20 bp, Artificial Sequence
  chemically synthesized
gtcctgaactgttaggccac

SEQ ID NO: 15408 - DNA, 20 bp, Artificial Sequence
  chemically synthesized
gaactgttaggccactggtc

SEQ ID NO: 15409 - DNA, 20 bp, Artificial Sequence
  chemically synthesized
actgttaggccactggtcca

SEQ ID NO: 15410 - DNA, 20 bp, Artificial Sequence
  chemically synthesized
tgttaggccactggtccaga

SEQ ID NO: 15411 - DNA, 20 bp, Artificial Sequence
  chemically synthesized
gatcctcataataaccctat

SEQ ID NO: 15412 - DNA, 20 bp, Artificial Sequence
  chemically synthesized
ctcataataaccctatgaga

SEQ ID NO: 15413 - DNA, 20 bp, Artificial Sequence
  chemically synthesized
caattattactcttacttta

SEQ ID NO: 15414 - DNA, 20 bp, Artificial Sequence
  chemically synthesized
agatgatgatcctgaaaaca

SEQ ID NO: 15415 - DNA, 20 bp, Artificial Sequence
  chemically synthesized
gatgatgatcctgaaaacat

SEQ ID NO: 15416 - DNA, 20 bp, Artificial Sequence
  chemically synthesized
tgatgatcctgaaaacatag

SEQ ID NO: 15417 - DNA, 20 bp, Artificial Sequence
  chemically synthesized
atcctgaaaacataggagtc

SEQ ID NO: 15418 - DNA, 20 bp, Artificial Sequence
  chemically synthesized
tcctgaaaacataggagtca

SEQ ID NO: 15419 - DNA, 20 bp, Artificial Sequence
  chemically synthesized
ggagtcaaggcacttgcccc

SEQ ID NO: 15420 - DNA, 20 bp, Artificial Sequence
  chemically synthesized
tcaaggcacttgcccctagc

SEQ ID NO: 15421 - DNA, 20 bp, Artificial Sequence
  chemically synthesized
caaggcacttgcccctagct

SEQ ID NO: 15422 - DNA, 20 bp, Artificial Sequence
  chemically synthesized
aaggcacttgcccctagctg

SEQ ID NO: 15423 - DNA, 20 bp, Artificial Sequence
  chemically synthesized
aggcacttgcccctagctgg

SEQ ID NO: 15424 - DNA, 20 bp, Artificial Sequence
  chemically synthesized
cttgcccctagctgggggta

SEQ ID NO: 15425 - DNA, 20 bp, Artificial Sequence
  chemically synthesized
ttgcccctagctgggggtat

SEQ ID NO: 15426 - DNA, 20 bp, Artificial Sequence
  chemically synthesized
tgcccctagctgggggtata

SEQ ID NO: 15427 - DNA, 20 bp, Artificial Sequence
  chemically synthesized
gcccctagctgggggtatag

SEQ ID NO: 15428 - DNA, 20 bp, Artificial Sequence
  chemically synthesized
ccctagctgggggtataggg

SEQ ID NO: 15429 - DNA, 20 bp, Artificial Sequence
  chemically synthesized
tagctgggggtataggggag

SEQ ID NO: 15430 - DNA, 20 bp, Artificial Sequence
  chemically synthesized
tataggggagcagtcccatg

SEQ ID NO: 15431 - DNA, 20 bp, Artificial Sequence
  chemically synthesized
aggggagcagtcccatgtag

SEQ ID NO: 15432 - DNA, 20 bp, Artificial Sequence
  chemically synthesized
ggagcagtcccatgtagtag

SEQ ID NO: 15433 - DNA, 20 bp, Artificial Sequence
  chemically synthesized
ccatgtctgccctctactca

SEQ ID NO: 15434 - DNA, 20 bp, Artificial Sequence
  chemically synthesized
tactcatggtctatctctcc

SEQ ID NO: 15435 - DNA, 20 bp, Artificial Sequence
  chemically synthesized
ggtctatctctcctggctcc

SEQ ID NO: 15436 - DNA, 20 bp, Artificial Sequence
  chemically synthesized
gtctatctctcctggctcct

SEQ ID NO: 15437 - DNA, 20 bp, Artificial Sequence
  chemically synthesized
ctatctctcctggctcctgg

SEQ ID NO: 15438 - DNA, 20 bp, Artificial Sequence
  chemically synthesized
ctcctggctcctgggagtca

SEQ ID NO: 15439 - DNA, 20 bp, Artificial Sequence
  chemically synthesized
tgggagtcatggactccacc

SEQ ID NO: 15440 - DNA, 20 bp, Artificial Sequence
  chemically synthesized
cctgacctaaccacctatct

SEQ ID NO: 15441 - DNA, 20 bp, Artificial Sequence
  chemically synthesized
aaccacctatctgagcctgc

SEQ ID NO: 15442 - DNA, 20 bp, Artificial Sequence
  chemically synthesized
ctgccagcctataacccatc

SEQ ID NO: 15443 - DNA, 20 bp, Artificial Sequence
  chemically synthesized
tgccagcctataacccatct

SEQ ID NO: 15444 - DNA, 20 bp, Artificial Sequence
  chemically synthesized
ataacccatctgggccctga

SEQ ID NO: 15445 - DNA, 20 bp, Artificial Sequence
  chemically synthesized
cccatctgggccctgatagc

SEQ ID NO: 15446 - DNA, 20 bp, Artificial Sequence
  chemically synthesized
atctgggccctgatagctgg

SEQ ID NO: 15447 - DNA, 20 bp, Artificial Sequence
  chemically synthesized
gggccctgatagctggtggc

SEQ ID NO: 15448 - DNA, 20 bp, Artificial Sequence
  chemically synthesized
tgaccccaccccaccctccc

SEQ ID NO: 15449 - DNA, 20 bp, Artificial Sequence
  chemically synthesized
accctccctggaacctctga

SEQ ID NO: 15450 - DNA, 20 bp, Artificial Sequence
  chemically synthesized
gaacctctgatagacacatc

SEQ ID NO: 15451 - DNA, 20 bp, Artificial Sequence
  chemically synthesized
gatagacacatctggcacac

SEQ ID NO: 15452 - DNA, 20 bp, Artificial Sequence
  chemically synthesized
atctggcacaccagctcgca

SEQ ID NO: 15453 - DNA, 20 bp, Artificial Sequence
  chemically synthesized
ccagctcgcaaagtcaccgt

SEQ ID NO: 15454 - DNA, 20 bp, Artificial Sequence
  chemically synthesized
cagctcgcaaagtcaccgtg

SEQ ID NO: 15455 - DNA, 20 bp, Artificial Sequence
  chemically synthesized
agctcgcaaagtcaccgtga

SEQ ID NO: 15456 - DNA, 20 bp, Artificial Sequence
  chemically synthesized
gtgagggtcttgtgtttgct

SEQ ID NO: 15457 - DNA, 20 bp, Artificial Sequence
  chemically synthesized
gtcaaaattccttgaaatcc

SEQ ID NO: 15458 - DNA, 20 bp, Artificial Sequence
  chemically synthesized
ttccttgaaatccaagtcct

SEQ ID NO: 15459 - DNA, 20 bp, Artificial Sequence
  chemically synthesized
ccttgaaatccaagtcctta

SEQ ID NO: 15460 - DNA, 20 bp, Artificial Sequence
  chemically synthesized
gactcctgctcccaaattta

SEQ ID NO: 15461 - DNA, 20 bp, Artificial Sequence
  chemically synthesized
tgctcccaaatttacagtca

SEQ ID NO: 15462 - DNA, 20 bp, Artificial Sequence
  chemically synthesized
tacagtcatagacttcttca

SEQ ID NO: 15463 - DNA, 20 bp, Artificial Sequence
  chemically synthesized
atggctgtctcctttatcca

SEQ ID NO: 15464 - DNA, 20 bp, Artificial Sequence
  chemically synthesized
atccatctgatcctcctcat

SEQ ID NO: 15465 - DNA, 20 bp, Artificial Sequence
  chemically synthesized
tctgatcctcctcatcagtg

SEQ ID NO: 15466 - DNA, 20 bp, Artificial Sequence
  chemically synthesized
tcctcctcatcagtgcagca

SEQ ID NO: 15467 - DNA, 20 bp, Artificial Sequence
  chemically synthesized
cctcctcatcagtgcagcac

SEQ ID NO: 15468 - DNA, 20 bp, Artificial Sequence
  chemically synthesized
ctcctcatcagtgcagcaca

SEQ ID NO: 15469 - DNA, 20 bp, Artificial Sequence
  chemically synthesized
cagtgcagcacagggcccat

SEQ ID NO: 15470 - DNA, 20 bp, Artificial Sequence
  chemically synthesized
tgcagcacagggcccatgag

SEQ ID NO: 15471 - DNA, 20 bp, Artificial Sequence
  chemically synthesized
agcacagggcccatgagcag

SEQ ID NO: 15472 - DNA, 20 bp, Artificial Sequence
  chemically synthesized
gggcccatgagcagtagctg

SEQ ID NO: 15473 - DNA, 20 bp, Artificial Sequence
  chemically synthesized
gcccatgagcagtagctgca

SEQ ID NO: 15474 - DNA, 20 bp, Artificial Sequence
  chemically synthesized
agtagctgcagagtctcaca

SEQ ID NO: 15475 - DNA, 20 bp, Artificial Sequence
  chemically synthesized
gtagctgcagagtctcacat

SEQ ID NO: 15476 - DNA, 20 bp, Artificial Sequence
  chemically synthesized
tgcagagtctcacataggtc

SEQ ID NO: 15477 - DNA, 20 bp, Artificial Sequence
  chemically synthesized
gcctctgacatgtccgacct

SEQ ID NO: 15478 - DNA, 20 bp, Artificial Sequence
  chemically synthesized
cctctgacatgtccgacctt

SEQ ID NO: 15479 - DNA, 20 bp, Artificial Sequence
  chemically synthesized
ggcaaatgcttgactcttct

SEQ ID NO: 15480 - DNA, 20 bp, Artificial Sequence
  chemically synthesized
atgcttgactcttctgagct

SEQ ID NO: 15481 - DNA, 20 bp, Artificial Sequence
  chemically synthesized
ttctgagctcagtcttgtca

SEQ ID NO: 15482 - DNA, 20 bp, Artificial Sequence
  chemically synthesized
agtcttgtcatggcaaaata

SEQ ID NO: 15483 - DNA, 20 bp, Artificial Sequence
  chemically synthesized
tggcaaaataaagataataa

SEQ ID NO: 15484 - DNA, 20 bp, Artificial Sequence
  chemically synthesized
ataataatagtgttttttta

SEQ ID NO: 15485 - DNA, 20 bp, Artificial Sequence
  chemically synthesized
aataatagtgtttttttatg

SEQ ID NO: 15486 - DNA, 20 bp, Artificial Sequence
  chemically synthesized
atagtgtttttttatggagt

SEQ ID NO: 15487 - DNA, 20 bp, Artificial Sequence
  chemically synthesized
tttttttatggagttagcgt

SEQ ID NO: 15488 - DNA, 20 bp, Artificial Sequence
  chemically synthesized
ttttttatggagttagcgtg

SEQ ID NO: 15489 - DNA, 20 bp, Artificial Sequence
  chemically synthesized
ttatggagttagcgtgagga

SEQ ID NO: 15490 - DNA, 20 bp, Artificial Sequence
  chemically synthesized
agcgtgaggatggaaaacaa

SEQ ID NO: 15491 - DNA, 20 bp, Artificial Sequence
  chemically synthesized
aaaacaatagcaaaattgat

SEQ ID NO: 15492 - DNA, 20 bp, Artificial Sequence
  chemically synthesized
caaaattgattagactataa

SEQ ID NO: 15493 - DNA, 20 bp, Artificial Sequence
  chemically synthesized
aaaattgattagactataaa

SEQ ID NO: 15494 - DNA, 20 bp, Artificial Sequence
  chemically synthesized
ctataaaaggtctcaacaaa

SEQ ID NO: 15495 - DNA, 20 bp, Artificial Sequence
  chemically synthesized
taaaaggtctcaacaaatag

SEQ ID NO: 15496 - DNA, 20 bp, Artificial Sequence
  chemically synthesized
aaggtctcaacaaatagtag

SEQ ID NO: 15497 - DNA, 20 bp, Artificial Sequence
  chemically synthesized
aattttcccttacctataat

SEQ ID NO: 15498 - DNA, 20 bp, Artificial Sequence
  chemically synthesized
ttttcccttacctataataa

SEQ ID NO: 15499 - DNA, 20 bp, Artificial Sequence
  chemically synthesized
ctcttattatattcttctta

SEQ ID NO: 15500 - DNA, 20 bp, Artificial Sequence
  chemically synthesized
tattcttcttatagtgattc

SEQ ID NO: 15501 - DNA, 20 bp, Artificial Sequence
  chemically synthesized
tatagtgattctggatatta

SEQ ID NO: 15502 - DNA, 20 bp, Artificial Sequence
  chemically synthesized
agtgattctggatattaaag

SEQ ID NO: 15503 - DNA, 20 bp, Artificial Sequence
  chemically synthesized
gtgattctggatattaaagt

SEQ ID NO: 15504 - DNA, 20 bp, Artificial Sequence
  chemically synthesized
ctggatattaaagtgggaat

SEQ ID NO: 15505 - DNA, 20 bp, Artificial Sequence
  chemically synthesized
tggatattaaagtgggaatg

SEQ ID NO: 15506 - DNA, 20 bp, Artificial Sequence
  chemically synthesized
ggatattaaagtgggaatga

SEQ ID NO: 15507 - DNA, 20 bp, Artificial Sequence
  chemically synthesized
gatattaaagtgggaatgag

SEQ ID NO: 15508 - DNA, 20 bp, Artificial Sequence
  chemically synthesized
attaaagtgggaatgagggg

SEQ ID NO: 15509 - DNA, 20 bp, Artificial Sequence
  chemically synthesized
ttaaagtgggaatgaggggc

SEQ ID NO: 15510 - DNA, 20 bp, Artificial Sequence
  chemically synthesized
tgaggggcaggccactaacg

SEQ ID NO: 15511 - DNA, 20 bp, Artificial Sequence
  chemically synthesized
ggggcaggccactaacgaag

SEQ ID NO: 15512 - DNA, 20 bp, Artificial Sequence
  chemically synthesized
aacgaagaagatgtttctca

SEQ ID NO: 15513 - DNA, 20 bp, Artificial Sequence
  chemically synthesized
gaagaagatgtttctcaaag

SEQ ID NO: 15514 - DNA, 20 bp, Artificial Sequence
  chemically synthesized
aagaagccattctccccaca

SEQ ID NO: 15515 - DNA, 20 bp, Artificial Sequence
  chemically synthesized
tctccccacatagatcatct

SEQ ID NO: 15516 - DNA, 20 bp, Artificial Sequence
  chemically synthesized
ccccacatagatcatctcag

SEQ ID NO: 15517 - DNA, 20 bp, Artificial Sequence
  chemically synthesized
cccacatagatcatctcagc

SEQ ID NO: 15518 - DNA, 20 bp, Artificial Sequence
  chemically synthesized
ccacatagatcatctcagca

SEQ ID NO: 15519 - DNA, 20 bp, Artificial Sequence
  chemically synthesized
tagatcatctcagcagggtt

SEQ ID NO: 15520 - DNA, 20 bp, Artificial Sequence
  chemically synthesized
agatcatctcagcagggttc

SEQ ID NO: 15521 - DNA, 20 bp, Artificial Sequence
  chemically synthesized
tcatctcagcagggttcagg

SEQ ID NO: 15522 - DNA, 20 bp, Artificial Sequence
  chemically synthesized
cagcagggttcaggaagata

SEQ ID NO: 15523 - DNA, 20 bp, Artificial Sequence
  chemically synthesized
agcagggttcaggaagataa

SEQ ID NO: 15524 - DNA, 20 bp, Artificial Sequence
  chemically synthesized
cagggttcaggaagataaag

SEQ ID NO: 15525 - DNA, 20 bp, Artificial Sequence
  chemically synthesized
agggttcaggaagataaagg

SEQ ID NO: 15526 - DNA, 20 bp, Artificial Sequence
  chemically synthesized
caggaagataaaggaggatc

SEQ ID NO: 15527 - DNA, 20 bp, Artificial Sequence
  chemically synthesized
aggaagataaaggaggatca

SEQ ID NO: 15528 - DNA, 20 bp, Artificial Sequence
  chemically synthesized
ataaaggaggatcaaggtcg

SEQ ID NO: 15529 - DNA, 20 bp, Artificial Sequence
  chemically synthesized
taaaggaggatcaaggtcga

SEQ ID NO: 15530 - DNA, 20 bp, Artificial Sequence
  chemically synthesized
aggaggatcaaggtcgaagg

SEQ ID NO: 15531 - DNA, 20 bp, Artificial Sequence
  chemically synthesized
ggaggatcaaggtcgaaggt

SEQ ID NO: 15532 - DNA, 20 bp, Artificial Sequence
  chemically synthesized
caaggtcgaaggtaggaact

SEQ ID NO: 15533 - DNA, 20 bp, Artificial Sequence
  chemically synthesized
aaggtcgaaggtaggaacta

SEQ ID NO: 15534 - DNA, 20 bp, Artificial Sequence
  chemically synthesized
gtcgaaggtaggaactaagg

SEQ ID NO: 15535 - DNA, 20 bp, Artificial Sequence
  chemically synthesized
taggaactaaggaagaacac

SEQ ID NO: 15536 - DNA, 20 bp, Artificial Sequence
  chemically synthesized
aggaactaaggaagaacact

SEQ ID NO: 15537 - DNA, 20 bp, Artificial Sequence
  chemically synthesized
actaaggaagaacactgggc

SEQ ID NO: 15538 - DNA, 20 bp, Artificial Sequence
  chemically synthesized
aaggaagaacactgggcaag

SEQ ID NO: 15539 - DNA, 20 bp, Artificial Sequence
  chemically synthesized
gaacactgggcaagtggatc

SEQ ID NO: 15540 - DNA, 20 bp, Artificial Sequence
  chemically synthesized
aacactgggcaagtggatcc

SEQ ID NO: 15541 - DNA, 20 bp, Artificial Sequence
  chemically synthesized
tccaggttgtccaacgctga

SEQ ID NO: 15542 - DNA, 20 bp, Artificial Sequence
  chemically synthesized
aggttgtccaacgctgaaag

SEQ ID NO: 15543 - DNA, 20 bp, Artificial Sequence
  chemically synthesized
ggttgtccaacgctgaaagt

SEQ ID NO: 15544 - DNA, 20 bp, Artificial Sequence
  chemically synthesized
aacgctgaaagtaggaatct

SEQ ID NO: 15545 - DNA, 20 bp, Artificial Sequence
  chemically synthesized
gaaagtaggaatctaagcac

SEQ ID NO: 15546 - DNA, 20 bp, Artificial Sequence
  chemically synthesized
ggaatctaagcactagtctc

SEQ ID NO: 15547 - DNA, 20 bp, Artificial Sequence
  chemically synthesized
aagcactagtctctggatgc

SEQ ID NO: 15548 - DNA, 20 bp, Artificial Sequence
  chemically synthesized
agcactagtctctggatgct

SEQ ID NO: 15549 - DNA, 20 bp, Artificial Sequence
  chemically synthesized
cactagtctctggatgctag

SEQ ID NO: 15550 - DNA, 20 bp, Artificial Sequence
  chemically synthesized
actagtctctggatgctagg

SEQ ID NO: 15551 - DNA, 20 bp, Artificial Sequence
  chemically synthesized
ctagtctctggatgctagga

SEQ ID NO: 15552 - DNA, 20 bp, Artificial Sequence
  chemically synthesized
atgctaggagggcctctgca

SEQ ID NO: 15553 - DNA, 20 bp, Artificial Sequence
  chemically synthesized
tgctaggagggcctctgcat

SEQ ID NO: 15554 - DNA, 20 bp, Artificial Sequence
  chemically synthesized
gcatgggtaactctttcaac

SEQ ID NO: 15555 - DNA, 20 bp, Artificial Sequence
  chemically synthesized
gggtaactctttcaactagc

SEQ ID NO: 15556 - DNA, 20 bp, Artificial Sequence
  chemically synthesized
ggtaactctttcaactagcc

SEQ ID NO: 15557 - DNA, 20 bp, Artificial Sequence
  chemically synthesized
gtaactctttcaactagcca

SEQ ID NO: 15558 - DNA, 20 bp, Artificial Sequence
  chemically synthesized
taactctttcaactagccag

SEQ ID NO: 15559 - DNA, 20 bp, Artificial Sequence
  chemically synthesized
tctttcaactagccaggggc

SEQ ID NO: 15560 - DNA, 20 bp, Artificial Sequence
  chemically synthesized
actagccaggggctggactg

SEQ ID NO: 15561 - DNA, 20 bp, Artificial Sequence
  chemically synthesized
tagccaggggctggactgtg

SEQ ID NO: 15562 - DNA, 20 bp, Artificial Sequence
  chemically synthesized
gactgtggagaaaccatttc

SEQ ID NO: 15563 - DNA, 20 bp, Artificial Sequence
  chemically synthesized
gtggagaaaccatttccaga

SEQ ID NO: 15564 - DNA, 20 bp, Artificial Sequence
  chemically synthesized
gagaaaccatttccagatag

SEQ ID NO: 15565 - DNA, 20 bp, Artificial Sequence
  chemically synthesized
aaccatttccagatagaagt

SEQ ID NO: 15566 - DNA, 20 bp, Artificial Sequence
  chemically synthesized
accatttccagatagaagtg

SEQ ID NO: 15567 - DNA, 20 bp, Artificial Sequence
  chemically synthesized
catttccagatagaagtgag

SEQ ID NO: 15568 - DNA, 20 bp, Artificial Sequence
  chemically synthesized
agatagaagtgaggagattc

SEQ ID NO: 15569 - DNA, 20 bp, Artificial Sequence
  chemically synthesized
tagaagtgaggagattccag

SEQ ID NO: 15570 - DNA, 20 bp, Artificial Sequence
  chemically synthesized
agaagtgaggagattccagc

SEQ ID NO: 15571 - DNA, 20 bp, Artificial Sequence
  chemically synthesized
gattccagcaggaaacactt

SEQ ID NO: 15572 - DNA, 20 bp, Artificial Sequence
  chemically synthesized
ttccagcaggaaacacttaa

SEQ ID NO: 15573 - DNA, 20 bp, Artificial Sequence
  chemically synthesized
ccagcaggaaacacttaaga

SEQ ID NO: 15574 - DNA, 20 bp, Artificial Sequence
  chemically synthesized
cagcaggaaacacttaagag

SEQ ID NO: 15575 - DNA, 20 bp, Artificial Sequence
  chemically synthesized
aacacttaagagaggatccc

SEQ ID NO: 15576 - DNA, 20 bp, Artificial Sequence
  chemically synthesized
acttaagagaggatccctgg

SEQ ID NO: 15577 - DNA, 20 bp, Artificial Sequence
  chemically synthesized
agagaggatccctggaagtt

SEQ ID NO: 15578 - DNA, 20 bp, Artificial Sequence
  chemically synthesized
gagaggatccctggaagttc

SEQ ID NO: 15579 - DNA, 20 bp, Artificial Sequence
  chemically synthesized
agaggatccctggaagttcg

SEQ ID NO: 15580 - DNA, 20 bp, Artificial Sequence
  chemically synthesized
ggatccctggaagttcgggg

SEQ ID NO: 15581 - DNA, 20 bp, Artificial Sequence
  chemically synthesized
gatccctggaagttcggggc

SEQ ID NO: 15582 - DNA, 20 bp, Artificial Sequence
  chemically synthesized
tccctggaagttcggggcag

SEQ ID NO: 15583 - DNA, 20 bp, Artificial Sequence
  chemically synthesized
ccctggaagttcggggcagg

SEQ ID NO: 15584 - DNA, 20 bp, Artificial Sequence
  chemically synthesized
aggaggctccctgtcacatg

SEQ ID NO: 15585 - DNA, 20 bp, Artificial Sequence
  chemically synthesized
ggaggctccctgtcacatga

SEQ ID NO: 15586 - DNA, 20 bp, Artificial Sequence
  chemically synthesized
tcacatgaaggaaacctgct

SEQ ID NO: 15587 - DNA, 20 bp, Artificial Sequence
  chemically synthesized
tgaaggaaacctgctcagcg

SEQ ID NO: 15588 - DNA, 20 bp, Artificial Sequence
  chemically synthesized
gaaggaaacctgctcagcgt

SEQ ID NO: 15589 - DNA, 20 bp, Artificial Sequence
  chemically synthesized
aacctgctcagcgtaggctc

SEQ ID NO: 15590 - DNA, 20 bp, Artificial Sequence
  chemically synthesized
acctgctcagcgtaggctct

SEQ ID NO: 15591 - DNA, 20 bp, Artificial Sequence
  chemically synthesized
tcttccctactcttatccaa

SEQ ID NO: 15592 - DNA, 20 bp, Artificial Sequence
  chemically synthesized
cttccctactcttatccaat

SEQ ID NO: 15593 - DNA, 20 bp, Artificial Sequence
  chemically synthesized
ttccctactcttatccaatg

SEQ ID NO: 15594 - DNA, 20 bp, Artificial Sequence
  chemically synthesized
ccaatggggcttctgatttt

SEQ ID NO: 15595 - DNA, 20 bp, Artificial Sequence
  chemically synthesized
tggggcttctgattttaagc

SEQ ID NO: 15596 - DNA, 20 bp, Artificial Sequence
  chemically synthesized
attttaagccagtcttcaca

SEQ ID NO: 15597 - DNA, 20 bp, Artificial Sequence
  chemically synthesized
agccagtcttcacaaagccc

SEQ ID NO: 15598 - DNA, 20 bp, Artificial Sequence
  chemically synthesized
agccccagatttctacatgc

SEQ ID NO: 15599 - DNA, 20 bp, Artificial Sequence
  chemically synthesized
ccccagatttctacatgctg

SEQ ID NO: 15600 - DNA, 20 bp, Artificial Sequence
  chemically synthesized
ctacatgctggagccctgaa

SEQ ID NO: 15601 - DNA, 20 bp, Artificial Sequence
  chemically synthesized
tacatgctggagccctgaat

SEQ ID NO: 15602 - DNA, 20 bp, Artificial Sequence
  chemically synthesized
atgctggagccctgaatggg

SEQ ID NO: 15603 - DNA, 20 bp, Artificial Sequence
  chemically synthesized
tgctggagccctgaatgggc

SEQ ID NO: 15604 - DNA, 20 bp, Artificial Sequence
  chemically synthesized
tggagccctgaatgggcagg

SEQ ID NO: 15605 - DNA, 20 bp, Artificial Sequence
  chemically synthesized
tgaatgggcaggaagcattg

SEQ ID NO: 15606 - DNA, 20 bp, Artificial Sequence
  chemically synthesized
attgcggtttccatttcatt

SEQ ID NO: 15607 - DNA, 20 bp, Artificial Sequence
  chemically synthesized
tgcggtttccatttcattca

SEQ ID NO: 15608 - DNA, 20 bp, Artificial Sequence
  chemically synthesized
tttcataccctgcttcccca

SEQ ID NO: 15609 - DNA, 20 bp, Artificial Sequence
  chemically synthesized
ataatctgattcatgcaacc

SEQ ID NO: 15610 - DNA, 20 bp, Artificial Sequence
  chemically synthesized
ttcatgcaaccaagaattat

SEQ ID NO: 15611 - DNA, 20 bp, Artificial Sequence
  chemically synthesized
catgcaaccaagaattatga

SEQ ID NO: 15612 - DNA, 20 bp, Artificial Sequence
  chemically synthesized
tgcaaccaagaattatgaga

SEQ ID NO: 15613 - DNA, 20 bp, Artificial Sequence
  chemically synthesized
aagaattatgagagagcctt

SEQ ID NO: 15614 - DNA, 20 bp, Artificial Sequence
  chemically synthesized
agagagccttcagtcatgcc

SEQ ID NO: 15615 - DNA, 20 bp, Artificial Sequence
  chemically synthesized
gagagccttcagtcatgcct

SEQ ID NO: 15616 - DNA, 20 bp, Artificial Sequence
  chemically synthesized
atttattgttgtgcatatga

SEQ ID NO: 15617 - DNA, 20 bp, Artificial Sequence
  chemically synthesized
tttattgttgtgcatatgat

SEQ ID NO: 15618 - DNA, 20 bp, Artificial Sequence
  chemically synthesized
ttattgttgtgcatatgatg

SEQ ID NO: 15619 - DNA, 20 bp, Artificial Sequence
  chemically synthesized
ttgttgtgcatatgatgggg

SEQ ID NO: 15620 - DNA, 20 bp, Artificial Sequence
  chemically synthesized
ttgtgcatatgatggggtag

SEQ ID NO: 15621 - DNA, 20 bp, Artificial Sequence
  chemically synthesized
catatgatggggtagcagac

SEQ ID NO: 15622 - DNA, 20 bp, Artificial Sequence
  chemically synthesized
agcagacaagaaaacgttaa

SEQ ID NO: 15623 - DNA, 20 bp, Artificial Sequence
  chemically synthesized
acaagaaaacgttaacagca

SEQ ID NO: 15624 - DNA, 20 bp, Artificial Sequence
  chemically synthesized
gttaacagcatagactttct

SEQ ID NO: 15625 - DNA, 20 bp, Artificial Sequence
  chemically synthesized
taacagcatagactttctca

SEQ ID NO: 15626 - DNA, 20 bp, Artificial Sequence
  chemically synthesized
agactttctcagagctatat

SEQ ID NO: 15627 - DNA, 20 bp, Artificial Sequence
  chemically synthesized
ttctcagagctatatgagtt

SEQ ID NO: 15628 - DNA, 20 bp, Artificial Sequence
  chemically synthesized
tctcagagctatatgagttt

SEQ ID NO: 15629 - DNA, 20 bp, Artificial Sequence
  chemically synthesized
tatgagtttgggaattaatc

SEQ ID NO: 15630 - DNA, 20 bp, Artificial Sequence
  chemically synthesized
gtttgggaattaatcaagac

SEQ ID NO: 15631 - DNA, 20 bp, Artificial Sequence
  chemically synthesized
atcaagaccagccttttgct

SEQ ID NO: 15632 - DNA, 20 bp, Artificial Sequence
  chemically synthesized
tcaagaccagccttttgctc

SEQ ID NO: 15633 - DNA, 20 bp, Artificial Sequence
  chemically synthesized
caagaccagccttttgctca

SEQ ID NO: 15634 - DNA, 20 bp, Artificial Sequence
  chemically synthesized
gaccagccttttgctcaggg

SEQ ID NO: 15635 - DNA, 20 bp, Artificial Sequence
  chemically synthesized
ctcagggtagaaatccccta

SEQ ID NO: 15636 - DNA, 20 bp, Artificial Sequence
  chemically synthesized
tcagggtagaaatcccctat

SEQ ID NO: 15637 - DNA, 20 bp, Artificial Sequence
  chemically synthesized
cagggtagaaatcccctata

SEQ ID NO: 15638 - DNA, 20 bp, Artificial Sequence
  chemically synthesized
tatagggatttattcaatga

SEQ ID NO: 15639 - DNA, 20 bp, Artificial Sequence
  chemically synthesized
atagggatttattcaatgat

SEQ ID NO: 15640 - DNA, 20 bp, Artificial Sequence
  chemically synthesized
tttattcaatgatgggttaa

SEQ ID NO: 15641 - DNA, 20 bp, Artificial Sequence
  chemically synthesized
tgggttaaaagctttctata

SEQ ID NO: 15642 - DNA, 20 bp, Artificial Sequence
  chemically synthesized
ttaaaagctttctatatggt

SEQ ID NO: 15643 - DNA, 20 bp, Artificial Sequence
  chemically synthesized
taaaagctttctatatggtg

SEQ ID NO: 15644 - DNA, 20 bp, Artificial Sequence
  chemically synthesized
aaagctttctatatggtgag

SEQ ID NO: 15645 - DNA, 20 bp, Artificial Sequence
  chemically synthesized
tctatatggtgaggagctca

SEQ ID NO: 15646 - DNA, 20 bp, Artificial Sequence
  chemically synthesized
gaggagctcacagattttcc

SEQ ID NO: 15647 - DNA, 20 bp, Artificial Sequence
  chemically synthesized
ttccaagcccttgcttttgc

SEQ ID NO: 15648 - DNA, 20 bp, Artificial Sequence
  chemically synthesized
aagcccttgcttttgctaga

SEQ ID NO: 15649 - DNA, 20 bp, Artificial Sequence
  chemically synthesized
gtttatgaaattcttacaca

SEQ ID NO: 15650 - DNA, 20 bp, Artificial Sequence
  chemically synthesized
tatgaaattcttacacacag

SEQ ID NO: 15651 - DNA, 20 bp, Artificial Sequence
  chemically synthesized
acagaagaatcttctaatcc

SEQ ID NO: 15652 - DNA, 20 bp, Artificial Sequence
  chemically synthesized
cagaagaatcttctaatcct

SEQ ID NO: 15653 - DNA, 20 bp, Artificial Sequence
  chemically synthesized
tataacttgattccctattc

SEQ ID NO: 15654 - DNA, 20 bp, Artificial Sequence
  chemically synthesized
aacttgattccctattccag

SEQ ID NO: 15655 - DNA, 20 bp, Artificial Sequence
  chemically synthesized
gataatattcccatattctg

SEQ ID NO: 15656 - DNA, 20 bp, Artificial Sequence
  chemically synthesized
ttcatgcatttgttaaataa

SEQ ID NO: 15657 - DNA, 20 bp, Artificial Sequence
  chemically synthesized
tcatgcatttgttaaataat

SEQ ID NO: 15658 - DNA, 20 bp, Artificial Sequence
  chemically synthesized
catttgttaaataataggca

SEQ ID NO: 15659 - DNA, 20 bp, Artificial Sequence
  chemically synthesized
taaataataggcatagtgac

SEQ ID NO: 15660 - DNA, 20 bp, Artificial Sequence
  chemically synthesized
ataggcatagtgacaagtgc

SEQ ID NO: 15661 - DNA, 20 bp, Artificial Sequence
  chemically synthesized
gacaagtgccagaactctaa

SEQ ID NO: 15662 - DNA, 20 bp, Artificial Sequence
  chemically synthesized
ccagaactctaacagtcaac

SEQ ID NO: 15663 - DNA, 20 bp, Artificial Sequence
  chemically synthesized
agaactctaacagtcaacca

SEQ ID NO: 15664 - DNA, 20 bp, Artificial Sequence
  chemically synthesized
aactctaacagtcaaccaga

SEQ ID NO: 15665 - DNA, 20 bp, Artificial Sequence
  chemically synthesized
aacagtcaaccagagagcca

SEQ ID NO: 15666 - DNA, 20 bp, Artificial Sequence
  chemically synthesized
ccacagttttcaacttcaca

SEQ ID NO: 15667 - DNA, 20 bp, Artificial Sequence
  chemically synthesized
caaagttaaccatctaactg

SEQ ID NO: 15668 - DNA, 20 bp, Artificial Sequence
  chemically synthesized
gttaaccatctaactgaaga

SEQ ID NO: 15669 - DNA, 20 bp, Artificial Sequence
  chemically synthesized
aaccatctaactgaagacag

SEQ ID NO: 15670 - DNA, 20 bp, Artificial Sequence
  chemically synthesized
accaccaccccttctccaca

SEQ ID NO: 15671 - DNA, 20 bp, Artificial Sequence
  chemically synthesized
caccccttctccacatggtg

SEQ ID NO: 15672 - DNA, 20 bp, Artificial Sequence
  chemically synthesized
ggtgtagtctttcctgatgt

SEQ ID NO: 15673 - DNA, 20 bp, Artificial Sequence
  chemically synthesized
gtgtagtctttcctgatgtc

SEQ ID NO: 15674 - DNA, 20 bp, Artificial Sequence
  chemically synthesized
tgtagtctttcctgatgtca

SEQ ID NO: 15675 - DNA, 20 bp, Artificial Sequence
  chemically synthesized
tttcctgatgtcagggatgt

SEQ ID NO: 15676 - DNA, 20 bp, Artificial Sequence
  chemically synthesized
ttcctgatgtcagggatgtt

SEQ ID NO: 15677 - DNA, 20 bp, Artificial Sequence
  chemically synthesized
gatgtcagggatgttaggct

SEQ ID NO: 15678 - DNA, 20 bp, Artificial Sequence
  chemically synthesized
atgtcagggatgttaggctc

SEQ ID NO: 15679 - DNA, 20 bp, Artificial Sequence
  chemically synthesized
cagggatgttaggctcaggt

SEQ ID NO: 15680 - DNA, 20 bp, Artificial Sequence
  chemically synthesized
agggatgttaggctcaggtt

SEQ ID NO: 15681 - DNA, 20 bp, Artificial Sequence
  chemically synthesized
atgttaggctcaggttagga

SEQ ID NO: 15682 - DNA, 20 bp, Artificial Sequence
  chemically synthesized
taggctcaggttaggaaagt

SEQ ID NO: 15683 - DNA, 20 bp, Artificial Sequence
  chemically synthesized
ggaaagtcagactatcatcc

SEQ ID NO: 15684 - DNA, 20 bp, Artificial Sequence
  chemically synthesized
aaagtcagactatcatccca

SEQ ID NO: 15685 - DNA, 20 bp, Artificial Sequence
  chemically synthesized
gtcagactatcatcccagag

SEQ ID NO: 15686 - DNA, 20 bp, Artificial Sequence
  chemically synthesized
tcagactatcatcccagagc

SEQ ID NO: 15687 - DNA, 20 bp, Artificial Sequence
  chemically synthesized
tatcatcccagagcaggaca

SEQ ID NO: 15688 - DNA, 20 bp, Artificial Sequence
  chemically synthesized
gagcaggacacagacgaata

SEQ ID NO: 15689 - DNA, 20 bp, Artificial Sequence
  chemically synthesized
acgaataaagtgtaattttt

SEQ ID NO: 15690 - DNA, 20 bp, Artificial Sequence
  chemically synthesized
agtgtaattttttagtcact

SEQ ID NO: 15691 - DNA, 20 bp, Artificial Sequence
  chemically synthesized
gtgtaattttttagtcactt

SEQ ID NO: 15692 - DNA, 20 bp, Artificial Sequence
  chemically synthesized
ttttagtcacttaggaaaaa

SEQ ID NO: 15693 - DNA, 20 bp, Artificial Sequence
  chemically synthesized
tagtcacttaggaaaaacag

SEQ ID NO: 15694 - DNA, 20 bp, Artificial Sequence
  chemically synthesized
aggaaaaacagtggaatgca

SEQ ID NO: 15695 - DNA, 20 bp, Artificial Sequence
  chemically synthesized
gaaaaacagtggaatgcaaa

SEQ ID NO: 15696 - DNA, 20 bp, Artificial Sequence
  chemically synthesized
agtaaaaaatgctttctgaa

SEQ ID NO: 15697 - DNA, 20 bp, Artificial Sequence
  chemically synthesized
tgctttctgaatggataact

SEQ ID NO: 15698 - DNA, 20 bp, Artificial Sequence
  chemically synthesized
tctgaatggataacttggcc

SEQ ID NO: 15699 - DNA, 20 bp, Artificial Sequence
  chemically synthesized
ctgaatggataacttggcct

SEQ ID NO: 15700 - DNA, 20 bp, Artificial Sequence
  chemically synthesized
gaatggataacttggcctgg

SEQ ID NO: 15701 - DNA, 20 bp, Artificial Sequence
  chemically synthesized
aatggataacttggcctggg

SEQ ID NO: 15702 - DNA, 20 bp, Artificial Sequence
  chemically synthesized
aacttggcctgggaggcctt

SEQ ID NO: 15703 - DNA, 20 bp, Artificial Sequence
  chemically synthesized
ttggcctgggaggcctttgg

SEQ ID NO: 15704 - DNA, 20 bp, Artificial Sequence
  chemically synthesized
gcctgggaggcctttggaag

SEQ ID NO: 15705 - DNA, 20 bp, Artificial Sequence
  chemically synthesized
ctgggaggcctttggaagca

SEQ ID NO: 15706 - DNA, 20 bp, Artificial Sequence
  chemically synthesized
aggcctttggaagcagagac

SEQ ID NO: 15707 - DNA, 20 bp, Artificial Sequence
  chemically synthesized
gcctttggaagcagagactg

SEQ ID NO: 15708 - DNA, 20 bp, Artificial Sequence
  chemically synthesized
tttaaacatctttgtatccc

SEQ ID NO: 15709 - DNA, 20 bp, Artificial Sequence
  chemically synthesized
atctttgtatccccagcatc

SEQ ID NO: 15710 - DNA, 20 bp, Artificial Sequence
  chemically synthesized
tatccccagcatccagcata

SEQ ID NO: 15711 - DNA, 20 bp, Artificial Sequence
  chemically synthesized
catccagcatacagactgcc

SEQ ID NO: 15712 - DNA, 20 bp, Artificial Sequence
  chemically synthesized
ccagcatacagactgccaag

SEQ ID NO: 15713 - DNA, 20 bp, Artificial Sequence
  chemically synthesized
acatgtcaataaatatttat

SEQ ID NO: 15714 - DNA, 20 bp, Artificial Sequence
  chemically synthesized
gtcaataaatatttattgga

SEQ ID NO: 15715 - DNA, 20 bp, Artificial Sequence
  chemically synthesized
ataaatatttattggatagt

SEQ ID NO: 15716 - DNA, 20 bp, Artificial Sequence
  chemically synthesized
tatttattggatagtgagca

SEQ ID NO: 15717 - DNA, 20 bp, Artificial Sequence
  chemically synthesized
atagtgagcaaagacataat

SEQ ID NO: 15718 - DNA, 20 bp, Artificial Sequence
  chemically synthesized
tagtgagcaaagacataatt

SEQ ID NO: 15719 - DNA, 20 bp, Artificial Sequence
  chemically synthesized
atctcaattctactatttgc

SEQ ID NO: 15720 - DNA, 20 bp, Artificial Sequence
  chemically synthesized
tcaattctactatttgctag

SEQ ID NO: 15721 - DNA, 20 bp, Artificial Sequence
  chemically synthesized
tagtttatgtttgtgtgtgt

SEQ ID NO: 15722 - DNA, 20 bp, Artificial Sequence
  chemically synthesized
gtttatgtttgtgtgtgtga

SEQ ID NO: 15723 - DNA, 20 bp, Artificial Sequence
  chemically synthesized
gtgtgtgagagtgtatgctt

SEQ ID NO: 15724 - DNA, 20 bp, Artificial Sequence
  chemically synthesized
gtgagagtgtatgcttgagc

SEQ ID NO: 15725 - DNA, 20 bp, Artificial Sequence
  chemically synthesized
agtgtatgcttgagcaagtt

SEQ ID NO: 15726 - DNA, 20 bp, Artificial Sequence
  chemically synthesized
tgtatgcttgagcaagttga

SEQ ID NO: 15727 - DNA, 20 bp, Artificial Sequence
  chemically synthesized
gtatgcttgagcaagttgag

SEQ ID NO: 15728 - DNA, 20 bp, Artificial Sequence
  chemically synthesized
tgcttgagcaagttgagagg

SEQ ID NO: 15729 - DNA, 20 bp, Artificial Sequence
  chemically synthesized
agaggtagtttttttaactg

SEQ ID NO: 15730 - DNA, 20 bp, Artificial Sequence
  chemically synthesized
tttttttaactgtagtaaaa

SEQ ID NO: 15731 - DNA, 20 bp, Artificial Sequence
  chemically synthesized
ttttttaactgtagtaaaat

SEQ ID NO: 15732 - DNA, 20 bp, Artificial Sequence
  chemically synthesized
tttttaactgtagtaaaatg

SEQ ID NO: 15733 - DNA, 20 bp, Artificial Sequence
  chemically synthesized
tagtaaaatggggataataa

SEQ ID NO: 15734 - DNA, 20 bp, Artificial Sequence
  chemically synthesized
taataatagtatctacctga

SEQ ID NO: 15735 - DNA, 20 bp, Artificial Sequence
  chemically synthesized
gtatctacctgaaagaatcc

SEQ ID NO: 15736 - DNA, 20 bp, Artificial Sequence
  chemically synthesized
atctacctgaaagaatccaa

SEQ ID NO: 15737 - DNA, 20 bp, Artificial Sequence
  chemically synthesized
taaatatgattaattatgca

SEQ ID NO: 15738 - DNA, 20 bp, Artificial Sequence
  chemically synthesized
attatgcaaagcactaatta

SEQ ID NO: 15739 - DNA, 20 bp, Artificial Sequence
  chemically synthesized
gcactaattacagtctctga

SEQ ID NO: 15740 - DNA, 20 bp, Artificial Sequence
  chemically synthesized
tgatagccttcaataaatgt

SEQ ID NO: 15741 - DNA, 20 bp, Artificial Sequence
  chemically synthesized
gtcagttatttttattatta

SEQ ID NO: 15742 - DNA, 20 bp, Artificial Sequence
  chemically synthesized
tatttttattattacagtta

SEQ ID NO: 15743 - DNA, 20 bp, Artificial Sequence
  chemically synthesized
ttattacagttaaagatgaa

SEQ ID NO: 15744 - DNA, 20 bp, Artificial Sequence
  chemically synthesized
tattacagttaaagatgaat

SEQ ID NO: 15745 - DNA, 20 bp, Artificial Sequence
  chemically synthesized
gttaaagatgaatgggcata

SEQ ID NO: 15746 - DNA, 20 bp, Artificial Sequence
  chemically synthesized
agatgaatgggcataaagta

SEQ ID NO: 15747 - DNA, 20 bp, Artificial Sequence
  chemically synthesized
gggcataaagtacagaacac

SEQ ID NO: 15748 - DNA, 20 bp, Artificial Sequence
  chemically synthesized
agaacactagttttcacctg

SEQ ID NO: 15749 - DNA, 20 bp, Artificial Sequence
  chemically synthesized
cactagttttcacctgcagc

SEQ ID NO: 15750 - DNA, 20 bp, Artificial Sequence
  chemically synthesized
acctgcagcaagaatgattg

SEQ ID NO: 15751 - DNA, 20 bp, Artificial Sequence
  chemically synthesized
tgcagttaaacaaaaaatac

SEQ ID NO: 15752 - DNA, 20 bp, Artificial Sequence
  chemically synthesized
aaaatactagcaaacatttc

SEQ ID NO: 15753 - DNA, 20 bp, Artificial Sequence
  chemically synthesized
aatactagcaaacatttcta

SEQ ID NO: 15754 - DNA, 20 bp, Artificial Sequence
  chemically synthesized
actagcaaacatttctagag

SEQ ID NO: 15755 - DNA, 20 bp, Artificial Sequence
  chemically synthesized
gcaaacatttctagagtagt

SEQ ID NO: 15756 - DNA, 20 bp, Artificial Sequence
  chemically synthesized
ctagagtagttagcatttat

SEQ ID NO: 15757 - DNA, 20 bp, Artificial Sequence
  chemically synthesized
tttgcatgtattaactcact

SEQ ID NO: 15758 - DNA, 20 bp, Artificial Sequence
  chemically synthesized
ttgcatgtattaactcactc

SEQ ID NO: 15759 - DNA, 20 bp, Artificial Sequence
  chemically synthesized
gtattaactcactcgggctg

SEQ ID NO: 15760 - DNA, 20 bp, Artificial Sequence
  chemically synthesized
gggctgcagaacaatcttat

SEQ ID NO: 15761 - DNA, 20 bp, Artificial Sequence
  chemically synthesized
tgtaatcatgcttataatcc

SEQ ID NO: 15762 - DNA, 20 bp, Artificial Sequence
  chemically synthesized
tgcttataatcccagcactt

SEQ ID NO: 15763 - DNA, 20 bp, Artificial Sequence
  chemically synthesized
ttataatcccagcactttgg

SEQ ID NO: 15764 - DNA, 20 bp, Artificial Sequence
  chemically synthesized
tataatcccagcactttgga

SEQ ID NO: 15765 - DNA, 20 bp, Artificial Sequence
  chemically synthesized
tcccagcactttggaaggct

SEQ ID NO: 15766 - DNA, 20 bp, Artificial Sequence
  chemically synthesized
cccagcactttggaaggctg

SEQ ID NO: 15767 - DNA, 20 bp, Artificial Sequence
  chemically synthesized
agcactttggaaggctgagg

SEQ ID NO: 15768 - DNA, 20 bp, Artificial Sequence
  chemically synthesized
gcactttggaaggctgaggt

SEQ ID NO: 15769 - DNA, 20 bp, Artificial Sequence
  chemically synthesized
ctttggaaggctgaggtggg

SEQ ID NO: 15770 - DNA, 20 bp, Artificial Sequence
  chemically synthesized
ctgaggtgggcagattgctt

SEQ ID NO: 15771 - DNA, 20 bp, Artificial Sequence
  chemically synthesized
tgggcagattgcttgagctc

SEQ ID NO: 15772 - DNA, 20 bp, Artificial Sequence
  chemically synthesized
ggcagattgcttgagctccg

SEQ ID NO: 15773 - DNA, 20 bp, Artificial Sequence
  chemically synthesized
ttgcttgagctccggagtct

SEQ ID NO: 15774 - DNA, 20 bp, Artificial Sequence
  chemically synthesized
ctaccaaaaatacaaaaaat

SEQ ID NO: 15775 - DNA, 20 bp, Artificial Sequence
  chemically synthesized
caaaaatacaaaaaattagc

SEQ ID NO: 15776 - DNA, 20 bp, Artificial Sequence
  chemically synthesized
aaaaatacaaaaaattagcg

SEQ ID NO: 15777 - DNA, 20 bp, Artificial Sequence
  chemically synthesized
tacaaaaaattagcgaggta

SEQ ID NO: 15778 - DNA, 20 bp, Artificial Sequence
  chemically synthesized
aaaaaattagcgaggtatgg

SEQ ID NO: 15779 - DNA, 20 bp, Artificial Sequence
  chemically synthesized
ggtatggtggtgtgtacctg

SEQ ID NO: 15780 - DNA, 20 bp, Artificial Sequence
  chemically synthesized
gtggtgtgtacctgtggttc

SEQ ID NO: 15781 - DNA, 20 bp, Artificial Sequence
  chemically synthesized
tacctgtggttccagctact

SEQ ID NO: 15782 - DNA, 20 bp, Artificial Sequence
  chemically synthesized
acctgtggttccagctactc

SEQ ID NO: 15783 - DNA, 20 bp, Artificial Sequence
  chemically synthesized
ttccagctactcaggatgtt

SEQ ID NO: 15784 - DNA, 20 bp, Artificial Sequence
  chemically synthesized
tccagctactcaggatgttg

SEQ ID NO: 15785 - DNA, 20 bp, Artificial Sequence
  chemically synthesized
agctactcaggatgttgagg

SEQ ID NO: 15786 - DNA, 20 bp, Artificial Sequence
  chemically synthesized
gctactcaggatgttgaggt

SEQ ID NO: 15787 - DNA, 20 bp, Artificial Sequence
  chemically synthesized
tactcaggatgttgaggtgg

SEQ ID NO: 15788 - DNA, 20 bp, Artificial Sequence
  chemically synthesized
actcaggatgttgaggtggg

SEQ ID NO: 15789 - DNA, 20 bp, Artificial Sequence
  chemically synthesized
ttgaggtgggaggaccgctt

SEQ ID NO: 15790 - DNA, 20 bp, Artificial Sequence
  chemically synthesized
gtgggaggaccgcttgagcc

SEQ ID NO: 15791 - DNA, 20 bp, Artificial Sequence
  chemically synthesized
tgggaggaccgcttgagcct

SEQ ID NO: 15792 - DNA, 20 bp, Artificial Sequence
  chemically synthesized
gaggaccgcttgagcctggg

SEQ ID NO: 15793 - DNA, 20 bp, Artificial Sequence
  chemically synthesized
cgcttgagcctgggaagtgc

SEQ ID NO: 15794 - DNA, 20 bp, Artificial Sequence
  chemically synthesized
agcctgggaagtgcaagttg

SEQ ID NO: 15795 - DNA, 20 bp, Artificial Sequence
  chemically synthesized
tgggaagtgcaagttgcagt

SEQ ID NO: 15796 - DNA, 20 bp, Artificial Sequence
  chemically synthesized
agtgcaagttgcagtgagcc

SEQ ID NO: 15797 - DNA, 20 bp, Artificial Sequence
  chemically synthesized
tttgccactacactcccatt

SEQ ID NO: 15798 - DNA, 20 bp, Artificial Sequence
  chemically synthesized
ttgccactacactcccattt

SEQ ID NO: 15799 - DNA, 20 bp, Artificial Sequence
  chemically synthesized
ctacactcccatttgggtga

SEQ ID NO: 15800 - DNA, 20 bp, Artificial Sequence
  chemically synthesized
acactcccatttgggtgaca

SEQ ID NO: 15801 - DNA, 20 bp, Artificial Sequence
  chemically synthesized
tcccatttgggtgacagagt

SEQ ID NO: 15802 - DNA, 20 bp, Artificial Sequence
  chemically synthesized
ttaaaaaaccctccatttta

SEQ ID NO: 15803 - DNA, 20 bp, Artificial Sequence
  chemically synthesized
aaccctccattttacagatg

SEQ ID NO: 15804 - DNA, 20 bp, Artificial Sequence
  chemically synthesized
attttacagatgaagaaact

SEQ ID NO: 15805 - DNA, 20 bp, Artificial Sequence
  chemically synthesized
aactgagtcatacaactact

SEQ ID NO: 15806 - DNA, 20 bp, Artificial Sequence
  chemically synthesized
ctgagtcatacaactactaa

SEQ ID NO: 15807 - DNA, 20 bp, Artificial Sequence
  chemically synthesized
tacaactactaagagaaact

SEQ ID NO: 15808 - DNA, 20 bp, Artificial Sequence
  chemically synthesized
aaactgagtcactaatcact

SEQ ID NO: 15809 - DNA, 20 bp, Artificial Sequence
  chemically synthesized
aactgagtcactaatcactc

SEQ ID NO: 15810 - DNA, 20 bp, Artificial Sequence
  chemically synthesized
tgagtcactaatcactcagg

SEQ ID NO: 15811 - DNA, 20 bp, Artificial Sequence
  chemically synthesized
cactaatcactcaggtggtc

SEQ ID NO: 15812 - DNA, 20 bp, Artificial Sequence
  chemically synthesized
tcactcaggtggtctggctc

SEQ ID NO: 15813 - DNA, 20 bp, Artificial Sequence
  chemically synthesized
atctctgctctatactgccc

SEQ ID NO: 15814 - DNA, 20 bp, Artificial Sequence
  chemically synthesized
tactgcccaagacttttata

SEQ ID NO: 15815 - DNA, 20 bp, Artificial Sequence
  chemically synthesized
cccaagacttttataaagtc

SEQ ID NO: 15816 - DNA, 20 bp, Artificial Sequence
  chemically synthesized
ccaagacttttataaagtca

SEQ ID NO: 15817 - DNA, 20 bp, Artificial Sequence
  chemically synthesized
caagacttttataaagtcaa

SEQ ID NO: 15818 - DNA, 20 bp, Artificial Sequence
  chemically synthesized
cttttataaagtcaagggtt

SEQ ID NO: 15819 - DNA, 20 bp, Artificial Sequence
  chemically synthesized
aagggttgagtcactgaaat

SEQ ID NO: 15820 - DNA, 20 bp, Artificial Sequence
  chemically synthesized
gagtcactgaaatgagttat

SEQ ID NO: 15821 - DNA, 20 bp, Artificial Sequence
  chemically synthesized
agtcactgaaatgagttatt

SEQ ID NO: 15822 - DNA, 20 bp, Artificial Sequence
  chemically synthesized
actgaaatgagttattggga

SEQ ID NO: 15823 - DNA, 20 bp, Artificial Sequence
  chemically synthesized
gagttattgggatggctgtg

SEQ ID NO: 15824 - DNA, 20 bp, Artificial Sequence
  chemically synthesized
agttattgggatggctgtgt

SEQ ID NO: 15825 - DNA, 20 bp, Artificial Sequence
  chemically synthesized
tattgggatggctgtgtggg

SEQ ID NO: 15826 - DNA, 20 bp, Artificial Sequence
  chemically synthesized
attgggatggctgtgtggga

SEQ ID NO: 15827 - DNA, 20 bp, Artificial Sequence
  chemically synthesized
ttgggatggctgtgtgggaa

SEQ ID NO: 15828 - DNA, 20 bp, Artificial Sequence
  chemically synthesized
ggctgtgtgggaagggtgct

SEQ ID NO: 15829 - DNA, 20 bp, Artificial Sequence
  chemically synthesized
gggtgctaagttctttccta

SEQ ID NO: 15830 - DNA, 20 bp, Artificial Sequence
  chemically synthesized
ggtgctaagttctttcctaa

SEQ ID NO: 15831 - DNA, 20 bp, Artificial Sequence
  chemically synthesized
gttctttcctaaaggtatgt

SEQ ID NO: 15832 - DNA, 20 bp, Artificial Sequence
  chemically synthesized
taaaggtatgtgagaataca

SEQ ID NO: 15833 - DNA, 20 bp, Artificial Sequence
  chemically synthesized
aaaggtatgtgagaatacaa

SEQ ID NO: 15834 - DNA, 20 bp, Artificial Sequence
  chemically synthesized
gtatgtgagaatacaaagga

SEQ ID NO: 15835 - DNA, 20 bp, Artificial Sequence
  chemically synthesized
tgtgagaatacaaaggaaag

SEQ ID NO: 15836 - DNA, 20 bp, Artificial Sequence
  chemically synthesized
tcctttttacacacgtgaac

SEQ ID NO: 15837 - DNA, 20 bp, Artificial Sequence
  chemically synthesized
gtgcatgcaaatctgacact

SEQ ID NO: 15838 - DNA, 20 bp, Artificial Sequence
  chemically synthesized
catgcaaatctgacactcag

SEQ ID NO: 15839 - DNA, 20 bp, Artificial Sequence
  chemically synthesized
atgcaaatctgacactcagt

SEQ ID NO: 15840 - DNA, 20 bp, Artificial Sequence
  chemically synthesized
aatctgacactcagtgggcc

SEQ ID NO: 15841 - DNA, 20 bp, Artificial Sequence
  chemically synthesized
atctgacactcagtgggcct

SEQ ID NO: 15842 - DNA, 20 bp, Artificial Sequence
  chemically synthesized
acactcagtgggcctgggtg

SEQ ID NO: 15843 - DNA, 20 bp, Artificial Sequence
  chemically synthesized
cactcagtgggcctgggtga

SEQ ID NO: 15844 - DNA, 20 bp, Artificial Sequence
  chemically synthesized
cagtgggcctgggtgaaggt

SEQ ID NO: 15845 - DNA, 20 bp, Artificial Sequence
  chemically synthesized
tgagaattttattgctgaat

SEQ ID NO: 15846 - DNA, 20 bp, Artificial Sequence
  chemically synthesized
agaattttattgctgaatga

SEQ ID NO: 15847 - DNA, 20 bp, Artificial Sequence
  chemically synthesized
tattgctgaatgagagcctc

SEQ ID NO: 15848 - DNA, 20 bp, Artificial Sequence
  chemically synthesized
attgctgaatgagagcctct

SEQ ID NO: 15849 - DNA, 20 bp, Artificial Sequence
  chemically synthesized
ttgctgaatgagagcctctg

SEQ ID NO: 15850 - DNA, 20 bp, Artificial Sequence
  chemically synthesized
agcctctggggacatcttgc

SEQ ID NO: 15851 - DNA, 20 bp, Artificial Sequence
  chemically synthesized
gggacatcttgccagtcaat

SEQ ID NO: 15852 - DNA, 20 bp, Artificial Sequence
  chemically synthesized
tcttgccagtcaatgagtct

SEQ ID NO: 15853 - DNA, 20 bp, Artificial Sequence
  chemically synthesized
cttgccagtcaatgagtctc

SEQ ID NO: 15854 - DNA, 20 bp, Artificial Sequence
  chemically synthesized
ctcaggttcaatttccttct

SEQ ID NO: 15855 - DNA, 20 bp, Artificial Sequence
  chemically synthesized
ttcaatttccttctcagtct

SEQ ID NO: 15856 - DNA, 20 bp, Artificial Sequence
  chemically synthesized
caatttccttctcagtcttg

SEQ ID NO: 15857 - DNA, 20 bp, Artificial Sequence
  chemically synthesized
ccttctcagtcttggagtaa

SEQ ID NO: 15858 - DNA, 20 bp, Artificial Sequence
  chemically synthesized
tctcagtcttggagtaacag

SEQ ID NO: 15859 - DNA, 20 bp, Artificial Sequence
  chemically synthesized
aagctcatgcatttaataaa

SEQ ID NO: 15860 - DNA, 20 bp, Artificial Sequence
  chemically synthesized
cggaaattttgtattgaaat

SEQ ID NO: 15861 - DNA, 20 bp, Artificial Sequence
  chemically synthesized
gaaattttgtattgaaatga

SEQ ID NO: 15862 - DNA, 20 bp, Artificial Sequence
  chemically synthesized
tgtattgaaatgagagccat

SEQ ID NO: 15863 - DNA, 20 bp, Artificial Sequence
  chemically synthesized
ccattggaaatcatttactc

SEQ ID NO: 15864 - DNA, 20 bp, Artificial Sequence
  chemically synthesized
tccagactcctacttataaa

SEQ ID NO: 15865 - DNA, 20 bp, Artificial Sequence
  chemically synthesized
cagactcctacttataaaaa

SEQ ID NO: 15866 - DNA, 20 bp, Artificial Sequence
  chemically synthesized
tacttataaaaagagaaact

SEQ ID NO: 15867 - DNA, 20 bp, Artificial Sequence
  chemically synthesized
acttataaaaagagaaactg

SEQ ID NO: 15868 - DNA, 20 bp, Artificial Sequence
  chemically synthesized
taaaaagagaaactgaggct

SEQ ID NO: 15869 - DNA, 20 bp, Artificial Sequence
  chemically synthesized
aaaagagaaactgaggctca

SEQ ID NO: 15870 - DNA, 20 bp, Artificial Sequence
  chemically synthesized
agagaaactgaggctcagag

SEQ ID NO: 15871 - DNA, 20 bp, Artificial Sequence
  chemically synthesized
gagaaactgaggctcagaga

SEQ ID NO: 15872 - DNA, 20 bp, Artificial Sequence
  chemically synthesized
agaaactgaggctcagagaa

SEQ ID NO: 15873 - DNA, 20 bp, Artificial Sequence
  chemically synthesized
aactgaggctcagagaaggg

SEQ ID NO: 15874 - DNA, 20 bp, Artificial Sequence
  chemically synthesized
actgaggctcagagaagggt

SEQ ID NO: 15875 - DNA, 20 bp, Artificial Sequence
  chemically synthesized
ctgaggctcagagaagggtg

SEQ ID NO: 15876 - DNA, 20 bp, Artificial Sequence
  chemically synthesized
gagaagggtggggactttct

SEQ ID NO: 15877 - DNA, 20 bp, Artificial Sequence
  chemically synthesized
gggactttctcagtatgaca

SEQ ID NO: 15878 - DNA, 20 bp, Artificial Sequence
  chemically synthesized
cagtatgacatggaaatgat

SEQ ID NO: 15879 - DNA, 20 bp, Artificial Sequence
  chemically synthesized
agtatgacatggaaatgatc

SEQ ID NO: 15880 - DNA, 20 bp, Artificial Sequence
  chemically synthesized
gacatggaaatgatcaggct

SEQ ID NO: 15881 - DNA, 20 bp, Artificial Sequence
  chemically synthesized
aatgatcaggcttggattca

SEQ ID NO: 15882 - DNA, 20 bp, Artificial Sequence
  chemically synthesized
aaagctcctgactttctgtc

SEQ ID NO: 15883 - DNA, 20 bp, Artificial Sequence
  chemically synthesized
ctttctgtctagtgtatgtg

SEQ ID NO: 15884 - DNA, 20 bp, Artificial Sequence
  chemically synthesized
ctgtctagtgtatgtgcagt

SEQ ID NO: 15885 - DNA, 20 bp, Artificial Sequence
  chemically synthesized
gccccttttcctctaactga

SEQ ID NO: 15886 - DNA, 20 bp, Artificial Sequence
  chemically synthesized
ccttttcctctaactgaaag

SEQ ID NO: 15887 - DNA, 20 bp, Artificial Sequence
  chemically synthesized
cttttcctctaactgaaaga

SEQ ID NO: 15888 - DNA, 20 bp, Artificial Sequence
  chemically synthesized
ctgaaagaaggaaaaaaaaa

SEQ ID NO: 15889 - DNA, 20 bp, Artificial Sequence
  chemically synthesized
ggaacccaaaatattctaca

SEQ ID NO: 15890 - DNA, 20 bp, Artificial Sequence
  chemically synthesized
tctacatagtttccatgtca

SEQ ID NO: 15891 - DNA, 20 bp, Artificial Sequence
  chemically synthesized
catagtttccatgtcacagc

SEQ ID NO: 15892 - DNA, 20 bp, Artificial Sequence
  chemically synthesized
atagtttccatgtcacagcc

SEQ ID NO: 15893 - DNA, 20 bp, Artificial Sequence
  chemically synthesized
tagtttccatgtcacagcca

SEQ ID NO: 15894 - DNA, 20 bp, Artificial Sequence
  chemically synthesized
ttccatgtcacagccagggc

SEQ ID NO: 15895 - DNA, 20 bp, Artificial Sequence
  chemically synthesized
tccatgtcacagccagggct

SEQ ID NO: 15896 - DNA, 20 bp, Artificial Sequence
  chemically synthesized
atgtcacagccagggctggg

SEQ ID NO: 15897 - DNA, 20 bp, Artificial Sequence
  chemically synthesized
tatcatttaaatgcataaat

SEQ ID NO: 15898 - DNA, 20 bp, Artificial Sequence
  chemically synthesized
ataaataagcaaaccctgct

SEQ ID NO: 15899 - DNA, 20 bp, Artificial Sequence
  chemically synthesized
taaataagcaaaccctgctc

SEQ ID NO: 15900 - DNA, 20 bp, Artificial Sequence
  chemically synthesized
aagcaaaccctgctcgggaa

SEQ ID NO: 15901 - DNA, 20 bp, Artificial Sequence
  chemically synthesized
agcaaaccctgctcgggaat

SEQ ID NO: 15902 - DNA, 20 bp, Artificial Sequence
  chemically synthesized
caaaccctgctcgggaatgg

SEQ ID NO: 15903 - DNA, 20 bp, Artificial Sequence
  chemically synthesized
aaaccctgctcgggaatggg

SEQ ID NO: 15904 - DNA, 20 bp, Artificial Sequence
  chemically synthesized
aaccctgctcgggaatggga

SEQ ID NO: 15905 - DNA, 20 bp, Artificial Sequence
  chemically synthesized
ccctgctcgggaatgggagg

SEQ ID NO: 15906 - DNA, 20 bp, Artificial Sequence
  chemically synthesized
ctgctcgggaatgggaggga

SEQ ID NO: 15907 - DNA, 20 bp, Artificial Sequence
  chemically synthesized
ggaatgggagggagagtctc

SEQ ID NO: 15908 - DNA, 20 bp, Artificial Sequence
  chemically synthesized
aatgggagggagagtctctg

SEQ ID NO: 15909 - DNA, 20 bp, Artificial Sequence
  chemically synthesized
ctctggagtccaccccttct

SEQ ID NO: 15910 - DNA, 20 bp, Artificial Sequence
  chemically synthesized
agtccaccccttctcggccc

SEQ ID NO: 15911 - DNA, 20 bp, Artificial Sequence
  chemically synthesized
ccttctcggccctggctctg

SEQ ID NO: 15912 - DNA, 20 bp, Artificial Sequence
  chemically synthesized
ctcggccctggctctgcaga

SEQ ID NO: 15913 - DNA, 20 bp, Artificial Sequence
  chemically synthesized
ctctgcagatagtgctatca

SEQ ID NO: 15914 - DNA, 20 bp, Artificial Sequence
  chemically synthesized
tagtgctatcaaagccctga

SEQ ID NO: 15915 - DNA, 20 bp, Artificial Sequence
  chemically synthesized
gtgctatcaaagccctgaca

SEQ ID NO: 15916 - DNA, 20 bp, Artificial Sequence
  chemically synthesized
gacagagccctgcccattgc

SEQ ID NO: 15917 - DNA, 20 bp, Artificial Sequence
  chemically synthesized
acagagccctgcccattgct

SEQ ID NO: 15918 - DNA, 20 bp, Artificial Sequence
  chemically synthesized
ccctgcccattgctgggcct

SEQ ID NO: 15919 - DNA, 20 bp, Artificial Sequence
  chemically synthesized
ctgcccattgctgggccttg

SEQ ID NO: 15920 - DNA, 20 bp, Artificial Sequence
  chemically synthesized
ccattgctgggccttggagt

SEQ ID NO: 15921 - DNA, 20 bp, Artificial Sequence
  chemically synthesized
tgctgggccttggagtgagt

SEQ ID NO: 15922 - DNA, 20 bp, Artificial Sequence
  chemically synthesized
ggccttggagtgagtcagcc

SEQ ID NO: 15923 - DNA, 20 bp, Artificial Sequence
  chemically synthesized
cttggagtgagtcagcctag

SEQ ID NO: 15924 - DNA, 20 bp, Artificial Sequence
  chemically synthesized
tggagtgagtcagcctagta

SEQ ID NO: 15925 - DNA, 20 bp, Artificial Sequence
  chemically synthesized
gagtgagtcagcctagtaga

SEQ ID NO: 15926 - DNA, 20 bp, Artificial Sequence
  chemically synthesized
agtgagtcagcctagtagag

SEQ ID NO: 15927 - DNA, 20 bp, Artificial Sequence
  chemically synthesized
gagtcagcctagtagagagg

SEQ ID NO: 15928 - DNA, 20 bp, Artificial Sequence
  chemically synthesized
agtcagcctagtagagaggc

SEQ ID NO: 15929 - DNA, 20 bp, Artificial Sequence
  chemically synthesized
gtcagcctagtagagaggca

SEQ ID NO: 15930 - DNA, 20 bp, Artificial Sequence
  chemically synthesized
gcctagtagagaggcagggc

SEQ ID NO: 15931 - DNA, 20 bp, Artificial Sequence
  chemically synthesized
aggcagggcaagccatctca

SEQ ID NO: 15932 - DNA, 20 bp, Artificial Sequence
  chemically synthesized
caagccatctcatagctgct

SEQ ID NO: 15933 - DNA, 20 bp, Artificial Sequence
  chemically synthesized
gccatctcatagctgctgag

SEQ ID NO: 15934 - DNA, 20 bp, Artificial Sequence
  chemically synthesized
ccatctcatagctgctgagt

SEQ ID NO: 15935 - DNA, 20 bp, Artificial Sequence
  chemically synthesized
atctcatagctgctgagtgg

SEQ ID NO: 15936 - DNA, 20 bp, Artificial Sequence
  chemically synthesized
ctcatagctgctgagtggga

SEQ ID NO: 15937 - DNA, 20 bp, Artificial Sequence
  chemically synthesized
catagctgctgagtgggaga

SEQ ID NO: 15938 - DNA, 20 bp, Artificial Sequence
  chemically synthesized
ctgctgagtgggagagagaa

SEQ ID NO: 15939 - DNA, 20 bp, Artificial Sequence
  chemically synthesized
tgctgagtgggagagagaaa

SEQ ID NO: 15940 - DNA, 20 bp, Artificial Sequence
  chemically synthesized
gctgagtgggagagagaaaa

SEQ ID NO: 15941 - DNA, 20 bp, Artificial Sequence
  chemically synthesized
gggctcattgtctataaact

SEQ ID NO: 15942 - DNA, 20 bp, Artificial Sequence
  chemically synthesized
ggctcattgtctataaactc

SEQ ID NO: 15943 - DNA, 20 bp, Artificial Sequence
  chemically synthesized
ttgtctataaactcaggtca

SEQ ID NO: 15944 - DNA, 20 bp, Artificial Sequence
  chemically synthesized
gctattcttattctcacact

SEQ ID NO: 15945 - DNA, 20 bp, Artificial Sequence
  chemically synthesized
cttattctcacactaagaaa

SEQ ID NO: 15946 - DNA, 20 bp, Artificial Sequence
  chemically synthesized
ctcacactaagaaaaagaat

SEQ ID NO: 15947 - DNA, 20 bp, Artificial Sequence
  chemically synthesized
ctgcgtcccctcttgtgtac

SEQ ID NO: 15948 - DNA, 20 bp, Artificial Sequence
  chemically synthesized
tgcgtcccctcttgtgtact

SEQ ID NO: 15949 - DNA, 20 bp, Artificial Sequence
  chemically synthesized
gcgtcccctcttgtgtactg

SEQ ID NO: 15950 - DNA, 20 bp, Artificial Sequence
  chemically synthesized
tcttgtgtactggggtcccc

SEQ ID NO: 15951 - DNA, 20 bp, Artificial Sequence
  chemically synthesized
ttgtgtactggggtccccaa

SEQ ID NO: 15952 - DNA, 20 bp, Artificial Sequence
  chemically synthesized
ggtccccaagagctctctaa

SEQ ID NO: 15953 - DNA, 20 bp, Artificial Sequence
  chemically synthesized
caagagctctctaaaagtga

SEQ ID NO: 15954 - DNA, 20 bp, Artificial Sequence
  chemically synthesized
gctctctaaaagtgatggca

SEQ ID NO: 15955 - DNA, 20 bp, Artificial Sequence
  chemically synthesized
tgatggcaaagtcattgcgc

SEQ ID NO: 15956 - DNA, 20 bp, Artificial Sequence
  chemically synthesized
ctgcatttgtctccacacac

SEQ ID NO: 15957 - DNA, 20 bp, Artificial Sequence
  chemically synthesized
ttgtctccacacaccagtca

SEQ ID NO: 15958 - DNA, 20 bp, Artificial Sequence
  chemically synthesized
atggacaataaccctcctcc

SEQ ID NO: 15959 - DNA, 20 bp, Artificial Sequence
  chemically synthesized
tggacaataaccctcctccc

SEQ ID NO: 15960 - DNA, 20 bp, Artificial Sequence
  chemically synthesized
cttgtctttgtataatactc

SEQ ID NO: 15961 - DNA, 20 bp, Artificial Sequence
  chemically synthesized
gtataatactcaagtaattt

SEQ ID NO: 15962 - DNA, 20 bp, Artificial Sequence
  chemically synthesized
ttctgttattcctgtttcaa

SEQ ID NO: 15963 - DNA, 20 bp, Artificial Sequence
  chemically synthesized
ttattcctgtttcaatggct

SEQ ID NO: 15964 - DNA, 20 bp, Artificial Sequence
  chemically synthesized
ttcctgtttcaatggcttag

SEQ ID NO: 15965 - DNA, 20 bp, Artificial Sequence
  chemically synthesized
tttcaatggcttagtagaaa

SEQ ID NO: 15966 - DNA, 20 bp, Artificial Sequence
  chemically synthesized
gttttcccataaattgacaa

SEQ ID NO: 15967 - DNA, 20 bp, Artificial Sequence
  chemically synthesized
atttcacatcaatgtctata

SEQ ID NO: 15968 - DNA, 20 bp, Artificial Sequence
  chemically synthesized
tttcacatcaatgtctatat

SEQ ID NO: 15969 - DNA, 20 bp, Artificial Sequence
  chemically synthesized
ctttatattgttactactct

SEQ ID NO: 15970 - DNA, 20 bp, Artificial Sequence
  chemically synthesized
atattgttactactctaaga

SEQ ID NO: 15971 - DNA, 20 bp, Artificial Sequence
  chemically synthesized
actctaagaaagttacaaca

SEQ ID NO: 15972 - DNA, 20 bp, Artificial Sequence
  chemically synthesized
agttacaacatggtgaatac

SEQ ID NO: 15973 - DNA, 20 bp, Artificial Sequence
  chemically synthesized
ttacaacatggtgaatacaa

SEQ ID NO: 15974 - DNA, 20 bp, Artificial Sequence
  chemically synthesized
aacatggtgaatacaagaga

SEQ ID NO: 15975 - DNA, 20 bp, Artificial Sequence
  chemically synthesized
atacaagagaaagctattac

SEQ ID NO: 15976 - DNA, 20 bp, Artificial Sequence
  chemically synthesized
agagaaagctattacaagtc

SEQ ID NO: 15977 - DNA, 20 bp, Artificial Sequence
  chemically synthesized
attacaagtccagaaaataa

SEQ ID NO: 15978 - DNA, 20 bp, Artificial Sequence
  chemically synthesized
aaaataaaagttatcatctt

SEQ ID NO: 15979 - DNA, 20 bp, Artificial Sequence
  chemically synthesized
aaataaaagttatcatcttg

SEQ ID NO: 15980 - DNA, 20 bp, Artificial Sequence
  chemically synthesized
aagttatcatcttgaggcct

SEQ ID NO: 15981 - DNA, 20 bp, Artificial Sequence
  chemically synthesized
atcttgaggcctcagctttc

SEQ ID NO: 15982 - DNA, 20 bp, Artificial Sequence
  chemically synthesized
tcttgaggcctcagctttct

SEQ ID NO: 15983 - DNA, 20 bp, Artificial Sequence
  chemically synthesized
attaatctaacaattatgaa

SEQ ID NO: 15984 - DNA, 20 bp, Artificial Sequence
  chemically synthesized
taacaattatgaacagcaat

SEQ ID NO: 15985 - DNA, 20 bp, Artificial Sequence
  chemically synthesized
gcaatgagataatgtgtaca

SEQ ID NO: 15986 - DNA, 20 bp, Artificial Sequence
  chemically synthesized
gataatgtgtacaaagtacc

SEQ ID NO: 15987 - DNA, 20 bp, Artificial Sequence
  chemically synthesized
acaaagtacccagacctatg

SEQ ID NO: 15988 - DNA, 20 bp, Artificial Sequence
  chemically synthesized
aagtacccagacctatgtgg

SEQ ID NO: 15989 - DNA, 20 bp, Artificial Sequence
  chemically synthesized
gtacccagacctatgtggta

SEQ ID NO: 15990 - DNA, 20 bp, Artificial Sequence
  chemically synthesized
gacctatgtggtagagcatc

SEQ ID NO: 15991 - DNA, 20 bp, Artificial Sequence
  chemically synthesized
acctatgtggtagagcatca

SEQ ID NO: 15992 - DNA, 20 bp, Artificial Sequence
  chemically synthesized
tatgtggtagagcatcaagg

SEQ ID NO: 15993 - DNA, 20 bp, Artificial Sequence
  chemically synthesized
agcatcaaggaagcgcattg

SEQ ID NO: 15994 - DNA, 20 bp, Artificial Sequence
  chemically synthesized
catcaaggaagcgcattgcg

SEQ ID NO: 15995 - DNA, 20 bp, Artificial Sequence
  chemically synthesized
caaggaagcgcattgcggag

SEQ ID NO: 15996 - DNA, 20 bp, Artificial Sequence
  chemically synthesized
gtttttgtattctgtttcgt

SEQ ID NO: 15997 - DNA, 20 bp, Artificial Sequence
  chemically synthesized
tttttgtattctgtttcgtg

SEQ ID NO: 15998 - DNA, 20 bp, Artificial Sequence
  chemically synthesized
tgtattctgtttcgtgaggc

SEQ ID NO: 15999 - DNA, 20 bp, Artificial Sequence
  chemically synthesized
gtattctgtttcgtgaggca

SEQ ID NO: 16000 - DNA, 20 bp, Artificial Sequence
  chemically synthesized
caaggtttcactctgctgtc

SEQ ID NO: 16001 - DNA, 20 bp, Artificial Sequence
  chemically synthesized
aaggtttcactctgctgtcc

SEQ ID NO: 16002 - DNA, 20 bp, Artificial Sequence
  chemically synthesized
tttcactctgctgtccaggc

SEQ ID NO: 16003 - DNA, 20 bp, Artificial Sequence
  chemically synthesized
tcactctgctgtccaggctg

SEQ ID NO: 16004 - DNA, 20 bp, Artificial Sequence
  chemically synthesized
ctgctgtccaggctggagtg

SEQ ID NO: 16005 - DNA, 20 bp, Artificial Sequence
  chemically synthesized
ctgtccaggctggagtgcag

SEQ ID NO: 16006 - DNA, 20 bp, Artificial Sequence
  chemically synthesized
ccaggctggagtgcagtggc

SEQ ID NO: 16007 - DNA, 20 bp, Artificial Sequence
  chemically synthesized
ggcaagatcatgtctcactg

SEQ ID NO: 16008 - DNA, 20 bp, Artificial Sequence
  chemically synthesized
cactgcagccttgacctcct

SEQ ID NO: 16009 - DNA, 20 bp, Artificial Sequence
  chemically synthesized
agccttgacctcctgagctc

SEQ ID NO: 16010 - DNA, 20 bp, Artificial Sequence
  chemically synthesized
gccttgacctcctgagctca

SEQ ID NO: 16011 - DNA, 20 bp, Artificial Sequence
  chemically synthesized
ccttgacctcctgagctcaa

SEQ ID NO: 16012 - DNA, 20 bp, Artificial Sequence
  chemically synthesized
ctcaagggatcctcccattt

SEQ ID NO: 16013 - DNA, 20 bp, Artificial Sequence
  chemically synthesized
tcctcccatttcggcctcct

SEQ ID NO: 16014 - DNA, 20 bp, Artificial Sequence
  chemically synthesized
tcccatttcggcctcctgag

SEQ ID NO: 16015 - DNA, 20 bp, Artificial Sequence
  chemically synthesized
atttcggcctcctgagtagc

SEQ ID NO: 16016 - DNA, 20 bp, Artificial Sequence
  chemically synthesized
tttcggcctcctgagtagct

SEQ ID NO: 16017 - DNA, 20 bp, Artificial Sequence
  chemically synthesized
ctcctgagtagctgggacta

SEQ ID NO: 16018 - DNA, 20 bp, Artificial Sequence
  chemically synthesized
tcctgagtagctgggactac

SEQ ID NO: 16019 - DNA, 20 bp, Artificial Sequence
  chemically synthesized
acaggtgtacatcacatgcc

SEQ ID NO: 16020 - DNA, 20 bp, Artificial Sequence
  chemically synthesized
ctaatttttttttttttttt

SEQ ID NO: 16021 - DNA, 20 bp, Artificial Sequence
  chemically synthesized
attttttttttttttttaag

SEQ ID NO: 16022 - DNA, 20 bp, Artificial Sequence
  chemically synthesized
tttttttttttttttaagta

SEQ ID NO: 16023 - DNA, 20 bp, Artificial Sequence
  chemically synthesized
ttttttttttaagtagagac

SEQ ID NO: 16024 - DNA, 20 bp, Artificial Sequence
  chemically synthesized
tttttttttaagtagagacg

SEQ ID NO: 16025 - DNA, 20 bp, Artificial Sequence
  chemically synthesized
cgaggtcttgctatgttgtc

SEQ ID NO: 16026 - DNA, 20 bp, Artificial Sequence
  chemically synthesized
gaggtcttgctatgttgtcc

SEQ ID NO: 16027 - DNA, 20 bp, Artificial Sequence
  chemically synthesized
caggataatatcaaactctt

SEQ ID NO: 16028 - DNA, 20 bp, Artificial Sequence
  chemically synthesized
aatatcaaactcttgagctc

SEQ ID NO: 16029 - DNA, 20 bp, Artificial Sequence
  chemically synthesized
atcaaactcttgagctcaag

SEQ ID NO: 16030 - DNA, 20 bp, Artificial Sequence
  chemically synthesized
tcctcccacttctacctctc

SEQ ID NO: 16031 - DNA, 20 bp, Artificial Sequence
  chemically synthesized
cacttctacctctcaagtgc

SEQ ID NO: 16032 - DNA, 20 bp, Artificial Sequence
  chemically synthesized
cctctcaagtgctggaatta

SEQ ID NO: 16033 - DNA, 20 bp, Artificial Sequence
  chemically synthesized
agtgctggaattacagacat

SEQ ID NO: 16034 - DNA, 20 bp, Artificial Sequence
  chemically synthesized
cagacatgagccaccactcc

SEQ ID NO: 16035 - DNA, 20 bp, Artificial Sequence
  chemically synthesized
gagccaccactcctggcttg

SEQ ID NO: 16036 - DNA, 20 bp, Artificial Sequence
  chemically synthesized
actaattcctgacactactt

SEQ ID NO: 16037 - DNA, 20 bp, Artificial Sequence
  chemically synthesized
ctaattcctgacactacttg

SEQ ID NO: 16038 - DNA, 20 bp, Artificial Sequence
  chemically synthesized
taattcctgacactacttga

SEQ ID NO: 16039 - DNA, 20 bp, Artificial Sequence
  chemically synthesized
tgacactacttgagggatac

SEQ ID NO: 16040 - DNA, 20 bp, Artificial Sequence
  chemically synthesized
actacttgagggatactaga

SEQ ID NO: 16041 - DNA, 20 bp, Artificial Sequence
  chemically synthesized
acttgagggatactagacag

SEQ ID NO: 16042 - DNA, 20 bp, Artificial Sequence
  chemically synthesized
cacatctttaatataccaaa

SEQ ID NO: 16043 - DNA, 20 bp, Artificial Sequence
  chemically synthesized
acatctttaatataccaaat

SEQ ID NO: 16044 - DNA, 20 bp, Artificial Sequence
  chemically synthesized
atataccaaatgggtgactg

SEQ ID NO: 16045 - DNA, 20 bp, Artificial Sequence
  chemically synthesized
tataccaaatgggtgactgt

SEQ ID NO: 16046 - DNA, 20 bp, Artificial Sequence
  chemically synthesized
ataccaaatgggtgactgta

SEQ ID NO: 16047 - DNA, 20 bp, Artificial Sequence
  chemically synthesized
aaatgggtgactgtagggtt

SEQ ID NO: 16048 - DNA, 20 bp, Artificial Sequence
  chemically synthesized
atgggtgactgtagggttga

SEQ ID NO: 16049 - DNA, 20 bp, Artificial Sequence
  chemically synthesized
tgggtgactgtagggttgag

SEQ ID NO: 16050 - DNA, 20 bp, Artificial Sequence
  chemically synthesized
gggtgactgtagggttgaga

SEQ ID NO: 16051 - DNA, 20 bp, Artificial Sequence
  chemically synthesized
gtgactgtagggttgagagg

SEQ ID NO: 16052 - DNA, 20 bp, Artificial Sequence
  chemically synthesized
tgtagggttgagagggagat

SEQ ID NO: 16053 - DNA, 20 bp, Artificial Sequence
  chemically synthesized
ttcaatgttttatgaccaaa

SEQ ID NO: 16054 - DNA, 20 bp, Artificial Sequence
  chemically synthesized
tcaatgttttatgaccaaaa

SEQ ID NO: 16055 - DNA, 20 bp, Artificial Sequence
  chemically synthesized
atgaccaaaaaggcttaaat

SEQ ID NO: 16056 - DNA, 20 bp, Artificial Sequence
  chemically synthesized
tgaccaaaaaggcttaaatc

SEQ ID NO: 16057 - DNA, 20 bp, Artificial Sequence
  chemically synthesized
aaaaggcttaaatcaggcac

SEQ ID NO: 16058 - DNA, 20 bp, Artificial Sequence
  chemically synthesized
gcttaaatcaggcacaagct

SEQ ID NO: 16059 - DNA, 20 bp, Artificial Sequence
  chemically synthesized
cttaaatcaggcacaagctt

SEQ ID NO: 16060 - DNA, 20 bp, Artificial Sequence
  chemically synthesized
gcttaggtcttttcaactgt

SEQ ID NO: 16061 - DNA, 20 bp, Artificial Sequence
  chemically synthesized
cttaggtcttttcaactgtg

SEQ ID NO: 16062 - DNA, 20 bp, Artificial Sequence
  chemically synthesized
gtcttttcaactgtgaggac

SEQ ID NO: 16063 - DNA, 20 bp, Artificial Sequence
  chemically synthesized
aactgtgaggaccggactga

SEQ ID NO: 16064 - DNA, 20 bp, Artificial Sequence
  chemically synthesized
aggaccggactgaaagtgtg

SEQ ID NO: 16065 - DNA, 20 bp, Artificial Sequence
  chemically synthesized
ggactgaaagtgtgcagttc

SEQ ID NO: 16066 - DNA, 20 bp, Artificial Sequence
  chemically synthesized
gactgaaagtgtgcagttca

SEQ ID NO: 16067 - DNA, 20 bp, Artificial Sequence
  chemically synthesized
gtgtgcagttcaaggccctg

SEQ ID NO: 16068 - DNA, 20 bp, Artificial Sequence
  chemically synthesized
agttgctgtttaactgttcc

SEQ ID NO: 16069 - DNA, 20 bp, Artificial Sequence
  chemically synthesized
gttgctgtttaactgttccc

SEQ ID NO: 16070 - DNA, 20 bp, Artificial Sequence
  chemically synthesized
gctgtttaactgttcccagg

SEQ ID NO: 16071 - DNA, 20 bp, Artificial Sequence
  chemically synthesized
gtttaactgttcccaggtgg

SEQ ID NO: 16072 - DNA, 20 bp, Artificial Sequence
  chemically synthesized
cccaggtggaagtctcttca

SEQ ID NO: 16073 - DNA, 20 bp, Artificial Sequence
  chemically synthesized
aagtctcttcaaagaaccac

SEQ ID NO: 16074 - DNA, 20 bp, Artificial Sequence
  chemically synthesized
caaagaaccactggtgcaaa

SEQ ID NO: 16075 - DNA, 20 bp, Artificial Sequence
  chemically synthesized
aaagaaccactggtgcaaaa

SEQ ID NO: 16076 - DNA, 20 bp, Artificial Sequence
  chemically synthesized
aagaaccactggtgcaaaaa

SEQ ID NO: 16077 - DNA, 20 bp, Artificial Sequence
  chemically synthesized
ggtgcaaaaagggaactacc

SEQ ID NO: 16078 - DNA, 20 bp, Artificial Sequence
  chemically synthesized
gtgcaaaaagggaactacct

SEQ ID NO: 16079 - DNA, 20 bp, Artificial Sequence
  chemically synthesized
tgcaaaaagggaactacctg

SEQ ID NO: 16080 - DNA, 20 bp, Artificial Sequence
  chemically synthesized
ctggggataaatatttcctc

SEQ ID NO: 16081 - DNA, 20 bp, Artificial Sequence
  chemically synthesized
ggataaatatttcctccaga

SEQ ID NO: 16082 - DNA, 20 bp, Artificial Sequence
  chemically synthesized
gataaatatttcctccagaa

SEQ ID NO: 16083 - DNA, 20 bp, Artificial Sequence
  chemically synthesized
ataaatatttcctccagaaa

SEQ ID NO: 16084 - DNA, 20 bp, Artificial Sequence
  chemically synthesized
taaatatttcctccagaaag

SEQ ID NO: 16085 - DNA, 20 bp, Artificial Sequence
  chemically synthesized
aaatatttcctccagaaagg

SEQ ID NO: 16086 - DNA, 20 bp, Artificial Sequence
  chemically synthesized
atttcctccagaaaggggga

SEQ ID NO: 16087 - DNA, 20 bp, Artificial Sequence
  chemically synthesized
tccagaaagggggaaagtgc

SEQ ID NO: 16088 - DNA, 20 bp, Artificial Sequence
  chemically synthesized
agtgcaagctcccctaccaa

SEQ ID NO: 16089 - DNA, 20 bp, Artificial Sequence
  chemically synthesized
agctcccctaccaaaagcac

SEQ ID NO: 16090 - DNA, 20 bp, Artificial Sequence
  chemically synthesized
gctcccctaccaaaagcacc

SEQ ID NO: 16091 - DNA, 20 bp, Artificial Sequence
  chemically synthesized
ccctaccaaaagcaccaggc

SEQ ID NO: 16092 - DNA, 20 bp, Artificial Sequence
  chemically synthesized
gtccttgtctattttccctg

SEQ ID NO: 16093 - DNA, 20 bp, Artificial Sequence
  chemically synthesized
tattttccctgaagttctca

SEQ ID NO: 16094 - DNA, 20 bp, Artificial Sequence
  chemically synthesized
cctgaagttctcaaagaaat

SEQ ID NO: 16095 - DNA, 20 bp, Artificial Sequence
  chemically synthesized
tgagacccttgtttaccttt

SEQ ID NO: 16096 - DNA, 20 bp, Artificial Sequence
  chemically synthesized
cccttgtttacctttaagat

SEQ ID NO: 16097 - DNA, 20 bp, Artificial Sequence
  chemically synthesized
cttgtttacctttaagatta

SEQ ID NO: 16098 - DNA, 20 bp, Artificial Sequence
  chemically synthesized
gtttacctttaagattagag

SEQ ID NO: 16099 - DNA, 20 bp, Artificial Sequence
  chemically synthesized
tttacctttaagattagaga

SEQ ID NO: 16100 - DNA, 20 bp, Artificial Sequence
  chemically synthesized
aagattagagaaggcttgaa

SEQ ID NO: 16101 - DNA, 20 bp, Artificial Sequence
  chemically synthesized
agagaaggcttgaaaagttt

SEQ ID NO: 16102 - DNA, 20 bp, Artificial Sequence
  chemically synthesized
aaaagtttgagctgtgcctt

SEQ ID NO: 16103 - DNA, 20 bp, Artificial Sequence
  chemically synthesized
aagtttgagctgtgcctttg

SEQ ID NO: 16104 - DNA, 20 bp, Artificial Sequence
  chemically synthesized
agtttgagctgtgcctttgg

SEQ ID NO: 16105 - DNA, 20 bp, Artificial Sequence
  chemically synthesized
acttttctcctttgttgacc

SEQ ID NO: 16106 - DNA, 20 bp, Artificial Sequence
  chemically synthesized
tctcctttgttgaccaagtt

SEQ ID NO: 16107 - DNA, 20 bp, Artificial Sequence
  chemically synthesized
cagctctcctgtatgcttcc

SEQ ID NO: 16108 - DNA, 20 bp, Artificial Sequence
  chemically synthesized
agctctcctgtatgcttcca

SEQ ID NO: 16109 - DNA, 20 bp, Artificial Sequence
  chemically synthesized
cttccaaggtctgttgcatc

SEQ ID NO: 16110 - DNA, 20 bp, Artificial Sequence
  chemically synthesized
tccaaggtctgttgcatcaa

SEQ ID NO: 16111 - DNA, 20 bp, Artificial Sequence
  chemically synthesized
aggtctgttgcatcaagagt

SEQ ID NO: 16112 - DNA, 20 bp, Artificial Sequence
  chemically synthesized
tgcatcaagagtgagaattg

SEQ ID NO: 16113 - DNA, 20 bp, Artificial Sequence
  chemically synthesized
gcatcaagagtgagaattga

SEQ ID NO: 16114 - DNA, 20 bp, Artificial Sequence
  chemically synthesized
agagtgagaattgaaggtct

SEQ ID NO: 16115 - DNA, 20 bp, Artificial Sequence
  chemically synthesized
gtgagaattgaaggtcttag

SEQ ID NO: 16116 - DNA, 20 bp, Artificial Sequence
  chemically synthesized
gaattgaaggtcttagaagc

SEQ ID NO: 16117 - DNA, 20 bp, Artificial Sequence
  chemically synthesized
aattgaaggtcttagaagct

SEQ ID NO: 16118 - DNA, 20 bp, Artificial Sequence
  chemically synthesized
ggtcttagaagctgggatct

SEQ ID NO: 16119 - DNA, 20 bp, Artificial Sequence
  chemically synthesized
agaagctgggatctcagatg

SEQ ID NO: 16120 - DNA, 20 bp, Artificial Sequence
  chemically synthesized
gaagctgggatctcagatgt

SEQ ID NO: 16121 - DNA, 20 bp, Artificial Sequence
  chemically synthesized
aagctgggatctcagatgta

SEQ ID NO: 16122 - DNA, 20 bp, Artificial Sequence
  chemically synthesized
gggatctcagatgtagggaa

SEQ ID NO: 16123 - DNA, 20 bp, Artificial Sequence
  chemically synthesized
gatctcagatgtagggaaaa

SEQ ID NO: 16124 - DNA, 20 bp, Artificial Sequence
  chemically synthesized
atctcagatgtagggaaaag

SEQ ID NO: 16125 - DNA, 20 bp, Artificial Sequence
  chemically synthesized
ctcagatgtagggaaaagag

SEQ ID NO: 16126 - DNA, 20 bp, Artificial Sequence
  chemically synthesized
tttcctgttcactcactgtt

SEQ ID NO: 16127 - DNA, 20 bp, Artificial Sequence
  chemically synthesized
gttcactcactgttaagata

SEQ ID NO: 16128 - DNA, 20 bp, Artificial Sequence
  chemically synthesized
atggctgaaattttttgatc

SEQ ID NO: 16129 - DNA, 20 bp, Artificial Sequence
  chemically synthesized
ttttgatctagtcatctaca

SEQ ID NO: 16130 - DNA, 20 bp, Artificial Sequence
  chemically synthesized
tctagtcatctacaaagcat

SEQ ID NO: 16131 - DNA, 20 bp, Artificial Sequence
  chemically synthesized
catctacaaagcatgagttg

SEQ ID NO: 16132 - DNA, 20 bp, Artificial Sequence
  chemically synthesized
atctacaaagcatgagttgt

SEQ ID NO: 16133 - DNA, 20 bp, Artificial Sequence
  chemically synthesized
acaaagcatgagttgtgggt

SEQ ID NO: 16134 - DNA, 20 bp, Artificial Sequence
  chemically synthesized
cttttgacttcctttgacat

SEQ ID NO: 16135 - DNA, 20 bp, Artificial Sequence
  chemically synthesized
tttgacatcagaatataacc

SEQ ID NO: 16136 - DNA, 20 bp, Artificial Sequence
  chemically synthesized
ttgacatcagaatataacct

SEQ ID NO: 16137 - DNA, 20 bp, Artificial Sequence
  chemically synthesized
aacctaggaattgattactt

SEQ ID NO: 16138 - DNA, 20 bp, Artificial Sequence
  chemically synthesized
aggaattgattacttaagtg

SEQ ID NO: 16139 - DNA, 20 bp, Artificial Sequence
  chemically synthesized
ggaattgattacttaagtga

SEQ ID NO: 16140 - DNA, 20 bp, Artificial Sequence
  chemically synthesized
ttgattacttaagtgaaggc

SEQ ID NO: 16141 - DNA, 20 bp, Artificial Sequence
  chemically synthesized
tgattacttaagtgaaggca

SEQ ID NO: 16142 - DNA, 20 bp, Artificial Sequence
  chemically synthesized
taagtgaaggcaaggtactt

SEQ ID NO: 16143 - DNA, 20 bp, Artificial Sequence
  chemically synthesized
gaaggcaaggtactttggtc

SEQ ID NO: 16144 - DNA, 20 bp, Artificial Sequence
  chemically synthesized
gcaaggtactttggtctgga

SEQ ID NO: 16145 - DNA, 20 bp, Artificial Sequence
  chemically synthesized
caaggtactttggtctggac

SEQ ID NO: 16146 - DNA, 20 bp, Artificial Sequence
  chemically synthesized
tggacaggaacattttgaac

SEQ ID NO: 16147 - DNA, 20 bp, Artificial Sequence
  chemically synthesized
ggacaggaacattttgaaca

SEQ ID NO: 16148 - DNA, 20 bp, Artificial Sequence
  chemically synthesized
caggaacattttgaacaagg

SEQ ID NO: 16149 - DNA, 20 bp, Artificial Sequence
  chemically synthesized
aggaacattttgaacaaggt

SEQ ID NO: 16150 - DNA, 20 bp, Artificial Sequence
  chemically synthesized
ggaacattttgaacaaggta

SEQ ID NO: 16151 - DNA, 20 bp, Artificial Sequence
  chemically synthesized
aacattttgaacaaggtagg

SEQ ID NO: 16152 - DNA, 20 bp, Artificial Sequence
  chemically synthesized
ttttgaacaaggtagggaga

SEQ ID NO: 16153 - DNA, 20 bp, Artificial Sequence
  chemically synthesized
aaggtagggagacagctatg

SEQ ID NO: 16154 - DNA, 20 bp, Artificial Sequence
  chemically synthesized
aggtagggagacagctatga

SEQ ID NO: 16155 - DNA, 20 bp, Artificial Sequence
  chemically synthesized
agggagacagctatgaaggc

SEQ ID NO: 16156 - DNA, 20 bp, Artificial Sequence
  chemically synthesized
tatttatacatttaaacaaa

SEQ ID NO: 16157 - DNA, 20 bp, Artificial Sequence
  chemically synthesized
atacatttaaacaaaaagta

SEQ ID NO: 16158 - DNA, 20 bp, Artificial Sequence
  chemically synthesized
acatttaaacaaaaagtata

SEQ ID NO: 16159 - DNA, 20 bp, Artificial Sequence
  chemically synthesized
taaacaaaaagtatagagcg

SEQ ID NO: 16160 - DNA, 20 bp, Artificial Sequence
  chemically synthesized
tagagcgtagtataatttgt

SEQ ID NO: 16161 - DNA, 20 bp, Artificial Sequence
  chemically synthesized
tagtataatttgtaagtgct

SEQ ID NO: 16162 - DNA, 20 bp, Artificial Sequence
  chemically synthesized
agtataatttgtaagtgctc

SEQ ID NO: 16163 - DNA, 20 bp, Artificial Sequence
  chemically synthesized
gtataatttgtaagtgctca

SEQ ID NO: 16164 - DNA, 20 bp, Artificial Sequence
  chemically synthesized
tgctcagggctgtgtgtgta

SEQ ID NO: 16165 - DNA, 20 bp, Artificial Sequence
  chemically synthesized
gattgtttgaaatgaaacta

SEQ ID NO: 16166 - DNA, 20 bp, Artificial Sequence
  chemically synthesized
tgtttgaaatgaaactaaag

SEQ ID NO: 16167 - DNA, 20 bp, Artificial Sequence
  chemically synthesized
gtttgaaatgaaactaaagt

SEQ ID NO: 16168 - DNA, 20 bp, Artificial Sequence
  chemically synthesized
ttgaaatgaaactaaagtgg

SEQ ID NO: 16169 - DNA, 20 bp, Artificial Sequence
  chemically synthesized
ctactgcccccttaaccctg

SEQ ID NO: 16170 - DNA, 20 bp, Artificial Sequence
  chemically synthesized
tggtccctacactaccctgc

SEQ ID NO: 16171 - DNA, 20 bp, Artificial Sequence
  chemically synthesized
acactaccctgcaagactct

SEQ ID NO: 16172 - DNA, 20 bp, Artificial Sequence
  chemically synthesized
ctgcaagactcttagctgct

SEQ ID NO: 16173 - DNA, 20 bp, Artificial Sequence
  chemically synthesized
tagctgcttagcttaattgt

SEQ ID NO: 16174 - DNA, 20 bp, Artificial Sequence
  chemically synthesized
agctgcttagcttaattgtg

SEQ ID NO: 16175 - DNA, 20 bp, Artificial Sequence
  chemically synthesized
gcttaattgtgaggctgatt

SEQ ID NO: 16176 - DNA, 20 bp, Artificial Sequence
  chemically synthesized
cttaattgtgaggctgattt

SEQ ID NO: 16177 - DNA, 20 bp, Artificial Sequence
  chemically synthesized
ttaattgtgaggctgatttg

SEQ ID NO: 16178 - DNA, 20 bp, Artificial Sequence
  chemically synthesized
tgtgaggctgatttggggca

SEQ ID NO: 16179 - DNA, 20 bp, Artificial Sequence
  chemically synthesized
caacatcctcataataactt

SEQ ID NO: 16180 - DNA, 20 bp, Artificial Sequence
  chemically synthesized
aattttataaaatatcacaa

SEQ ID NO: 16181 - DNA, 20 bp, Artificial Sequence
  chemically synthesized
attttataaaatatcacaat

SEQ ID NO: 16182 - DNA, 20 bp, Artificial Sequence
  chemically synthesized
ttttataaaatatcacaata

SEQ ID NO: 16183 - DNA, 20 bp, Artificial Sequence
  chemically synthesized
tatcacaatagggtcatgtt

SEQ ID NO: 16184 - DNA, 20 bp, Artificial Sequence
  chemically synthesized
cacaatagggtcatgttcag

SEQ ID NO: 16185 - DNA, 20 bp, Artificial Sequence
  chemically synthesized
acaatagggtcatgttcagt

SEQ ID NO: 16186 - DNA, 20 bp, Artificial Sequence
  chemically synthesized
caatagggtcatgttcagta

SEQ ID NO: 16187 - DNA, 20 bp, Artificial Sequence
  chemically synthesized
agtagggtgatatataaaat

SEQ ID NO: 16188 - DNA, 20 bp, Artificial Sequence
  chemically synthesized
ggtgatatataaaattagac

SEQ ID NO: 16189 - DNA, 20 bp, Artificial Sequence
  chemically synthesized
atataaaattagacaagcca

SEQ ID NO: 16190 - DNA, 20 bp, Artificial Sequence
  chemically synthesized
aattagacaagccatagttt

SEQ ID NO: 16191 - DNA, 20 bp, Artificial Sequence
  chemically synthesized
tttgaataaatatatgacaa

SEQ ID NO: 16192 - DNA, 20 bp, Artificial Sequence
  chemically synthesized
ttgaataaatatatgacaaa

SEQ ID NO: 16193 - DNA, 20 bp, Artificial Sequence
  chemically synthesized
ggcaatttaattatctttat

SEQ ID NO: 16194 - DNA, 20 bp, Artificial Sequence
  chemically synthesized
tttaattatctttatgagtt

SEQ ID NO: 16195 - DNA, 20 bp, Artificial Sequence
  chemically synthesized
taattatctttatgagtttg

SEQ ID NO: 16196 - DNA, 20 bp, Artificial Sequence
  chemically synthesized
aattatctttatgagtttgg

SEQ ID NO: 16197 - DNA, 20 bp, Artificial Sequence
  chemically synthesized
tttatgagtttggaggtatc

SEQ ID NO: 16198 - DNA, 20 bp, Artificial Sequence
  chemically synthesized
gaggtatccagtatgaaatt

SEQ ID NO: 16199 - DNA, 20 bp, Artificial Sequence
  chemically synthesized
tttagataatacctgccttc

SEQ ID NO: 16200 - DNA, 20 bp, Artificial Sequence
  chemically synthesized
ctgccttctagtgttgaaat

SEQ ID NO: 16201 - DNA, 20 bp, Artificial Sequence
  chemically synthesized
atgcatcaatgaacttatta

SEQ ID NO: 16202 - DNA, 20 bp, Artificial Sequence
  chemically synthesized
aatgaacttattatagttcc

SEQ ID NO: 16203 - DNA, 20 bp, Artificial Sequence
  chemically synthesized
ttattatagttcctagcaca

SEQ ID NO: 16204 - DNA, 20 bp, Artificial Sequence
  chemically synthesized
tatagttcctagcacaaagt

SEQ ID NO: 16205 - DNA, 20 bp, Artificial Sequence
  chemically synthesized
atgtatttatctgttattaa

SEQ ID NO: 16206 - DNA, 20 bp, Artificial Sequence
  chemically synthesized
tgtatttatctgttattaat

SEQ ID NO: 16207 - DNA, 20 bp, Artificial Sequence
  chemically synthesized
tgttattaataggaatctta

SEQ ID NO: 16208 - DNA, 20 bp, Artificial Sequence
  chemically synthesized
gttattaataggaatcttat

SEQ ID NO: 16209 - DNA, 20 bp, Artificial Sequence
  chemically synthesized
aatccttattaataactatg

SEQ ID NO: 16210 - DNA, 20 bp, Artificial Sequence
  chemically synthesized
ccttattaataactatgaag

SEQ ID NO: 16211 - DNA, 20 bp, Artificial Sequence
  chemically synthesized
cttattaataactatgaagc

SEQ ID NO: 16212 - DNA, 20 bp, Artificial Sequence
  chemically synthesized
tatgaagcaggtatttattt

SEQ ID NO: 16213 - DNA, 20 bp, Artificial Sequence
  chemically synthesized
ggtatttatttgagttttcc

SEQ ID NO: 16214 - DNA, 20 bp, Artificial Sequence
  chemically synthesized
tttatttgagttttccaagt

SEQ ID NO: 16215 - DNA, 20 bp, Artificial Sequence
  chemically synthesized
ttgagttttccaagtgagtt

SEQ ID NO: 16216 - DNA, 20 bp, Artificial Sequence
  chemically synthesized
ttttccaagtgagttaagta

SEQ ID NO: 16217 - DNA, 20 bp, Artificial Sequence
  chemically synthesized
aagtatagcttgtaatactt

SEQ ID NO: 16218 - DNA, 20 bp, Artificial Sequence
  chemically synthesized
agtatagcttgtaatactta

SEQ ID NO: 16219 - DNA, 20 bp, Artificial Sequence
  chemically synthesized
aatacttaaggaaatatcca

SEQ ID NO: 16220 - DNA, 20 bp, Artificial Sequence
  chemically synthesized
atacttaaggaaatatccac

SEQ ID NO: 16221 - DNA, 20 bp, Artificial Sequence
  chemically synthesized
ggaaatatccacaggttaca

SEQ ID NO: 16222 - DNA, 20 bp, Artificial Sequence
  chemically synthesized
atatccacaggttacatagc

SEQ ID NO: 16223 - DNA, 20 bp, Artificial Sequence
  chemically synthesized
tacatagctagtatataact

SEQ ID NO: 16224 - DNA, 20 bp, Artificial Sequence
  chemically synthesized
tataaaacattctaacaata

SEQ ID NO: 16225 - DNA, 20 bp, Artificial Sequence
  chemically synthesized
tatataaactaaaaaactga

SEQ ID NO: 16226 - DNA, 20 bp, Artificial Sequence
  chemically synthesized
atataaactaaaaaactgaa

SEQ ID NO: 16227 - DNA, 20 bp, Artificial Sequence
  chemically synthesized
tataaactaaaaaactgaaa

SEQ ID NO: 16228 - DNA, 20 bp, Artificial Sequence
  chemically synthesized
ctcaatatcacttcttcact

SEQ ID NO: 16229 - DNA, 20 bp, Artificial Sequence
  chemically synthesized
cttcttcacttagaaaaaac

SEQ ID NO: 16230 - DNA, 20 bp, Artificial Sequence
  chemically synthesized
cacttagaaaaaaccagcct

SEQ ID NO: 16231 - DNA, 20 bp, Artificial Sequence
  chemically synthesized
tcctttcaaaatatacttct

SEQ ID NO: 16232 - DNA, 20 bp, Artificial Sequence
  chemically synthesized
aaaatatacttctgagaaat

SEQ ID NO: 16233 - DNA, 20 bp, Artificial Sequence
  chemically synthesized
aatatacttctgagaaatga

SEQ ID NO: 16234 - DNA, 20 bp, Artificial Sequence
  chemically synthesized
tatacttctgagaaatgaga

SEQ ID NO: 16235 - DNA, 20 bp, Artificial Sequence
  chemically synthesized
tacttctgagaaatgagaga

SEQ ID NO: 16236 - DNA, 20 bp, Artificial Sequence
  chemically synthesized
tgagaaatgagagagagaaa

SEQ ID NO: 16237 - DNA, 20 bp, Artificial Sequence
  chemically synthesized
gagaaatgagagagagaaat

SEQ ID NO: 16238 - DNA, 20 bp, Artificial Sequence
  chemically synthesized
agaaatgagagagagaaatg

SEQ ID NO: 16239 - DNA, 20 bp, Artificial Sequence
  chemically synthesized
aaatgagagagagaaatggg

SEQ ID NO: 16240 - DNA, 20 bp, Artificial Sequence
  chemically synthesized
aatgagagagagaaatgggg

SEQ ID NO: 16241 - DNA, 20 bp, Artificial Sequence
  chemically synthesized
atgagagagagaaatgggga

SEQ ID NO: 16242 - DNA, 20 bp, Artificial Sequence
  chemically synthesized
agagagagaaatggggaggg

SEQ ID NO: 16243 - DNA, 20 bp, Artificial Sequence
  chemically synthesized
gagagaaatggggagggtag

SEQ ID NO: 16244 - DNA, 20 bp, Artificial Sequence
  chemically synthesized
agagaaatggggagggtaga

SEQ ID NO: 16245 - DNA, 20 bp, Artificial Sequence
  chemically synthesized
gaaatggggagggtagaagg

SEQ ID NO: 16246 - DNA, 20 bp, Artificial Sequence
  chemically synthesized
aaatggggagggtagaagga

SEQ ID NO: 16247 - DNA, 20 bp, Artificial Sequence
  chemically synthesized
tggggagggtagaaggaagg

SEQ ID NO: 16248 - DNA, 20 bp, Artificial Sequence
  chemically synthesized
gagggtagaaggaaggaaga

SEQ ID NO: 16249 - DNA, 20 bp, Artificial Sequence
  chemically synthesized
agggtagaaggaaggaagat

SEQ ID NO: 16250 - DNA, 20 bp, Artificial Sequence
  chemically synthesized
gggtagaaggaaggaagata

SEQ ID NO: 16251 - DNA, 20 bp, Artificial Sequence
  chemically synthesized
agaaggaaggaagatagggt

SEQ ID NO: 16252 - DNA, 20 bp, Artificial Sequence
  chemically synthesized
aaggaaggaagatagggtaa

SEQ ID NO: 16253 - DNA, 20 bp, Artificial Sequence
  chemically synthesized
aaggaagatagggtaagaga

SEQ ID NO: 16254 - DNA, 20 bp, Artificial Sequence
  chemically synthesized
aggaagatagggtaagagac

SEQ ID NO: 16255 - DNA, 20 bp, Artificial Sequence
  chemically synthesized
ggaagatagggtaagagaca

SEQ ID NO: 16256 - DNA, 20 bp, Artificial Sequence
  chemically synthesized
agatagggtaagagacaggg

SEQ ID NO: 16257 - DNA, 20 bp, Artificial Sequence
  chemically synthesized
gatagggtaagagacaggga

SEQ ID NO: 16258 - DNA, 20 bp, Artificial Sequence
  chemically synthesized
tagggtaagagacagggaag

SEQ ID NO: 16259 - DNA, 20 bp, Artificial Sequence
  chemically synthesized
agggtaagagacagggaagg

SEQ ID NO: 16260 - DNA, 20 bp, Artificial Sequence
  chemically synthesized
aagagacagggaaggaggtg

SEQ ID NO: 16261 - DNA, 20 bp, Artificial Sequence
  chemically synthesized
agagacagggaaggaggtgt

SEQ ID NO: 16262 - DNA, 20 bp, Artificial Sequence
  chemically synthesized
gagacagggaaggaggtgtg

SEQ ID NO: 16263 - DNA, 20 bp, Artificial Sequence
  chemically synthesized
cagggaaggaggtgtgggga

SEQ ID NO: 16264 - DNA, 20 bp, Artificial Sequence
  chemically synthesized
ttcttttctctgtctcttga

SEQ ID NO: 16265 - DNA, 20 bp, Artificial Sequence
  chemically synthesized
cttttctctgtctcttgaaa

SEQ ID NO: 16266 - DNA, 20 bp, Artificial Sequence
  chemically synthesized
ctttccattacattgaatca

SEQ ID NO: 16267 - DNA, 20 bp, Artificial Sequence
  chemically synthesized
tttccattacattgaatcaa

SEQ ID NO: 16268 - DNA, 20 bp, Artificial Sequence
  chemically synthesized
aaaggtaatgttgccatttc

SEQ ID NO: 16269 - DNA, 20 bp, Artificial Sequence
  chemically synthesized
atttctggactcttgaaata

SEQ ID NO: 16270 - DNA, 20 bp, Artificial Sequence
  chemically synthesized
ctggactcttgaaataaaga

SEQ ID NO: 16271 - DNA, 20 bp, Artificial Sequence
  chemically synthesized
gatgtatgaaataattttga

SEQ ID NO: 16272 - DNA, 20 bp, Artificial Sequence
  chemically synthesized
gaaataattttgaaagtcta

SEQ ID NO: 16273 - DNA, 20 bp, Artificial Sequence
  chemically synthesized
ctatggcattttcaaaatgc

SEQ ID NO: 16274 - DNA, 20 bp, Artificial Sequence
  chemically synthesized
tatggcattttcaaaatgca

SEQ ID NO: 16275 - DNA, 20 bp, Artificial Sequence
  chemically synthesized
caaggtgatgtcttactaac

SEQ ID NO: 16276 - DNA, 20 bp, Artificial Sequence
  chemically synthesized
actagcctttgctttattat

SEQ ID NO: 16277 - DNA, 20 bp, Artificial Sequence
  chemically synthesized
ctttgctttattattagaaa

SEQ ID NO: 16278 - DNA, 20 bp, Artificial Sequence
  chemically synthesized
tttgctttattattagaaat

SEQ ID NO: 16279 - DNA, 20 bp, Artificial Sequence
  chemically synthesized
ttgctttattattagaaatg

SEQ ID NO: 16280 - DNA, 20 bp, Artificial Sequence
  chemically synthesized
ctttattattagaaatgggg

SEQ ID NO: 16281 - DNA, 20 bp, Artificial Sequence
  chemically synthesized
attattagaaatggggaagt

SEQ ID NO: 16282 - DNA, 20 bp, Artificial Sequence
  chemically synthesized
tagaaatggggaagtgagta

SEQ ID NO: 16283 - DNA, 20 bp, Artificial Sequence
  chemically synthesized
agtgagtatagacattttat

SEQ ID NO: 16284 - DNA, 20 bp, Artificial Sequence
  chemically synthesized
gtgagtatagacattttatc

SEQ ID NO: 16285 - DNA, 20 bp, Artificial Sequence
  chemically synthesized
gagtatagacattttatcag

SEQ ID NO: 16286 - DNA, 20 bp, Artificial Sequence
  chemically synthesized
cattttatcaggagatatat

SEQ ID NO: 16287 - DNA, 20 bp, Artificial Sequence
  chemically synthesized
attttatcaggagatatatt

SEQ ID NO: 16288 - DNA, 20 bp, Artificial Sequence
  chemically synthesized
tcaggagatatattaggaaa

SEQ ID NO: 16289 - DNA, 20 bp, Artificial Sequence
  chemically synthesized
caggagatatattaggaaaa

SEQ ID NO: 16290 - DNA, 20 bp, Artificial Sequence
  chemically synthesized
aggagatatattaggaaaaa

SEQ ID NO: 16291 - DNA, 20 bp, Artificial Sequence
  chemically synthesized
atattaggaaaaagggaaac

SEQ ID NO: 16292 - DNA, 20 bp, Artificial Sequence
  chemically synthesized
attaggaaaaagggaaactg

SEQ ID NO: 16293 - DNA, 20 bp, Artificial Sequence
  chemically synthesized
aaaagggaaactggagaaac

SEQ ID NO: 16294 - DNA, 20 bp, Artificial Sequence
  chemically synthesized
aaagggaaactggagaaact

SEQ ID NO: 16295 - DNA, 20 bp, Artificial Sequence
  chemically synthesized
agggaaactggagaaactgg

SEQ ID NO: 16296 - DNA, 20 bp, Artificial Sequence
  chemically synthesized
gggaaactggagaaactggg

SEQ ID NO: 16297 - DNA, 20 bp, Artificial Sequence
  chemically synthesized
gaaactggagaaactgggag

SEQ ID NO: 16298 - DNA, 20 bp, Artificial Sequence
  chemically synthesized
gagaaactgggaggagtatc

SEQ ID NO: 16299 - DNA, 20 bp, Artificial Sequence
  chemically synthesized
tccagatgtcctgtccctgt

SEQ ID NO: 16300 - DNA, 20 bp, Artificial Sequence
  chemically synthesized
ccagatgtcctgtccctgta

SEQ ID NO: 16301 - DNA, 20 bp, Artificial Sequence
  chemically synthesized
gatgtcctgtccctgtaagg

SEQ ID NO: 16302 - DNA, 20 bp, Artificial Sequence
  chemically synthesized
atgtcctgtccctgtaaggt

SEQ ID NO: 16303 - DNA, 20 bp, Artificial Sequence
  chemically synthesized
tgtcctgtccctgtaaggtg

SEQ ID NO: 16304 - DNA, 20 bp, Artificial Sequence
  chemically synthesized
gtcctgtccctgtaaggtgg

SEQ ID NO: 16305 - DNA, 20 bp, Artificial Sequence
  chemically synthesized
gggcacccaccttcaatcaa

SEQ ID NO: 16306 - DNA, 20 bp, Artificial Sequence
  chemically synthesized
ggcacccaccttcaatcaaa

SEQ ID NO: 16307 - DNA, 20 bp, Artificial Sequence
  chemically synthesized
gcacccaccttcaatcaaaa

SEQ ID NO: 16308 - DNA, 20 bp, Artificial Sequence
  chemically synthesized
tccttaacaacttccttgct

SEQ ID NO: 16309 - DNA, 20 bp, Artificial Sequence
  chemically synthesized
ccttaacaacttccttgctt

SEQ ID NO: 16310 - DNA, 20 bp, Artificial Sequence
  chemically synthesized
cttaacaacttccttgcttg

SEQ ID NO: 16311 - DNA, 20 bp, Artificial Sequence
  chemically synthesized
tgcttggggctccaccatct

SEQ ID NO: 16312 - DNA, 20 bp, Artificial Sequence
  chemically synthesized
gctccaccatcttggaccat

SEQ ID NO: 16313 - DNA, 20 bp, Artificial Sequence
  chemically synthesized
atcttggaccattagctcca

SEQ ID NO: 16314 - DNA, 20 bp, Artificial Sequence
  chemically synthesized
tcttggaccattagctccac

SEQ ID NO: 16315 - DNA, 20 bp, Artificial Sequence
  chemically synthesized
cacaggtatcttcttccctc

SEQ ID NO: 16316 - DNA, 20 bp, Artificial Sequence
  chemically synthesized
aggtatcttcttccctctag

SEQ ID NO: 16317 - DNA, 20 bp, Artificial Sequence
  chemically synthesized
cttccctctagtggtcataa

SEQ ID NO: 16318 - DNA, 20 bp, Artificial Sequence
  chemically synthesized
ccctctagtggtcataacag

SEQ ID NO: 16319 - DNA, 20 bp, Artificial Sequence
  chemically synthesized
agtggtcataacagcagctt

SEQ ID NO: 16320 - DNA, 20 bp, Artificial Sequence
  chemically synthesized
cagcttcagctacctctcta

SEQ ID NO: 16321 - DNA, 20 bp, Artificial Sequence
  chemically synthesized
gcttcagctacctctctaaa

SEQ ID NO: 16322 - DNA, 20 bp, Artificial Sequence
  chemically synthesized
acctctctaaagagtcctgc

SEQ ID NO: 16323 - DNA, 20 bp, Artificial Sequence
  chemically synthesized
ctaaagagtcctgccagata

SEQ ID NO: 16324 - DNA, 20 bp, Artificial Sequence
  chemically synthesized
taaagagtcctgccagatat

SEQ ID NO: 16325 - DNA, 20 bp, Artificial Sequence
  chemically synthesized
gagtcctgccagatataggt

SEQ ID NO: 16326 - DNA, 20 bp, Artificial Sequence
  chemically synthesized
agtcctgccagatataggtc

SEQ ID NO: 16327 - DNA, 20 bp, Artificial Sequence
  chemically synthesized
aaatataatccactaataaa

SEQ ID NO: 16328 - DNA, 20 bp, Artificial Sequence
  chemically synthesized
atataatccactaataaaaa

SEQ ID NO: 16329 - DNA, 20 bp, Artificial Sequence
  chemically synthesized
aaagagaaacattttgactg

SEQ ID NO: 16330 - DNA, 20 bp, Artificial Sequence
  chemically synthesized
taacattctcactctttcat

SEQ ID NO: 16331 - DNA, 20 bp, Artificial Sequence
  chemically synthesized
ctctttcatcagtaatcact

SEQ ID NO: 16332 - DNA, 20 bp, Artificial Sequence
  chemically synthesized
tctttcatcagtaatcactc

SEQ ID NO: 16333 - DNA, 20 bp, Artificial Sequence
  chemically synthesized
tcaggttattctgtgaccaa

SEQ ID NO: 16334 - DNA, 20 bp, Artificial Sequence
  chemically synthesized
attctgtgaccaacagactg

SEQ ID NO: 16335 - DNA, 20 bp, Artificial Sequence
  chemically synthesized
ttctgtgaccaacagactgt

SEQ ID NO: 16336 - DNA, 20 bp, Artificial Sequence
  chemically synthesized
caacagactgtgggaaaaat

SEQ ID NO: 16337 - DNA, 20 bp, Artificial Sequence
  chemically synthesized
acagactgtgggaaaaatca

SEQ ID NO: 16338 - DNA, 20 bp, Artificial Sequence
  chemically synthesized
gactgtgggaaaaatcagag

SEQ ID NO: 16339 - DNA, 20 bp, Artificial Sequence
  chemically synthesized
actgtgggaaaaatcagaga

SEQ ID NO: 16340 - DNA, 20 bp, Artificial Sequence
  chemically synthesized
tgtgggaaaaatcagagaag

SEQ ID NO: 16341 - DNA, 20 bp, Artificial Sequence
  chemically synthesized
gtgggaaaaatcagagaagg

SEQ ID NO: 16342 - DNA, 20 bp, Artificial Sequence
  chemically synthesized
ggaggcatcctcatgcttac

SEQ ID NO: 16343 - DNA, 20 bp, Artificial Sequence
  chemically synthesized
agcctaaactgaaattgcta

SEQ ID NO: 16344 - DNA, 20 bp, Artificial Sequence
  chemically synthesized
ctaaactgaaattgctatag

SEQ ID NO: 16345 - DNA, 20 bp, Artificial Sequence
  chemically synthesized
aaactgaaattgctatagca

SEQ ID NO: 16346 - DNA, 20 bp, Artificial Sequence
  chemically synthesized
attgctatagcagagtgaac

SEQ ID NO: 16347 - DNA, 20 bp, Artificial Sequence
  chemically synthesized
gctatagcagagtgaaccag

SEQ ID NO: 16348 - DNA, 20 bp, Artificial Sequence
  chemically synthesized
ctatagcagagtgaaccaga

SEQ ID NO: 16349 - DNA, 20 bp, Artificial Sequence
  chemically synthesized
agagtgaaccagaaggttta

SEQ ID NO: 16350 - DNA, 20 bp, Artificial Sequence
  chemically synthesized
gtttacagatattttccaca

SEQ ID NO: 16351 - DNA, 20 bp, Artificial Sequence
  chemically synthesized
ttacagatattttccacaaa

SEQ ID NO: 16352 - DNA, 20 bp, Artificial Sequence
  chemically synthesized
atattttccacaaagagtaa

SEQ ID NO: 16353 - DNA, 20 bp, Artificial Sequence
  chemically synthesized
tattttccacaaagagtaaa

SEQ ID NO: 16354 - DNA, 20 bp, Artificial Sequence
  chemically synthesized
cacaaagagtaaaaggattg

SEQ ID NO: 16355 - DNA, 20 bp, Artificial Sequence
  chemically synthesized
aaaaggattgaagccttctc

SEQ ID NO: 16356 - DNA, 20 bp, Artificial Sequence
  chemically synthesized
gccttctccagatcaatgca

SEQ ID NO: 16357 - DNA, 20 bp, Artificial Sequence
  chemically synthesized
ccttctccagatcaatgcat

SEQ ID NO: 16358 - DNA, 20 bp, Artificial Sequence
  chemically synthesized
caatgcataggaaataataa

SEQ ID NO: 16359 - DNA, 20 bp, Artificial Sequence
  chemically synthesized
catattatgacgaacaacat

SEQ ID NO: 16360 - DNA, 20 bp, Artificial Sequence
  chemically synthesized
atattatgacgaacaacatt

SEQ ID NO: 16361 - DNA, 20 bp, Artificial Sequence
  chemically synthesized
atgacgaacaacattaggat

SEQ ID NO: 16362 - DNA, 20 bp, Artificial Sequence
  chemically synthesized
gtccatatcaatttttaatc

SEQ ID NO: 16363 - DNA, 20 bp, Artificial Sequence
  chemically synthesized
tcaatttttaatccagtcat

SEQ ID NO: 16364 - DNA, 20 bp, Artificial Sequence
  chemically synthesized
ttttaatccagtcataagca

SEQ ID NO: 16365 - DNA, 20 bp, Artificial Sequence
  chemically synthesized
tcataagcacagactacgtg

SEQ ID NO: 16366 - DNA, 20 bp, Artificial Sequence
  chemically synthesized
agactacgtgaagcacgtcc

SEQ ID NO: 16367 - DNA, 20 bp, Artificial Sequence
  chemically synthesized
acgtgaagcacgtccaagtg

SEQ ID NO: 16368 - DNA, 20 bp, Artificial Sequence
  chemically synthesized
cgtgaagcacgtccaagtga

SEQ ID NO: 16369 - DNA, 20 bp, Artificial Sequence
  chemically synthesized
gaagcacgtccaagtgaagg

SEQ ID NO: 16370 - DNA, 20 bp, Artificial Sequence
  chemically synthesized
aagcacgtccaagtgaaggc

SEQ ID NO: 16371 - DNA, 20 bp, Artificial Sequence
  chemically synthesized
gcacgtccaagtgaaggcag

SEQ ID NO: 16372 - DNA, 20 bp, Artificial Sequence
  chemically synthesized
caagtgaaggcaggagaaat

SEQ ID NO: 16373 - DNA, 20 bp, Artificial Sequence
  chemically synthesized
agtgaaggcaggagaaatga

SEQ ID NO: 16374 - DNA, 20 bp, Artificial Sequence
  chemically synthesized
gtgaaggcaggagaaatgag

SEQ ID NO: 16375 - DNA, 20 bp, Artificial Sequence
  chemically synthesized
gaaggcaggagaaatgagag

SEQ ID NO: 16376 - DNA, 20 bp, Artificial Sequence
  chemically synthesized
gcaggagaaatgagaggagc

SEQ ID NO: 16377 - DNA, 20 bp, Artificial Sequence
  chemically synthesized
gagaaatgagaggagcaaga

SEQ ID NO: 16378 - DNA, 20 bp, Artificial Sequence
  chemically synthesized
gaaatgagaggagcaagaaa

SEQ ID NO: 16379 - DNA, 20 bp, Artificial Sequence
  chemically synthesized
aaatgagaggagcaagaaag

SEQ ID NO: 16380 - DNA, 20 bp, Artificial Sequence
  chemically synthesized
atgagaggagcaagaaagag

SEQ ID NO: 16381 - DNA, 20 bp, Artificial Sequence
  chemically synthesized
gaaagaggagccatttgatc

SEQ ID NO: 16382 - DNA, 20 bp, Artificial Sequence
  chemically synthesized
aggagccatttgatcaagaa

SEQ ID NO: 16383 - DNA, 20 bp, Artificial Sequence
  chemically synthesized
agccatttgatcaagaatag

SEQ ID NO: 16384 - DNA, 20 bp, Artificial Sequence
  chemically synthesized
ttgatcaagaatagcagaaa

SEQ ID NO: 16385 - DNA, 20 bp, Artificial Sequence
  chemically synthesized
tgatcaagaatagcagaaaa

SEQ ID NO: 16386 - DNA, 20 bp, Artificial Sequence
  chemically synthesized
caagaatagcagaaaaagga

SEQ ID NO: 16387 - DNA, 20 bp, Artificial Sequence
  chemically synthesized
aagaatagcagaaaaaggaa

SEQ ID NO: 16388 - DNA, 20 bp, Artificial Sequence
  chemically synthesized
atagcagaaaaaggaaaggc

SEQ ID NO: 16389 - DNA, 20 bp, Artificial Sequence
  chemically synthesized
acaaatgattgtcatgccaa

SEQ ID NO: 16390 - DNA, 20 bp, Artificial Sequence
  chemically synthesized
tgattgtcatgccaacagta

SEQ ID NO: 16391 - DNA, 20 bp, Artificial Sequence
  chemically synthesized
tacagataactctgctaata

SEQ ID NO: 16392 - DNA, 20 bp, Artificial Sequence
  chemically synthesized
acagataactctgctaataa

SEQ ID NO: 16393 - DNA, 20 bp, Artificial Sequence
  chemically synthesized
gataactctgctaataaagg

SEQ ID NO: 16394 - DNA, 20 bp, Artificial Sequence
  chemically synthesized
taactctgctaataaaggta

SEQ ID NO: 16395 - DNA, 20 bp, Artificial Sequence
  chemically synthesized
aactctgctaataaaggtag

SEQ ID NO: 16396 - DNA, 20 bp, Artificial Sequence
  chemically synthesized
ataaaggtagaggcataata

SEQ ID NO: 16397 - DNA, 20 bp, Artificial Sequence
  chemically synthesized
taaaggtagaggcataatac

SEQ ID NO: 16398 - DNA, 20 bp, Artificial Sequence
  chemically synthesized
aggtagaggcataatacagg

SEQ ID NO: 16399 - DNA, 20 bp, Artificial Sequence
  chemically synthesized
tagaggcataatacaggtag

SEQ ID NO: 16400 - DNA, 20 bp, Artificial Sequence
  chemically synthesized
aggcataatacaggtagtag

SEQ ID NO: 16401 - DNA, 20 bp, Artificial Sequence
  chemically synthesized
ggtagtagcagatatctaca

SEQ ID NO: 16402 - DNA, 20 bp, Artificial Sequence
  chemically synthesized
agtagcagatatctacatag

SEQ ID NO: 16403 - DNA, 20 bp, Artificial Sequence
  chemically synthesized
agatatctacatagtagtta

SEQ ID NO: 16404 - DNA, 20 bp, Artificial Sequence
  chemically synthesized
gatatctacatagtagttaa

SEQ ID NO: 16405 - DNA, 20 bp, Artificial Sequence
  chemically synthesized
tacatagtagttaaaggaca

SEQ ID NO: 16406 - DNA, 20 bp, Artificial Sequence
  chemically synthesized
tagttaaaggacatggccat

SEQ ID NO: 16407 - DNA, 20 bp, Artificial Sequence
  chemically synthesized
aaaggacatggccatcagta

SEQ ID NO: 16408 - DNA, 20 bp, Artificial Sequence
  chemically synthesized
ggacatggccatcagtacag

SEQ ID NO: 16409 - DNA, 20 bp, Artificial Sequence
  chemically synthesized
tcagtacagaagattccata

SEQ ID NO: 16410 - DNA, 20 bp, Artificial Sequence
  chemically synthesized
cagtacagaagattccataa

SEQ ID NO: 16411 - DNA, 20 bp, Artificial Sequence
  chemically synthesized
gtacagaagattccataaag

SEQ ID NO: 16412 - DNA, 20 bp, Artificial Sequence
  chemically synthesized
attccataaaggagaaccta

SEQ ID NO: 16413 - DNA, 20 bp, Artificial Sequence
  chemically synthesized
tccataaaggagaacctaaa

SEQ ID NO: 16414 - DNA, 20 bp, Artificial Sequence
  chemically synthesized
ccataaaggagaacctaaag

SEQ ID NO: 16415 - DNA, 20 bp, Artificial Sequence
  chemically synthesized
taaaggagaacctaaagagg

SEQ ID NO: 16416 - DNA, 20 bp, Artificial Sequence
  chemically synthesized
aaagaggaagaataatttgt

SEQ ID NO: 16417 - DNA, 20 bp, Artificial Sequence
  chemically synthesized
gaggaagaataatttgtcag

SEQ ID NO: 16418 - DNA, 20 bp, Artificial Sequence
  chemically synthesized
ataatttgtcagaagcttaa

SEQ ID NO: 16419 - DNA, 20 bp, Artificial Sequence
  chemically synthesized
aagcttaaaagctgaactct

SEQ ID NO: 16420 - DNA, 20 bp, Artificial Sequence
  chemically synthesized
agcttaaaagctgaactctg

SEQ ID NO: 16421 - DNA, 20 bp, Artificial Sequence
  chemically synthesized
ctacaatatccttttgactg

SEQ ID NO: 16422 - DNA, 20 bp, Artificial Sequence
  chemically synthesized
aatatccttttgactgtgga

SEQ ID NO: 16423 - DNA, 20 bp, Artificial Sequence
  chemically synthesized
atatccttttgactgtggaa

SEQ ID NO: 16424 - DNA, 20 bp, Artificial Sequence
  chemically synthesized
tatccttttgactgtggaaa

SEQ ID NO: 16425 - DNA, 20 bp, Artificial Sequence
  chemically synthesized
ccttttgactgtggaaaggg

SEQ ID NO: 16426 - DNA, 20 bp, Artificial Sequence
  chemically synthesized
gactgtggaaagggtggtga

SEQ ID NO: 16427 - DNA, 20 bp, Artificial Sequence
  chemically synthesized
actgtggaaagggtggtgaa

SEQ ID NO: 16428 - DNA, 20 bp, Artificial Sequence
  chemically synthesized
tggaaagggtggtgaaagga

SEQ ID NO: 16429 - DNA, 20 bp, Artificial Sequence
  chemically synthesized
gggtggtgaaaggaaagttc

SEQ ID NO: 16430 - DNA, 20 bp, Artificial Sequence
  chemically synthesized
ggtggtgaaaggaaagttca

SEQ ID NO: 16431 - DNA, 20 bp, Artificial Sequence
  chemically synthesized
aggaaagttcaaggacattt

SEQ ID NO: 16432 - DNA, 20 bp, Artificial Sequence
  chemically synthesized
caaggacatttgagccaaca

SEQ ID NO: 16433 - DNA, 20 bp, Artificial Sequence
  chemically synthesized
aggacatttgagccaacata

SEQ ID NO: 16434 - DNA, 20 bp, Artificial Sequence
  chemically synthesized
gacatttgagccaacataga

SEQ ID NO: 16435 - DNA, 20 bp, Artificial Sequence
  chemically synthesized
acatttgagccaacatagag

SEQ ID NO: 16436 - DNA, 20 bp, Artificial Sequence
  chemically synthesized
gccaacatagagaggaacat

SEQ ID NO: 16437 - DNA, 20 bp, Artificial Sequence
  chemically synthesized
catagagaggaacattggct

SEQ ID NO: 16438 - DNA, 20 bp, Artificial Sequence
  chemically synthesized
gagaggaacattggcttggt

SEQ ID NO: 16439 - DNA, 20 bp, Artificial Sequence
  chemically synthesized
agaggaacattggcttggtg

SEQ ID NO: 16440 - DNA, 20 bp, Artificial Sequence
  chemically synthesized
gaggaacattggcttggtga

SEQ ID NO: 16441 - DNA, 20 bp, Artificial Sequence
  chemically synthesized
atatctgtcctgatgttgtc

SEQ ID NO: 16442 - DNA, 20 bp, Artificial Sequence
  chemically synthesized
tatctgtcctgatgttgtcc

SEQ ID NO: 16443 - DNA, 20 bp, Artificial Sequence
  chemically synthesized
tgtcctgatgttgtccagga

SEQ ID NO: 16444 - DNA, 20 bp, Artificial Sequence
  chemically synthesized
tgatacccatataaataacg

SEQ ID NO: 16445 - DNA, 20 bp, Artificial Sequence
  chemically synthesized
atacccatataaataacgta

SEQ ID NO: 16446 - DNA, 20 bp, Artificial Sequence
  chemically synthesized
tataaataacgtagagaaaa

SEQ ID NO: 16447 - DNA, 20 bp, Artificial Sequence
  chemically synthesized
ataaataacgtagagaaaac

SEQ ID NO: 16448 - DNA, 20 bp, Artificial Sequence
  chemically synthesized
aaataacgtagagaaaacag

SEQ ID NO: 16449 - DNA, 20 bp, Artificial Sequence
  chemically synthesized
aataacgtagagaaaacagg

SEQ ID NO: 16450 - DNA, 20 bp, Artificial Sequence
  chemically synthesized
ataacgtagagaaaacagga

SEQ ID NO: 16451 - DNA, 20 bp, Artificial Sequence
  chemically synthesized
taacgtagagaaaacaggag

SEQ ID NO: 16452 - DNA, 20 bp, Artificial Sequence
  chemically synthesized
gtagagaaaacaggagggga

SEQ ID NO: 16453 - DNA, 20 bp, Artificial Sequence
  chemically synthesized
agagaaaacaggaggggata

SEQ ID NO: 16454 - DNA, 20 bp, Artificial Sequence
  chemically synthesized
aacaggaggggatagagatc

SEQ ID NO: 16455 - DNA, 20 bp, Artificial Sequence
  chemically synthesized
aggggatagagatctagaca

SEQ ID NO: 16456 - DNA, 20 bp, Artificial Sequence
  chemically synthesized
gggatagagatctagacaaa

SEQ ID NO: 16457 - DNA, 20 bp, Artificial Sequence
  chemically synthesized
ggatagagatctagacaaag

SEQ ID NO: 16458 - DNA, 20 bp, Artificial Sequence
  chemically synthesized
atctagacaaagaggcatca

SEQ ID NO: 16459 - DNA, 20 bp, Artificial Sequence
  chemically synthesized
agacaaagaggcatcaaaga

SEQ ID NO: 16460 - DNA, 20 bp, Artificial Sequence
  chemically synthesized
gacaaagaggcatcaaagat

SEQ ID NO: 16461 - DNA, 20 bp, Artificial Sequence
  chemically synthesized
acaaagaggcatcaaagata

SEQ ID NO: 16462 - DNA, 20 bp, Artificial Sequence
  chemically synthesized
tcaaagatagggatgtttgt

SEQ ID NO: 16463 - DNA, 20 bp, Artificial Sequence
  chemically synthesized
caaagatagggatgtttgta

SEQ ID NO: 16464 - DNA, 20 bp, Artificial Sequence
  chemically synthesized
ggatgtttgtaaggatgaaa

SEQ ID NO: 16465 - DNA, 20 bp, Artificial Sequence
  chemically synthesized
aaatagaacgttttttgcgt

SEQ ID NO: 16466 - DNA, 20 bp, Artificial Sequence
  chemically synthesized
ttttttgcgttagtcaccgt

SEQ ID NO: 16467 - DNA, 20 bp, Artificial Sequence
  chemically synthesized
tttttgcgttagtcaccgtg

SEQ ID NO: 16468 - DNA, 20 bp, Artificial Sequence
  chemically synthesized
ttagtcaccgtgaggatgac

SEQ ID NO: 16469 - DNA, 20 bp, Artificial Sequence
  chemically synthesized
caccgtgaggatgaccggta

SEQ ID NO: 16470 - DNA, 20 bp, Artificial Sequence
  chemically synthesized
accgtgaggatgaccggtaa

SEQ ID NO: 16471 - DNA, 20 bp, Artificial Sequence
  chemically synthesized
gatgaccggtaaaggcaatg

SEQ ID NO: 16472 - DNA, 20 bp, Artificial Sequence
  chemically synthesized
tgaccggtaaaggcaatgca

SEQ ID NO: 16473 - DNA, 20 bp, Artificial Sequence
  chemically synthesized
gaccggtaaaggcaatgcag

SEQ ID NO: 16474 - DNA, 20 bp, Artificial Sequence
  chemically synthesized
ataataattgtgtgtattca

SEQ ID NO: 16475 - DNA, 20 bp, Artificial Sequence
  chemically synthesized
taataattgtgtgtattcat

SEQ ID NO: 16476 - DNA, 20 bp, Artificial Sequence
  chemically synthesized
aataattgtgtgtattcatg

SEQ ID NO: 16477 - DNA, 20 bp, Artificial Sequence
  chemically synthesized
tggggtacaacatgatgctt

SEQ ID NO: 16478 - DNA, 20 bp, Artificial Sequence
  chemically synthesized
tgtacgtgtacaatattaaa

SEQ ID NO: 16479 - DNA, 20 bp, Artificial Sequence
  chemically synthesized
acaatattaaatggttaaat

SEQ ID NO: 16480 - DNA, 20 bp, Artificial Sequence
  chemically synthesized
caatattaaatggttaaata

SEQ ID NO: 16481 - DNA, 20 bp, Artificial Sequence
  chemically synthesized
cttcacatacttattttttg

SEQ ID NO: 16482 - DNA, 20 bp, Artificial Sequence
  chemically synthesized
acactcttcattcaaaaatc

SEQ ID NO: 16483 - DNA, 20 bp, Artificial Sequence
  chemically synthesized
tcattcaaaaatctggaaca

SEQ ID NO: 16484 - DNA, 20 bp, Artificial Sequence
  chemically synthesized
agttaaaatgtcatatgtgt

SEQ ID NO: 16485 - DNA, 20 bp, Artificial Sequence
  chemically synthesized
gttaaaatgtcatatgtgtc

SEQ ID NO: 16486 - DNA, 20 bp, Artificial Sequence
  chemically synthesized
atgtcatatgtgtcaggatg

SEQ ID NO: 16487 - DNA, 20 bp, Artificial Sequence
  chemically synthesized
tatgtgtcaggatgcagtaa

SEQ ID NO: 16488 - DNA, 20 bp, Artificial Sequence
  chemically synthesized
tcaggatgcagtaatagatt

SEQ ID NO: 16489 - DNA, 20 bp, Artificial Sequence
  chemically synthesized
atcatgaataatgatcaatc

SEQ ID NO: 16490 - DNA, 20 bp, Artificial Sequence
  chemically synthesized
tcatgaataatgatcaatcg

SEQ ID NO: 16491 - DNA, 20 bp, Artificial Sequence
  chemically synthesized
cgaggaaaacctatgaaaat

SEQ ID NO: 16492 - DNA, 20 bp, Artificial Sequence
  chemically synthesized
ctatgaaaatgagaaaattt

SEQ ID NO: 16493 - DNA, 20 bp, Artificial Sequence
  chemically synthesized
atgaaaatgagaaaattttg

SEQ ID NO: 16494 - DNA, 20 bp, Artificial Sequence
  chemically synthesized
aaaaatatcttgatcacttt

SEQ ID NO: 16495 - DNA, 20 bp, Artificial Sequence
  chemically synthesized
aaatatcttgatcacttttg

SEQ ID NO: 16496 - DNA, 20 bp, Artificial Sequence
  chemically synthesized
aatatcttgatcacttttgg

SEQ ID NO: 16497 - DNA, 20 bp, Artificial Sequence
  chemically synthesized
tcttgatcacttttggaggt

SEQ ID NO: 16498 - DNA, 20 bp, Artificial Sequence
  chemically synthesized
cttgatcacttttggaggtc

SEQ ID NO: 16499 - DNA, 20 bp, Artificial Sequence
  chemically synthesized
acttttggaggtcaggaatt

SEQ ID NO: 16500 - DNA, 20 bp, Artificial Sequence
  chemically synthesized
gaattcagattcatttttct

SEQ ID NO: 16501 - DNA, 20 bp, Artificial Sequence
  chemically synthesized
ttcatttttctcggcctgta

SEQ ID NO: 16502 - DNA, 20 bp, Artificial Sequence
  chemically synthesized
aagaacttgaaattgcatta

SEQ ID NO: 16503 - DNA, 20 bp, Artificial Sequence
  chemically synthesized
aacttgaaattgcattatag

SEQ ID NO: 16504 - DNA, 20 bp, Artificial Sequence
  chemically synthesized
aattgcattatagcagaatg

SEQ ID NO: 16505 - DNA, 20 bp, Artificial Sequence
  chemically synthesized
attgcattatagcagaatgt

SEQ ID NO: 16506 - DNA, 20 bp, Artificial Sequence
  chemically synthesized
tatagcagaatgtaggcctt

SEQ ID NO: 16507 - DNA, 20 bp, Artificial Sequence
  chemically synthesized
agcagaatgtaggccttgag

SEQ ID NO: 16508 - DNA, 20 bp, Artificial Sequence
  chemically synthesized
aggccttgagtggattgatg

SEQ ID NO: 16509 - DNA, 20 bp, Artificial Sequence
  chemically synthesized
ccttgagtggattgatgtgg

SEQ ID NO: 16510 - DNA, 20 bp, Artificial Sequence
  chemically synthesized
gattgatgtggaagcaaaac

SEQ ID NO: 16511 - DNA, 20 bp, Artificial Sequence
  chemically synthesized
agcaaaacaagccacaaata

SEQ ID NO: 16512 - DNA, 20 bp, Artificial Sequence
  chemically synthesized
tgacttgtgccattaatttt

SEQ ID NO: 16513 - DNA, 20 bp, Artificial Sequence
  chemically synthesized
cttgtgccattaattttaag

SEQ ID NO: 16514 - DNA, 20 bp, Artificial Sequence
  chemically synthesized
aagcagtttcatatgaaacg

SEQ ID NO: 16515 - DNA, 20 bp, Artificial Sequence
  chemically synthesized
agcagtttcatatgaaacgt

SEQ ID NO: 16516 - DNA, 20 bp, Artificial Sequence
  chemically synthesized
gtttctttattgctacgtca

SEQ ID NO: 16517 - DNA, 20 bp, Artificial Sequence
  chemically synthesized
ctttattgctacgtcacagt

SEQ ID NO: 16518 - DNA, 20 bp, Artificial Sequence
  chemically synthesized
acgtcacagtcagatgttca

SEQ ID NO: 16519 - DNA, 20 bp, Artificial Sequence
  chemically synthesized
agtcagatgttcatggtcct

SEQ ID NO: 16520 - DNA, 20 bp, Artificial Sequence
  chemically synthesized
ggtcctgagtgctctcctcc

SEQ ID NO: 16521 - DNA, 20 bp, Artificial Sequence
  chemically synthesized
cctgagtgctctcctccaag

SEQ ID NO: 16522 - DNA, 20 bp, Artificial Sequence
  chemically synthesized
gagtgctctcctccaagcag

SEQ ID NO: 16523 - DNA, 20 bp, Artificial Sequence
  chemically synthesized
agtgctctcctccaagcagt

SEQ ID NO: 16524 - DNA, 20 bp, Artificial Sequence
  chemically synthesized
ctctcctccaagcagtgggc

SEQ ID NO: 16525 - DNA, 20 bp, Artificial Sequence
  chemically synthesized
tctcctccaagcagtgggcc

SEQ ID NO: 16526 - DNA, 20 bp, Artificial Sequence
  chemically synthesized
tcctccaagcagtgggccag

SEQ ID NO: 16527 - DNA, 20 bp, Artificial Sequence
  chemically synthesized
caagcagtgggccaggagtc

SEQ ID NO: 16528 - DNA, 20 bp, Artificial Sequence
  chemically synthesized
aagcagtgggccaggagtcc

SEQ ID NO: 16529 - DNA, 20 bp, Artificial Sequence
  chemically synthesized
tgtgattgactttatcattt

SEQ ID NO: 16530 - DNA, 20 bp, Artificial Sequence
  chemically synthesized
atcttttactttctgccaca

SEQ ID NO: 16531 - DNA, 20 bp, Artificial Sequence
  chemically synthesized
cttttactttctgccacata

SEQ ID NO: 16532 - DNA, 20 bp, Artificial Sequence
  chemically synthesized
ttttactttctgccacatag

SEQ ID NO: 16533 - DNA, 20 bp, Artificial Sequence
  chemically synthesized
tactttctgccacatagagg

SEQ ID NO: 16534 - DNA, 20 bp, Artificial Sequence
  chemically synthesized
actttctgccacatagagga

SEQ ID NO: 16535 - DNA, 20 bp, Artificial Sequence
  chemically synthesized
ctttctgccacatagaggaa

SEQ ID NO: 16536 - DNA, 20 bp, Artificial Sequence
  chemically synthesized
ctgccacatagaggaaggga

SEQ ID NO: 16537 - DNA, 20 bp, Artificial Sequence
  chemically synthesized
gccacatagaggaagggaaa

SEQ ID NO: 16538 - DNA, 20 bp, Artificial Sequence
  chemically synthesized
gaggaagggaaagagaatga

SEQ ID NO: 16539 - DNA, 20 bp, Artificial Sequence
  chemically synthesized
gaagggaaagagaatgatag

SEQ ID NO: 16540 - DNA, 20 bp, Artificial Sequence
  chemically synthesized
aagggaaagagaatgataga

SEQ ID NO: 16541 - DNA, 20 bp, Artificial Sequence
  chemically synthesized
agggaaagagaatgatagaa

SEQ ID NO: 16542 - DNA, 20 bp, Artificial Sequence
  chemically synthesized
gatagaagggcactctgcct

SEQ ID NO: 16543 - DNA, 20 bp, Artificial Sequence
  chemically synthesized
atagaagggcactctgcctt

SEQ ID NO: 16544 - DNA, 20 bp, Artificial Sequence
  chemically synthesized
tagaagggcactctgcctta

SEQ ID NO: 16545 - DNA, 20 bp, Artificial Sequence
  chemically synthesized
gaagggcactctgccttagg

SEQ ID NO: 16546 - DNA, 20 bp, Artificial Sequence
  chemically synthesized
ttattatctccacattattt

SEQ ID NO: 16547 - DNA, 20 bp, Artificial Sequence
  chemically synthesized
cacattattttagtcacaac

SEQ ID NO: 16548 - DNA, 20 bp, Artificial Sequence
  chemically synthesized
tttagtcacaaccagtcaca

SEQ ID NO: 16549 - DNA, 20 bp, Artificial Sequence
  chemically synthesized
tcacaaccagtcacatggcc

SEQ ID NO: 16550 - DNA, 20 bp, Artificial Sequence
  chemically synthesized
cacatggccaagttaattgc

SEQ ID NO: 16551 - DNA, 20 bp, Artificial Sequence
  chemically synthesized
acatggccaagttaattgca

SEQ ID NO: 16552 - DNA, 20 bp, Artificial Sequence
  chemically synthesized
catggccaagttaattgcaa

SEQ ID NO: 16553 - DNA, 20 bp, Artificial Sequence
  chemically synthesized
aagttaattgcaagggctgt

SEQ ID NO: 16554 - DNA, 20 bp, Artificial Sequence
  chemically synthesized
aagggctgttggaaattgtt

SEQ ID NO: 16555 - DNA, 20 bp, Artificial Sequence
  chemically synthesized
ggctgttggaaattgttgag

SEQ ID NO: 16556 - DNA, 20 bp, Artificial Sequence
  chemically synthesized
tgttgagaagtatattgatt

SEQ ID NO: 16557 - DNA, 20 bp, Artificial Sequence
  chemically synthesized
tgtttctgacatactgtgtc

SEQ ID NO: 16558 - DNA, 20 bp, Artificial Sequence
  chemically synthesized
tgacatactgtgtccggaat

SEQ ID NO: 16559 - DNA, 20 bp, Artificial Sequence
  chemically synthesized
catactgtgtccggaattgg

SEQ ID NO: 16560 - DNA, 20 bp, Artificial Sequence
  chemically synthesized
atactgtgtccggaattggt

SEQ ID NO: 16561 - DNA, 20 bp, Artificial Sequence
  chemically synthesized
gtccggaattggtgggttct

SEQ ID NO: 16562 - DNA, 20 bp, Artificial Sequence
  chemically synthesized
ttcttggtttcactgacttc

SEQ ID NO: 16563 - DNA, 20 bp, Artificial Sequence
  chemically synthesized
tttcactgacttcaagaatg

SEQ ID NO: 16564 - DNA, 20 bp, Artificial Sequence
  chemically synthesized
actgacttcaagaatgaagc

SEQ ID NO: 16565 - DNA, 20 bp, Artificial Sequence
  chemically synthesized
ctgacttcaagaatgaagcc

SEQ ID NO: 16566 - DNA, 20 bp, Artificial Sequence
  chemically synthesized
tgacttcaagaatgaagccg

SEQ ID NO: 16567 - DNA, 20 bp, Artificial Sequence
  chemically synthesized
aatgaagccggggaccctcg

SEQ ID NO: 16568 - DNA, 20 bp, Artificial Sequence
  chemically synthesized
aagccggggaccctcgtggt

SEQ ID NO: 16569 - DNA, 20 bp, Artificial Sequence
  chemically synthesized
gaccctcgtggtgagtgtta

SEQ ID NO: 16570 - DNA, 20 bp, Artificial Sequence
  chemically synthesized
ggtgagtgttacagttctta

SEQ ID NO: 16571 - DNA, 20 bp, Artificial Sequence
  chemically synthesized
gtgagtgttacagttcttaa

SEQ ID NO: 16572 - DNA, 20 bp, Artificial Sequence
  chemically synthesized
gttcttaaaggctgcgtgtg

SEQ ID NO: 16573 - DNA, 20 bp, Artificial Sequence
  chemically synthesized
tcttaaaggctgcgtgtgtg

SEQ ID NO: 16574 - DNA, 20 bp, Artificial Sequence
  chemically synthesized
agtttgttcgttctgatgtt

SEQ ID NO: 16575 - DNA, 20 bp, Artificial Sequence
  chemically synthesized
ttctgatgtttggatgtgtt

SEQ ID NO: 16576 - DNA, 20 bp, Artificial Sequence
  chemically synthesized
ctgatgtttggatgtgttcg

SEQ ID NO: 16577 - DNA, 20 bp, Artificial Sequence
  chemically synthesized
tcggagtttcttccttctga

SEQ ID NO: 16578 - DNA, 20 bp, Artificial Sequence
  chemically synthesized
cggagtttcttccttctgat

SEQ ID NO: 16579 - DNA, 20 bp, Artificial Sequence
  chemically synthesized
tcttccttctgatgggttcg

SEQ ID NO: 16580 - DNA, 20 bp, Artificial Sequence
  chemically synthesized
tgatgggttcgtggtctcgc

SEQ ID NO: 16581 - DNA, 20 bp, Artificial Sequence
  chemically synthesized
ggttcgtggtctcgctggct

SEQ ID NO: 16582 - DNA, 20 bp, Artificial Sequence
  chemically synthesized
gttcgtggtctcgctggctc

SEQ ID NO: 16583 - DNA, 20 bp, Artificial Sequence
  chemically synthesized
tcgtggtctcgctggctcag

SEQ ID NO: 16584 - DNA, 20 bp, Artificial Sequence
  chemically synthesized
gtctcgctggctcaggagtg

SEQ ID NO: 16585 - DNA, 20 bp, Artificial Sequence
  chemically synthesized
ctggctcaggagtgaagctg

SEQ ID NO: 16586 - DNA, 20 bp, Artificial Sequence
  chemically synthesized
agtgaagctgcagaccttca

SEQ ID NO: 16587 - DNA, 20 bp, Artificial Sequence
  chemically synthesized
gaccttcacagtgaacgttc

SEQ ID NO: 16588 - DNA, 20 bp, Artificial Sequence
  chemically synthesized
cagtgaacgttccagctctt

SEQ ID NO: 16589 - DNA, 20 bp, Artificial Sequence
  chemically synthesized
agtgaacgttccagctctta

SEQ ID NO: 16590 - DNA, 20 bp, Artificial Sequence
  chemically synthesized
gaacgttccagctcttaagg

SEQ ID NO: 16591 - DNA, 20 bp, Artificial Sequence
  chemically synthesized
agctcttaaggcggcgcctc

SEQ ID NO: 16592 - DNA, 20 bp, Artificial Sequence
  chemically synthesized
ctcttaaggcggcgcctctg

SEQ ID NO: 16593 - DNA, 20 bp, Artificial Sequence
  chemically synthesized
ctggagttgttcgttcctcc

SEQ ID NO: 16594 - DNA, 20 bp, Artificial Sequence
  chemically synthesized
gagttgttcgttcctcccgg

SEQ ID NO: 16595 - DNA, 20 bp, Artificial Sequence
  chemically synthesized
agttgttcgttcctcccggt

SEQ ID NO: 16596 - DNA, 20 bp, Artificial Sequence
  chemically synthesized
cgttcctcccggtgggttcg

SEQ ID NO: 16597 - DNA, 20 bp, Artificial Sequence
  chemically synthesized
cggtgggttcgtggtctcgc

SEQ ID NO: 16598 - DNA, 20 bp, Artificial Sequence
  chemically synthesized
ttcgtggtctcgctggcttc

SEQ ID NO: 16599 - DNA, 20 bp, Artificial Sequence
  chemically synthesized
cgtggtctcgctggcttcaa

SEQ ID NO: 16600 - DNA, 20 bp, Artificial Sequence
  chemically synthesized
tctcgctggcttcaagagtg

SEQ ID NO: 16601 - DNA, 20 bp, Artificial Sequence
  chemically synthesized
tggcttcaagagtgaagctg

SEQ ID NO: 16602 - DNA, 20 bp, Artificial Sequence
  chemically synthesized
agtgaagctgcagaccttcg

SEQ ID NO: 16603 - DNA, 20 bp, Artificial Sequence
  chemically synthesized
aagctgcagaccttcgcggt

SEQ ID NO: 16604 - DNA, 20 bp, Artificial Sequence
  chemically synthesized
gaccttcgcggtgagcgtta

SEQ ID NO: 16605 - DNA, 20 bp, Artificial Sequence
  chemically synthesized
ggtgagcgttacagctcata

SEQ ID NO: 16606 - DNA, 20 bp, Artificial Sequence
  chemically synthesized
gtgagcgttacagctcataa

SEQ ID NO: 16607 - DNA, 20 bp, Artificial Sequence
  chemically synthesized
agcgttacagctcataaagg

SEQ ID NO: 16608 - DNA, 20 bp, Artificial Sequence
  chemically synthesized
tacagctcataaaggcagtg

SEQ ID NO: 16609 - DNA, 20 bp, Artificial Sequence
  chemically synthesized
aaaggcagtgtagacccaaa

SEQ ID NO: 16610 - DNA, 20 bp, Artificial Sequence
  chemically synthesized
gcagtgtagacccaaacagt

SEQ ID NO: 16611 - DNA, 20 bp, Artificial Sequence
  chemically synthesized
gtgtagacccaaacagtgag

SEQ ID NO: 16612 - DNA, 20 bp, Artificial Sequence
  chemically synthesized
tagacccaaacagtgagcag

SEQ ID NO: 16613 - DNA, 20 bp, Artificial Sequence
  chemically synthesized
cccaaacagtgagcagcagc

SEQ ID NO: 16614 - DNA, 20 bp, Artificial Sequence
  chemically synthesized
cagcagcaagatttattgca

SEQ ID NO: 16615 - DNA, 20 bp, Artificial Sequence
  chemically synthesized
gcagcaagatttattgcaaa

SEQ ID NO: 16616 - DNA, 20 bp, Artificial Sequence
  chemically synthesized
agatttattgcaaagagcga

SEQ ID NO: 16617 - DNA, 20 bp, Artificial Sequence
  chemically synthesized
ttgcaaagagcgaaagaaca

SEQ ID NO: 16618 - DNA, 20 bp, Artificial Sequence
  chemically synthesized
gcgaaagaacaaagcttcca

SEQ ID NO: 16619 - DNA, 20 bp, Artificial Sequence
  chemically synthesized
agaacaaagcttccacagtg

SEQ ID NO: 16620 - DNA, 20 bp, Artificial Sequence
  chemically synthesized
acaaagcttccacagtgtgg

SEQ ID NO: 16621 - DNA, 20 bp, Artificial Sequence
  chemically synthesized
caaagcttccacagtgtgga

SEQ ID NO: 16622 - DNA, 20 bp, Artificial Sequence
  chemically synthesized
aaagcttccacagtgtggaa

SEQ ID NO: 16623 - DNA, 20 bp, Artificial Sequence
  chemically synthesized
aagcttccacagtgtggaag

SEQ ID NO: 16624 - DNA, 20 bp, Artificial Sequence
  chemically synthesized
cacagtgtggaaggggaccc

SEQ ID NO: 16625 - DNA, 20 bp, Artificial Sequence
  chemically synthesized
agtgtggaaggggacccgag

SEQ ID NO: 16626 - DNA, 20 bp, Artificial Sequence
  chemically synthesized
gtgtggaaggggacccgagc

SEQ ID NO: 16627 - DNA, 20 bp, Artificial Sequence
  chemically synthesized
cccgagcgggttgccactgc

SEQ ID NO: 16628 - DNA, 20 bp, Artificial Sequence
  chemically synthesized
gcgggttgccactgctggct

SEQ ID NO: 16629 - DNA, 20 bp, Artificial Sequence
  chemically synthesized
cgggttgccactgctggctc

SEQ ID NO: 16630 - DNA, 20 bp, Artificial Sequence
  chemically synthesized
gttgccactgctggctcggg

SEQ ID NO: 16631 - DNA, 20 bp, Artificial Sequence
  chemically synthesized
cctgcttttattctcttatc

SEQ ID NO: 16632 - DNA, 20 bp, Artificial Sequence
  chemically synthesized
cccacccacatcctgctgat

SEQ ID NO: 16633 - DNA, 20 bp, Artificial Sequence
  chemically synthesized
acccacatcctgctgattgg

SEQ ID NO: 16634 - DNA, 20 bp, Artificial Sequence
  chemically synthesized
ccacatcctgctgattggta

SEQ ID NO: 16635 - DNA, 20 bp, Artificial Sequence
  chemically synthesized
tcctgctgattggtagagcc

SEQ ID NO: 16636 - DNA, 20 bp, Artificial Sequence
  chemically synthesized
tgctgattggtagagcccag

SEQ ID NO: 16637 - DNA, 20 bp, Artificial Sequence
  chemically synthesized
agcccagtggtctgttttga

SEQ ID NO: 16638 - DNA, 20 bp, Artificial Sequence
  chemically synthesized
gcccagtggtctgttttgac

SEQ ID NO: 16639 - DNA, 20 bp, Artificial Sequence
  chemically synthesized
cccagtggtctgttttgaca

SEQ ID NO: 16640 - DNA, 20 bp, Artificial Sequence
  chemically synthesized
tgttttgacagggcactgat

SEQ ID NO: 16641 - DNA, 20 bp, Artificial Sequence
  chemically synthesized
ttggtgcatttacaatccat

SEQ ID NO: 16642 - DNA, 20 bp, Artificial Sequence
  chemically synthesized
tgcatttacaatccatgagc

SEQ ID NO: 16643 - DNA, 20 bp, Artificial Sequence
  chemically synthesized
caatccatgagctagacaca

SEQ ID NO: 16644 - DNA, 20 bp, Artificial Sequence
  chemically synthesized
aatccatgagctagacacaa

SEQ ID NO: 16645 - DNA, 20 bp, Artificial Sequence
  chemically synthesized
aaggttctccacgtccccac

SEQ ID NO: 16646 - DNA, 20 bp, Artificial Sequence
  chemically synthesized
tctccacgtccccaccagat

SEQ ID NO: 16647 - DNA, 20 bp, Artificial Sequence
  chemically synthesized
cacgtccccaccagattagc

SEQ ID NO: 16648 - DNA, 20 bp, Artificial Sequence
  chemically synthesized
cccaccagattagctagata

SEQ ID NO: 16649 - DNA, 20 bp, Artificial Sequence
  chemically synthesized
caccagattagctagataca

SEQ ID NO: 16650 - DNA, 20 bp, Artificial Sequence
  chemically synthesized
agatacagagtgtccacaca

SEQ ID NO: 16651 - DNA, 20 bp, Artificial Sequence
  chemically synthesized
gatacagagtgtccacacaa

SEQ ID NO: 16652 - DNA, 20 bp, Artificial Sequence
  chemically synthesized
tgtccacacaaaggttctcc

SEQ ID NO: 16653 - DNA, 20 bp, Artificial Sequence
  chemically synthesized
aaggttctccaagtccccac

SEQ ID NO: 16654 - DNA, 20 bp, Artificial Sequence
  chemically synthesized
ggttctccaagtccccacca

SEQ ID NO: 16655 - DNA, 20 bp, Artificial Sequence
  chemically synthesized
tctccaagtccccaccagag

SEQ ID NO: 16656 - DNA, 20 bp, Artificial Sequence
  chemically synthesized
caagtccccaccagagtagc

SEQ ID NO: 16657 - DNA, 20 bp, Artificial Sequence
  chemically synthesized
cccaccagagtagctagata

SEQ ID NO: 16658 - DNA, 20 bp, Artificial Sequence
  chemically synthesized
caccagagtagctagataca

SEQ ID NO: 16659 - DNA, 20 bp, Artificial Sequence
  chemically synthesized
gctagatacagagtgttgat

SEQ ID NO: 16660 - DNA, 20 bp, Artificial Sequence
  chemically synthesized
ttggtgcattcacaaaccct

SEQ ID NO: 16661 - DNA, 20 bp, Artificial Sequence
  chemically synthesized
tgcattcacaaaccctgagc

SEQ ID NO: 16662 - DNA, 20 bp, Artificial Sequence
  chemically synthesized
cacaaaccctgagctagaca

SEQ ID NO: 16663 - DNA, 20 bp, Artificial Sequence
  chemically synthesized
acaaaccctgagctagacac

SEQ ID NO: 16664 - DNA, 20 bp, Artificial Sequence
  chemically synthesized
caaaccctgagctagacaca

SEQ ID NO: 16665 - DNA, 20 bp, Artificial Sequence
  chemically synthesized
gctagacacagggtgctgat

SEQ ID NO: 16666 - DNA, 20 bp, Artificial Sequence
  chemically synthesized
ttggtgtgtttacaaacctt

SEQ ID NO: 16667 - DNA, 20 bp, Artificial Sequence
  chemically synthesized
tgtgtttacaaaccttgagc

SEQ ID NO: 16668 - DNA, 20 bp, Artificial Sequence
  chemically synthesized
tacaaaccttgagctagata

SEQ ID NO: 16669 - DNA, 20 bp, Artificial Sequence
  chemically synthesized
tgagctagatacagactgcc

SEQ ID NO: 16670 - DNA, 20 bp, Artificial Sequence
  chemically synthesized
gctagatacagactgccgag

SEQ ID NO: 16671 - DNA, 20 bp, Artificial Sequence
  chemically synthesized
gtggtgtatttacaatccct

SEQ ID NO: 16672 - DNA, 20 bp, Artificial Sequence
  chemically synthesized
tgtatttacaatccctgagc

SEQ ID NO: 16673 - DNA, 20 bp, Artificial Sequence
  chemically synthesized
caatccctgagctagacata

SEQ ID NO: 16674 - DNA, 20 bp, Artificial Sequence
  chemically synthesized
aatccctgagctagacataa

SEQ ID NO: 16675 - DNA, 20 bp, Artificial Sequence
  chemically synthesized
aaggttctccacgtccccac

SEQ ID NO: 16676 - DNA, 20 bp, Artificial Sequence
  chemically synthesized
ggttctccacgtccccacca

SEQ ID NO: 16677 - DNA, 20 bp, Artificial Sequence
  chemically synthesized
tctccacgtccccaccagag

SEQ ID NO: 16678 - DNA, 20 bp, Artificial Sequence
  chemically synthesized
cacgtccccaccagagtagc

SEQ ID NO: 16679 - DNA, 20 bp, Artificial Sequence
  chemically synthesized
cccaccagagtagctagata

SEQ ID NO: 16680 - DNA, 20 bp, Artificial Sequence
  chemically synthesized
caccagagtagctagataca

SEQ ID NO: 16681 - DNA, 20 bp, Artificial Sequence
  chemically synthesized
gctagatacagagtgttgat

SEQ ID NO: 16682 - DNA, 20 bp, Artificial Sequence
  chemically synthesized
ttggtgcattcacaaaccct

SEQ ID NO: 16683 - DNA, 20 bp, Artificial Sequence
  chemically synthesized
tgcattcacaaaccctgagc

SEQ ID NO: 16684 - DNA, 20 bp, Artificial Sequence
  chemically synthesized
cacaaaccctgagctagaca

SEQ ID NO: 16685 - DNA, 20 bp, Artificial Sequence
  chemically synthesized
acaaaccctgagctagacac

SEQ ID NO: 16686 - DNA, 20 bp, Artificial Sequence
  chemically synthesized
caaaccctgagctagacaca

SEQ ID NO: 16687 - DNA, 20 bp, Artificial Sequence
  chemically synthesized
gctagacacagggtgctgat

SEQ ID NO: 16688 - DNA, 20 bp, Artificial Sequence
  chemically synthesized
ttggtgtgtttacaaacctt

SEQ ID NO: 16689 - DNA, 20 bp, Artificial Sequence
  chemically synthesized
tgtgtttacaaaccttgagc

SEQ ID NO: 16690 - DNA, 20 bp, Artificial Sequence
  chemically synthesized
tacaaaccttgagctagata

SEQ ID NO: 16691 - DNA, 20 bp, Artificial Sequence
  chemically synthesized
gctagatacagactgccgat

SEQ ID NO: 16692 - DNA, 20 bp, Artificial Sequence
  chemically synthesized
ttggtgtatttacaatccct

SEQ ID NO: 16693 - DNA, 20 bp, Artificial Sequence
  chemically synthesized
tgtatttacaatccctgagc

SEQ ID NO: 16694 - DNA, 20 bp, Artificial Sequence
  chemically synthesized
caatccctgagctagacata

SEQ ID NO: 16695 - DNA, 20 bp, Artificial Sequence
  chemically synthesized
aatccctgagctagacataa

SEQ ID NO: 16696 - DNA, 20 bp, Artificial Sequence
  chemically synthesized
gctagacataaaggttctcc

SEQ ID NO: 16697 - DNA, 20 bp, Artificial Sequence
  chemically synthesized
ctagacataaaggttctcca

SEQ ID NO: 16698 - DNA, 20 bp, Artificial Sequence
  chemically synthesized
aaggttctccaaggccccac

SEQ ID NO: 16699 - DNA, 20 bp, Artificial Sequence
  chemically synthesized
ggttctccaaggccccacca

SEQ ID NO: 16700 - DNA, 20 bp, Artificial Sequence
  chemically synthesized
tctccaaggccccaccagag

SEQ ID NO: 16701 - DNA, 20 bp, Artificial Sequence
  chemically synthesized
caaggccccaccagagtagc

SEQ ID NO: 16702 - DNA, 20 bp, Artificial Sequence
  chemically synthesized
gccccaccagagtagctaga

SEQ ID NO: 16703 - DNA, 20 bp, Artificial Sequence
  chemically synthesized
cccaccagagtagctagata

SEQ ID NO: 16704 - DNA, 20 bp, Artificial Sequence
  chemically synthesized
tagctagatagagtgttgat

SEQ ID NO: 16705 - DNA, 20 bp, Artificial Sequence
  chemically synthesized
ttggtgcattcacaaaccct

SEQ ID NO: 16706 - DNA, 20 bp, Artificial Sequence
  chemically synthesized
tgcattcacaaaccctgagc

SEQ ID NO: 16707 - DNA, 20 bp, Artificial Sequence
  chemically synthesized
cacaaaccctgagctagaca

SEQ ID NO: 16708 - DNA, 20 bp, Artificial Sequence
  chemically synthesized
acaaaccctgagctagacac

SEQ ID NO: 16709 - DNA, 20 bp, Artificial Sequence
  chemically synthesized
caaaccctgagctagacaca

SEQ ID NO: 16710 - DNA, 20 bp, Artificial Sequence
  chemically synthesized
gctagacacagggtgctgat

SEQ ID NO: 16711 - DNA, 20 bp, Artificial Sequence
  chemically synthesized
ttggtgtgtttacaaacctt

SEQ ID NO: 16712 - DNA, 20 bp, Artificial Sequence
  chemically synthesized
tgtgtttacaaaccttgagc

SEQ ID NO: 16713 - DNA, 20 bp, Artificial Sequence
  chemically synthesized
tacaaaccttgagctagata

SEQ ID NO: 16714 - DNA, 20 bp, Artificial Sequence
  chemically synthesized
caaaccttgagctagataca

SEQ ID NO: 16715 - DNA, 20 bp, Artificial Sequence
  chemically synthesized
gctagatacagagtgccaat

SEQ ID NO: 16716 - DNA, 20 bp, Artificial Sequence
  chemically synthesized
tgtatttacaatcccttatc

SEQ ID NO: 16717 - DNA, 20 bp, Artificial Sequence
  chemically synthesized
acaatcccttatctagacat

SEQ ID NO: 16718 - DNA, 20 bp, Artificial Sequence
  chemically synthesized
caatcccttatctagacata

SEQ ID NO: 16719 - DNA, 20 bp, Artificial Sequence
  chemically synthesized
aatcccttatctagacataa

SEQ ID NO: 16720 - DNA, 20 bp, Artificial Sequence
  chemically synthesized
ataagggttcttcgcatccc

SEQ ID NO: 16721 - DNA, 20 bp, Artificial Sequence
  chemically synthesized
cttcgcatccccagcaaact

SEQ ID NO: 16722 - DNA, 20 bp, Artificial Sequence
  chemically synthesized
ttcgcatccccagcaaactc

SEQ ID NO: 16723 - DNA, 20 bp, Artificial Sequence
  chemically synthesized
cgcatccccagcaaactcag

SEQ ID NO: 16724 - DNA, 20 bp, Artificial Sequence
  chemically synthesized
ccccagcaaactcaggagcc

SEQ ID NO: 16725 - DNA, 20 bp, Artificial Sequence
  chemically synthesized
agcaaactcaggagcctagc

SEQ ID NO: 16726 - DNA, 20 bp, Artificial Sequence
  chemically synthesized
ggagcctagccggcttcacc

SEQ ID NO: 16727 - DNA, 20 bp, Artificial Sequence
  chemically synthesized
gcctagccggcttcacccag

SEQ ID NO: 16728 - DNA, 20 bp, Artificial Sequence
  chemically synthesized
cacccagtggatcccgcacc

SEQ ID NO: 16729 - DNA, 20 bp, Artificial Sequence
  chemically synthesized
acccagtggatcccgcacct

SEQ ID NO: 16730 - DNA, 20 bp, Artificial Sequence
  chemically synthesized
tggatcccgcacctgggctg

SEQ ID NO: 16731 - DNA, 20 bp, Artificial Sequence
  chemically synthesized
ggatcccgcacctgggctgc

SEQ ID NO: 16732 - DNA, 20 bp, Artificial Sequence
  chemically synthesized
gatcccgcacctgggctgca

SEQ ID NO: 16733 - DNA, 20 bp, Artificial Sequence
  chemically synthesized
atcccgcacctgggctgcag

SEQ ID NO: 16734 - DNA, 20 bp, Artificial Sequence
  chemically synthesized
tcccgcacctgggctgcagg

SEQ ID NO: 16735 - DNA, 20 bp, Artificial Sequence
  chemically synthesized
ccgcacctgggctgcagggg

SEQ ID NO: 16736 - DNA, 20 bp, Artificial Sequence
  chemically synthesized
ctgcagggggagctgcctgc

SEQ ID NO: 16737 - DNA, 20 bp, Artificial Sequence
  chemically synthesized
tgccgtgcgcccgcactctt

SEQ ID NO: 16738 - DNA, 20 bp, Artificial Sequence
  chemically synthesized
cgcccgcactcttcagccct

SEQ ID NO: 16739 - DNA, 20 bp, Artificial Sequence
  chemically synthesized
gcccgcactcttcagccctt

SEQ ID NO: 16740 - DNA, 20 bp, Artificial Sequence
  chemically synthesized
cgcactcttcagcccttggg

SEQ ID NO: 16741 - DNA, 20 bp, Artificial Sequence
  chemically synthesized
ttcagcccttgggtggtcga

SEQ ID NO: 16742 - DNA, 20 bp, Artificial Sequence
  chemically synthesized
tcagcccttgggtggtcgat

SEQ ID NO: 16743 - DNA, 20 bp, Artificial Sequence
  chemically synthesized
ccttgggtggtcgatgggac

SEQ ID NO: 16744 - DNA, 20 bp, Artificial Sequence
  chemically synthesized
cttgggtggtcgatgggact

SEQ ID NO: 16745 - DNA, 20 bp, Artificial Sequence
  chemically synthesized
gtcgatgggactgggtgccc

SEQ ID NO: 16746 - DNA, 20 bp, Artificial Sequence
  chemically synthesized
cgatgggactgggtgccctg

SEQ ID NO: 16747 - DNA, 20 bp, Artificial Sequence
  chemically synthesized
tgggactgggtgccctggag

SEQ ID NO: 16748 - DNA, 20 bp, Artificial Sequence
  chemically synthesized
gggactgggtgccctggagc

SEQ ID NO: 16749 - DNA, 20 bp, Artificial Sequence
  chemically synthesized
ggactgggtgccctggagca

SEQ ID NO: 16750 - DNA, 20 bp, Artificial Sequence
  chemically synthesized
gactgggtgccctggagcag

SEQ ID NO: 16751 - DNA, 20 bp, Artificial Sequence
  chemically synthesized
actgggtgccctggagcagg

SEQ ID NO: 16752 - DNA, 20 bp, Artificial Sequence
  chemically synthesized
gggtgccctggagcaggggg

SEQ ID NO: 16753 - DNA, 20 bp, Artificial Sequence
  chemically synthesized
gagcagggggcggcgctcgt

SEQ ID NO: 16754 - DNA, 20 bp, Artificial Sequence
  chemically synthesized
agggggcggcgctcgtcggc

SEQ ID NO: 16755 - DNA, 20 bp, Artificial Sequence
  chemically synthesized
gggggcggcgctcgtcggcg

SEQ ID NO: 16756 - DNA, 20 bp, Artificial Sequence
  chemically synthesized
cggcgctcgtcggcgaggct

SEQ ID NO: 16757 - DNA, 20 bp, Artificial Sequence
  chemically synthesized
ggcgctcgtcggcgaggctc

SEQ ID NO: 16758 - DNA, 20 bp, Artificial Sequence
  chemically synthesized
tcggcgaggctcgggccgca

SEQ ID NO: 16759 - DNA, 20 bp, Artificial Sequence
  chemically synthesized
cggcgaggctcgggccgcac

SEQ ID NO: 16760 - DNA, 20 bp, Artificial Sequence
  chemically synthesized
gcgaggctcgggccgcacag

SEQ ID NO: 16761 - DNA, 20 bp, Artificial Sequence
  chemically synthesized
gggccgcacaggagcccatg

SEQ ID NO: 16762 - DNA, 20 bp, Artificial Sequence
  chemically synthesized
ggccgcacaggagcccatga

SEQ ID NO: 16763 - DNA, 20 bp, Artificial Sequence
  chemically synthesized
cgcacaggagcccatgaagg

SEQ ID NO: 16764 - DNA, 20 bp, Artificial Sequence
  chemically synthesized
gcacaggagcccatgaaggt

SEQ ID NO: 16765 - DNA, 20 bp, Artificial Sequence
  chemically synthesized
cacaggagcccatgaaggtg

SEQ ID NO: 16766 - DNA, 20 bp, Artificial Sequence
  chemically synthesized
caggagcccatgaaggtggg

SEQ ID NO: 16767 - DNA, 20 bp, Artificial Sequence
  chemically synthesized
aggagcccatgaaggtgggg

SEQ ID NO: 16768 - DNA, 20 bp, Artificial Sequence
  chemically synthesized
cccatgaaggtggggaggct

SEQ ID NO: 16769 - DNA, 20 bp, Artificial Sequence
  chemically synthesized
ccatgaaggtggggaggctc

SEQ ID NO: 16770 - DNA, 20 bp, Artificial Sequence
  chemically synthesized
aaggtggggaggctcaggca

SEQ ID NO: 16771 - DNA, 20 bp, Artificial Sequence
  chemically synthesized
ggctcaggcatggcgcgctg

SEQ ID NO: 16772 - DNA, 20 bp, Artificial Sequence
  chemically synthesized
gctcaggcatggcgcgctgc

SEQ ID NO: 16773 - DNA, 20 bp, Artificial Sequence
  chemically synthesized
catggcgcgctgcaggtccc

SEQ ID NO: 16774 - DNA, 20 bp, Artificial Sequence
  chemically synthesized
aggtcccgagccctgccccg

SEQ ID NO: 16775 - DNA, 20 bp, Artificial Sequence
  chemically synthesized
ggtcccgagccctgccccgc

SEQ ID NO: 16776 - DNA, 20 bp, Artificial Sequence
  chemically synthesized
cccgagccctgccccgcagg

SEQ ID NO: 16777 - DNA, 20 bp, Artificial Sequence
  chemically synthesized
ccgagccctgccccgcagga

SEQ ID NO: 16778 - DNA, 20 bp, Artificial Sequence
  chemically synthesized
agccctgccccgcaggaagg

SEQ ID NO: 16779 - DNA, 20 bp, Artificial Sequence
  chemically synthesized
tgccccgcaggaaggcagct

SEQ ID NO: 16780 - DNA, 20 bp, Artificial Sequence
  chemically synthesized
gccccgcaggaaggcagcta

SEQ ID NO: 16781 - DNA, 20 bp, Artificial Sequence
  chemically synthesized
gcaggaaggcagctaaggcc

SEQ ID NO: 16782 - DNA, 20 bp, Artificial Sequence
  chemically synthesized
gaaggcagctaaggcccggc

SEQ ID NO: 16783 - DNA, 20 bp, Artificial Sequence
  chemically synthesized
aaggcagctaaggcccggcg

SEQ ID NO: 16784 - DNA, 20 bp, Artificial Sequence
  chemically synthesized
ctaaggcccggcgaggaatt

SEQ ID NO: 16785 - DNA, 20 bp, Artificial Sequence
  chemically synthesized
gcccggcgaggaattgagca

SEQ ID NO: 16786 - DNA, 20 bp, Artificial Sequence
  chemically synthesized
cggcgaggaattgagcacag

SEQ ID NO: 16787 - DNA, 20 bp, Artificial Sequence
  chemically synthesized
gaattgagcacagcagctgc

SEQ ID NO: 16788 - DNA, 20 bp, Artificial Sequence
  chemically synthesized
gagcacagcagctgctggcc

SEQ ID NO: 16789 - DNA, 20 bp, Artificial Sequence
  chemically synthesized
agcacagcagctgctggccc

SEQ ID NO: 16790 - DNA, 20 bp, Artificial Sequence
  chemically synthesized
cagctgctggcccaggtgct

SEQ ID NO: 16791 - DNA, 20 bp, Artificial Sequence
  chemically synthesized
gctaagcccctcactgcccg

SEQ ID NO: 16792 - DNA, 20 bp, Artificial Sequence
  chemically synthesized
agcccctcactgcccgcggc

SEQ ID NO: 16793 - DNA, 20 bp, Artificial Sequence
  chemically synthesized
ccctcactgcccgcggccgg

SEQ ID NO: 16794 - DNA, 20 bp, Artificial Sequence
  chemically synthesized
cctcactgcccgcggccggt

SEQ ID NO: 16795 - DNA, 20 bp, Artificial Sequence
  chemically synthesized
ctcactgcccgcggccggtg

SEQ ID NO: 16796 - DNA, 20 bp, Artificial Sequence
  chemically synthesized
ctgcccgcggccggtggggc

SEQ ID NO: 16797 - DNA, 20 bp, Artificial Sequence
  chemically synthesized
ccgcggccggtggggccggc

SEQ ID NO: 16798 - DNA, 20 bp, Artificial Sequence
  chemically synthesized
cggccggtggggccggctgg

SEQ ID NO: 16799 - DNA, 20 bp, Artificial Sequence
  chemically synthesized
tggggccggctggcggctcc

SEQ ID NO: 16800 - DNA, 20 bp, Artificial Sequence
  chemically synthesized
ccggctggcggctccgagtg

SEQ ID NO: 16801 - DNA, 20 bp, Artificial Sequence
  chemically synthesized
cggctggcggctccgagtgc

SEQ ID NO: 16802 - DNA, 20 bp, Artificial Sequence
  chemically synthesized
ggctggcggctccgagtgcg

SEQ ID NO: 16803 - DNA, 20 bp, Artificial Sequence
  chemically synthesized
ggctccgagtgcggggtcct

SEQ ID NO: 16804 - DNA, 20 bp, Artificial Sequence
  chemically synthesized
ctccgagtgcggggtcctcg

SEQ ID NO: 16805 - DNA, 20 bp, Artificial Sequence
  chemically synthesized
cctcggagcccatgcccacc

SEQ ID NO: 16806 - DNA, 20 bp, Artificial Sequence
  chemically synthesized
tgcccacccggaactccctc

SEQ ID NO: 16807 - DNA, 20 bp, Artificial Sequence
  chemically synthesized
acccggaactccctcaagca

SEQ ID NO: 16808 - DNA, 20 bp, Artificial Sequence
  chemically synthesized
actccctcaagcacggcgca

SEQ ID NO: 16809 - DNA, 20 bp, Artificial Sequence
  chemically synthesized
ctcaagcacggcgcacagcc

SEQ ID NO: 16810 - DNA, 20 bp, Artificial Sequence
  chemically synthesized
gtctgtccctccacacctcc

SEQ ID NO: 16811 - DNA, 20 bp, Artificial Sequence
  chemically synthesized
gtccctccacacctcctggc

SEQ ID NO: 16812 - DNA, 20 bp, Artificial Sequence
  chemically synthesized
tccacacctcctggcaagct

SEQ ID NO: 16813 - DNA, 20 bp, Artificial Sequence
  chemically synthesized
ccacacctcctggcaagctg

SEQ ID NO: 16814 - DNA, 20 bp, Artificial Sequence
  chemically synthesized
cacacctcctggcaagctga

SEQ ID NO: 16815 - DNA, 20 bp, Artificial Sequence
  chemically synthesized
cacctcctggcaagctgagg

SEQ ID NO: 16816 - DNA, 20 bp, Artificial Sequence
  chemically synthesized
tcctggcaagctgagggagc

SEQ ID NO: 16817 - DNA, 20 bp, Artificial Sequence
  chemically synthesized
caagctgagggagccggctc

SEQ ID NO: 16818 - DNA, 20 bp, Artificial Sequence
  chemically synthesized
gagggagccggctctggcct

SEQ ID NO: 16819 - DNA, 20 bp, Artificial Sequence
  chemically synthesized
gagccggctctggccttggc

SEQ ID NO: 16820 - DNA, 20 bp, Artificial Sequence
  chemically synthesized
ggctctggccttggccagcc

SEQ ID NO: 16821 - DNA, 20 bp, Artificial Sequence
  chemically synthesized
tggccttggccagcccagaa

SEQ ID NO: 16822 - DNA, 20 bp, Artificial Sequence
  chemically synthesized
ggccttggccagcccagaaa

SEQ ID NO: 16823 - DNA, 20 bp, Artificial Sequence
  chemically synthesized
gccttggccagcccagaaaa

SEQ ID NO: 16824 - DNA, 20 bp, Artificial Sequence
  chemically synthesized
agcccagaaaagggctccca

SEQ ID NO: 16825 - DNA, 20 bp, Artificial Sequence
  chemically synthesized
agaaaagggctcccacagtg

SEQ ID NO: 16826 - DNA, 20 bp, Artificial Sequence
  chemically synthesized
aaagggctcccacagtgcag

SEQ ID NO: 16827 - DNA, 20 bp, Artificial Sequence
  chemically synthesized
ggctcccacagtgcagcggc

SEQ ID NO: 16828 - DNA, 20 bp, Artificial Sequence
  chemically synthesized
cacagtgcagcggccggctg

SEQ ID NO: 16829 - DNA, 20 bp, Artificial Sequence
  chemically synthesized
acagtgcagcggccggctga

SEQ ID NO: 16830 - DNA, 20 bp, Artificial Sequence
  chemically synthesized
cagtgcagcggccggctgaa

SEQ ID NO: 16831 - DNA, 20 bp, Artificial Sequence
  chemically synthesized
ggccggctgaagggctcctc

SEQ ID NO: 16832 - DNA, 20 bp, Artificial Sequence
  chemically synthesized
ctcctcaagtgccaccaatg

SEQ ID NO: 16833 - DNA, 20 bp, Artificial Sequence
  chemically synthesized
tcctcaagtgccaccaatgt

SEQ ID NO: 16834 - DNA, 20 bp, Artificial Sequence
  chemically synthesized
ctcaagtgccaccaatgtgg

SEQ ID NO: 16835 - DNA, 20 bp, Artificial Sequence
  chemically synthesized
gtgccaccaatgtgggagcc

SEQ ID NO: 16836 - DNA, 20 bp, Artificial Sequence
  chemically synthesized
tgccaccaatgtgggagccc

SEQ ID NO: 16837 - DNA, 20 bp, Artificial Sequence
  chemically synthesized
caccaatgtgggagcccagg

SEQ ID NO: 16838 - DNA, 20 bp, Artificial Sequence
  chemically synthesized
ccaatgtgggagcccaggca

SEQ ID NO: 16839 - DNA, 20 bp, Artificial Sequence
  chemically synthesized
caatgtgggagcccaggcag

SEQ ID NO: 16840 - DNA, 20 bp, Artificial Sequence
  chemically synthesized
atgtgggagcccaggcagag

SEQ ID NO: 16841 - DNA, 20 bp, Artificial Sequence
  chemically synthesized
tgtgggagcccaggcagagg

SEQ ID NO: 16842 - DNA, 20 bp, Artificial Sequence
  chemically synthesized
gcccaggcagaggaggcgcc

SEQ ID NO: 16843 - DNA, 20 bp, Artificial Sequence
  chemically synthesized
ccaggcagaggaggcgccaa

SEQ ID NO: 16844 - DNA, 20 bp, Artificial Sequence
  chemically synthesized
gcagaggaggcgccaagagc

SEQ ID NO: 16845 - DNA, 20 bp, Artificial Sequence
  chemically synthesized
aggaggcgccaagagcgagc

SEQ ID NO: 16846 - DNA, 20 bp, Artificial Sequence
  chemically synthesized
ggaggcgccaagagcgagcg

SEQ ID NO: 16847 - DNA, 20 bp, Artificial Sequence
  chemically synthesized
gaggcgccaagagcgagcga

SEQ ID NO: 16848 - DNA, 20 bp, Artificial Sequence
  chemically synthesized
caagagcgagcgagggctgt

SEQ ID NO: 16849 - DNA, 20 bp, Artificial Sequence
  chemically synthesized
aagagcgagcgagggctgtg

SEQ ID NO: 16850 - DNA, 20 bp, Artificial Sequence
  chemically synthesized
gcgagggctgtgaggactgc

SEQ ID NO: 16851 - DNA, 20 bp, Artificial Sequence
  chemically synthesized
cacctctcaatactaatcac

SEQ ID NO: 16852 - DNA, 20 bp, Artificial Sequence
  chemically synthesized
caatactaatcactagtaat

SEQ ID NO: 16853 - DNA, 20 bp, Artificial Sequence
  chemically synthesized
ccctgtgcttccaaaaataa

SEQ ID NO: 16854 - DNA, 20 bp, Artificial Sequence
  chemically synthesized
cctgtgcttccaaaaataac

SEQ ID NO: 16855 - DNA, 20 bp, Artificial Sequence
  chemically synthesized
ggaatattattgtaaaatca

SEQ ID NO: 16856 - DNA, 20 bp, Artificial Sequence
  chemically synthesized
gaatattattgtaaaatcaa

SEQ ID NO: 16857 - DNA, 20 bp, Artificial Sequence
  chemically synthesized
ccatatgttttattatgttt

SEQ ID NO: 16858 - DNA, 20 bp, Artificial Sequence
  chemically synthesized
tatgttttattatgtttaag

SEQ ID NO: 16859 - DNA, 20 bp, Artificial Sequence
  chemically synthesized
tatgtttaagcagtaaaaat

SEQ ID NO: 16860 - DNA, 20 bp, Artificial Sequence
  chemically synthesized
taagcagtaaaaataagacc

SEQ ID NO: 16861 - DNA, 20 bp, Artificial Sequence
  chemically synthesized
agcagtaaaaataagacctg

SEQ ID NO: 16862 - DNA, 20 bp, Artificial Sequence
  chemically synthesized
aataagacctggagtgcaaa

SEQ ID NO: 16863 - DNA, 20 bp, Artificial Sequence
  chemically synthesized
ccaaatgctgtaatacttca

SEQ ID NO: 16864 - DNA, 20 bp, Artificial Sequence
  chemically synthesized
tgtaatacttcatggaatct

SEQ ID NO: 16865 - DNA, 20 bp, Artificial Sequence
  chemically synthesized
ccccaaattatgtcttattt

SEQ ID NO: 16866 - DNA, 20 bp, Artificial Sequence
  chemically synthesized
ccaaattatgtcttatttca

SEQ ID NO: 16867 - DNA, 20 bp, Artificial Sequence
  chemically synthesized
ttatttcagagcaaataact

SEQ ID NO: 16868 - DNA, 20 bp, Artificial Sequence
  chemically synthesized
tatttcagagcaaataactt

SEQ ID NO: 16869 - DNA, 20 bp, Artificial Sequence
  chemically synthesized
attattattgtataatgatt

SEQ ID NO: 16870 - DNA, 20 bp, Artificial Sequence
  chemically synthesized
tattattgtataatgattca

SEQ ID NO: 16871 - DNA, 20 bp, Artificial Sequence
  chemically synthesized
atgattcagagcatgtattc

SEQ ID NO: 16872 - DNA, 20 bp, Artificial Sequence
  chemically synthesized
gattcagagcatgtattcta

SEQ ID NO: 16873 - DNA, 20 bp, Artificial Sequence
  chemically synthesized
attctagagccaaatatcat

SEQ ID NO: 16874 - DNA, 20 bp, Artificial Sequence
  chemically synthesized
agttgaattatgccctctgt

SEQ ID NO: 16875 - DNA, 20 bp, Artificial Sequence
  chemically synthesized
gaattatgccctctgtcagt

SEQ ID NO: 16876 - DNA, 20 bp, Artificial Sequence
  chemically synthesized
ttatgccctctgtcagttag

SEQ ID NO: 16877 - DNA, 20 bp, Artificial Sequence
  chemically synthesized
agttagtagccacttcatct

SEQ ID NO: 16878 - DNA, 20 bp, Artificial Sequence
  chemically synthesized
ttcatcttggaatattactt

SEQ ID NO: 16879 - DNA, 20 bp, Artificial Sequence
  chemically synthesized
tcatcttggaatattacttt

SEQ ID NO: 16880 - DNA, 20 bp, Artificial Sequence
  chemically synthesized
catcttggaatattacttta

SEQ ID NO: 16881 - DNA, 20 bp, Artificial Sequence
  chemically synthesized
tactttagggccctgtgcct

SEQ ID NO: 16882 - DNA, 20 bp, Artificial Sequence
  chemically synthesized
gcctcagtttcctcctctta

SEQ ID NO: 16883 - DNA, 20 bp, Artificial Sequence
  chemically synthesized
cctcagtttcctcctcttaa

SEQ ID NO: 16884 - DNA, 20 bp, Artificial Sequence
  chemically synthesized
ctcagtttcctcctcttaaa

SEQ ID NO: 16885 - DNA, 20 bp, Artificial Sequence
  chemically synthesized
cctcttaaagggtattacaa

SEQ ID NO: 16886 - DNA, 20 bp, Artificial Sequence
  chemically synthesized
agggtattacaatagtactt

SEQ ID NO: 16887 - DNA, 20 bp, Artificial Sequence
  chemically synthesized
gggtattacaatagtacttg

SEQ ID NO: 16888 - DNA, 20 bp, Artificial Sequence
  chemically synthesized
ttacaatagtacttgaggca

SEQ ID NO: 16889 - DNA, 20 bp, Artificial Sequence
  chemically synthesized
acaatagtacttgaggcaca

SEQ ID NO: 16890 - DNA, 20 bp, Artificial Sequence
  chemically synthesized
taaatgaaataatatatcaa

SEQ ID NO: 16891 - DNA, 20 bp, Artificial Sequence
  chemically synthesized
tatcaacagtgtcttgtgta

SEQ ID NO: 16892 - DNA, 20 bp, Artificial Sequence
  chemically synthesized
cagtgtcttgtgtatagtat

SEQ ID NO: 16893 - DNA, 20 bp, Artificial Sequence
  chemically synthesized
ctattacttttatactatcc

SEQ ID NO: 16894 - DNA, 20 bp, Artificial Sequence
  chemically synthesized
ttttatactatcctagtgtg

SEQ ID NO: 16895 - DNA, 20 bp, Artificial Sequence
  chemically synthesized
actatcctagtgtgtagatt

SEQ ID NO: 16896 - DNA, 20 bp, Artificial Sequence
  chemically synthesized
ctatcctagtgtgtagattg

SEQ ID NO: 16897 - DNA, 20 bp, Artificial Sequence
  chemically synthesized
tagtgtgtagattgaggatg

SEQ ID NO: 16898 - DNA, 20 bp, Artificial Sequence
  chemically synthesized
agtgtgtagattgaggatgt

SEQ ID NO: 16899 - DNA, 20 bp, Artificial Sequence
  chemically synthesized
gtgtgtagattgaggatgta

SEQ ID NO: 16900 - DNA, 20 bp, Artificial Sequence
  chemically synthesized
tgtgtagattgaggatgtag

SEQ ID NO: 16901 - DNA, 20 bp, Artificial Sequence
  chemically synthesized
agattgaggatgtaggggct

SEQ ID NO: 16902 - DNA, 20 bp, Artificial Sequence
  chemically synthesized
attgaggatgtaggggctta

SEQ ID NO: 16903 - DNA, 20 bp, Artificial Sequence
  chemically synthesized
ggatgtaggggcttagagca

SEQ ID NO: 16904 - DNA, 20 bp, Artificial Sequence
  chemically synthesized
gggcttagagcaaagacatg

SEQ ID NO: 16905 - DNA, 20 bp, Artificial Sequence
  chemically synthesized
ggcttagagcaaagacatga

SEQ ID NO: 16906 - DNA, 20 bp, Artificial Sequence
  chemically synthesized
aaagacatgaaggtcacata

SEQ ID NO: 16907 - DNA, 20 bp, Artificial Sequence
  chemically synthesized
aagacatgaaggtcacatat

SEQ ID NO: 16908 - DNA, 20 bp, Artificial Sequence
  chemically synthesized
acatgaaggtcacatatggg

SEQ ID NO: 16909 - DNA, 20 bp, Artificial Sequence
  chemically synthesized
aggtcacatatgggtagaca

SEQ ID NO: 16910 - DNA, 20 bp, Artificial Sequence
  chemically synthesized
ggtcacatatgggtagacat

SEQ ID NO: 16911 - DNA, 20 bp, Artificial Sequence
  chemically synthesized
tgggtagacatgggaataaa

SEQ ID NO: 16912 - DNA, 20 bp, Artificial Sequence
  chemically synthesized
agacatgggaataaatagat

SEQ ID NO: 16913 - DNA, 20 bp, Artificial Sequence
  chemically synthesized
atagatgagatgacattgtc

SEQ ID NO: 16914 - DNA, 20 bp, Artificial Sequence
  chemically synthesized
tagatgagatgacattgtca

SEQ ID NO: 16915 - DNA, 20 bp, Artificial Sequence
  chemically synthesized
gacattgtcaaggattacac

SEQ ID NO: 16916 - DNA, 20 bp, Artificial Sequence
  chemically synthesized
tacacgagtctttctctgca

SEQ ID NO: 16917 - DNA, 20 bp, Artificial Sequence
  chemically synthesized
cgagtctttctctgcaaagc

SEQ ID NO: 16918 - DNA, 20 bp, Artificial Sequence
  chemically synthesized
gagtctttctctgcaaagcg

SEQ ID NO: 16919 - DNA, 20 bp, Artificial Sequence
  chemically synthesized
agtctttctctgcaaagcga

SEQ ID NO: 16920 - DNA, 20 bp, Artificial Sequence
  chemically synthesized
ctttctctgcaaagcgaggg

SEQ ID NO: 16921 - DNA, 20 bp, Artificial Sequence
  chemically synthesized
tttctctgcaaagcgaggga

SEQ ID NO: 16922 - DNA, 20 bp, Artificial Sequence
  chemically synthesized
tctgcaaagcgagggaaggt

SEQ ID NO: 16923 - DNA, 20 bp, Artificial Sequence
  chemically synthesized
gagggaaggttagtctcttt

SEQ ID NO: 16924 - DNA, 20 bp, Artificial Sequence
  chemically synthesized
gggaaggttagtctctttca

SEQ ID NO: 16925 - DNA, 20 bp, Artificial Sequence
  chemically synthesized
gtctctttcagagaacatca

SEQ ID NO: 16926 - DNA, 20 bp, Artificial Sequence
  chemically synthesized
tctttcagagaacatcatgg

SEQ ID NO: 16927 - DNA, 20 bp, Artificial Sequence
  chemically synthesized
catggcagaaacattttttc

SEQ ID NO: 16928 - DNA, 20 bp, Artificial Sequence
  chemically synthesized
tggcagaaacattttttcaa

SEQ ID NO: 16929 - DNA, 20 bp, Artificial Sequence
  chemically synthesized
ccatgcattttacgtccatg

SEQ ID NO: 16930 - DNA, 20 bp, Artificial Sequence
  chemically synthesized
atgtagttgcaaacaatgcc

SEQ ID NO: 16931 - DNA, 20 bp, Artificial Sequence
  chemically synthesized
tagttgcaaacaatgccaag

SEQ ID NO: 16932 - DNA, 20 bp, Artificial Sequence
  chemically synthesized
tgccaagtagaactccaatc

SEQ ID NO: 16933 - DNA, 20 bp, Artificial Sequence
  chemically synthesized
ccaagtagaactccaatcca

SEQ ID NO: 16934 - DNA, 20 bp, Artificial Sequence
  chemically synthesized
tagaactccaatccagagct

SEQ ID NO: 16935 - DNA, 20 bp, Artificial Sequence
  chemically synthesized
aactccaatccagagctaag

SEQ ID NO: 16936 - DNA, 20 bp, Artificial Sequence
  chemically synthesized
actccaatccagagctaagt

SEQ ID NO: 16937 - DNA, 20 bp, Artificial Sequence
  chemically synthesized
ctccaatccagagctaagtg

SEQ ID NO: 16938 - DNA, 20 bp, Artificial Sequence
  chemically synthesized
tccagagctaagtggggctg

SEQ ID NO: 16939 - DNA, 20 bp, Artificial Sequence
  chemically synthesized
ccagagctaagtggggctgt

SEQ ID NO: 16940 - DNA, 20 bp, Artificial Sequence
  chemically synthesized
gggaactatgtaccaattga

SEQ ID NO: 16941 - DNA, 20 bp, Artificial Sequence
  chemically synthesized
ggacatgctgctttttgact

SEQ ID NO: 16942 - DNA, 20 bp, Artificial Sequence
  chemically synthesized
acatgctgctttttgactca

SEQ ID NO: 16943 - DNA, 20 bp, Artificial Sequence
  chemically synthesized
catgctgctttttgactcag

SEQ ID NO: 16944 - DNA, 20 bp, Artificial Sequence
  chemically synthesized
gctgctttttgactcagagg

SEQ ID NO: 16945 - DNA, 20 bp, Artificial Sequence
  chemically synthesized
tttttgactcagaggtggat

SEQ ID NO: 16946 - DNA, 20 bp, Artificial Sequence
  chemically synthesized
tttgactcagaggtggataa

SEQ ID NO: 16947 - DNA, 20 bp, Artificial Sequence
  chemically synthesized
agacaaaactcttttcttct

SEQ ID NO: 16948 - DNA, 20 bp, Artificial Sequence
  chemically synthesized
ttcttcttagatgtactaaa

SEQ ID NO: 16949 - DNA, 20 bp, Artificial Sequence
  chemically synthesized
ttcttagatgtactaaaaag

SEQ ID NO: 16950 - DNA, 20 bp, Artificial Sequence
  chemically synthesized
tagatgtactaaaaagtagt

SEQ ID NO: 16951 - DNA, 20 bp, Artificial Sequence
  chemically synthesized
gtactaaaaagtagttagtc

SEQ ID NO: 16952 - DNA, 20 bp, Artificial Sequence
  chemically synthesized
ctaaaaagtagttagtctgg

SEQ ID NO: 16953 - DNA, 20 bp, Artificial Sequence
  chemically synthesized
gtagttagtctggaagtatt

SEQ ID NO: 16954 - DNA, 20 bp, Artificial Sequence
  chemically synthesized
gttagtctggaagtatttag

SEQ ID NO: 16955 - DNA, 20 bp, Artificial Sequence
  chemically synthesized
ttagtctggaagtatttaga

SEQ ID NO: 16956 - DNA, 20 bp, Artificial Sequence
  chemically synthesized
tggaagtatttagaaggctt

SEQ ID NO: 16957 - DNA, 20 bp, Artificial Sequence
  chemically synthesized
gaagtatttagaaggctttg

SEQ ID NO: 16958 - DNA, 20 bp, Artificial Sequence
  chemically synthesized
agtatttagaaggctttgga

SEQ ID NO: 16959 - DNA, 20 bp, Artificial Sequence
  chemically synthesized
gtatttagaaggctttggag

SEQ ID NO: 16960 - DNA, 20 bp, Artificial Sequence
  chemically synthesized
ggagaggaatgtgattttat

SEQ ID NO: 16961 - DNA, 20 bp, Artificial Sequence
  chemically synthesized
gagaggaatgtgattttatc

SEQ ID NO: 16962 - DNA, 20 bp, Artificial Sequence
  chemically synthesized
tttatcaggtaaatcaaaaa

SEQ ID NO: 16963 - DNA, 20 bp, Artificial Sequence
  chemically synthesized
tatcaggtaaatcaaaaata

SEQ ID NO: 16964 - DNA, 20 bp, Artificial Sequence
  chemically synthesized
atcaggtaaatcaaaaatag

SEQ ID NO: 16965 - DNA, 20 bp, Artificial Sequence
  chemically synthesized
aaaatagaggctatttctga

SEQ ID NO: 16966 - DNA, 20 bp, Artificial Sequence
  chemically synthesized
atagaggctatttctgaaag

SEQ ID NO: 16967 - DNA, 20 bp, Artificial Sequence
  chemically synthesized
ctatttctgaaagaagcaac

SEQ ID NO: 16968 - DNA, 20 bp, Artificial Sequence
  chemically synthesized
tgaaagaagcaactagaacc

SEQ ID NO: 16969 - DNA, 20 bp, Artificial Sequence
  chemically synthesized
aactagaaccaagttacaca

SEQ ID NO: 16970 - DNA, 20 bp, Artificial Sequence
  chemically synthesized
aatgtacatatatttttgac

SEQ ID NO: 16971 - DNA, 20 bp, Artificial Sequence
  chemically synthesized
tgtacatatatttttgacta

SEQ ID NO: 16972 - DNA, 20 bp, Artificial Sequence
  chemically synthesized
acatatatttttgactagag

SEQ ID NO: 16973 - DNA, 20 bp, Artificial Sequence
  chemically synthesized
aaatttgtataaaatatttg

SEQ ID NO: 16974 - DNA, 20 bp, Artificial Sequence
  chemically synthesized
aatttgtataaaatatttgc

SEQ ID NO: 16975 - DNA, 20 bp, Artificial Sequence
  chemically synthesized
tgtataaaatatttgcaggt

SEQ ID NO: 16976 - DNA, 20 bp, Artificial Sequence
  chemically synthesized
taaaatatttgcaggtaagt

SEQ ID NO: 16977 - DNA, 20 bp, Artificial Sequence
  chemically synthesized
aaaatatttgcaggtaagtt

SEQ ID NO: 16978 - DNA, 20 bp, Artificial Sequence
  chemically synthesized
agttaggtaatgcaacattt

SEQ ID NO: 16979 - DNA, 20 bp, Artificial Sequence
  chemically synthesized
aatgcaacatttgagactct

SEQ ID NO: 16980 - DNA, 20 bp, Artificial Sequence
  chemically synthesized
catttgagactctaagtttg

SEQ ID NO: 16981 - DNA, 20 bp, Artificial Sequence
  chemically synthesized
atttgagactctaagtttgt

SEQ ID NO: 16982 - DNA, 20 bp, Artificial Sequence
  chemically synthesized
ctctaagtttgtgggaaact

SEQ ID NO: 16983 - DNA, 20 bp, Artificial Sequence
  chemically synthesized
tgggaaacttagaactgttt

SEQ ID NO: 16984 - DNA, 20 bp, Artificial Sequence
  chemically synthesized
aatgctatgaaatgattttg

SEQ ID NO: 16985 - DNA, 20 bp, Artificial Sequence
  chemically synthesized
atgattttgcagatttttct

SEQ ID NO: 16986 - DNA, 20 bp, Artificial Sequence
  chemically synthesized
agatttttctgagatgttta

SEQ ID NO: 16987 - DNA, 20 bp, Artificial Sequence
  chemically synthesized
tctgagatgtttatagtgat

SEQ ID NO: 16988 - DNA, 20 bp, Artificial Sequence
  chemically synthesized
agatgtttatagtgataagt

SEQ ID NO: 16989 - DNA, 20 bp, Artificial Sequence
  chemically synthesized
ataagtgagaatatatgaca

SEQ ID NO: 16990 - DNA, 20 bp, Artificial Sequence
  chemically synthesized
tatctctttgtaacttacca

SEQ ID NO: 16991 - DNA, 20 bp, Artificial Sequence
  chemically synthesized
ctctttgtaacttaccacag

SEQ ID NO: 16992 - DNA, 20 bp, Artificial Sequence
  chemically synthesized
gatttgtattattttatgtg

SEQ ID NO: 16993 - DNA, 20 bp, Artificial Sequence
  chemically synthesized
ttattttatgtgaagaaact

SEQ ID NO: 16994 - DNA, 20 bp, Artificial Sequence
  chemically synthesized
atgtgaagaaactcagaata

SEQ ID NO: 16995 - DNA, 20 bp, Artificial Sequence
  chemically synthesized
gtgaagaaactcagaatatg

SEQ ID NO: 16996 - DNA, 20 bp, Artificial Sequence
  chemically synthesized
tctcaaattatcacttttat

SEQ ID NO: 16997 - DNA, 20 bp, Artificial Sequence
  chemically synthesized
ctcaaattatcacttttata

SEQ ID NO: 16998 - DNA, 20 bp, Artificial Sequence
  chemically synthesized
cttattttctttatgtaaac

SEQ ID NO: 16999 - DNA, 20 bp, Artificial Sequence
  chemically synthesized
atctcttctcattttctatc

SEQ ID NO: 17000 - DNA, 20 bp, Artificial Sequence
  chemically synthesized
tctcttctcattttctatca

SEQ ID NO: 17001 - DNA, 20 bp, Artificial Sequence
  chemically synthesized
cattttctatcaaggattaa

SEQ ID NO: 17002 - DNA, 20 bp, Artificial Sequence
  chemically synthesized
tctccaactttttgtatcta

SEQ ID NO: 17003 - DNA, 20 bp, Artificial Sequence
  chemically synthesized
ctccaactttttgtatctac

SEQ ID NO: 17004 - DNA, 20 bp, Artificial Sequence
  chemically synthesized
ctaccttcatttatatttta

SEQ ID NO: 17005 - DNA, 20 bp, Artificial Sequence
  chemically synthesized
ccttcatttatattttaaag

SEQ ID NO: 17006 - DNA, 20 bp, Artificial Sequence
  chemically synthesized
cttcatttatattttaaagt

SEQ ID NO: 17007 - DNA, 20 bp, Artificial Sequence
  chemically synthesized
atttatattttaaagtaggt

SEQ ID NO: 17008 - DNA, 20 bp, Artificial Sequence
  chemically synthesized
caaatgcattttaacactcc

SEQ ID NO: 17009 - DNA, 20 bp, Artificial Sequence
  chemically synthesized
tgcattttaacactccaaga

SEQ ID NO: 17010 - DNA, 20 bp, Artificial Sequence
  chemically synthesized
ttaacactccaagatagatt

SEQ ID NO: 17011 - DNA, 20 bp, Artificial Sequence
  chemically synthesized
tttagattaaaacatctaac

SEQ ID NO: 17012 - DNA, 20 bp, Artificial Sequence
  chemically synthesized
ttagattaaaacatctaacc

SEQ ID NO: 17013 - DNA, 20 bp, Artificial Sequence
  chemically synthesized
ttccgttattgtaacatgat

SEQ ID NO: 17014 - DNA, 20 bp, Artificial Sequence
  chemically synthesized
tccgttattgtaacatgatg

SEQ ID NO: 17015 - DNA, 20 bp, Artificial Sequence
  chemically synthesized
cgttattgtaacatgatgag

SEQ ID NO: 17016 - DNA, 20 bp, Artificial Sequence
  chemically synthesized
tgtaacatgatgaggagaca

SEQ ID NO: 17017 - DNA, 20 bp, Artificial Sequence
  chemically synthesized
acatgatgaggagacatgga

SEQ ID NO: 17018 - DNA, 20 bp, Artificial Sequence
  chemically synthesized
ttctgctaatttctccttta

SEQ ID NO: 17019 - DNA, 20 bp, Artificial Sequence
  chemically synthesized
cctttaaagtcacttcacat

SEQ ID NO: 17020 - DNA, 20 bp, Artificial Sequence
  chemically synthesized
attagttatctcttacatat

SEQ ID NO: 17021 - DNA, 20 bp, Artificial Sequence
  chemically synthesized
atctcttacatatgagtccc

SEQ ID NO: 17022 - DNA, 20 bp, Artificial Sequence
  chemically synthesized
tcttacatatgagtccctgg

SEQ ID NO: 17023 - DNA, 20 bp, Artificial Sequence
  chemically synthesized
atatgagtccctggcagtgt

SEQ ID NO: 17024 - DNA, 20 bp, Artificial Sequence
  chemically synthesized
cattccttttcatgacccta

SEQ ID NO: 17025 - DNA, 20 bp, Artificial Sequence
  chemically synthesized
aaatatactgcatttttcta

SEQ ID NO: 17026 - DNA, 20 bp, Artificial Sequence
  chemically synthesized
atttcaacctacacaaatta

SEQ ID NO: 17027 - DNA, 20 bp, Artificial Sequence
  chemically synthesized
tttcaacctacacaaattat

SEQ ID NO: 17028 - DNA, 20 bp, Artificial Sequence
  chemically synthesized
tgcatgcctttatccctaat

SEQ ID NO: 17029 - DNA, 20 bp, Artificial Sequence
  chemically synthesized
gcatgcctttatccctaatt

SEQ ID NO: 17030 - DNA, 20 bp, Artificial Sequence
  chemically synthesized
ttatccctaattaggctaca

SEQ ID NO: 17031 - DNA, 20 bp, Artificial Sequence
  chemically synthesized
ggctacacagctgtttaaat

SEQ ID NO: 17032 - DNA, 20 bp, Artificial Sequence
  chemically synthesized
gctacacagctgtttaaatt

SEQ ID NO: 17033 - DNA, 20 bp, Artificial Sequence
  chemically synthesized
gctgtttaaattaggaatta

SEQ ID NO: 17034 - DNA, 20 bp, Artificial Sequence
  chemically synthesized
ttaggaattacagatttcgc

SEQ ID NO: 17035 - DNA, 20 bp, Artificial Sequence
  chemically synthesized
agataattgtatatctgata

SEQ ID NO: 17036 - DNA, 20 bp, Artificial Sequence
  chemically synthesized
attgtatatctgatacagat

SEQ ID NO: 17037 - DNA, 20 bp, Artificial Sequence
  chemically synthesized
ttgtatatctgatacagatt

SEQ ID NO: 17038 - DNA, 20 bp, Artificial Sequence
  chemically synthesized
attaggcatttaataaattt

SEQ ID NO: 17039 - DNA, 20 bp, Artificial Sequence
  chemically synthesized
atttaataaattttggtgaa

SEQ ID NO: 17040 - DNA, 20 bp, Artificial Sequence
  chemically synthesized
tttaataaattttggtgaat

SEQ ID NO: 17041 - DNA, 20 bp, Artificial Sequence
  chemically synthesized
attgttcctcaaacatttgt

SEQ ID NO: 17042 - DNA, 20 bp, Artificial Sequence
  chemically synthesized
cactatgatacctacttatt

SEQ ID NO: 17043 - DNA, 20 bp, Artificial Sequence
  chemically synthesized
atacctacttattgagaatc

SEQ ID NO: 17044 - DNA, 20 bp, Artificial Sequence
  chemically synthesized
cttattgagaatcaagtaaa

SEQ ID NO: 17045 - DNA, 20 bp, Artificial Sequence
  chemically synthesized
tattgagaatcaagtaaata

SEQ ID NO: 17046 - DNA, 20 bp, Artificial Sequence
  chemically synthesized
atcaagtaaatagagatatt

SEQ ID NO: 17047 - DNA, 20 bp, Artificial Sequence
  chemically synthesized
agagatattcagacacatta

SEQ ID NO: 17048 - DNA, 20 bp, Artificial Sequence
  chemically synthesized
agatattcagacacattaca

SEQ ID NO: 17049 - DNA, 20 bp, Artificial Sequence
  chemically synthesized
tattcagacacattacagag

SEQ ID NO: 17050 - DNA, 20 bp, Artificial Sequence
  chemically synthesized
agtatatacttacaaactca

SEQ ID NO: 17051 - DNA, 20 bp, Artificial Sequence
  chemically synthesized
ctcaaagtatttgacacccc

SEQ ID NO: 17052 - DNA, 20 bp, Artificial Sequence
  chemically synthesized
tcaaagtatttgacacccct

SEQ ID NO: 17053 - DNA, 20 bp, Artificial Sequence
  chemically synthesized
atgaaacacttttgaatata

SEQ ID NO: 17054 - DNA, 20 bp, Artificial Sequence
  chemically synthesized
ataaacattgccaatgcatg

SEQ ID NO: 17055 - DNA, 20 bp, Artificial Sequence
  chemically synthesized
acattgccaatgcatgcaga

SEQ ID NO: 17056 - DNA, 20 bp, Artificial Sequence
  chemically synthesized
ttgccaatgcatgcagaaag

SEQ ID NO: 17057 - DNA, 20 bp, Artificial Sequence
  chemically synthesized
atgcagaaagaagcttaatg

SEQ ID NO: 17058 - DNA, 20 bp, Artificial Sequence
  chemically synthesized
tacatatactttcatgaaca

SEQ ID NO: 17059 - DNA, 20 bp, Artificial Sequence
  chemically synthesized
aacatcctttccctttctgt

SEQ ID NO: 17060 - DNA, 20 bp, Artificial Sequence
  chemically synthesized
catcctttccctttctgtta

SEQ ID NO: 17061 - DNA, 20 bp, Artificial Sequence
  chemically synthesized
acctgccttcatccatccct

SEQ ID NO: 17062 - DNA, 20 bp, Artificial Sequence
  chemically synthesized
tcccttggatatgatacctt

SEQ ID NO: 17063 - DNA, 20 bp, Artificial Sequence
  chemically synthesized
ccccacacccaaatcttcaa

SEQ ID NO: 17064 - DNA, 20 bp, Artificial Sequence
  chemically synthesized
acacccaaatcttcaacaga

SEQ ID NO: 17065 - DNA, 20 bp, Artificial Sequence
  chemically synthesized
cttcaacagacagaaatgta

SEQ ID NO: 17066 - DNA, 20 bp, Artificial Sequence
  chemically synthesized
aagtcccgtttaatgtgtga

SEQ ID NO: 17067 - DNA, 20 bp, Artificial Sequence
  chemically synthesized
atgaactaaatattctatct

SEQ ID NO: 17068 - DNA, 20 bp, Artificial Sequence
  chemically synthesized
ctatctcagtattcatctga

SEQ ID NO: 17069 - DNA, 20 bp, Artificial Sequence
  chemically synthesized
tcagtattcatctgacagca

SEQ ID NO: 17070 - DNA, 20 bp, Artificial Sequence
  chemically synthesized
cagtattcatctgacagcat

SEQ ID NO: 17071 - DNA, 20 bp, Artificial Sequence
  chemically synthesized
tattcatctgacagcatagg

SEQ ID NO: 17072 - DNA, 20 bp, Artificial Sequence
  chemically synthesized
attcatctgacagcatagga

SEQ ID NO: 17073 - DNA, 20 bp, Artificial Sequence
  chemically synthesized
tcatctgacagcataggaag

SEQ ID NO: 17074 - DNA, 20 bp, Artificial Sequence
  chemically synthesized
atctgacagcataggaagga

SEQ ID NO: 17075 - DNA, 20 bp, Artificial Sequence
  chemically synthesized
taccacatattgtgtttcta

SEQ ID NO: 17076 - DNA, 20 bp, Artificial Sequence
  chemically synthesized
ttgtgtttctatggccgaat

SEQ ID NO: 17077 - DNA, 20 bp, Artificial Sequence
  chemically synthesized
tttctatggccgaatcagct

SEQ ID NO: 17078 - DNA, 20 bp, Artificial Sequence
  chemically synthesized
ttctatggccgaatcagctt

SEQ ID NO: 17079 - DNA, 20 bp, Artificial Sequence
  chemically synthesized
agcttaggttctacattgtg

SEQ ID NO: 17080 - DNA, 20 bp, Artificial Sequence
  chemically synthesized
ggttctacattgtgtggttt

SEQ ID NO: 17081 - DNA, 20 bp, Artificial Sequence
  chemically synthesized
ataaattacttaacctacct

SEQ ID NO: 17082 - DNA, 20 bp, Artificial Sequence
  chemically synthesized
attacttaacctacctaagt

SEQ ID NO: 17083 - DNA, 20 bp, Artificial Sequence
  chemically synthesized
ttacttaacctacctaagta

SEQ ID NO: 17084 - DNA, 20 bp, Artificial Sequence
  chemically synthesized
taagtaaggcacctacgtgt

SEQ ID NO: 17085 - DNA, 20 bp, Artificial Sequence
  chemically synthesized
cgtgtcagtctcttcatgtg

SEQ ID NO: 17086 - DNA, 20 bp, Artificial Sequence
  chemically synthesized
tcagtctcttcatgtgtagt

SEQ ID NO: 17087 - DNA, 20 bp, Artificial Sequence
  chemically synthesized
cagtctcttcatgtgtagtc

SEQ ID NO: 17088 - DNA, 20 bp, Artificial Sequence
  chemically synthesized
tagtcaggaattataatgaa

SEQ ID NO: 17089 - DNA, 20 bp, Artificial Sequence
  chemically synthesized
ttataatgaaaagtaactcg

SEQ ID NO: 17090 - DNA, 20 bp, Artificial Sequence
  chemically synthesized
cgaagtatttttgtgataat

SEQ ID NO: 17091 - DNA, 20 bp, Artificial Sequence
  chemically synthesized
gtatttttgtgataatcagt

SEQ ID NO: 17092 - DNA, 20 bp, Artificial Sequence
  chemically synthesized
gataaaaatgtgaacctctt

SEQ ID NO: 17093 - DNA, 20 bp, Artificial Sequence
  chemically synthesized
atgtgaacctcttaagacac

SEQ ID NO: 17094 - DNA, 20 bp, Artificial Sequence
  chemically synthesized
attatatactgaactcatgt

SEQ ID NO: 17095 - DNA, 20 bp, Artificial Sequence
  chemically synthesized
ttatatactgaactcatgtg

SEQ ID NO: 17096 - DNA, 20 bp, Artificial Sequence
  chemically synthesized
actgaactcatgtgaggatc

SEQ ID NO: 17097 - DNA, 20 bp, Artificial Sequence
  chemically synthesized
gaggatccagtttctatatc

SEQ ID NO: 17098 - DNA, 20 bp, Artificial Sequence
  chemically synthesized
aggatccagtttctatatct

SEQ ID NO: 17099 - DNA, 20 bp, Artificial Sequence
  chemically synthesized
ctaggcttttcaaactacct

SEQ ID NO: 17100 - DNA, 20 bp, Artificial Sequence
  chemically synthesized
aggcttttcaaactacctta

SEQ ID NO: 17101 - DNA, 20 bp, Artificial Sequence
  chemically synthesized
atacttgtatatcttccttg

SEQ ID NO: 17102 - DNA, 20 bp, Artificial Sequence
  chemically synthesized
tacttgtatatcttccttgt

SEQ ID NO: 17103 - DNA, 20 bp, Artificial Sequence
  chemically synthesized
gtatatcttccttgtaggta

SEQ ID NO: 17104 - DNA, 20 bp, Artificial Sequence
  chemically synthesized
atatcttccttgtaggtata

SEQ ID NO: 17105 - DNA, 20 bp, Artificial Sequence
  chemically synthesized
atagagtaaaatactaactt

SEQ ID NO: 17106 - DNA, 20 bp, Artificial Sequence
  chemically synthesized
tagagtaaaatactaacttc

SEQ ID NO: 17107 - DNA, 20 bp, Artificial Sequence
  chemically synthesized
taaaatactaacttcaggtt

SEQ ID NO: 17108 - DNA, 20 bp, Artificial Sequence
  chemically synthesized
catattataatttacattgc

SEQ ID NO: 17109 - DNA, 20 bp, Artificial Sequence
  chemically synthesized
ttttattttctgttccttat

SEQ ID NO: 17110 - DNA, 20 bp, Artificial Sequence
  chemically synthesized
tccttattggtcaatacttt

SEQ ID NO: 17111 - DNA, 20 bp, Artificial Sequence
  chemically synthesized
ttggtcaatacttttggatc

SEQ ID NO: 17112 - DNA, 20 bp, Artificial Sequence
  chemically synthesized
tggatccagctgttcaactg

SEQ ID NO: 17113 - DNA, 20 bp, Artificial Sequence
  chemically synthesized
taacacttgataataatgcc

SEQ ID NO: 17114 - DNA, 20 bp, Artificial Sequence
  chemically synthesized
acacttgataataatgccaa

SEQ ID NO: 17115 - DNA, 20 bp, Artificial Sequence
  chemically synthesized
cacttgataataatgccaag

SEQ ID NO: 17116 - DNA, 20 bp, Artificial Sequence
  chemically synthesized
tgataataatgccaagaggc

SEQ ID NO: 17117 - DNA, 20 bp, Artificial Sequence
  chemically synthesized
gataataatgccaagaggct

SEQ ID NO: 17118 - DNA, 20 bp, Artificial Sequence
  chemically synthesized
ataataatgccaagaggctg

SEQ ID NO: 17119 - DNA, 20 bp, Artificial Sequence
  chemically synthesized
taatgccaagaggctggggt

SEQ ID NO: 17120 - DNA, 20 bp, Artificial Sequence
  chemically synthesized
aagaggctggggtgagctat

SEQ ID NO: 17121 - DNA, 20 bp, Artificial Sequence
  chemically synthesized
gaggctggggtgagctataa

SEQ ID NO: 17122 - DNA, 20 bp, Artificial Sequence
  chemically synthesized
aggctggggtgagctataag

SEQ ID NO: 17123 - DNA, 20 bp, Artificial Sequence
  chemically synthesized
gctggggtgagctataagag

SEQ ID NO: 17124 - DNA, 20 bp, Artificial Sequence
  chemically synthesized
ggtgagctataagaggagtc

SEQ ID NO: 17125 - DNA, 20 bp, Artificial Sequence
  chemically synthesized
gtgagctataagaggagtca

SEQ ID NO: 17126 - DNA, 20 bp, Artificial Sequence
  chemically synthesized
taagaggagtcaaggctaat

SEQ ID NO: 17127 - DNA, 20 bp, Artificial Sequence
  chemically synthesized
ggagtcaaggctaatcagta

SEQ ID NO: 17128 - DNA, 20 bp, Artificial Sequence
  chemically synthesized
tcaaggctaatcagtacagc

SEQ ID NO: 17129 - DNA, 20 bp, Artificial Sequence
  chemically synthesized
aaggctaatcagtacagcaa

SEQ ID NO: 17130 - DNA, 20 bp, Artificial Sequence
  chemically synthesized
aggctaatcagtacagcaag

SEQ ID NO: 17131 - DNA, 20 bp, Artificial Sequence
  chemically synthesized
gtacagcaagaggaatgaat

SEQ ID NO: 17132 - DNA, 20 bp, Artificial Sequence
  chemically synthesized
cagcaagaggaatgaataag

SEQ ID NO: 17133 - DNA, 20 bp, Artificial Sequence
  chemically synthesized
aagaggaatgaataagaagc

SEQ ID NO: 17134 - DNA, 20 bp, Artificial Sequence
  chemically synthesized
aatgaataagaagctagata

SEQ ID NO: 17135 - DNA, 20 bp, Artificial Sequence
  chemically synthesized
atgaataagaagctagataa

SEQ ID NO: 17136 - DNA, 20 bp, Artificial Sequence
  chemically synthesized
tgaataagaagctagataaa

SEQ ID NO: 17137 - DNA, 20 bp, Artificial Sequence
  chemically synthesized
aagaagctagataaagggaa

SEQ ID NO: 17138 - DNA, 20 bp, Artificial Sequence
  chemically synthesized
gctagataaagggaacggcg

SEQ ID NO: 17139 - DNA, 20 bp, Artificial Sequence
  chemically synthesized
ctagataaagggaacggcgt

SEQ ID NO: 17140 - DNA, 20 bp, Artificial Sequence
  chemically synthesized
agataaagggaacggcgtgg

SEQ ID NO: 17141 - DNA, 20 bp, Artificial Sequence
  chemically synthesized
gataaagggaacggcgtggg

SEQ ID NO: 17142 - DNA, 20 bp, Artificial Sequence
  chemically synthesized
ataaagggaacggcgtggga

SEQ ID NO: 17143 - DNA, 20 bp, Artificial Sequence
  chemically synthesized
ggcgtgggagggtgtttcct

SEQ ID NO: 17144 - DNA, 20 bp, Artificial Sequence
  chemically synthesized
gcgtgggagggtgtttcctg

SEQ ID NO: 17145 - DNA, 20 bp, Artificial Sequence
  chemically synthesized
cgtgggagggtgtttcctga

SEQ ID NO: 17146 - DNA, 20 bp, Artificial Sequence
  chemically synthesized
tttcctgagggaatattcat

SEQ ID NO: 17147 - DNA, 20 bp, Artificial Sequence
  chemically synthesized
gggaatattcatgagacaaa

SEQ ID NO: 17148 - DNA, 20 bp, Artificial Sequence
  chemically synthesized
gaatattcatgagacaaaca

SEQ ID NO: 17149 - DNA, 20 bp, Artificial Sequence
  chemically synthesized
catgagacaaacagagaata

SEQ ID NO: 17150 - DNA, 20 bp, Artificial Sequence
  chemically synthesized
aaacagagaataaagaaatg

SEQ ID NO: 17151 - DNA, 20 bp, Artificial Sequence
  chemically synthesized
aacagagaataaagaaatga

SEQ ID NO: 17152 - DNA, 20 bp, Artificial Sequence
  chemically synthesized
acagagaataaagaaatgaa

SEQ ID NO: 17153 - DNA, 20 bp, Artificial Sequence
  chemically synthesized
aagggaatgtaaatataata

SEQ ID NO: 17154 - DNA, 20 bp, Artificial Sequence
  chemically synthesized
agggaatgtaaatataatat

SEQ ID NO: 17155 - DNA, 20 bp, Artificial Sequence
  chemically synthesized
atataggcatgttaatatac

SEQ ID NO: 17156 - DNA, 20 bp, Artificial Sequence
  chemically synthesized
gttaatatacaagtgatttc

SEQ ID NO: 17157 - DNA, 20 bp, Artificial Sequence
  chemically synthesized
atatacaagtgatttctaga

SEQ ID NO: 17158 - DNA, 20 bp, Artificial Sequence
  chemically synthesized
tttctagaaagtgcatgaat

SEQ ID NO: 17159 - DNA, 20 bp, Artificial Sequence
  chemically synthesized
tagaaagtgcatgaataaga

SEQ ID NO: 17160 - DNA, 20 bp, Artificial Sequence
  chemically synthesized
aagtgcatgaataagacagc

SEQ ID NO: 17161 - DNA, 20 bp, Artificial Sequence
  chemically synthesized
gcatgaataagacagctaga

SEQ ID NO: 17162 - DNA, 20 bp, Artificial Sequence
  chemically synthesized
gaataagacagctagaaaga

SEQ ID NO: 17163 - DNA, 20 bp, Artificial Sequence
  chemically synthesized
aagacagctagaaagataga

SEQ ID NO: 17164 - DNA, 20 bp, Artificial Sequence
  chemically synthesized
gctagaaagatagaaagacc

SEQ ID NO: 17165 - DNA, 20 bp, Artificial Sequence
  chemically synthesized
cttaaaatgtgaatgtgaaa

SEQ ID NO: 17166 - DNA, 20 bp, Artificial Sequence
  chemically synthesized
atgtgaatgtgaaacagttc

SEQ ID NO: 17167 - DNA, 20 bp, Artificial Sequence
  chemically synthesized
aatgtgaaacagttctggct

SEQ ID NO: 17168 - DNA, 20 bp, Artificial Sequence
  chemically synthesized
tgtgaaacagttctggctga

SEQ ID NO: 17169 - DNA, 20 bp, Artificial Sequence
  chemically synthesized
tctggctgagagaaatatct

SEQ ID NO: 17170 - DNA, 20 bp, Artificial Sequence
  chemically synthesized
ctggctgagagaaatatctc

SEQ ID NO: 17171 - DNA, 20 bp, Artificial Sequence
  chemically synthesized
tgagagaaatatctcaggaa

SEQ ID NO: 17172 - DNA, 20 bp, Artificial Sequence
  chemically synthesized
tctcaggaatggccatgttc

SEQ ID NO: 17173 - DNA, 20 bp, Artificial Sequence
  chemically synthesized
ctcaggaatggccatgttcc

SEQ ID NO: 17174 - DNA, 20 bp, Artificial Sequence
  chemically synthesized
aatggccatgttccaggctt

SEQ ID NO: 17175 - DNA, 20 bp, Artificial Sequence
  chemically synthesized
atggccatgttccaggcttc

SEQ ID NO: 17176 - DNA, 20 bp, Artificial Sequence
  chemically synthesized
tggccatgttccaggcttca

SEQ ID NO: 17177 - DNA, 20 bp, Artificial Sequence
  chemically synthesized
ccatgttccaggcttcaggg

SEQ ID NO: 17178 - DNA, 20 bp, Artificial Sequence
  chemically synthesized
catgttccaggcttcagggt

SEQ ID NO: 17179 - DNA, 20 bp, Artificial Sequence
  chemically synthesized
cttcagggtaggacccatgc

SEQ ID NO: 17180 - DNA, 20 bp, Artificial Sequence
  chemically synthesized
ttcagggtaggacccatgcc

SEQ ID NO: 17181 - DNA, 20 bp, Artificial Sequence
  chemically synthesized
tcagggtaggacccatgcca

SEQ ID NO: 17182 - DNA, 20 bp, Artificial Sequence
  chemically synthesized
ctgcctcctgtccctatcat

SEQ ID NO: 17183 - DNA, 20 bp, Artificial Sequence
  chemically synthesized
tgcctcctgtccctatcatt

SEQ ID NO: 17184 - DNA, 20 bp, Artificial Sequence
  chemically synthesized
cctcctgtccctatcattag

SEQ ID NO: 17185 - DNA, 20 bp, Artificial Sequence
  chemically synthesized
ctcctgtccctatcattagg

SEQ ID NO: 17186 - DNA, 20 bp, Artificial Sequence
  chemically synthesized
tgtccctatcattaggaggc

SEQ ID NO: 17187 - DNA, 20 bp, Artificial Sequence
  chemically synthesized
gtccctatcattaggaggcc

SEQ ID NO: 17188 - DNA, 20 bp, Artificial Sequence
  chemically synthesized
tccctatcattaggaggcca

SEQ ID NO: 17189 - DNA, 20 bp, Artificial Sequence
  chemically synthesized
ctatcattaggaggccaggg

SEQ ID NO: 17190 - DNA, 20 bp, Artificial Sequence
  chemically synthesized
tatcattaggaggccagggt

SEQ ID NO: 17191 - DNA, 20 bp, Artificial Sequence
  chemically synthesized
tcattaggaggccagggtgg

SEQ ID NO: 17192 - DNA, 20 bp, Artificial Sequence
  chemically synthesized
cattaggaggccagggtggg

SEQ ID NO: 17193 - DNA, 20 bp, Artificial Sequence
  chemically synthesized
ccagggtgggaggattgctt

SEQ ID NO: 17194 - DNA, 20 bp, Artificial Sequence
  chemically synthesized
cagggtgggaggattgcttg

SEQ ID NO: 17195 - DNA, 20 bp, Artificial Sequence
  chemically synthesized
gtgggaggattgcttgaggt

SEQ ID NO: 17196 - DNA, 20 bp, Artificial Sequence
  chemically synthesized
tgggaggattgcttgaggtt

SEQ ID NO: 17197 - DNA, 20 bp, Artificial Sequence
  chemically synthesized
gattgcttgaggttaggaat

SEQ ID NO: 17198 - DNA, 20 bp, Artificial Sequence
  chemically synthesized
ttgcttgaggttaggaattg

SEQ ID NO: 17199 - DNA, 20 bp, Artificial Sequence
  chemically synthesized
gcttgaggttaggaattgga

SEQ ID NO: 17200 - DNA, 20 bp, Artificial Sequence
  chemically synthesized
tgaggttaggaattggagag

SEQ ID NO: 17201 - DNA, 20 bp, Artificial Sequence
  chemically synthesized
taggaattggagagcagcct

SEQ ID NO: 17202 - DNA, 20 bp, Artificial Sequence
  chemically synthesized
tttacaaaaaataaaaacat

SEQ ID NO: 17203 - DNA, 20 bp, Artificial Sequence
  chemically synthesized
caaaaaataaaaacattagc

SEQ ID NO: 17204 - DNA, 20 bp, Artificial Sequence
  chemically synthesized
aaaaaataaaaacattagct

SEQ ID NO: 17205 - DNA, 20 bp, Artificial Sequence
  chemically synthesized
ataaaaacattagctaggtg

SEQ ID NO: 17206 - DNA, 20 bp, Artificial Sequence
  chemically synthesized
aaaacattagctaggtgcag

SEQ ID NO: 17207 - DNA, 20 bp, Artificial Sequence
  chemically synthesized
ggtgcagtggcataaacctg

SEQ ID NO: 17208 - DNA, 20 bp, Artificial Sequence
  chemically synthesized
gtggcataaacctgtagtcc

SEQ ID NO: 17209 - DNA, 20 bp, Artificial Sequence
  chemically synthesized
tggcataaacctgtagtcct

SEQ ID NO: 17210 - DNA, 20 bp, Artificial Sequence
  chemically synthesized
tgtagtcctaggtactcaaa

SEQ ID NO: 17211 - DNA, 20 bp, Artificial Sequence
  chemically synthesized
tcctaggtactcaaaaagct

SEQ ID NO: 17212 - DNA, 20 bp, Artificial Sequence
  chemically synthesized
cctaggtactcaaaaagctg

SEQ ID NO: 17213 - DNA, 20 bp, Artificial Sequence
  chemically synthesized
aggtactcaaaaagctgagg

SEQ ID NO: 17214 - DNA, 20 bp, Artificial Sequence
  chemically synthesized
tactcaaaaagctgaggaag

SEQ ID NO: 17215 - DNA, 20 bp, Artificial Sequence
  chemically synthesized
actcaaaaagctgaggaaga

SEQ ID NO: 17216 - DNA, 20 bp, Artificial Sequence
  chemically synthesized
ctgaggaagaaggattgctt

SEQ ID NO: 17217 - DNA, 20 bp, Artificial Sequence
  chemically synthesized
gaagaaggattgcttgagcc

SEQ ID NO: 17218 - DNA, 20 bp, Artificial Sequence
  chemically synthesized
aagaaggattgcttgagccc

SEQ ID NO: 17219 - DNA, 20 bp, Artificial Sequence
  chemically synthesized
ttgcttgagcccaggatttc

SEQ ID NO: 17220 - DNA, 20 bp, Artificial Sequence
  chemically synthesized
tgcttgagcccaggatttca

SEQ ID NO: 17221 - DNA, 20 bp, Artificial Sequence
  chemically synthesized
agcccaggatttcaaggctg

SEQ ID NO: 17222 - DNA, 20 bp, Artificial Sequence
  chemically synthesized
caggatttcaaggctgcagt

SEQ ID NO: 17223 - DNA, 20 bp, Artificial Sequence
  chemically synthesized
aaggctgcagtgagctgtga

SEQ ID NO: 17224 - DNA, 20 bp, Artificial Sequence
  chemically synthesized
gtgatggcaccactgcactc

SEQ ID NO: 17225 - DNA, 20 bp, Artificial Sequence
  chemically synthesized
ggcaccactgcactccagcc

SEQ ID NO: 17226 - DNA, 20 bp, Artificial Sequence
  chemically synthesized
gcaccactgcactccagcct

SEQ ID NO: 17227 - DNA, 20 bp, Artificial Sequence
  chemically synthesized
ctgcactccagcctgggcaa

SEQ ID NO: 17228 - DNA, 20 bp, Artificial Sequence
  chemically synthesized
gcactccagcctgggcaaca

SEQ ID NO: 17229 - DNA, 20 bp, Artificial Sequence
  chemically synthesized
tccagcctgggcaacagagc

SEQ ID NO: 17230 - DNA, 20 bp, Artificial Sequence
  chemically synthesized
aaataaataaataaataaat

SEQ ID NO: 17231 - DNA, 20 bp, Artificial Sequence
  chemically synthesized
ataaataaataaataagctt

SEQ ID NO: 17232 - DNA, 20 bp, Artificial Sequence
  chemically synthesized
taaataagctttagccacac

SEQ ID NO: 17233 - DNA, 20 bp, Artificial Sequence
  chemically synthesized
aagctttagccacaccagac

SEQ ID NO: 17234 - DNA, 20 bp, Artificial Sequence
  chemically synthesized
agtaacattgtgtattttta

SEQ ID NO: 17235 - DNA, 20 bp, Artificial Sequence
  chemically synthesized
gtaacattgtgtatttttaa

SEQ ID NO: 17236 - DNA, 20 bp, Artificial Sequence
  chemically synthesized
aaggactgcattaataaatt

SEQ ID NO: 17237 - DNA, 20 bp, Artificial Sequence
  chemically synthesized
aggactgcattaataaattt

SEQ ID NO: 17238 - DNA, 20 bp, Artificial Sequence
  chemically synthesized
ggactgcattaataaatttg

SEQ ID NO: 17239 - DNA, 20 bp, Artificial Sequence
  chemically synthesized
gactgcattaataaatttgg

SEQ ID NO: 17240 - DNA, 20 bp, Artificial Sequence
  chemically synthesized
ttaataaatttgggggttta

SEQ ID NO: 17241 - DNA, 20 bp, Artificial Sequence
  chemically synthesized
aaatttgggggtttacagaa

SEQ ID NO: 17242 - DNA, 20 bp, Artificial Sequence
  chemically synthesized
tttgggggtttacagaatgg

SEQ ID NO: 17243 - DNA, 20 bp, Artificial Sequence
  chemically synthesized
ttgggggtttacagaatggc

SEQ ID NO: 17244 - DNA, 20 bp, Artificial Sequence
  chemically synthesized
ggggtttacagaatggcagg

SEQ ID NO: 17245 - DNA, 20 bp, Artificial Sequence
  chemically synthesized
gaatggcaggtagttatcct

SEQ ID NO: 17246 - DNA, 20 bp, Artificial Sequence
  chemically synthesized
aatggcaggtagttatcctt

SEQ ID NO: 17247 - DNA, 20 bp, Artificial Sequence
  chemically synthesized
ggcaggtagttatccttggg

SEQ ID NO: 17248 - DNA, 20 bp, Artificial Sequence
  chemically synthesized
ttgggaagacaatatgctga

SEQ ID NO: 17249 - DNA, 20 bp, Artificial Sequence
  chemically synthesized
tgggaagacaatatgctgat

SEQ ID NO: 17250 - DNA, 20 bp, Artificial Sequence
  chemically synthesized
gggaagacaatatgctgatg

SEQ ID NO: 17251 - DNA, 20 bp, Artificial Sequence
  chemically synthesized
tactgccctgactaaactca

SEQ ID NO: 17252 - DNA, 20 bp, Artificial Sequence
  chemically synthesized
tgactaaactcacagtatga

SEQ ID NO: 17253 - DNA, 20 bp, Artificial Sequence
  chemically synthesized
actaaactcacagtatgaca

SEQ ID NO: 17254 - DNA, 20 bp, Artificial Sequence
  chemically synthesized
gtgctgacttgataattcct

SEQ ID NO: 17255 - DNA, 20 bp, Artificial Sequence
  chemically synthesized
gctgacttgataattcctca

SEQ ID NO: 17256 - DNA, 20 bp, Artificial Sequence
  chemically synthesized
gacttgataattcctcagag

SEQ ID NO: 17257 - DNA, 20 bp, Artificial Sequence
  chemically synthesized
attcctcagagcagatctct

SEQ ID NO: 17258 - DNA, 20 bp, Artificial Sequence
  chemically synthesized
tcctcagagcagatctctaa

SEQ ID NO: 17259 - DNA, 20 bp, Artificial Sequence
  chemically synthesized
ctcagagcagatctctaaga

SEQ ID NO: 17260 - DNA, 20 bp, Artificial Sequence
  chemically synthesized
cagatctctaagagagctta

SEQ ID NO: 17261 - DNA, 20 bp, Artificial Sequence
  chemically synthesized
agacacaacgcctgcttcac

SEQ ID NO: 17262 - DNA, 20 bp, Artificial Sequence
  chemically synthesized
gacacaacgcctgcttcaca

SEQ ID NO: 17263 - DNA, 20 bp, Artificial Sequence
  chemically synthesized
gcctgcttcacaaggttctc

SEQ ID NO: 17264 - DNA, 20 bp, Artificial Sequence
  chemically synthesized
cttcacaaggttctcaagta

SEQ ID NO: 17265 - DNA, 20 bp, Artificial Sequence
  chemically synthesized
ctcaagtatggcaaacttgt

SEQ ID NO: 17266 - DNA, 20 bp, Artificial Sequence
  chemically synthesized
agtatggcaaacttgtcagt

SEQ ID NO: 17267 - DNA, 20 bp, Artificial Sequence
  chemically synthesized
gtatggcaaacttgtcagtc

SEQ ID NO: 17268 - DNA, 20 bp, Artificial Sequence
  chemically synthesized
tatggcaaacttgtcagtca

SEQ ID NO: 17269 - DNA, 20 bp, Artificial Sequence
  chemically synthesized
gcaaacttgtcagtcagggt

SEQ ID NO: 17270 - DNA, 20 bp, Artificial Sequence
  chemically synthesized
ttgtcagtcagggtgagact

SEQ ID NO: 17271 - DNA, 20 bp, Artificial Sequence
  chemically synthesized
tgtcagtcagggtgagactg

SEQ ID NO: 17272 - DNA, 20 bp, Artificial Sequence
  chemically synthesized
gtcagggtgagactgaggat

SEQ ID NO: 17273 - DNA, 20 bp, Artificial Sequence
  chemically synthesized
tcagggtgagactgaggatg

SEQ ID NO: 17274 - DNA, 20 bp, Artificial Sequence
  chemically synthesized
tgagactgaggatgaggtct

SEQ ID NO: 17275 - DNA, 20 bp, Artificial Sequence
  chemically synthesized
agactgaggatgaggtctaa

SEQ ID NO: 17276 - DNA, 20 bp, Artificial Sequence
  chemically synthesized
tgaggtctaagagacttgtc

SEQ ID NO: 17277 - DNA, 20 bp, Artificial Sequence
  chemically synthesized
ggtctaagagacttgtctgg

SEQ ID NO: 17278 - DNA, 20 bp, Artificial Sequence
  chemically synthesized
tggaagctgcacttgtttga

SEQ ID NO: 17279 - DNA, 20 bp, Artificial Sequence
  chemically synthesized
ggaagctgcacttgtttgaa

SEQ ID NO: 17280 - DNA, 20 bp, Artificial Sequence
  chemically synthesized
aaaggacactgattttactt

SEQ ID NO: 17281 - DNA, 20 bp, Artificial Sequence
  chemically synthesized
ggacactgattttacttcag

SEQ ID NO: 17282 - DNA, 20 bp, Artificial Sequence
  chemically synthesized
taaatgtccttatatatcac

SEQ ID NO: 17283 - DNA, 20 bp, Artificial Sequence
  chemically synthesized
gtccttatatatcactggat

SEQ ID NO: 17284 - DNA, 20 bp, Artificial Sequence
  chemically synthesized
cttatatatcactggatcag

SEQ ID NO: 17285 - DNA, 20 bp, Artificial Sequence
  chemically synthesized
ttatatatcactggatcagc

SEQ ID NO: 17286 - DNA, 20 bp, Artificial Sequence
  chemically synthesized
tatatcactggatcagcagg

SEQ ID NO: 17287 - DNA, 20 bp, Artificial Sequence
  chemically synthesized
gatgctgacttaataattga

SEQ ID NO: 17288 - DNA, 20 bp, Artificial Sequence
  chemically synthesized
atgctgacttaataattgaa

SEQ ID NO: 17289 - DNA, 20 bp, Artificial Sequence
  chemically synthesized
attgaaaggattttcaaact

SEQ ID NO: 17290 - DNA, 20 bp, Artificial Sequence
  chemically synthesized
gaaaggattttcaaactaag

SEQ ID NO: 17291 - DNA, 20 bp, Artificial Sequence
  chemically synthesized
aagttgtaaaatataatata

SEQ ID NO: 17292 - DNA, 20 bp, Artificial Sequence
  chemically synthesized
agttgtaaaatataatatat

SEQ ID NO: 17293 - DNA, 20 bp, Artificial Sequence
  chemically synthesized
gcataaatatacatttactt

SEQ ID NO: 17294 - DNA, 20 bp, Artificial Sequence
  chemically synthesized
atacatttacttaagaaaat

SEQ ID NO: 17295 - DNA, 20 bp, Artificial Sequence
  chemically synthesized
ttgatttttgactattgata

SEQ ID NO: 17296 - DNA, 20 bp, Artificial Sequence
  chemically synthesized
tgatttttgactattgatac

SEQ ID NO: 17297 - DNA, 20 bp, Artificial Sequence
  chemically synthesized
ctattgatacaggctgttta

SEQ ID NO: 17298 - DNA, 20 bp, Artificial Sequence
  chemically synthesized
acaggctgtttaaagatcaa

SEQ ID NO: 17299 - DNA, 20 bp, Artificial Sequence
  chemically synthesized
caggctgtttaaagatcaat

SEQ ID NO: 17300 - DNA, 20 bp, Artificial Sequence
  chemically synthesized
gtcatcccttgctaacatat

SEQ ID NO: 17301 - DNA, 20 bp, Artificial Sequence
  chemically synthesized
gctaacatatgagtaaactt

SEQ ID NO: 17302 - DNA, 20 bp, Artificial Sequence
  chemically synthesized
cacttcttcttatttataat

SEQ ID NO: 17303 - DNA, 20 bp, Artificial Sequence
  chemically synthesized
aattagatacctctgtttct

SEQ ID NO: 17304 - DNA, 20 bp, Artificial Sequence
  chemically synthesized
tcgctatcataccttatttt

SEQ ID NO: 17305 - DNA, 20 bp, Artificial Sequence
  chemically synthesized
attttcagcacatcgcccct

SEQ ID NO: 17306 - DNA, 20 bp, Artificial Sequence
  chemically synthesized
tacacatttacacattgttg

SEQ ID NO: 17307 - DNA, 20 bp, Artificial Sequence
  chemically synthesized
acacatttacacattgttgt

SEQ ID NO: 17308 - DNA, 20 bp, Artificial Sequence
  chemically synthesized
gctgtcttcttataacaatc

SEQ ID NO: 17309 - DNA, 20 bp, Artificial Sequence
  chemically synthesized
tcttataacaatcaagaaaa

SEQ ID NO: 17310 - DNA, 20 bp, Artificial Sequence
  chemically synthesized
cgctatgttttttactctta

SEQ ID NO: 17311 - DNA, 20 bp, Artificial Sequence
  chemically synthesized
tactcttacagacatccttt

SEQ ID NO: 17312 - DNA, 20 bp, Artificial Sequence
  chemically synthesized
tcttacagacatcctttcag

SEQ ID NO: 17313 - DNA, 20 bp, Artificial Sequence
  chemically synthesized
gacatcctttcagtggtcaa

SEQ ID NO: 17314 - DNA, 20 bp, Artificial Sequence
  chemically synthesized
catcctttcagtggtcaata

SEQ ID NO: 17315 - DNA, 20 bp, Artificial Sequence
  chemically synthesized
ttcagtggtcaatagagatg

SEQ ID NO: 17316 - DNA, 20 bp, Artificial Sequence
  chemically synthesized
agatgcagctttcctaaatg

SEQ ID NO: 17317 - DNA, 20 bp, Artificial Sequence
  chemically synthesized
cctaaatgtagtttgtatgt

SEQ ID NO: 17318 - DNA, 20 bp, Artificial Sequence
  chemically synthesized
tgttagcacaatgtgcattt

SEQ ID NO: 17319 - DNA, 20 bp, Artificial Sequence
  chemically synthesized
gcattttagaccaaacaaca

SEQ ID NO: 17320 - DNA, 20 bp, Artificial Sequence
  chemically synthesized
cattttagaccaaacaacaa

SEQ ID NO: 17321 - DNA, 20 bp, Artificial Sequence
  chemically synthesized
gaccaaacaacaaaggcaac

SEQ ID NO: 17322 - DNA, 20 bp, Artificial Sequence
  chemically synthesized
cagaaaacgacgtttctaaa

SEQ ID NO: 17323 - DNA, 20 bp, Artificial Sequence
  chemically synthesized
taaactctgtatgccaactt

SEQ ID NO: 17324 - DNA, 20 bp, Artificial Sequence
  chemically synthesized
acaaataaataaattttaca

SEQ ID NO: 17325 - DNA, 20 bp, Artificial Sequence
  chemically synthesized
aaataaataaattttacaca

SEQ ID NO: 17326 - DNA, 20 bp, Artificial Sequence
  chemically synthesized
ccccccacgtcctactttca

SEQ ID NO: 17327 - DNA, 20 bp, Artificial Sequence
  chemically synthesized
cgcacaataactgaatcctt

SEQ ID NO: 17328 - DNA, 20 bp, Artificial Sequence
  chemically synthesized
gcacaataactgaatccttc

SEQ ID NO: 17329 - DNA, 20 bp, Artificial Sequence
  chemically synthesized
acaataactgaatccttcag

SEQ ID NO: 17330 - DNA, 20 bp, Artificial Sequence
  chemically synthesized
ataactgaatccttcaggag

SEQ ID NO: 17331 - DNA, 20 bp, Artificial Sequence
  chemically synthesized
cttcaggagtagtcatttat

SEQ ID NO: 17332 - DNA, 20 bp, Artificial Sequence
  chemically synthesized
ttatttttcctgcatccaaa

SEQ ID NO: 17333 - DNA, 20 bp, Artificial Sequence
  chemically synthesized
tatttttcctgcatccaaat

SEQ ID NO: 17334 - DNA, 20 bp, Artificial Sequence
  chemically synthesized
tccaaatgggccttctaatt

SEQ ID NO: 17335 - DNA, 20 bp, Artificial Sequence
  chemically synthesized
caaatgggccttctaatttg

SEQ ID NO: 17336 - DNA, 20 bp, Artificial Sequence
  chemically synthesized
tggagaaatactgcattatt

SEQ ID NO: 17337 - DNA, 20 bp, Artificial Sequence
  chemically synthesized
aatactgcattatttagctt

SEQ ID NO: 17338 - DNA, 20 bp, Artificial Sequence
  chemically synthesized
cattatttagctttagtttt

SEQ ID NO: 17339 - DNA, 20 bp, Artificial Sequence
  chemically synthesized
atttagctttagttttcagt

SEQ ID NO: 17340 - DNA, 20 bp, Artificial Sequence
  chemically synthesized
gtattttcttatcaaatctc

SEQ ID NO: 17341 - DNA, 20 bp, Artificial Sequence
  chemically synthesized
tcaaatctctggaatatttt

SEQ ID NO: 17342 - DNA, 20 bp, Artificial Sequence
  chemically synthesized
aaatctctggaatattttca

SEQ ID NO: 17343 - DNA, 20 bp, Artificial Sequence
  chemically synthesized
ttttcagagtgctcactgtc

SEQ ID NO: 17344 - DNA, 20 bp, Artificial Sequence
  chemically synthesized
cagatgtaaaataaatatga

SEQ ID NO: 17345 - DNA, 20 bp, Artificial Sequence
  chemically synthesized
ataaatatgaaagatttctt

SEQ ID NO: 17346 - DNA, 20 bp, Artificial Sequence
  chemically synthesized
tatgaaagatttcttaagtg

SEQ ID NO: 17347 - DNA, 20 bp, Artificial Sequence
  chemically synthesized
gaaagatttcttaagtgaag

SEQ ID NO: 17348 - DNA, 20 bp, Artificial Sequence
  chemically synthesized
aagatttcttaagtgaagca

SEQ ID NO: 17349 - DNA, 20 bp, Artificial Sequence
  chemically synthesized
gatttcttaagtgaagcaga

SEQ ID NO: 17350 - DNA, 20 bp, Artificial Sequence
  chemically synthesized
taagtgaagcagagagaatt

SEQ ID NO: 17351 - DNA, 20 bp, Artificial Sequence
  chemically synthesized
gaagcagagagaatttagaa

SEQ ID NO: 17352 - DNA, 20 bp, Artificial Sequence
  chemically synthesized
agaatggaataattatatac

SEQ ID NO: 17353 - DNA, 20 bp, Artificial Sequence
  chemically synthesized
gaatggaataattatatact

SEQ ID NO: 17354 - DNA, 20 bp, Artificial Sequence
  chemically synthesized
tatatactgggttctgaaca

SEQ ID NO: 17355 - DNA, 20 bp, Artificial Sequence
  chemically synthesized
tctgaacatggactttcaat

SEQ ID NO: 17356 - DNA, 20 bp, Artificial Sequence
  chemically synthesized
acatggactttcaatcagaa

SEQ ID NO: 17357 - DNA, 20 bp, Artificial Sequence
  chemically synthesized
tcaatcagaaaagaaaatat

SEQ ID NO: 17358 - DNA, 20 bp, Artificial Sequence
  chemically synthesized
atcagaaaagaaaatattag

SEQ ID NO: 17359 - DNA, 20 bp, Artificial Sequence
  chemically synthesized
gaaaagaaaatattagaagc

SEQ ID NO: 17360 - DNA, 20 bp, Artificial Sequence
  chemically synthesized
atattagaagcaagctcaac

SEQ ID NO: 17361 - DNA, 20 bp, Artificial Sequence
  chemically synthesized
ctcaacgagaacttaaaaat

SEQ ID NO: 17362 - DNA, 20 bp, Artificial Sequence
  chemically synthesized
aacgagaacttaaaaattgg

SEQ ID NO: 17363 - DNA, 20 bp, Artificial Sequence
  chemically synthesized
aacttaaaaattggaagaaa

SEQ ID NO: 17364 - DNA, 20 bp, Artificial Sequence
  chemically synthesized
ttaaaaattggaagaaacag

SEQ ID NO: 17365 - DNA, 20 bp, Artificial Sequence
  chemically synthesized
ttggaagaaacagcagtctt

SEQ ID NO: 17366 - DNA, 20 bp, Artificial Sequence
  chemically synthesized
ggaagaaacagcagtcttca

SEQ ID NO: 17367 - DNA, 20 bp, Artificial Sequence
  chemically synthesized
aagaaacagcagtcttcaga

SEQ ID NO: 17368 - DNA, 20 bp, Artificial Sequence
  chemically synthesized
agaaacagcagtcttcagag

SEQ ID NO: 17369 - DNA, 20 bp, Artificial Sequence
  chemically synthesized
gaggaatgaatgcaactttt

SEQ ID NO: 17370 - DNA, 20 bp, Artificial Sequence
  chemically synthesized
atgaatgcaacttttgagat

SEQ ID NO: 17371 - DNA, 20 bp, Artificial Sequence
  chemically synthesized
ttttgagattagtttcctat

SEQ ID NO: 17372 - DNA, 20 bp, Artificial Sequence
  chemically synthesized
tttgagattagtttcctata

SEQ ID NO: 17373 - DNA, 20 bp, Artificial Sequence
  chemically synthesized
tgagattagtttcctataag

SEQ ID NO: 17374 - DNA, 20 bp, Artificial Sequence
  chemically synthesized
ttagtttcctataaggagat

SEQ ID NO: 17375 - DNA, 20 bp, Artificial Sequence
  chemically synthesized
aggagatcagctgcaaatac

SEQ ID NO: 17376 - DNA, 20 bp, Artificial Sequence
  chemically synthesized
atcagctgcaaatactagcg

SEQ ID NO: 17377 - DNA, 20 bp, Artificial Sequence
  chemically synthesized
tgcaaatactagcgcagaac

SEQ ID NO: 17378 - DNA, 20 bp, Artificial Sequence
  chemically synthesized
aaatactagcgcagaactag

SEQ ID NO: 17379 - DNA, 20 bp, Artificial Sequence
  chemically synthesized
tactagcgcagaactagcag

SEQ ID NO: 17380 - DNA, 20 bp, Artificial Sequence
  chemically synthesized
cgcagaactagcagtagatg

SEQ ID NO: 17381 - DNA, 20 bp, Artificial Sequence
  chemically synthesized
gtcatcccctgttacactaa

SEQ ID NO: 17382 - DNA, 20 bp, Artificial Sequence
  chemically synthesized
tcccctgttacactaatagc

SEQ ID NO: 17383 - DNA, 20 bp, Artificial Sequence
  chemically synthesized
cctgttacactaatagcaag

SEQ ID NO: 17384 - DNA, 20 bp, Artificial Sequence
  chemically synthesized
gttacactaatagcaagtgg

SEQ ID NO: 17385 - DNA, 20 bp, Artificial Sequence
  chemically synthesized
taatagcaagtggtagactg

SEQ ID NO: 17386 - DNA, 20 bp, Artificial Sequence
  chemically synthesized
gcaagtggtagactgcggtt

SEQ ID NO: 17387 - DNA, 20 bp, Artificial Sequence
  chemically synthesized
tgcggttcagacccaatgaa

SEQ ID NO: 17388 - DNA, 20 bp, Artificial Sequence
  chemically synthesized
cagacccaatgaacagcata

SEQ ID NO: 17389 - DNA, 20 bp, Artificial Sequence
  chemically synthesized
aaagacttacaaacactttg

SEQ ID NO: 17390 - DNA, 20 bp, Artificial Sequence
  chemically synthesized
gacttacaaacactttgaag

SEQ ID NO: 17391 - DNA, 20 bp, Artificial Sequence
  chemically synthesized
aaacactttgaagaagattg

SEQ ID NO: 17392 - DNA, 20 bp, Artificial Sequence
  chemically synthesized
aacactttgaagaagattga

SEQ ID NO: 17393 - DNA, 20 bp, Artificial Sequence
  chemically synthesized
actttgaagaagattgaagg

SEQ ID NO: 17394 - DNA, 20 bp, Artificial Sequence
  chemically synthesized
gaaggaagaaactattccat

SEQ ID NO: 17395 - DNA, 20 bp, Artificial Sequence
  chemically synthesized
aatataacattacctttgcc

SEQ ID NO: 17396 - DNA, 20 bp, Artificial Sequence
  chemically synthesized
attatcaaaactatttcatg

SEQ ID NO: 17397 - DNA, 20 bp, Artificial Sequence
  chemically synthesized
aactatttcatgaagtgaaa

SEQ ID NO: 17398 - DNA, 20 bp, Artificial Sequence
  chemically synthesized
tcatgaagtgaaaaagtctc

SEQ ID NO: 17399 - DNA, 20 bp, Artificial Sequence
  chemically synthesized
agtctcgagattttttatgt

SEQ ID NO: 17400 - DNA, 20 bp, Artificial Sequence
  chemically synthesized
ctcgagattttttatgtgag

SEQ ID NO: 17401 - DNA, 20 bp, Artificial Sequence
  chemically synthesized
agattttttatgtgagaagc

SEQ ID NO: 17402 - DNA, 20 bp, Artificial Sequence
  chemically synthesized
attttttatgtgagaagcaa

SEQ ID NO: 17403 - DNA, 20 bp, Artificial Sequence
  chemically synthesized
ttttttatgtgagaagcaag

SEQ ID NO: 17404 - DNA, 20 bp, Artificial Sequence
  chemically synthesized
tttttatgtgagaagcaaga

SEQ ID NO: 17405 - DNA, 20 bp, Artificial Sequence
  chemically synthesized
ttttatgtgagaagcaagag

SEQ ID NO: 17406 - DNA, 20 bp, Artificial Sequence
  chemically synthesized
gtgagaagcaagaggggaaa

SEQ ID NO: 17407 - DNA, 20 bp, Artificial Sequence
  chemically synthesized
agcaagaggggaaatagaaa

SEQ ID NO: 17408 - DNA, 20 bp, Artificial Sequence
  chemically synthesized
gcaagaggggaaatagaaat

SEQ ID NO: 17409 - DNA, 20 bp, Artificial Sequence
  chemically synthesized
agaggggaaatagaaatggg

SEQ ID NO: 17410 - DNA, 20 bp, Artificial Sequence
  chemically synthesized
ggtggtgatatctaaattta

SEQ ID NO: 17411 - DNA, 20 bp, Artificial Sequence
  chemically synthesized
gtgatatctaaatttatagt

SEQ ID NO: 17412 - DNA, 20 bp, Artificial Sequence
  chemically synthesized
ttatagttggttattttttt

SEQ ID NO: 17413 - DNA, 20 bp, Artificial Sequence
  chemically synthesized
tagttggttatttttttcag

SEQ ID NO: 17414 - DNA, 20 bp, Artificial Sequence
  chemically synthesized
ttttttcagaagaaaaatgt

SEQ ID NO: 17415 - DNA, 20 bp, Artificial Sequence
  chemically synthesized
tttttcagaagaaaaatgtc

SEQ ID NO: 17416 - DNA, 20 bp, Artificial Sequence
  chemically synthesized
tttcagaagaaaaatgtcag

SEQ ID NO: 17417 - DNA, 20 bp, Artificial Sequence
  chemically synthesized
aaaaatgtcaggagacaaaa

SEQ ID NO: 17418 - DNA, 20 bp, Artificial Sequence
  chemically synthesized
atgtcaggagacaaaataga

SEQ ID NO: 17419 - DNA, 20 bp, Artificial Sequence
  chemically synthesized
caggagacaaaatagaaagc

SEQ ID NO: 17420 - DNA, 20 bp, Artificial Sequence
  chemically synthesized
agacaaaatagaaagctgga

SEQ ID NO: 17421 - DNA, 20 bp, Artificial Sequence
  chemically synthesized
caaaatagaaagctggaaag

SEQ ID NO: 17422 - DNA, 20 bp, Artificial Sequence
  chemically synthesized
agaaagctggaaagaagaaa

SEQ ID NO: 17423 - DNA, 20 bp, Artificial Sequence
  chemically synthesized
tggaaagaagaaaaagtatt

SEQ ID NO: 17424 - DNA, 20 bp, Artificial Sequence
  chemically synthesized
aagaagaaaaagtattaagt

SEQ ID NO: 17425 - DNA, 20 bp, Artificial Sequence
  chemically synthesized
aaaaagtattaagttagttt

SEQ ID NO: 17426 - DNA, 20 bp, Artificial Sequence
  chemically synthesized
aagtattaagttagtttcag

SEQ ID NO: 17427 - DNA, 20 bp, Artificial Sequence
  chemically synthesized
aagttagtttcagcagacaa

SEQ ID NO: 17428 - DNA, 20 bp, Artificial Sequence
  chemically synthesized
agttagtttcagcagacaat

SEQ ID NO: 17429 - DNA, 20 bp, Artificial Sequence
  chemically synthesized
tagtttcagcagacaatggg

SEQ ID NO: 17430 - DNA, 20 bp, Artificial Sequence
  chemically synthesized
tttcagcagacaatgggaag

SEQ ID NO: 17431 - DNA, 20 bp, Artificial Sequence
  chemically synthesized
ttcagcagacaatgggaaga

SEQ ID NO: 17432 - DNA, 20 bp, Artificial Sequence
  chemically synthesized
gacaatgggaagaaggaaaa

SEQ ID NO: 17433 - DNA, 20 bp, Artificial Sequence
  chemically synthesized
acaatgggaagaaggaaaac

SEQ ID NO: 17434 - DNA, 20 bp, Artificial Sequence
  chemically synthesized
caatgggaagaaggaaaacg

SEQ ID NO: 17435 - DNA, 20 bp, Artificial Sequence
  chemically synthesized
gggaagaaggaaaacggggc

SEQ ID NO: 17436 - DNA, 20 bp, Artificial Sequence
  chemically synthesized
ggaagaaggaaaacggggct

SEQ ID NO: 17437 - DNA, 20 bp, Artificial Sequence
  chemically synthesized
gaaaacggggctgggatatc

SEQ ID NO: 17438 - DNA, 20 bp, Artificial Sequence
  chemically synthesized
ctgggatatctggcttccac

SEQ ID NO: 17439 - DNA, 20 bp, Artificial Sequence
  chemically synthesized
tctggcttccacgagatgat

SEQ ID NO: 17440 - DNA, 20 bp, Artificial Sequence
  chemically synthesized
gaaatgtgtttgctgctatt

SEQ ID NO: 17441 - DNA, 20 bp, Artificial Sequence
  chemically synthesized
gtttgctgctatttagctgt

SEQ ID NO: 17442 - DNA, 20 bp, Artificial Sequence
  chemically synthesized
agtctgtatcacacgccttt

SEQ ID NO: 17443 - DNA, 20 bp, Artificial Sequence
  chemically synthesized
ctgtatcacacgccttttag

SEQ ID NO: 17444 - DNA, 20 bp, Artificial Sequence
  chemically synthesized
cttttagtagtaaaatatgc

SEQ ID NO: 17445 - DNA, 20 bp, Artificial Sequence
  chemically synthesized
gtaaaatatgccagtctact

SEQ ID NO: 17446 - DNA, 20 bp, Artificial Sequence
  chemically synthesized
taaaatatgccagtctacta

SEQ ID NO: 17447 - DNA, 20 bp, Artificial Sequence
  chemically synthesized
aaaatatgccagtctactaa

SEQ ID NO: 17448 - DNA, 20 bp, Artificial Sequence
  chemically synthesized
taagggaaattacatttcat

SEQ ID NO: 17449 - DNA, 20 bp, Artificial Sequence
  chemically synthesized
ggaaattacatttcatgagt

SEQ ID NO: 17450 - DNA, 20 bp, Artificial Sequence
  chemically synthesized
tttcatgagtaagcttccta

SEQ ID NO: 17451 - DNA, 20 bp, Artificial Sequence
  chemically synthesized
gagtaagcttcctaaagttc

SEQ ID NO: 17452 - DNA, 20 bp, Artificial Sequence
  chemically synthesized
agttctagatatttgctgtt

SEQ ID NO: 17453 - DNA, 20 bp, Artificial Sequence
  chemically synthesized
tttgctgtttagcctcacac

SEQ ID NO: 17454 - DNA, 20 bp, Artificial Sequence
  chemically synthesized
cacaagtttgcttactaatc

SEQ ID NO: 17455 - DNA, 20 bp, Artificial Sequence
  chemically synthesized
agtttgcttactaatcaagc

SEQ ID NO: 17456 - DNA, 20 bp, Artificial Sequence
  chemically synthesized
taatcaagcaagatcctttt

SEQ ID NO: 17457 - DNA, 20 bp, Artificial Sequence
  chemically synthesized
atcaagcaagatccttttca

SEQ ID NO: 17458 - DNA, 20 bp, Artificial Sequence
  chemically synthesized
aagatccttttcagagtaac

SEQ ID NO: 17459 - DNA, 20 bp, Artificial Sequence
  chemically synthesized
tttcagagtaactagtttca

SEQ ID NO: 17460 - DNA, 20 bp, Artificial Sequence
  chemically synthesized
gagtaactagtttcaaagta

SEQ ID NO: 17461 - DNA, 20 bp, Artificial Sequence
  chemically synthesized
gtaactagtttcaaagtatg

SEQ ID NO: 17462 - DNA, 20 bp, Artificial Sequence
  chemically synthesized
ttattcaaattcacctttat

SEQ ID NO: 17463 - DNA, 20 bp, Artificial Sequence
  chemically synthesized
tccaactgcacatttttctt

SEQ ID NO: 17464 - DNA, 20 bp, Artificial Sequence
  chemically synthesized
agatgaactgtatttgaccc

SEQ ID NO: 17465 - DNA, 20 bp, Artificial Sequence
  chemically synthesized
gtatttgacccaagctgctt

SEQ ID NO: 17466 - DNA, 20 bp, Artificial Sequence
  chemically synthesized
cttgactatttctgaaatca

SEQ ID NO: 17467 - DNA, 20 bp, Artificial Sequence
  chemically synthesized
aatcatagttactcttcttt

SEQ ID NO: 17468 - DNA, 20 bp, Artificial Sequence
  chemically synthesized
cttcctgtattctttttctt

SEQ ID NO: 17469 - DNA, 20 bp, Artificial Sequence
  chemically synthesized
ttctttttcttcagcatcac

SEQ ID NO: 17470 - DNA, 20 bp, Artificial Sequence
  chemically synthesized
cactggcattccctctttat

SEQ ID NO: 17471 - DNA, 20 bp, Artificial Sequence
  chemically synthesized
actggcattccctctttatt

SEQ ID NO: 17472 - DNA, 20 bp, Artificial Sequence
  chemically synthesized
taaaaatttctcgctcacat

SEQ ID NO: 17473 - DNA, 20 bp, Artificial Sequence
  chemically synthesized
ttaaaattgaatctaactct

SEQ ID NO: 17474 - DNA, 20 bp, Artificial Sequence
  chemically synthesized
taaaattgaatctaactctg

SEQ ID NO: 17475 - DNA, 20 bp, Artificial Sequence
  chemically synthesized
atctaactctgaggaaaaaa

SEQ ID NO: 17476 - DNA, 20 bp, Artificial Sequence
  chemically synthesized
actctgaggaaaaaaaagtg

SEQ ID NO: 17477 - DNA, 20 bp, Artificial Sequence
  chemically synthesized
aaaaagtgtggatataaaac

SEQ ID NO: 17478 - DNA, 20 bp, Artificial Sequence
  chemically synthesized
aaaagtgtggatataaaacc

SEQ ID NO: 17479 - DNA, 20 bp, Artificial Sequence
  chemically synthesized
aaagtgtggatataaaacca

SEQ ID NO: 17480 - DNA, 20 bp, Artificial Sequence
  chemically synthesized
ataaaaccagggttcctttt

SEQ ID NO: 17481 - DNA, 20 bp, Artificial Sequence
  chemically synthesized
ccagggttccttttcagtaa

SEQ ID NO: 17482 - DNA, 20 bp, Artificial Sequence
  chemically synthesized
cagggttccttttcagtaat

SEQ ID NO: 17483 - DNA, 20 bp, Artificial Sequence
  chemically synthesized
gggttccttttcagtaatgg

SEQ ID NO: 17484 - DNA, 20 bp, Artificial Sequence
  chemically synthesized
gttccttttcagtaatggga

SEQ ID NO: 17485 - DNA, 20 bp, Artificial Sequence
  chemically synthesized
ttccttttcagtaatgggag

SEQ ID NO: 17486 - DNA, 20 bp, Artificial Sequence
  chemically synthesized
tttcagtaatgggagaggcc

SEQ ID NO: 17487 - DNA, 20 bp, Artificial Sequence
  chemically synthesized
tgggagaggcccagaaatcc

SEQ ID NO: 17488 - DNA, 20 bp, Artificial Sequence
  chemically synthesized
ggagaggcccagaaatccta

SEQ ID NO: 17489 - DNA, 20 bp, Artificial Sequence
  chemically synthesized
ccagaaatcctagagatctt

SEQ ID NO: 17490 - DNA, 20 bp, Artificial Sequence
  chemically synthesized
agatcttgagattctgaaat

SEQ ID NO: 17491 - DNA, 20 bp, Artificial Sequence
  chemically synthesized
gatcttgagattctgaaata

SEQ ID NO: 17492 - DNA, 20 bp, Artificial Sequence
  chemically synthesized
atcttgagattctgaaataa

SEQ ID NO: 17493 - DNA, 20 bp, Artificial Sequence
  chemically synthesized
agattctgaaataagggctc

SEQ ID NO: 17494 - DNA, 20 bp, Artificial Sequence
  chemically synthesized
ggctcaagccctactctgcc

SEQ ID NO: 17495 - DNA, 20 bp, Artificial Sequence
  chemically synthesized
gccctactctgcccagaaaa

SEQ ID NO: 17496 - DNA, 20 bp, Artificial Sequence
  chemically synthesized
ccctactctgcccagaaaat

SEQ ID NO: 17497 - DNA, 20 bp, Artificial Sequence
  chemically synthesized
aatgcttctttgaatctgct

SEQ ID NO: 17498 - DNA, 20 bp, Artificial Sequence
  chemically synthesized
ggtcttgatgctataaatga

SEQ ID NO: 17499 - DNA, 20 bp, Artificial Sequence
  chemically synthesized
gtcttgatgctataaatgat

SEQ ID NO: 17500 - DNA, 20 bp, Artificial Sequence
  chemically synthesized
taaatgataggattcacgaa

SEQ ID NO: 17501 - DNA, 20 bp, Artificial Sequence
  chemically synthesized
aatgataggattcacgaatg

SEQ ID NO: 17502 - DNA, 20 bp, Artificial Sequence
  chemically synthesized
atgataggattcacgaatgg

SEQ ID NO: 17503 - DNA, 20 bp, Artificial Sequence
  chemically synthesized
taggattcacgaatggagga

SEQ ID NO: 17504 - DNA, 20 bp, Artificial Sequence
  chemically synthesized
ggattcacgaatggaggaaa

SEQ ID NO: 17505 - DNA, 20 bp, Artificial Sequence
  chemically synthesized
cgaatggaggaaagagaaaa

SEQ ID NO: 17506 - DNA, 20 bp, Artificial Sequence
  chemically synthesized
gaggaaagagaaaatggaca

SEQ ID NO: 17507 - DNA, 20 bp, Artificial Sequence
  chemically synthesized
gagaaaatggacatagctca

SEQ ID NO: 17508 - DNA, 20 bp, Artificial Sequence
  chemically synthesized
atggacatagctcatggtaa

SEQ ID NO: 17509 - DNA, 20 bp, Artificial Sequence
  chemically synthesized
tggacatagctcatggtaat

SEQ ID NO: 17510 - DNA, 20 bp, Artificial Sequence
  chemically synthesized
ggacatagctcatggtaatg

SEQ ID NO: 17511 - DNA, 20 bp, Artificial Sequence
  chemically synthesized
catggtaatggggaccacat

SEQ ID NO: 17512 - DNA, 20 bp, Artificial Sequence
  chemically synthesized
atggtaatggggaccacatg

SEQ ID NO: 17513 - DNA, 20 bp, Artificial Sequence
  chemically synthesized
ccaaacctgtgaatgaatga

SEQ ID NO: 17514 - DNA, 20 bp, Artificial Sequence
  chemically synthesized
aatgaatgacagtcccatca

SEQ ID NO: 17515 - DNA, 20 bp, Artificial Sequence
  chemically synthesized
atcacagtgatgtgaaatac

SEQ ID NO: 17516 - DNA, 20 bp, Artificial Sequence
  chemically synthesized
tcacagtgatgtgaaatact

SEQ ID NO: 17517 - DNA, 20 bp, Artificial Sequence
  chemically synthesized
tgatgtgaaatactaggaca

SEQ ID NO: 17518 - DNA, 20 bp, Artificial Sequence
  chemically synthesized
atactaggacacagctaata

SEQ ID NO: 17519 - DNA, 20 bp, Artificial Sequence
  chemically synthesized
tactaggacacagctaatat

SEQ ID NO: 17520 - DNA, 20 bp, Artificial Sequence
  chemically synthesized
ctaggacacagctaatatgg

SEQ ID NO: 17521 - DNA, 20 bp, Artificial Sequence
  chemically synthesized
acagctaatatgggagacac

SEQ ID NO: 17522 - DNA, 20 bp, Artificial Sequence
  chemically synthesized
atatgggagacacaagtgtt

SEQ ID NO: 17523 - DNA, 20 bp, Artificial Sequence
  chemically synthesized
atgggagacacaagtgttga

SEQ ID NO: 17524 - DNA, 20 bp, Artificial Sequence
  chemically synthesized
gacacaagtgttgagagatt

SEQ ID NO: 17525 - DNA, 20 bp, Artificial Sequence
  chemically synthesized
agatttagcttcctcttgtc

SEQ ID NO: 17526 - DNA, 20 bp, Artificial Sequence
  chemically synthesized
gcaatgcccatcactgtctt

SEQ ID NO: 17527 - DNA, 20 bp, Artificial Sequence
  chemically synthesized
caatgcccatcactgtcttg

SEQ ID NO: 17528 - DNA, 20 bp, Artificial Sequence
  chemically synthesized
cccatcactgtcttgaggat

SEQ ID NO: 17529 - DNA, 20 bp, Artificial Sequence
  chemically synthesized
tgtcttgaggattagtatat

SEQ ID NO: 17530 - DNA, 20 bp, Artificial Sequence
  chemically synthesized
tgaggattagtatataagaa

SEQ ID NO: 17531 - DNA, 20 bp, Artificial Sequence
  chemically synthesized
atataagaaaagatgatgat

SEQ ID NO: 17532 - DNA, 20 bp, Artificial Sequence
  chemically synthesized
ataagaaaagatgatgatta

SEQ ID NO: 17533 - DNA, 20 bp, Artificial Sequence
  chemically synthesized
tgatgattagagcatctaaa

SEQ ID NO: 17534 - DNA, 20 bp, Artificial Sequence
  chemically synthesized
gattagagcatctaaaaaga

SEQ ID NO: 17535 - DNA, 20 bp, Artificial Sequence
  chemically synthesized
agcatctaaaaagacagtca

SEQ ID NO: 17536 - DNA, 20 bp, Artificial Sequence
  chemically synthesized
atctaaaaagacagtcaaag

SEQ ID NO: 17537 - DNA, 20 bp, Artificial Sequence
  chemically synthesized
gtcaaagaagtctgaataat

SEQ ID NO: 17538 - DNA, 20 bp, Artificial Sequence
  chemically synthesized
tatgtgattaaacgtgatat

SEQ ID NO: 17539 - DNA, 20 bp, Artificial Sequence
  chemically synthesized
gattaaacgtgatatcagca

SEQ ID NO: 17540 - DNA, 20 bp, Artificial Sequence
  chemically synthesized
attaaacgtgatatcagcac

SEQ ID NO: 17541 - DNA, 20 bp, Artificial Sequence
  chemically synthesized
aacgtgatatcagcacaggc

SEQ ID NO: 17542 - DNA, 20 bp, Artificial Sequence
  chemically synthesized
cgagttttatgacatcttga

SEQ ID NO: 17543 - DNA, 20 bp, Artificial Sequence
  chemically synthesized
agttttatgacatcttgatg

SEQ ID NO: 17544 - DNA, 20 bp, Artificial Sequence
  chemically synthesized
gttttatgacatcttgatgg

SEQ ID NO: 17545 - DNA, 20 bp, Artificial Sequence
  chemically synthesized
gatggaggcaaaatgtgtgc

SEQ ID NO: 17546 - DNA, 20 bp, Artificial Sequence
  chemically synthesized
tggaggcaaaatgtgtgcaa

SEQ ID NO: 17547 - DNA, 20 bp, Artificial Sequence
  chemically synthesized
ggaggcaaaatgtgtgcaag

SEQ ID NO: 17548 - DNA, 20 bp, Artificial Sequence
  chemically synthesized
gaggcaaaatgtgtgcaaga

SEQ ID NO: 17549 - DNA, 20 bp, Artificial Sequence
  chemically synthesized
aaaatgtgtgcaagagggca

SEQ ID NO: 17550 - DNA, 20 bp, Artificial Sequence
  chemically synthesized
aaatgtgtgcaagagggcac

SEQ ID NO: 17551 - DNA, 20 bp, Artificial Sequence
  chemically synthesized
agggcacgggaaccacaata

SEQ ID NO: 17552 - DNA, 20 bp, Artificial Sequence
  chemically synthesized
gggcacgggaaccacaatat

SEQ ID NO: 17553 - DNA, 20 bp, Artificial Sequence
  chemically synthesized
cacgggaaccacaatatggg

SEQ ID NO: 17554 - DNA, 20 bp, Artificial Sequence
  chemically synthesized
gggaaccacaatatgggtag

SEQ ID NO: 17555 - DNA, 20 bp, Artificial Sequence
  chemically synthesized
aaccacaatatgggtagcag

SEQ ID NO: 17556 - DNA, 20 bp, Artificial Sequence
  chemically synthesized
ccacaatatgggtagcagta

SEQ ID NO: 17557 - DNA, 20 bp, Artificial Sequence
  chemically synthesized
tatgggtagcagtagagtga

SEQ ID NO: 17558 - DNA, 20 bp, Artificial Sequence
  chemically synthesized
gcagtagagtgaaagaatta

SEQ ID NO: 17559 - DNA, 20 bp, Artificial Sequence
  chemically synthesized
cagtagagtgaaagaattat

SEQ ID NO: 17560 - DNA, 20 bp, Artificial Sequence
  chemically synthesized
tgaaagaattatgggcaaaa

SEQ ID NO: 17561 - DNA, 20 bp, Artificial Sequence
  chemically synthesized
atggacataaaacctctcat

SEQ ID NO: 17562 - DNA, 20 bp, Artificial Sequence
  chemically synthesized
aaacctctcatcagtacccc

SEQ ID NO: 17563 - DNA, 20 bp, Artificial Sequence
  chemically synthesized
ccagtcctatgttcatcact

SEQ ID NO: 17564 - DNA, 20 bp, Artificial Sequence
  chemically synthesized
cagtcctatgttcatcactc

SEQ ID NO: 17565 - DNA, 20 bp, Artificial Sequence
  chemically synthesized
tatgttcatcactcgggaat

SEQ ID NO: 17566 - DNA, 20 bp, Artificial Sequence
  chemically synthesized
ttcatcactcgggaattggt

SEQ ID NO: 17567 - DNA, 20 bp, Artificial Sequence
  chemically synthesized
ctcgggaattggtaagaatg

SEQ ID NO: 17568 - DNA, 20 bp, Artificial Sequence
  chemically synthesized
gtaagaatgcagttgtacct

SEQ ID NO: 17569 - DNA, 20 bp, Artificial Sequence
  chemically synthesized
agaatgcagttgtacctcag

SEQ ID NO: 17570 - DNA, 20 bp, Artificial Sequence
  chemically synthesized
agttgtacctcagtggtgtg

SEQ ID NO: 17571 - DNA, 20 bp, Artificial Sequence
  chemically synthesized
gtacctcagtggtgtgcgga

SEQ ID NO: 17572 - DNA, 20 bp, Artificial Sequence
  chemically synthesized
gtgtgcggatggcaatgaaa

SEQ ID NO: 17573 - DNA, 20 bp, Artificial Sequence
  chemically synthesized
ggatggcaatgaaacagtca

SEQ ID NO: 17574 - DNA, 20 bp, Artificial Sequence
  chemically synthesized
gatggcaatgaaacagtcat

SEQ ID NO: 17575 - DNA, 20 bp, Artificial Sequence
  chemically synthesized
aaacagtcataggccaaaac

SEQ ID NO: 17576 - DNA, 20 bp, Artificial Sequence
  chemically synthesized
agtcataggccaaaacaagc

SEQ ID NO: 17577 - DNA, 20 bp, Artificial Sequence
  chemically synthesized
caagatacctgattctacaa

SEQ ID NO: 17578 - DNA, 20 bp, Artificial Sequence
  chemically synthesized
atacctgattctacaatggc

SEQ ID NO: 17579 - DNA, 20 bp, Artificial Sequence
  chemically synthesized
caatggccagtgaatgaatg

SEQ ID NO: 17580 - DNA, 20 bp, Artificial Sequence
  chemically synthesized
aatggccagtgaatgaatga

SEQ ID NO: 17581 - DNA, 20 bp, Artificial Sequence
  chemically synthesized
ccagtgaatgaatgaaggat

SEQ ID NO: 17582 - DNA, 20 bp, Artificial Sequence
  chemically synthesized
cagtgaatgaatgaaggatt

SEQ ID NO: 17583 - DNA, 20 bp, Artificial Sequence
  chemically synthesized
gaatgaaggattgggtgaaa

SEQ ID NO: 17584 - DNA, 20 bp, Artificial Sequence
  chemically synthesized
aatgaaggattgggtgaaac

SEQ ID NO: 17585 - DNA, 20 bp, Artificial Sequence
  chemically synthesized
gaaggattgggtgaaacagg

SEQ ID NO: 17586 - DNA, 20 bp, Artificial Sequence
  chemically synthesized
attgggtgaaacaggcagca

SEQ ID NO: 17587 - DNA, 20 bp, Artificial Sequence
  chemically synthesized
ttgggtgaaacaggcagcat

SEQ ID NO: 17588 - DNA, 20 bp, Artificial Sequence
  chemically synthesized
cagcatgggcaatctccctc

SEQ ID NO: 17589 - DNA, 20 bp, Artificial Sequence
  chemically synthesized
tgggcaatctccctctggtc

SEQ ID NO: 17590 - DNA, 20 bp, Artificial Sequence
  chemically synthesized
gcaatctccctctggtctag

SEQ ID NO: 17591 - DNA, 20 bp, Artificial Sequence
  chemically synthesized
atctccctctggtctagcag

SEQ ID NO: 17592 - DNA, 20 bp, Artificial Sequence
  chemically synthesized
tctccctctggtctagcagc

SEQ ID NO: 17593 - DNA, 20 bp, Artificial Sequence
  chemically synthesized
tggtctagcagcaggacacc

SEQ ID NO: 17594 - DNA, 20 bp, Artificial Sequence
  chemically synthesized
ggtctagcagcaggacaccc

SEQ ID NO: 17595 - DNA, 20 bp, Artificial Sequence
  chemically synthesized
cagcaggacacccaggactg

SEQ ID NO: 17596 - DNA, 20 bp, Artificial Sequence
  chemically synthesized
agcaggacacccaggactgt

SEQ ID NO: 17597 - DNA, 20 bp, Artificial Sequence
  chemically synthesized
acccaggactgtgggcattg

SEQ ID NO: 17598 - DNA, 20 bp, Artificial Sequence
  chemically synthesized
attgtagtgaatgtcatccc

SEQ ID NO: 17599 - DNA, 20 bp, Artificial Sequence
  chemically synthesized
ttgtagtgaatgtcatccca

SEQ ID NO: 17600 - DNA, 20 bp, Artificial Sequence
  chemically synthesized
atcccaaggtccgtgtctgc

SEQ ID NO: 17601 - DNA, 20 bp, Artificial Sequence
  chemically synthesized
aaggtccgtgtctgccagca

SEQ ID NO: 17602 - DNA, 20 bp, Artificial Sequence
  chemically synthesized
tccgtgtctgccagcatagc

SEQ ID NO: 17603 - DNA, 20 bp, Artificial Sequence
  chemically synthesized
ccgtgtctgccagcatagcc

SEQ ID NO: 17604 - DNA, 20 bp, Artificial Sequence
  chemically synthesized
tgtctgccagcatagccagg

SEQ ID NO: 17605 - DNA, 20 bp, Artificial Sequence
  chemically synthesized
ctgccagcatagccaggaag

SEQ ID NO: 17606 - DNA, 20 bp, Artificial Sequence
  chemically synthesized
catagccaggaagtagtaca

SEQ ID NO: 17607 - DNA, 20 bp, Artificial Sequence
  chemically synthesized
atagccaggaagtagtacat

SEQ ID NO: 17608 - DNA, 20 bp, Artificial Sequence
  chemically synthesized
ggaagtagtacatgggctca

SEQ ID NO: 17609 - DNA, 20 bp, Artificial Sequence
  chemically synthesized
aagtagtacatgggctcatg

SEQ ID NO: 17610 - DNA, 20 bp, Artificial Sequence
  chemically synthesized
agtagtacatgggctcatgg

SEQ ID NO: 17611 - DNA, 20 bp, Artificial Sequence
  chemically synthesized
aggctgtgatcattccaaat

SEQ ID NO: 17612 - DNA, 20 bp, Artificial Sequence
  chemically synthesized
ggctgtgatcattccaaatg

SEQ ID NO: 17613 - DNA, 20 bp, Artificial Sequence
  chemically synthesized
tgatcattccaaatgaggac

SEQ ID NO: 17614 - DNA, 20 bp, Artificial Sequence
  chemically synthesized
tcattccaaatgaggacaag

SEQ ID NO: 17615 - DNA, 20 bp, Artificial Sequence
  chemically synthesized
attccaaatgaggacaagaa

SEQ ID NO: 17616 - DNA, 20 bp, Artificial Sequence
  chemically synthesized
agaagagtgccatttccaaa

SEQ ID NO: 17617 - DNA, 20 bp, Artificial Sequence
  chemically synthesized
gaagagtgccatttccaaaa

SEQ ID NO: 17618 - DNA, 20 bp, Artificial Sequence
  chemically synthesized
agtgccatttccaaaaagga

SEQ ID NO: 17619 - DNA, 20 bp, Artificial Sequence
  chemically synthesized
tgccatttccaaaaaggacg

SEQ ID NO: 17620 - DNA, 20 bp, Artificial Sequence
  chemically synthesized
catttccaaaaaggacggag

SEQ ID NO: 17621 - DNA, 20 bp, Artificial Sequence
  chemically synthesized
ttccaaaaaggacggagaag

SEQ ID NO: 17622 - DNA, 20 bp, Artificial Sequence
  chemically synthesized
ggacggagaagtagatgaca

SEQ ID NO: 17623 - DNA, 20 bp, Artificial Sequence
  chemically synthesized
cggagaagtagatgacaaag

SEQ ID NO: 17624 - DNA, 20 bp, Artificial Sequence
  chemically synthesized
ggagaagtagatgacaaaga

SEQ ID NO: 17625 - DNA, 20 bp, Artificial Sequence
  chemically synthesized
gtagatgacaaagaaggaca

SEQ ID NO: 17626 - DNA, 20 bp, Artificial Sequence
  chemically synthesized
agatgacaaagaaggacata

SEQ ID NO: 17627 - DNA, 20 bp, Artificial Sequence
  chemically synthesized
caaagaaggacatagagatc

SEQ ID NO: 17628 - DNA, 20 bp, Artificial Sequence
  chemically synthesized
agaaggacatagagatccgg

SEQ ID NO: 17629 - DNA, 20 bp, Artificial Sequence
  chemically synthesized
tccggtagtgaactgcctct

SEQ ID NO: 17630 - DNA, 20 bp, Artificial Sequence
  chemically synthesized
agtgaactgcctctgagccc

SEQ ID NO: 17631 - DNA, 20 bp, Artificial Sequence
  chemically synthesized
gaactgcctctgagcccaag

SEQ ID NO: 17632 - DNA, 20 bp, Artificial Sequence
  chemically synthesized
tgcctctgagcccaagaagc

SEQ ID NO: 17633 - DNA, 20 bp, Artificial Sequence
  chemically synthesized
tctgagcccaagaagccagt

SEQ ID NO: 17634 - DNA, 20 bp, Artificial Sequence
  chemically synthesized
agcccaagaagccagtcagc

SEQ ID NO: 17635 - DNA, 20 bp, Artificial Sequence
  chemically synthesized
ccaagaagccagtcagcaag

SEQ ID NO: 17636 - DNA, 20 bp, Artificial Sequence
  chemically synthesized
caagaagccagtcagcaaga

SEQ ID NO: 17637 - DNA, 20 bp, Artificial Sequence
  chemically synthesized
aagaagccagtcagcaagaa

SEQ ID NO: 17638 - DNA, 20 bp, Artificial Sequence
  chemically synthesized
agaagccagtcagcaagaag

SEQ ID NO: 17639 - DNA, 20 bp, Artificial Sequence
  chemically synthesized
gccagtcagcaagaaggggc

SEQ ID NO: 17640 - DNA, 20 bp, Artificial Sequence
  chemically synthesized
agcactgttgttataccaca

SEQ ID NO: 17641 - DNA, 20 bp, Artificial Sequence
  chemically synthesized
actgttgttataccacatgg

SEQ ID NO: 17642 - DNA, 20 bp, Artificial Sequence
  chemically synthesized
ctgttgttataccacatggt

SEQ ID NO: 17643 - DNA, 20 bp, Artificial Sequence
  chemically synthesized
ataccacatggtaggttttg

SEQ ID NO: 17644 - DNA, 20 bp, Artificial Sequence
  chemically synthesized
taccacatggtaggttttgc

SEQ ID NO: 17645 - DNA, 20 bp, Artificial Sequence
  chemically synthesized
cacatggtaggttttgcagg

SEQ ID NO: 17646 - DNA, 20 bp, Artificial Sequence
  chemically synthesized
catggtaggttttgcaggtg

SEQ ID NO: 17647 - DNA, 20 bp, Artificial Sequence
  chemically synthesized
ggtaggttttgcaggtggag

SEQ ID NO: 17648 - DNA, 20 bp, Artificial Sequence
  chemically synthesized
caggtggagaagatattttt

SEQ ID NO: 17649 - DNA, 20 bp, Artificial Sequence
  chemically synthesized
aggtggagaagatatttttt

SEQ ID NO: 17650 - DNA, 20 bp, Artificial Sequence
  chemically synthesized
ggtggagaagatatttttta

SEQ ID NO: 17651 - DNA, 20 bp, Artificial Sequence
  chemically synthesized
gtggagaagatattttttag

SEQ ID NO: 17652 - DNA, 20 bp, Artificial Sequence
  chemically synthesized
tttaggggtgatgacctcca

SEQ ID NO: 17653 - DNA, 20 bp, Artificial Sequence
  chemically synthesized
ggtgatgacctccaaagatg

SEQ ID NO: 17654 - DNA, 20 bp, Artificial Sequence
  chemically synthesized
tttctctcacaatcttcttg

SEQ ID NO: 17655 - DNA, 20 bp, Artificial Sequence
  chemically synthesized
atcttcttgtagcacatcat

SEQ ID NO: 17656 - DNA, 20 bp, Artificial Sequence
  chemically synthesized
tcttcttgtagcacatcatc

SEQ ID NO: 17657 - DNA, 20 bp, Artificial Sequence
  chemically synthesized
tcaaaacttaaatatttttc

SEQ ID NO: 17658 - DNA, 20 bp, Artificial Sequence
  chemically synthesized
tctcatacttaattaattgt

SEQ ID NO: 17659 - DNA, 20 bp, Artificial Sequence
  chemically synthesized
aattgtaagcctgtactcac

SEQ ID NO: 17660 - DNA, 20 bp, Artificial Sequence
  chemically synthesized
attgtaagcctgtactcaca

SEQ ID NO: 17661 - DNA, 20 bp, Artificial Sequence
  chemically synthesized
gtactcacaaggcctttccc

SEQ ID NO: 17662 - DNA, 20 bp, Artificial Sequence
  chemically synthesized
ataacaaataacaaaaatca

SEQ ID NO: 17663 - DNA, 20 bp, Artificial Sequence
  chemically synthesized
caaataacaaaaatcatggt

SEQ ID NO: 17664 - DNA, 20 bp, Artificial Sequence
  chemically synthesized
aataattccaattcactatg

SEQ ID NO: 17665 - DNA, 20 bp, Artificial Sequence
  chemically synthesized
tcatcttacgtctgtgctca

SEQ ID NO: 17666 - DNA, 20 bp, Artificial Sequence
  chemically synthesized
gtgctcatagccttgactct

SEQ ID NO: 17667 - DNA, 20 bp, Artificial Sequence
  chemically synthesized
ccttgactcttggtcccaaa

SEQ ID NO: 17668 - DNA, 20 bp, Artificial Sequence
  chemically synthesized
cttgactcttggtcccaaat

SEQ ID NO: 17669 - DNA, 20 bp, Artificial Sequence
  chemically synthesized
tcctcctattatttatcata

SEQ ID NO: 17670 - DNA, 20 bp, Artificial Sequence
  chemically synthesized
cctcctattatttatcatat

SEQ ID NO: 17671 - DNA, 20 bp, Artificial Sequence
  chemically synthesized
cccttactgtgttactatcc

SEQ ID NO: 17672 - DNA, 20 bp, Artificial Sequence
  chemically synthesized
actgtgttactatccaagtt

SEQ ID NO: 17673 - DNA, 20 bp, Artificial Sequence
  chemically synthesized
tgttactatccaagttgagt

SEQ ID NO: 17674 - DNA, 20 bp, Artificial Sequence
  chemically synthesized
attttttctcttgaaactaa

SEQ ID NO: 17675 - DNA, 20 bp, Artificial Sequence
  chemically synthesized
ttttttctcttgaaactaat

SEQ ID NO: 17676 - DNA, 20 bp, Artificial Sequence
  chemically synthesized
ttctcttgaaactaatggga

SEQ ID NO: 17677 - DNA, 20 bp, Artificial Sequence
  chemically synthesized
actaatgggacagctgtatt

SEQ ID NO: 17678 - DNA, 20 bp, Artificial Sequence
  chemically synthesized
ctaatgggacagctgtattt

SEQ ID NO: 17679 - DNA, 20 bp, Artificial Sequence
  chemically synthesized
tgtatttaggattaaccact

SEQ ID NO: 17680 - DNA, 20 bp, Artificial Sequence
  chemically synthesized
gtatttaggattaaccactg

SEQ ID NO: 17681 - DNA, 20 bp, Artificial Sequence
  chemically synthesized
tgaggaaaatgcttattcaa

SEQ ID NO: 17682 - DNA, 20 bp, Artificial Sequence
  chemically synthesized
cttattcaatagaaatgact

SEQ ID NO: 17683 - DNA, 20 bp, Artificial Sequence
  chemically synthesized
gtgatcaatgttgctatctc

SEQ ID NO: 17684 - DNA, 20 bp, Artificial Sequence
  chemically synthesized
atcaatgttgctatctcaag

SEQ ID NO: 17685 - DNA, 20 bp, Artificial Sequence
  chemically synthesized
atctcaagtggactgtgaat

SEQ ID NO: 17686 - DNA, 20 bp, Artificial Sequence
  chemically synthesized
tcaagtggactgtgaataag

SEQ ID NO: 17687 - DNA, 20 bp, Artificial Sequence
  chemically synthesized
aagtggactgtgaataagaa

SEQ ID NO: 17688 - DNA, 20 bp, Artificial Sequence
  chemically synthesized
ctgtgaataagaagagaacc

SEQ ID NO: 17689 - DNA, 20 bp, Artificial Sequence
  chemically synthesized
aataagaagagaacccagcc

SEQ ID NO: 17690 - DNA, 20 bp, Artificial Sequence
  chemically synthesized
ataagaagagaacccagcct

SEQ ID NO: 17691 - DNA, 20 bp, Artificial Sequence
  chemically synthesized
agaacccagcctgggcaaca

SEQ ID NO: 17692 - DNA, 20 bp, Artificial Sequence
  chemically synthesized
cccagcctgggcaacatagc

SEQ ID NO: 17693 - DNA, 20 bp, Artificial Sequence
  chemically synthesized
cctgcctccaccaaaaaaaa

SEQ ID NO: 17694 - DNA, 20 bp, Artificial Sequence
  chemically synthesized
ctccaccaaaaaaaaaagaa

SEQ ID NO: 17695 - DNA, 20 bp, Artificial Sequence
  chemically synthesized
aaaaaagaaaagataaaaat

SEQ ID NO: 17696 - DNA, 20 bp, Artificial Sequence
  chemically synthesized
aagaaaagataaaaattagc

SEQ ID NO: 17697 - DNA, 20 bp, Artificial Sequence
  chemically synthesized
agaaaagataaaaattagct

SEQ ID NO: 17698 - DNA, 20 bp, Artificial Sequence
  chemically synthesized
agataaaaattagctgggca

SEQ ID NO: 17699 - DNA, 20 bp, Artificial Sequence
  chemically synthesized
gataaaaattagctgggcac

SEQ ID NO: 17700 - DNA, 20 bp, Artificial Sequence
  chemically synthesized
ataaaaattagctgggcaca

SEQ ID NO: 17701 - DNA, 20 bp, Artificial Sequence
  chemically synthesized
taaaaattagctgggcacag

SEQ ID NO: 17702 - DNA, 20 bp, Artificial Sequence
  chemically synthesized
cacaggggcacacatcacct

SEQ ID NO: 17703 - DNA, 20 bp, Artificial Sequence
  chemically synthesized
gggcacacatcacctgagcc

SEQ ID NO: 17704 - DNA, 20 bp, Artificial Sequence
  chemically synthesized
ggcacacatcacctgagccc

SEQ ID NO: 17705 - DNA, 20 bp, Artificial Sequence
  chemically synthesized
tcacctgagcccaggactgt

SEQ ID NO: 17706 - DNA, 20 bp, Artificial Sequence
  chemically synthesized
cacctgagcccaggactgtg

SEQ ID NO: 17707 - DNA, 20 bp, Artificial Sequence
  chemically synthesized
agcccaggactgtgaggctg

SEQ ID NO: 17708 - DNA, 20 bp, Artificial Sequence
  chemically synthesized
gcccaggactgtgaggctgc

SEQ ID NO: 17709 - DNA, 20 bp, Artificial Sequence
  chemically synthesized
cccaggactgtgaggctgca

SEQ ID NO: 17710 - DNA, 20 bp, Artificial Sequence
  chemically synthesized
caggactgtgaggctgcagg

SEQ ID NO: 17711 - DNA, 20 bp, Artificial Sequence
  chemically synthesized
gctgcagggagctatgattg

SEQ ID NO: 17712 - DNA, 20 bp, Artificial Sequence
  chemically synthesized
atgattgcagcactgctctc

SEQ ID NO: 17713 - DNA, 20 bp, Artificial Sequence
  chemically synthesized
tgcagcactgctctccagcc

SEQ ID NO: 17714 - DNA, 20 bp, Artificial Sequence
  chemically synthesized
gcagcactgctctccagcct

SEQ ID NO: 17715 - DNA, 20 bp, Artificial Sequence
  chemically synthesized
ctgctctccagcctgggcaa

SEQ ID NO: 17716 - DNA, 20 bp, Artificial Sequence
  chemically synthesized
gctctccagcctgggcaacg

SEQ ID NO: 17717 - DNA, 20 bp, Artificial Sequence
  chemically synthesized
tccagcctgggcaacggagt

SEQ ID NO: 17718 - DNA, 20 bp, Artificial Sequence
  chemically synthesized
aataaaataaaataaaacga

SEQ ID NO: 17719 - DNA, 20 bp, Artificial Sequence
  chemically synthesized
gaaaataactcatctattgt

SEQ ID NO: 17720 - DNA, 20 bp, Artificial Sequence
  chemically synthesized
tcatctattgtgagtttcca

SEQ ID NO: 17721 - DNA, 20 bp, Artificial Sequence
  chemically synthesized
agaaatctgaacacctgaac

SEQ ID NO: 17722 - DNA, 20 bp, Artificial Sequence
  chemically synthesized
aatctgaacacctgaacaag

SEQ ID NO: 17723 - DNA, 20 bp, Artificial Sequence
  chemically synthesized
atctgaacacctgaacaagt

SEQ ID NO: 17724 - DNA, 20 bp, Artificial Sequence
  chemically synthesized
aacacctgaacaagtgggta

SEQ ID NO: 17725 - DNA, 20 bp, Artificial Sequence
  chemically synthesized
cctgaacaagtgggtaaagt

SEQ ID NO: 17726 - DNA, 20 bp, Artificial Sequence
  chemically synthesized
taaagttagtaaactcattt

SEQ ID NO: 17727 - DNA, 20 bp, Artificial Sequence
  chemically synthesized
gttagtaaactcattttaga

SEQ ID NO: 17728 - DNA, 20 bp, Artificial Sequence
  chemically synthesized
ttagtaaactcattttagaa

SEQ ID NO: 17729 - DNA, 20 bp, Artificial Sequence
  chemically synthesized
tttagaaaggtgtaattact

SEQ ID NO: 17730 - DNA, 20 bp, Artificial Sequence
  chemically synthesized
agaaaggtgtaattactcag

SEQ ID NO: 17731 - DNA, 20 bp, Artificial Sequence
  chemically synthesized
gtgtaattactcagtggact

SEQ ID NO: 17732 - DNA, 20 bp, Artificial Sequence
  chemically synthesized
tgtaattactcagtggactt

SEQ ID NO: 17733 - DNA, 20 bp, Artificial Sequence
  chemically synthesized
tactcagtggacttgggact

SEQ ID NO: 17734 - DNA, 20 bp, Artificial Sequence
  chemically synthesized
cagtggacttgggactcagc

SEQ ID NO: 17735 - DNA, 20 bp, Artificial Sequence
  chemically synthesized
caagttccctatgctgcaaa

SEQ ID NO: 17736 - DNA, 20 bp, Artificial Sequence
  chemically synthesized
ccctatgctgcaaaaagtct

SEQ ID NO: 17737 - DNA, 20 bp, Artificial Sequence
  chemically synthesized
gctgcaaaaagtctgagttt

SEQ ID NO: 17738 - DNA, 20 bp, Artificial Sequence
  chemically synthesized
aagtctgagttttggcacat

SEQ ID NO: 17739 - DNA, 20 bp, Artificial Sequence
  chemically synthesized
agtctgagttttggcacatt

SEQ ID NO: 17740 - DNA, 20 bp, Artificial Sequence
  chemically synthesized
gtctgagttttggcacatta

SEQ ID NO: 17741 - DNA, 20 bp, Artificial Sequence
  chemically synthesized
attagggacaaacatgaaaa

SEQ ID NO: 17742 - DNA, 20 bp, Artificial Sequence
  chemically synthesized
ttagggacaaacatgaaaat

SEQ ID NO: 17743 - DNA, 20 bp, Artificial Sequence
  chemically synthesized
agggacaaacatgaaaatag

SEQ ID NO: 17744 - DNA, 20 bp, Artificial Sequence
  chemically synthesized
tgaaaataggagactcatgt

SEQ ID NO: 17745 - DNA, 20 bp, Artificial Sequence
  chemically synthesized
aaataggagactcatgttgg

SEQ ID NO: 17746 - DNA, 20 bp, Artificial Sequence
  chemically synthesized
ctcatgttggaagctcataa

SEQ ID NO: 17747 - DNA, 20 bp, Artificial Sequence
  chemically synthesized
gctcataacggaaatatttt

SEQ ID NO: 17748 - DNA, 20 bp, Artificial Sequence
  chemically synthesized
ctcataacggaaatatttta

SEQ ID NO: 17749 - DNA, 20 bp, Artificial Sequence
  chemically synthesized
taaggacatacttctacaat

SEQ ID NO: 17750 - DNA, 20 bp, Artificial Sequence
  chemically synthesized
aaggacatacttctacaatg

SEQ ID NO: 17751 - DNA, 20 bp, Artificial Sequence
  chemically synthesized
aggacatacttctacaatga

SEQ ID NO: 17752 - DNA, 20 bp, Artificial Sequence
  chemically synthesized
tacaatgagggcctccacaa

SEQ ID NO: 17753 - DNA, 20 bp, Artificial Sequence
  chemically synthesized
cacaaaagcctaatacttgt

SEQ ID NO: 17754 - DNA, 20 bp, Artificial Sequence
  chemically synthesized
caaaagcctaatacttgtta

SEQ ID NO: 17755 - DNA, 20 bp, Artificial Sequence
  chemically synthesized
cctaatacttgttagagtca

SEQ ID NO: 17756 - DNA, 20 bp, Artificial Sequence
  chemically synthesized
tgttagagtcatagattcgt

SEQ ID NO: 17757 - DNA, 20 bp, Artificial Sequence
  chemically synthesized
ttcgtaagtatgttgatctg

SEQ ID NO: 17758 - DNA, 20 bp, Artificial Sequence
  chemically synthesized
tcgtaagtatgttgatctga

SEQ ID NO: 17759 - DNA, 20 bp, Artificial Sequence
  chemically synthesized
cgtaagtatgttgatctgaa

SEQ ID NO: 17760 - DNA, 20 bp, Artificial Sequence
  chemically synthesized
tatgttgatctgaagggcaa

SEQ ID NO: 17761 - DNA, 20 bp, Artificial Sequence
  chemically synthesized
ctgaagggcaatagtaatat

SEQ ID NO: 17762 - DNA, 20 bp, Artificial Sequence
  chemically synthesized
aagggcaatagtaatatcgg

SEQ ID NO: 17763 - DNA, 20 bp, Artificial Sequence
  chemically synthesized
gcaatagtaatatcggaagt

SEQ ID NO: 17764 - DNA, 20 bp, Artificial Sequence
  chemically synthesized
aatatcggaagttggtaatt

SEQ ID NO: 17765 - DNA, 20 bp, Artificial Sequence
  chemically synthesized
gttaataaacttcacacaac

SEQ ID NO: 17766 - DNA, 20 bp, Artificial Sequence
  chemically synthesized
aaacttcacacaaccagttc

SEQ ID NO: 17767 - DNA, 20 bp, Artificial Sequence
  chemically synthesized
aacttcacacaaccagttct

SEQ ID NO: 17768 - DNA, 20 bp, Artificial Sequence
  chemically synthesized
acttcacacaaccagttcta

SEQ ID NO: 17769 - DNA, 20 bp, Artificial Sequence
  chemically synthesized
acacaaccagttctagggaa

SEQ ID NO: 17770 - DNA, 20 bp, Artificial Sequence
  chemically synthesized
accagttctagggaaaagat

SEQ ID NO: 17771 - DNA, 20 bp, Artificial Sequence
  chemically synthesized
agggaaaagataagcactcc

SEQ ID NO: 17772 - DNA, 20 bp, Artificial Sequence
  chemically synthesized
ggaaaagataagcactccca

SEQ ID NO: 17773 - DNA, 20 bp, Artificial Sequence
  chemically synthesized
aaaagataagcactcccaga

SEQ ID NO: 17774 - DNA, 20 bp, Artificial Sequence
  chemically synthesized
gcactcccagagagaaaata

SEQ ID NO: 17775 - DNA, 20 bp, Artificial Sequence
  chemically synthesized
tacggcaactatgttgctga

SEQ ID NO: 17776 - DNA, 20 bp, Artificial Sequence
  chemically synthesized
cggcaactatgttgctgatg

SEQ ID NO: 17777 - DNA, 20 bp, Artificial Sequence
  chemically synthesized
tgctgatggagacaatctta

SEQ ID NO: 17778 - DNA, 20 bp, Artificial Sequence
  chemically synthesized
tctaatcattatgaatctgt

SEQ ID NO: 17779 - DNA, 20 bp, Artificial Sequence
  chemically synthesized
gaatctgtaagactcgtatt

SEQ ID NO: 17780 - DNA, 20 bp, Artificial Sequence
  chemically synthesized
tcgtattgagaaaaattcac

SEQ ID NO: 17781 - DNA, 20 bp, Artificial Sequence
  chemically synthesized
cgtattgagaaaaattcaca

SEQ ID NO: 17782 - DNA, 20 bp, Artificial Sequence
  chemically synthesized
aaaattcacaaggatcctca

SEQ ID NO: 17783 - DNA, 20 bp, Artificial Sequence
  chemically synthesized
aaattcacaaggatcctcat

SEQ ID NO: 17784 - DNA, 20 bp, Artificial Sequence
  chemically synthesized
aattcacaaggatcctcata

SEQ ID NO: 17785 - DNA, 20 bp, Artificial Sequence
  chemically synthesized
gatcctcatagggaactatg

SEQ ID NO: 17786 - DNA, 20 bp, Artificial Sequence
  chemically synthesized
tttataattacacttttaca

SEQ ID NO: 17787 - DNA, 20 bp, Artificial Sequence
  chemically synthesized
aattacacttttacaaagtc

SEQ ID NO: 17788 - DNA, 20 bp, Artificial Sequence
  chemically synthesized
atttttgttgttgtgatacc

SEQ ID NO: 17789 - DNA, 20 bp, Artificial Sequence
  chemically synthesized
tgtgataccaagaaattttg

SEQ ID NO: 17790 - DNA, 20 bp, Artificial Sequence
  chemically synthesized
gataccaagaaattttgtag

SEQ ID NO: 17791 - DNA, 20 bp, Artificial Sequence
  chemically synthesized
ataccaagaaattttgtagc

SEQ ID NO: 17792 - DNA, 20 bp, Artificial Sequence
  chemically synthesized
aaattttgtagcaggtttat

SEQ ID NO: 17793 - DNA, 20 bp, Artificial Sequence
  chemically synthesized
aattttgtagcaggtttatt

SEQ ID NO: 17794 - DNA, 20 bp, Artificial Sequence
  chemically synthesized
gcaggtttattgggaaaaca

SEQ ID NO: 17795 - DNA, 20 bp, Artificial Sequence
  chemically synthesized
aggtttattgggaaaacaaa

SEQ ID NO: 17796 - DNA, 20 bp, Artificial Sequence
  chemically synthesized
gggaaaacaaagagaactac

SEQ ID NO: 17797 - DNA, 20 bp, Artificial Sequence
  chemically synthesized
ggaaaacaaagagaactaca

SEQ ID NO: 17798 - DNA, 20 bp, Artificial Sequence
  chemically synthesized
gaaaacaaagagaactacaa

SEQ ID NO: 17799 - DNA, 20 bp, Artificial Sequence
  chemically synthesized
agagaactacaagggaaact

SEQ ID NO: 17800 - DNA, 20 bp, Artificial Sequence
  chemically synthesized
caattgattctgtatgtgtc

SEQ ID NO: 17801 - DNA, 20 bp, Artificial Sequence
  chemically synthesized
attgattctgtatgtgtcca

SEQ ID NO: 17802 - DNA, 20 bp, Artificial Sequence
  chemically synthesized
tattactaccgacacctttg

SEQ ID NO: 17803 - DNA, 20 bp, Artificial Sequence
  chemically synthesized
gacacctttgaagtgtaatt

SEQ ID NO: 17804 - DNA, 20 bp, Artificial Sequence
  chemically synthesized
agtgtaattcagtaaaaatg

SEQ ID NO: 17805 - DNA, 20 bp, Artificial Sequence
  chemically synthesized
ttttattttataaaaaccta

SEQ ID NO: 17806 - DNA, 20 bp, Artificial Sequence
  chemically synthesized
acaataataattatatgttt

SEQ ID NO: 17807 - DNA, 20 bp, Artificial Sequence
  chemically synthesized
aattatatgtttcagaattt

SEQ ID NO: 17808 - DNA, 20 bp, Artificial Sequence
  chemically synthesized
tgtttcagaattttggcaca

SEQ ID NO: 17809 - DNA, 20 bp, Artificial Sequence
  chemically synthesized
catagtaacatctctaatat

SEQ ID NO: 17810 - DNA, 20 bp, Artificial Sequence
  chemically synthesized
tctctaatataagcaattat

SEQ ID NO: 17811 - DNA, 20 bp, Artificial Sequence
  chemically synthesized
ctaatataagcaattattgg

SEQ ID NO: 17812 - DNA, 20 bp, Artificial Sequence
  chemically synthesized
aatataagcaattattggtg

SEQ ID NO: 17813 - DNA, 20 bp, Artificial Sequence
  chemically synthesized
tataagcaattattggtgga

SEQ ID NO: 17814 - DNA, 20 bp, Artificial Sequence
  chemically synthesized
taagcaattattggtggaga

SEQ ID NO: 17815 - DNA, 20 bp, Artificial Sequence
  chemically synthesized
caattattggtggagagaga

SEQ ID NO: 17816 - DNA, 20 bp, Artificial Sequence
  chemically synthesized
tattggtggagagagatgga

SEQ ID NO: 17817 - DNA, 20 bp, Artificial Sequence
  chemically synthesized
ttggtggagagagatggaca

SEQ ID NO: 17818 - DNA, 20 bp, Artificial Sequence
  chemically synthesized
tggtggagagagatggacag

SEQ ID NO: 17819 - DNA, 20 bp, Artificial Sequence
  chemically synthesized
ggagagagatggacagagga

SEQ ID NO: 17820 - DNA, 20 bp, Artificial Sequence
  chemically synthesized
gagagagatggacagaggaa

SEQ ID NO: 17821 - DNA, 20 bp, Artificial Sequence
  chemically synthesized
gatggacagaggaaaggtga

SEQ ID NO: 17822 - DNA, 20 bp, Artificial Sequence
  chemically synthesized
atggacagaggaaaggtgaa

SEQ ID NO: 17823 - DNA, 20 bp, Artificial Sequence
  chemically synthesized
aaaggtgaaaggacttttga

SEQ ID NO: 17824 - DNA, 20 bp, Artificial Sequence
  chemically synthesized
aaggtgaaaggacttttgaa

SEQ ID NO: 17825 - DNA, 20 bp, Artificial Sequence
  chemically synthesized
aggtgaaaggacttttgaaa

SEQ ID NO: 17826 - DNA, 20 bp, Artificial Sequence
  chemically synthesized
ttttgaaagggctgctactt

SEQ ID NO: 17827 - DNA, 20 bp, Artificial Sequence
  chemically synthesized
tttgaaagggctgctacttc

SEQ ID NO: 17828 - DNA, 20 bp, Artificial Sequence
  chemically synthesized
ttgaaagggctgctacttca

SEQ ID NO: 17829 - DNA, 20 bp, Artificial Sequence
  chemically synthesized
tgaaagggctgctacttcag

SEQ ID NO: 17830 - DNA, 20 bp, Artificial Sequence
  chemically synthesized
actgttgataacaaaaatgt

SEQ ID NO: 17831 - DNA, 20 bp, Artificial Sequence
  chemically synthesized
tgataacaaaaatgtcagtc

SEQ ID NO: 17832 - DNA, 20 bp, Artificial Sequence
  chemically synthesized
gataacaaaaatgtcagtct

SEQ ID NO: 17833 - DNA, 20 bp, Artificial Sequence
  chemically synthesized
aaatgtcagtctaggcactg

SEQ ID NO: 17834 - DNA, 20 bp, Artificial Sequence
  chemically synthesized
tgtcagtctaggcactgcag

SEQ ID NO: 17835 - DNA, 20 bp, Artificial Sequence
  chemically synthesized
cagtctaggcactgcagtag

SEQ ID NO: 17836 - DNA, 20 bp, Artificial Sequence
  chemically synthesized
gtctaggcactgcagtagca

SEQ ID NO: 17837 - DNA, 20 bp, Artificial Sequence
  chemically synthesized
tagcagagactatgttcata

SEQ ID NO: 17838 - DNA, 20 bp, Artificial Sequence
  chemically synthesized
ccactgaattatgacctgca

SEQ ID NO: 17839 - DNA, 20 bp, Artificial Sequence
  chemically synthesized
gacctgcatagtgcttaatg

SEQ ID NO: 17840 - DNA, 20 bp, Artificial Sequence
  chemically synthesized
ctgcatagtgcttaatgtgg

SEQ ID NO: 17841 - DNA, 20 bp, Artificial Sequence
  chemically synthesized
gcagaacttatctaccgcca

SEQ ID NO: 17842 - DNA, 20 bp, Artificial Sequence
  chemically synthesized
cagaacttatctaccgccac

SEQ ID NO: 17843 - DNA, 20 bp, Artificial Sequence
  chemically synthesized
gaacttatctaccgccacag

SEQ ID NO: 17844 - DNA, 20 bp, Artificial Sequence
  chemically synthesized
agtgatgtgtatatcattat

SEQ ID NO: 17845 - DNA, 20 bp, Artificial Sequence
  chemically synthesized
accttccaatgttgccttat

SEQ ID NO: 17846 - DNA, 20 bp, Artificial Sequence
  chemically synthesized
cttccaatgttgccttataa

SEQ ID NO: 17847 - DNA, 20 bp, Artificial Sequence
  chemically synthesized
aatgttgccttataagagaa

SEQ ID NO: 17848 - DNA, 20 bp, Artificial Sequence
  chemically synthesized
taatgccaaaatttgttgta

SEQ ID NO: 17849 - DNA, 20 bp, Artificial Sequence
  chemically synthesized
aatgccaaaatttgttgtac

SEQ ID NO: 17850 - DNA, 20 bp, Artificial Sequence
  chemically synthesized
caaaatttgttgtacaggat

SEQ ID NO: 17851 - DNA, 20 bp, Artificial Sequence
  chemically synthesized
aaatttgttgtacaggataa

SEQ ID NO: 17852 - DNA, 20 bp, Artificial Sequence
  chemically synthesized
ataagagctaaccacttatt

SEQ ID NO: 17853 - DNA, 20 bp, Artificial Sequence
  chemically synthesized
tatttggatctactgtcacc

SEQ ID NO: 17854 - DNA, 20 bp, Artificial Sequence
  chemically synthesized
atctactgtcacccagataa

SEQ ID NO: 17855 - DNA, 20 bp, Artificial Sequence
  chemically synthesized
ctgtcacccagataatggac

SEQ ID NO: 17856 - DNA, 20 bp, Artificial Sequence
  chemically synthesized
cacccagataatggaccaga

SEQ ID NO: 17857 - DNA, 20 bp, Artificial Sequence
  chemically synthesized
cccagataatggaccagatg

SEQ ID NO: 17858 - DNA, 20 bp, Artificial Sequence
  chemically synthesized
ccagataatggaccagatgg

SEQ ID NO: 17859 - DNA, 20 bp, Artificial Sequence
  chemically synthesized
gataatggaccagatggagg

SEQ ID NO: 17860 - DNA, 20 bp, Artificial Sequence
  chemically synthesized
atggaccagatggaggaagc

SEQ ID NO: 17861 - DNA, 20 bp, Artificial Sequence
  chemically synthesized
ggaccagatggaggaagccg

SEQ ID NO: 17862 - DNA, 20 bp, Artificial Sequence
  chemically synthesized
gaccagatggaggaagccgg

SEQ ID NO: 17863 - DNA, 20 bp, Artificial Sequence
  chemically synthesized
ccagatggaggaagccggag

SEQ ID NO: 17864 - DNA, 20 bp, Artificial Sequence
  chemically synthesized
cagatggaggaagccggagg

SEQ ID NO: 17865 - DNA, 20 bp, Artificial Sequence
  chemically synthesized
gcctgattattcttaaacta

SEQ ID NO: 17866 - DNA, 20 bp, Artificial Sequence
  chemically synthesized
tagtcgtgttttcaaaacct

SEQ ID NO: 17867 - DNA, 20 bp, Artificial Sequence
  chemically synthesized
ttcaaaacctgagctgcgtt

SEQ ID NO: 17868 - DNA, 20 bp, Artificial Sequence
  chemically synthesized
tcaaaacctgagctgcgttt

SEQ ID NO: 17869 - DNA, 20 bp, Artificial Sequence
  chemically synthesized
tgagctgcgtttgggacatg

SEQ ID NO: 17870 - DNA, 20 bp, Artificial Sequence
  chemically synthesized
gtttgggacatgcggatgca

SEQ ID NO: 17871 - DNA, 20 bp, Artificial Sequence
  chemically synthesized
tttgggacatgcggatgcac

SEQ ID NO: 17872 - DNA, 20 bp, Artificial Sequence
  chemically synthesized
ttgggacatgcggatgcaca

SEQ ID NO: 17873 - DNA, 20 bp, Artificial Sequence
  chemically synthesized
agggttttattaaaactgtg

SEQ ID NO: 17874 - DNA, 20 bp, Artificial Sequence
  chemically synthesized
taaaactgtgtggtaattac

SEQ ID NO: 17875 - DNA, 20 bp, Artificial Sequence
  chemically synthesized
aaaactgtgtggtaattact

SEQ ID NO: 17876 - DNA, 20 bp, Artificial Sequence
  chemically synthesized
aaactgtgtggtaattactg

SEQ ID NO: 17877 - DNA, 20 bp, Artificial Sequence
  chemically synthesized
tgtggtaattactggggaaa

SEQ ID NO: 17878 - DNA, 20 bp, Artificial Sequence
  chemically synthesized
aaatagttaatacaatttat

SEQ ID NO: 17879 - DNA, 20 bp, Artificial Sequence
  chemically synthesized
aagtatattttattgaccta

SEQ ID NO: 17880 - DNA, 20 bp, Artificial Sequence
  chemically synthesized
atattttattgacctaaaga

SEQ ID NO: 17881 - DNA, 20 bp, Artificial Sequence
  chemically synthesized
agccctctatttaacatctg

SEQ ID NO: 17882 - DNA, 20 bp, Artificial Sequence
  chemically synthesized
tatttaacatctgcagtctc

SEQ ID NO: 17883 - DNA, 20 bp, Artificial Sequence
  chemically synthesized
atctgcagtctctagcaaaa

SEQ ID NO: 17884 - DNA, 20 bp, Artificial Sequence
  chemically synthesized
ctctagcaaaacagctacgc

SEQ ID NO: 17885 - DNA, 20 bp, Artificial Sequence
  chemically synthesized
gctacgctggcatttaattg

SEQ ID NO: 17886 - DNA, 20 bp, Artificial Sequence
  chemically synthesized
gcatttaattgtggcaaatt

SEQ ID NO: 17887 - DNA, 20 bp, Artificial Sequence
  chemically synthesized
tttaattgtggcaaatttgg

SEQ ID NO: 17888 - DNA, 20 bp, Artificial Sequence
  chemically synthesized
tgtggcaaatttggtagtac

SEQ ID NO: 17889 - DNA, 20 bp, Artificial Sequence
  chemically synthesized
gtccacatacccaaatattc

SEQ ID NO: 17890 - DNA, 20 bp, Artificial Sequence
  chemically synthesized
tccacatacccaaatattcc

SEQ ID NO: 17891 - DNA, 20 bp, Artificial Sequence
  chemically synthesized
ccacatacccaaatattcca

SEQ ID NO: 17892 - DNA, 20 bp, Artificial Sequence
  chemically synthesized
acatacccaaatattccagg

SEQ ID NO: 17893 - DNA, 20 bp, Artificial Sequence
  chemically synthesized
cccaaatattccagggagaa

SEQ ID NO: 17894 - DNA, 20 bp, Artificial Sequence
  chemically synthesized
agggagaatagttgccctaa

SEQ ID NO: 17895 - DNA, 20 bp, Artificial Sequence
  chemically synthesized
gaatagttgccctaatagtt

SEQ ID NO: 17896 - DNA, 20 bp, Artificial Sequence
  chemically synthesized
aatagttgccctaatagttt

SEQ ID NO: 17897 - DNA, 20 bp, Artificial Sequence
  chemically synthesized
atagttgccctaatagttta

SEQ ID NO: 17898 - DNA, 20 bp, Artificial Sequence
  chemically synthesized
agttgccctaatagtttagg

SEQ ID NO: 17899 - DNA, 20 bp, Artificial Sequence
  chemically synthesized
taatagtttagggagtctcc

SEQ ID NO: 17900 - DNA, 20 bp, Artificial Sequence
  chemically synthesized
tagaatgtgatacatgacaa

SEQ ID NO: 17901 - DNA, 20 bp, Artificial Sequence
  chemically synthesized
atgtgatacatgacaaaagt

SEQ ID NO: 17902 - DNA, 20 bp, Artificial Sequence
  chemically synthesized
gtgatacatgacaaaagtga

SEQ ID NO: 17903 - DNA, 20 bp, Artificial Sequence
  chemically synthesized
aaaagtgagagtcataactt

SEQ ID NO: 17904 - DNA, 20 bp, Artificial Sequence
  chemically synthesized
agtgagagtcataactttag

SEQ ID NO: 17905 - DNA, 20 bp, Artificial Sequence
  chemically synthesized
ttagtggaatttatcactct

SEQ ID NO: 17906 - DNA, 20 bp, Artificial Sequence
  chemically synthesized
tagtggaatttatcactctc

SEQ ID NO: 17907 - DNA, 20 bp, Artificial Sequence
  chemically synthesized
ggaatttatcactctcaggc

SEQ ID NO: 17908 - DNA, 20 bp, Artificial Sequence
  chemically synthesized
ttatcactctcaggcaagca

SEQ ID NO: 17909 - DNA, 20 bp, Artificial Sequence
  chemically synthesized
atcactctcaggcaagcata

SEQ ID NO: 17910 - DNA, 20 bp, Artificial Sequence
  chemically synthesized
tcactctcaggcaagcatag

SEQ ID NO: 17911 - DNA, 20 bp, Artificial Sequence
  chemically synthesized
ggcaagcatagaggccccct

SEQ ID NO: 17912 - DNA, 20 bp, Artificial Sequence
  chemically synthesized
gcaagcatagaggccccctg

SEQ ID NO: 17913 - DNA, 20 bp, Artificial Sequence
  chemically synthesized
caagcatagaggccccctga

SEQ ID NO: 17914 - DNA, 20 bp, Artificial Sequence
  chemically synthesized
ctgagggatgcaaaaatgac

SEQ ID NO: 17915 - DNA, 20 bp, Artificial Sequence
  chemically synthesized
ctgttctcttgcccctttct

SEQ ID NO: 17916 - DNA, 20 bp, Artificial Sequence
  chemically synthesized
tgcccctttctgagtgcctt

SEQ ID NO: 17917 - DNA, 20 bp, Artificial Sequence
  chemically synthesized
cctttggactgattctttga

SEQ ID NO: 17918 - DNA, 20 bp, Artificial Sequence
  chemically synthesized
ttctttgacagcaactatcc

SEQ ID NO: 17919 - DNA, 20 bp, Artificial Sequence
  chemically synthesized
ctttgacagcaactatccca

SEQ ID NO: 17920 - DNA, 20 bp, Artificial Sequence
  chemically synthesized
gcaactatcccagagtcctc

SEQ ID NO: 17921 - DNA, 20 bp, Artificial Sequence
  chemically synthesized
aactatcccagagtcctcaa

SEQ ID NO: 17922 - DNA, 20 bp, Artificial Sequence
  chemically synthesized
agagtcctcaagagtttctg

SEQ ID NO: 17923 - DNA, 20 bp, Artificial Sequence
  chemically synthesized
gagtcctcaagagtttctga

SEQ ID NO: 17924 - DNA, 20 bp, Artificial Sequence
  chemically synthesized
aagagtttctgaaggtaaca

SEQ ID NO: 17925 - DNA, 20 bp, Artificial Sequence
  chemically synthesized
ggtaacatagatccatcatc

SEQ ID NO: 17926 - DNA, 20 bp, Artificial Sequence
  chemically synthesized
taacatagatccatcatcca

SEQ ID NO: 17927 - DNA, 20 bp, Artificial Sequence
  chemically synthesized
caacttgccatgctgacaaa

SEQ ID NO: 17928 - DNA, 20 bp, Artificial Sequence
  chemically synthesized
tgccatgctgacaaaaagct

SEQ ID NO: 17929 - DNA, 20 bp, Artificial Sequence
  chemically synthesized
gccatgctgacaaaaagctt

SEQ ID NO: 17930 - DNA, 20 bp, Artificial Sequence
  chemically synthesized
caaaaagcttaggaactgtt

SEQ ID NO: 17931 - DNA, 20 bp, Artificial Sequence
  chemically synthesized
aaaaagcttaggaactgttc

SEQ ID NO: 17932 - DNA, 20 bp, Artificial Sequence
  chemically synthesized
tgttcaggaaaccatttata

SEQ ID NO: 17933 - DNA, 20 bp, Artificial Sequence
  chemically synthesized
ataaagacataaactaaaat

SEQ ID NO: 17934 - DNA, 20 bp, Artificial Sequence
  chemically synthesized
aagacataaactaaaatgag

SEQ ID NO: 17935 - DNA, 20 bp, Artificial Sequence
  chemically synthesized
aactaaaatgagaagacaaa

SEQ ID NO: 17936 - DNA, 20 bp, Artificial Sequence
  chemically synthesized
ctaaaatgagaagacaaaaa

SEQ ID NO: 17937 - DNA, 20 bp, Artificial Sequence
  chemically synthesized
gaagacaaaaagagaatatt

SEQ ID NO: 17938 - DNA, 20 bp, Artificial Sequence
  chemically synthesized
atattaagatcgtgttaaaa

SEQ ID NO: 17939 - DNA, 20 bp, Artificial Sequence
  chemically synthesized
aagatcgtgttaaaaaagaa

SEQ ID NO: 17940 - DNA, 20 bp, Artificial Sequence
  chemically synthesized
aaaaagaacagtcttccgtt

SEQ ID NO: 17941 - DNA, 20 bp, Artificial Sequence
  chemically synthesized
aacagtcttccgtttagttc

SEQ ID NO: 17942 - DNA, 20 bp, Artificial Sequence
  chemically synthesized
tttagttccagataatctgc

SEQ ID NO: 17943 - DNA, 20 bp, Artificial Sequence
  chemically synthesized
ctgcaagtgccctgtacaat

SEQ ID NO: 17944 - DNA, 20 bp, Artificial Sequence
  chemically synthesized
gccccaaaattgtgttccta

SEQ ID NO: 17945 - DNA, 20 bp, Artificial Sequence
  chemically synthesized
ccaaaattgtgttcctatag

SEQ ID NO: 17946 - DNA, 20 bp, Artificial Sequence
  chemically synthesized
tataccaaaataaatattta

SEQ ID NO: 17947 - DNA, 20 bp, Artificial Sequence
  chemically synthesized
tatttaaagtcaactgacaa

SEQ ID NO: 17948 - DNA, 20 bp, Artificial Sequence
  chemically synthesized
atttaaagtcaactgacaat

SEQ ID NO: 17949 - DNA, 20 bp, Artificial Sequence
  chemically synthesized
taaagtcaactgacaatggg

SEQ ID NO: 17950 - DNA, 20 bp, Artificial Sequence
  chemically synthesized
aactgacaatgggaagccat

SEQ ID NO: 17951 - DNA, 20 bp, Artificial Sequence
  chemically synthesized
caatgggaagccatgagatg

SEQ ID NO: 17952 - DNA, 20 bp, Artificial Sequence
  chemically synthesized
acaaaatatctgaaaaatct

SEQ ID NO: 17953 - DNA, 20 bp, Artificial Sequence
  chemically synthesized
tctgaaaaatctcagctttt

SEQ ID NO: 17954 - DNA, 20 bp, Artificial Sequence
  chemically synthesized
acttttttatatcttacctt

SEQ ID NO: 17955 - DNA, 20 bp, Artificial Sequence
  chemically synthesized
accttaagtacaaattaaaa

SEQ ID NO: 17956 - DNA, 20 bp, Artificial Sequence
  chemically synthesized
ttaagtacaaattaaaatgg

SEQ ID NO: 17957 - DNA, 20 bp, Artificial Sequence
  chemically synthesized
aagtacaaattaaaatggaa

SEQ ID NO: 17958 - DNA, 20 bp, Artificial Sequence
  chemically synthesized
agtacaaattaaaatggaag

SEQ ID NO: 17959 - DNA, 20 bp, Artificial Sequence
  chemically synthesized
acaaattaaaatggaagagg

SEQ ID NO: 17960 - DNA, 20 bp, Artificial Sequence
  chemically synthesized
attaaaatggaagaggtggc

SEQ ID NO: 17961 - DNA, 20 bp, Artificial Sequence
  chemically synthesized
ttaaaatggaagaggtggcc

SEQ ID NO: 17962 - DNA, 20 bp, Artificial Sequence
  chemically synthesized
atggaagaggtggccaggca

SEQ ID NO: 17963 - DNA, 20 bp, Artificial Sequence
  chemically synthesized
ggaagaggtggccaggcaca

SEQ ID NO: 17964 - DNA, 20 bp, Artificial Sequence
  chemically synthesized
gaagaggtggccaggcacag

SEQ ID NO: 17965 - DNA, 20 bp, Artificial Sequence
  chemically synthesized
gaggctcatgcctgtaatcc

SEQ ID NO: 17966 - DNA, 20 bp, Artificial Sequence
  chemically synthesized
tgcctgtaatcctagcactt

SEQ ID NO: 17967 - DNA, 20 bp, Artificial Sequence
  chemically synthesized
ctgtaatcctagcactttgg

SEQ ID NO: 17968 - DNA, 20 bp, Artificial Sequence
  chemically synthesized
tgtaatcctagcactttgga

SEQ ID NO: 17969 - DNA, 20 bp, Artificial Sequence
  chemically synthesized
tcctagcactttggaaggct

SEQ ID NO: 17970 - DNA, 20 bp, Artificial Sequence
  chemically synthesized
cctagcactttggaaggctg

SEQ ID NO: 17971 - DNA, 20 bp, Artificial Sequence
  chemically synthesized
agcactttggaaggctgagg

SEQ ID NO: 17972 - DNA, 20 bp, Artificial Sequence
  chemically synthesized
ggaaggctgaggtggatcac

SEQ ID NO: 17973 - DNA, 20 bp, Artificial Sequence
  chemically synthesized
gaaggctgaggtggatcacg

SEQ ID NO: 17974 - DNA, 20 bp, Artificial Sequence
  chemically synthesized
gctgaggtggatcacgaggt

SEQ ID NO: 17975 - DNA, 20 bp, Artificial Sequence
  chemically synthesized
gaggtggatcacgaggtcag

SEQ ID NO: 17976 - DNA, 20 bp, Artificial Sequence
  chemically synthesized
gatcacgaggtcagcagttt

SEQ ID NO: 17977 - DNA, 20 bp, Artificial Sequence
  chemically synthesized
cgaggtcagcagtttgagac

SEQ ID NO: 17978 - DNA, 20 bp, Artificial Sequence
  chemically synthesized
tcagcagtttgagactagcc

SEQ ID NO: 17979 - DNA, 20 bp, Artificial Sequence
  chemically synthesized
tgagactagcctggccaaca

SEQ ID NO: 17980 - DNA, 20 bp, Artificial Sequence
  chemically synthesized
tctactaaaaatacaaaaat

SEQ ID NO: 17981 - DNA, 20 bp, Artificial Sequence
  chemically synthesized
ctaaaaatacaaaaattagc

SEQ ID NO: 17982 - DNA, 20 bp, Artificial Sequence
  chemically synthesized
taaaaatacaaaaattagct

SEQ ID NO: 17983 - DNA, 20 bp, Artificial Sequence
  chemically synthesized
atacaaaaattagctgggtg

SEQ ID NO: 17984 - DNA, 20 bp, Artificial Sequence
  chemically synthesized
caaaaattagctgggtgtgg

SEQ ID NO: 17985 - DNA, 20 bp, Artificial Sequence
  chemically synthesized
aattagctgggtgtggtggt

SEQ ID NO: 17986 - DNA, 20 bp, Artificial Sequence
  chemically synthesized
gtggtgagcgcctgtaatcc

SEQ ID NO: 17987 - DNA, 20 bp, Artificial Sequence
  chemically synthesized
cgcctgtaatcccagctact

SEQ ID NO: 17988 - DNA, 20 bp, Artificial Sequence
  chemically synthesized
gcctgtaatcccagctactc

SEQ ID NO: 17989 - DNA, 20 bp, Artificial Sequence
  chemically synthesized
ctgtaatcccagctactcgg

SEQ ID NO: 17990 - DNA, 20 bp, Artificial Sequence
  chemically synthesized
tgtaatcccagctactcggg

SEQ ID NO: 17991 - DNA, 20 bp, Artificial Sequence
  chemically synthesized
tcccagctactcgggaggct

SEQ ID NO: 17992 - DNA, 20 bp, Artificial Sequence
  chemically synthesized
cccagctactcgggaggctg

SEQ ID NO: 17993 - DNA, 20 bp, Artificial Sequence
  chemically synthesized
agctactcgggaggctgagg

SEQ ID NO: 17994 - DNA, 20 bp, Artificial Sequence
  chemically synthesized
gctactcgggaggctgaggc

SEQ ID NO: 17995 - DNA, 20 bp, Artificial Sequence
  chemically synthesized
tactcgggaggctgaggcag

SEQ ID NO: 17996 - DNA, 20 bp, Artificial Sequence
  chemically synthesized
gagaattgctttaaaaaaac

SEQ ID NO: 17997 - DNA, 20 bp, Artificial Sequence
  chemically synthesized
agaattgctttaaaaaaact

SEQ ID NO: 17998 - DNA, 20 bp, Artificial Sequence
  chemically synthesized
gaattgctttaaaaaaactg

SEQ ID NO: 17999 - DNA, 20 bp, Artificial Sequence
  chemically synthesized
attgctttaaaaaaactggg

SEQ ID NO: 18000 - DNA, 20 bp, Artificial Sequence
  chemically synthesized
gctttaaaaaaactggggag

SEQ ID NO: 18001 - DNA, 20 bp, Artificial Sequence
  chemically synthesized
tttaaaaaaactggggagca

SEQ ID NO: 18002 - DNA, 20 bp, Artificial Sequence
  chemically synthesized
ttaaaaaaactggggagcag

SEQ ID NO: 18003 - DNA, 20 bp, Artificial Sequence
  chemically synthesized
ctggggagcagaggtcgtcg

SEQ ID NO: 18004 - DNA, 20 bp, Artificial Sequence
  chemically synthesized
ggagcagaggtcgtcgcagt

SEQ ID NO: 18005 - DNA, 20 bp, Artificial Sequence
  chemically synthesized
agaggtcgtcgcagtgagcc

SEQ ID NO: 18006 - DNA, 20 bp, Artificial Sequence
  chemically synthesized
aagattgtgccactgcacta

SEQ ID NO: 18007 - DNA, 20 bp, Artificial Sequence
  chemically synthesized
tgtgccactgcactacagcc

SEQ ID NO: 18008 - DNA, 20 bp, Artificial Sequence
  chemically synthesized
gtgccactgcactacagcct

SEQ ID NO: 18009 - DNA, 20 bp, Artificial Sequence
  chemically synthesized
gcactacagcctgggcgaca

SEQ ID NO: 18010 - DNA, 20 bp, Artificial Sequence
  chemically synthesized
tacagcctgggcgacaaagc

SEQ ID NO: 18011 - DNA, 20 bp, Artificial Sequence
  chemically synthesized
acagcctgggcgacaaagca

SEQ ID NO: 18012 - DNA, 20 bp, Artificial Sequence
  chemically synthesized
tctcaaaaaaaaaaaaaaaa

SEQ ID NO: 18013 - DNA, 20 bp, Artificial Sequence
  chemically synthesized
ctcaaaaaaaaaaaaaaaaa

SEQ ID NO: 18014 - DNA, 20 bp, Artificial Sequence
  chemically synthesized
aaaaaaaaaaaaaaaaggtt

SEQ ID NO: 18015 - DNA, 20 bp, Artificial Sequence
  chemically synthesized
aaaaaaaaaaaaaaggtttg

SEQ ID NO: 18016 - DNA, 20 bp, Artificial Sequence
  chemically synthesized
aaaaaaaaaaaaggtttgga

SEQ ID NO: 18017 - DNA, 20 bp, Artificial Sequence
  chemically synthesized
aaaggtttggagagaaacat

SEQ ID NO: 18018 - DNA, 20 bp, Artificial Sequence
  chemically synthesized
aaggtttggagagaaacatt

SEQ ID NO: 18019 - DNA, 20 bp, Artificial Sequence
  chemically synthesized
ggagagaaacattgggaaac

SEQ ID NO: 18020 - DNA, 20 bp, Artificial Sequence
  chemically synthesized
gagagaaacattgggaaact

SEQ ID NO: 18021 - DNA, 20 bp, Artificial Sequence
  chemically synthesized
actaggacaaattttgctct

SEQ ID NO: 18022 - DNA, 20 bp, Artificial Sequence
  chemically synthesized
caaattttgctctcagtaaa

SEQ ID NO: 18023 - DNA, 20 bp, Artificial Sequence
  chemically synthesized
ttttgctctcagtaaaaaga

SEQ ID NO: 18024 - DNA, 20 bp, Artificial Sequence
  chemically synthesized
cagtaaaaagaaagatctca

SEQ ID NO: 18025 - DNA, 20 bp, Artificial Sequence
  chemically synthesized
agtaaaaagaaagatctcaa

SEQ ID NO: 18026 - DNA, 20 bp, Artificial Sequence
  chemically synthesized
taaaaagaaagatctcaaag

SEQ ID NO: 18027 - DNA, 20 bp, Artificial Sequence
  chemically synthesized
aagaaagatctcaaaggaga

SEQ ID NO: 18028 - DNA, 20 bp, Artificial Sequence
  chemically synthesized
gatctcaaaggagatagaca

SEQ ID NO: 18029 - DNA, 20 bp, Artificial Sequence
  chemically synthesized
ctcaaaggagatagacaaag

SEQ ID NO: 18030 - DNA, 20 bp, Artificial Sequence
  chemically synthesized
aaaggagatagacaaagaag

SEQ ID NO: 18031 - DNA, 20 bp, Artificial Sequence
  chemically synthesized
aaggagatagacaaagaagc

SEQ ID NO: 18032 - DNA, 20 bp, Artificial Sequence
  chemically synthesized
gatagacaaagaagcaggca

SEQ ID NO: 18033 - DNA, 20 bp, Artificial Sequence
  chemically synthesized
aaagaagcaggcacagatgt

SEQ ID NO: 18034 - DNA, 20 bp, Artificial Sequence
  chemically synthesized
agaagcaggcacagatgtaa

SEQ ID NO: 18035 - DNA, 20 bp, Artificial Sequence
  chemically synthesized
gaagcaggcacagatgtaag

SEQ ID NO: 18036 - DNA, 20 bp, Artificial Sequence
  chemically synthesized
caggcacagatgtaagagga

SEQ ID NO: 18037 - DNA, 20 bp, Artificial Sequence
  chemically synthesized
acagatgtaagaggatagca

SEQ ID NO: 18038 - DNA, 20 bp, Artificial Sequence
  chemically synthesized
atttacaaaaaaacaatgaa

SEQ ID NO: 18039 - DNA, 20 bp, Artificial Sequence
  chemically synthesized
tttacaaaaaaacaatgaaa

SEQ ID NO: 18040 - DNA, 20 bp, Artificial Sequence
  chemically synthesized
ttacaaaaaaacaatgaaaa

SEQ ID NO: 18041 - DNA, 20 bp, Artificial Sequence
  chemically synthesized
caaaaaaacaatgaaaaggg

SEQ ID NO: 18042 - DNA, 20 bp, Artificial Sequence
  chemically synthesized
acaatgaaaagggaagttta

SEQ ID NO: 18043 - DNA, 20 bp, Artificial Sequence
  chemically synthesized
caatgaaaagggaagtttat

SEQ ID NO: 18044 - DNA, 20 bp, Artificial Sequence
  chemically synthesized
atgaaaagggaagtttatag

SEQ ID NO: 18045 - DNA, 20 bp, Artificial Sequence
  chemically synthesized
aaaagggaagtttataggag

SEQ ID NO: 18046 - DNA, 20 bp, Artificial Sequence
  chemically synthesized
gtttataggagtggatacta

SEQ ID NO: 18047 - DNA, 20 bp, Artificial Sequence
  chemically synthesized
tataggagtggatactatgg

SEQ ID NO: 18048 - DNA, 20 bp, Artificial Sequence
  chemically synthesized
ataggagtggatactatggt

SEQ ID NO: 18049 - DNA, 20 bp, Artificial Sequence
  chemically synthesized
tggatactatggtaggttaa

SEQ ID NO: 18050 - DNA, 20 bp, Artificial Sequence
  chemically synthesized
taggttaatagtgaaaaata

SEQ ID NO: 18051 - DNA, 20 bp, Artificial Sequence
  chemically synthesized
attatcaattaatataaaca

SEQ ID NO: 18052 - DNA, 20 bp, Artificial Sequence
  chemically synthesized
tatcaattaatataaacata

SEQ ID NO: 18053 - DNA, 20 bp, Artificial Sequence
  chemically synthesized
atcaattaatataaacatag

SEQ ID NO: 18054 - DNA, 20 bp, Artificial Sequence
  chemically synthesized
acatagaggtgttgattgtt

SEQ ID NO: 18055 - DNA, 20 bp, Artificial Sequence
  chemically synthesized
catagaggtgttgattgttt

SEQ ID NO: 18056 - DNA, 20 bp, Artificial Sequence
  chemically synthesized
atagaggtgttgattgtttg

SEQ ID NO: 18057 - DNA, 20 bp, Artificial Sequence
  chemically synthesized
tgttgattgtttggggcaac

SEQ ID NO: 18058 - DNA, 20 bp, Artificial Sequence
  chemically synthesized
gttgattgtttggggcaact

SEQ ID NO: 18059 - DNA, 20 bp, Artificial Sequence
  chemically synthesized
gtttggggcaactaggtctt

SEQ ID NO: 18060 - DNA, 20 bp, Artificial Sequence
  chemically synthesized
tattgacaatttcaacataa

SEQ ID NO: 18061 - DNA, 20 bp, Artificial Sequence
  chemically synthesized
tgacaatttcaacataatgg

SEQ ID NO: 18062 - DNA, 20 bp, Artificial Sequence
  chemically synthesized
aatgaatgcctaatgactgt

SEQ ID NO: 18063 - DNA, 20 bp, Artificial Sequence
  chemically synthesized
cctaatgactgtgagacaaa

SEQ ID NO: 18064 - DNA, 20 bp, Artificial Sequence
  chemically synthesized
atgactgtgagacaaaaagt

SEQ ID NO: 18065 - DNA, 20 bp, Artificial Sequence
  chemically synthesized
gacaaaaagtgagtaaaaaa

SEQ ID NO: 18066 - DNA, 20 bp, Artificial Sequence
  chemically synthesized
aaaagtgagtaaaaaacagc

SEQ ID NO: 18067 - DNA, 20 bp, Artificial Sequence
  chemically synthesized
aaagtgagtaaaaaacagct

SEQ ID NO: 18068 - DNA, 20 bp, Artificial Sequence
  chemically synthesized
gagtaaaaaacagctgggca

SEQ ID NO: 18069 - DNA, 20 bp, Artificial Sequence
  chemically synthesized
taaaaaacagctgggcacgg

SEQ ID NO: 18070 - DNA, 20 bp, Artificial Sequence
  chemically synthesized
gtggctcatgcctataatcc

SEQ ID NO: 18071 - DNA, 20 bp, Artificial Sequence
  chemically synthesized
tgcctataatcccagcactt

SEQ ID NO: 18072 - DNA, 20 bp, Artificial Sequence
  chemically synthesized
gcctataatcccagcacttt

SEQ ID NO: 18073 - DNA, 20 bp, Artificial Sequence
  chemically synthesized
ctataatcccagcactttgg

SEQ ID NO: 18074 - DNA, 20 bp, Artificial Sequence
  chemically synthesized
tataatcccagcactttggg

SEQ ID NO: 18075 - DNA, 20 bp, Artificial Sequence
  chemically synthesized
tcccagcactttgggaggcc

SEQ ID NO: 18076 - DNA, 20 bp, Artificial Sequence
  chemically synthesized
cccagcactttgggaggccg

SEQ ID NO: 18077 - DNA, 20 bp, Artificial Sequence
  chemically synthesized
cagcactttgggaggccgag

SEQ ID NO: 18078 - DNA, 20 bp, Artificial Sequence
  chemically synthesized
agcactttgggaggccgagg

SEQ ID NO: 18079 - DNA, 20 bp, Artificial Sequence
  chemically synthesized
gcactttgggaggccgagga

SEQ ID NO: 18080 - DNA, 20 bp, Artificial Sequence
  chemically synthesized
ctttgggaggccgaggaggg

SEQ ID NO: 18081 - DNA, 20 bp, Artificial Sequence
  chemically synthesized
ccgaggagggtggatcactt

SEQ ID NO: 18082 - DNA, 20 bp, Artificial Sequence
  chemically synthesized
gagggtggatcacttgagtt

SEQ ID NO: 18083 - DNA, 20 bp, Artificial Sequence
  chemically synthesized
agggtggatcacttgagttc

SEQ ID NO: 18084 - DNA, 20 bp, Artificial Sequence
  chemically synthesized
ggtggatcacttgagttcag

SEQ ID NO: 18085 - DNA, 20 bp, Artificial Sequence
  chemically synthesized
tcacttgagttcaggagttc

SEQ ID NO: 18086 - DNA, 20 bp, Artificial Sequence
  chemically synthesized
tgagttcaggagttcgagac

SEQ ID NO: 18087 - DNA, 20 bp, Artificial Sequence
  chemically synthesized
ttcaggagttcgagaccagc

SEQ ID NO: 18088 - DNA, 20 bp, Artificial Sequence
  chemically synthesized
tcaggagttcgagaccagct

SEQ ID NO: 18089 - DNA, 20 bp, Artificial Sequence
  chemically synthesized
cgagaccagctgggccaaca

SEQ ID NO: 18090 - DNA, 20 bp, Artificial Sequence
  chemically synthesized
actactataattacaaaaat

SEQ ID NO: 18091 - DNA, 20 bp, Artificial Sequence
  chemically synthesized
ctataattacaaaaataagc

SEQ ID NO: 18092 - DNA, 20 bp, Artificial Sequence
  chemically synthesized
tataattacaaaaataagcc

SEQ ID NO: 18093 - DNA, 20 bp, Artificial Sequence
  chemically synthesized
ttacaaaaataagccaggtg

SEQ ID NO: 18094 - DNA, 20 bp, Artificial Sequence
  chemically synthesized
caaaaataagccaggtgtgg

SEQ ID NO: 18095 - DNA, 20 bp, Artificial Sequence
  chemically synthesized
gtggcacatgatcataatcc

SEQ ID NO: 18096 - DNA, 20 bp, Artificial Sequence
  chemically synthesized
gatcataatcccagctactc

SEQ ID NO: 18097 - DNA, 20 bp, Artificial Sequence
  chemically synthesized
tcataatcccagctactctg

SEQ ID NO: 18098 - DNA, 20 bp, Artificial Sequence
  chemically synthesized
cataatcccagctactctgg

SEQ ID NO: 18099 - DNA, 20 bp, Artificial Sequence
  chemically synthesized
tcccagctactctggaggct

SEQ ID NO: 18100 - DNA, 20 bp, Artificial Sequence
  chemically synthesized
cccagctactctggaggctg

SEQ ID NO: 18101 - DNA, 20 bp, Artificial Sequence
  chemically synthesized
tactctggaggctgaggcat

SEQ ID NO: 18102 - DNA, 20 bp, Artificial Sequence
  chemically synthesized
catgagaatcccctgaaccc

SEQ ID NO: 18103 - DNA, 20 bp, Artificial Sequence
  chemically synthesized
gagaatcccctgaaccctgg

SEQ ID NO: 18104 - DNA, 20 bp, Artificial Sequence
  chemically synthesized
gaatcccctgaaccctggtg

SEQ ID NO: 18105 - DNA, 20 bp, Artificial Sequence
  chemically synthesized
aatcccctgaaccctggtgg

SEQ ID NO: 18106 - DNA, 20 bp, Artificial Sequence
  chemically synthesized
tcccctgaaccctggtggag

SEQ ID NO: 18107 - DNA, 20 bp, Artificial Sequence
  chemically synthesized
cccctgaaccctggtggagg

SEQ ID NO: 18108 - DNA, 20 bp, Artificial Sequence
  chemically synthesized
aaccctggtggaggaggtcg

SEQ ID NO: 18109 - DNA, 20 bp, Artificial Sequence
  chemically synthesized
ctggtggaggaggtcgcagt

SEQ ID NO: 18110 - DNA, 20 bp, Artificial Sequence
  chemically synthesized
ggaggaggtcgcagtgagct

SEQ ID NO: 18111 - DNA, 20 bp, Artificial Sequence
  chemically synthesized
gagatcgcaccactgcactc

SEQ ID NO: 18112 - DNA, 20 bp, Artificial Sequence
  chemically synthesized
cgcaccactgcactctagcc

SEQ ID NO: 18113 - DNA, 20 bp, Artificial Sequence
  chemically synthesized
gcaccactgcactctagcct

SEQ ID NO: 18114 - DNA, 20 bp, Artificial Sequence
  chemically synthesized
ctgcactctagcctgggcaa

SEQ ID NO: 18115 - DNA, 20 bp, Artificial Sequence
  chemically synthesized
gcactctagcctgggcaaca

SEQ ID NO: 18116 - DNA, 20 bp, Artificial Sequence
  chemically synthesized
caacagagaaaaatctgtta

SEQ ID NO: 18117 - DNA, 20 bp, Artificial Sequence
  chemically synthesized
acagagaaaaatctgttaaa

SEQ ID NO: 18118 - DNA, 20 bp, Artificial Sequence
  chemically synthesized
agagaaaaatctgttaaaga

SEQ ID NO: 18119 - DNA, 20 bp, Artificial Sequence
  chemically synthesized
agaaaaatctgttaaagaga

SEQ ID NO: 18120 - DNA, 20 bp, Artificial Sequence
  chemically synthesized
aaaaatctgttaaagagaga

SEQ ID NO: 18121 - DNA, 20 bp, Artificial Sequence
  chemically synthesized
aaatctgttaaagagagaga

SEQ ID NO: 18122 - DNA, 20 bp, Artificial Sequence
  chemically synthesized
tgttaaagagagagagagaa

SEQ ID NO: 18123 - DNA, 20 bp, Artificial Sequence
  chemically synthesized
aagagagagagagaaaagaa

SEQ ID NO: 18124 - DNA, 20 bp, Artificial Sequence
  chemically synthesized
gagagagagaaaagaaaagt

SEQ ID NO: 18125 - DNA, 20 bp, Artificial Sequence
  chemically synthesized
aagaaaagtgagtaaaaaac

SEQ ID NO: 18126 - DNA, 20 bp, Artificial Sequence
  chemically synthesized
aaagtgagtaaaaaacaaga

SEQ ID NO: 18127 - DNA, 20 bp, Artificial Sequence
  chemically synthesized
gagtaaaaaacaagaaagta

SEQ ID NO: 18128 - DNA, 20 bp, Artificial Sequence
  chemically synthesized
ttattttatttatattgtta

SEQ ID NO: 18129 - DNA, 20 bp, Artificial Sequence
  chemically synthesized
tttatttatattgttatggt

SEQ ID NO: 18130 - DNA, 20 bp, Artificial Sequence
  chemically synthesized
ttatttatattgttatggtg

SEQ ID NO: 18131 - DNA, 20 bp, Artificial Sequence
  chemically synthesized
attgttatggtgaggaaatt

SEQ ID NO: 18132 - DNA, 20 bp, Artificial Sequence
  chemically synthesized
atggtgaggaaattgagcct

SEQ ID NO: 18133 - DNA, 20 bp, Artificial Sequence
  chemically synthesized
gaggaaattgagccttagac

SEQ ID NO: 18134 - DNA, 20 bp, Artificial Sequence
  chemically synthesized
aattgagccttagacaagtt

SEQ ID NO: 18135 - DNA, 20 bp, Artificial Sequence
  chemically synthesized
ccttagacaagttaagcaat

SEQ ID NO: 18136 - DNA, 20 bp, Artificial Sequence
  chemically synthesized
acaagttaagcaattagcct

SEQ ID NO: 18137 - DNA, 20 bp, Artificial Sequence
  chemically synthesized
cgcaactaatatgtgtcata

SEQ ID NO: 18138 - DNA, 20 bp, Artificial Sequence
  chemically synthesized
gcaactaatatgtgtcataa

SEQ ID NO: 18139 - DNA, 20 bp, Artificial Sequence
  chemically synthesized
gtcataaaggaattcaaaca

SEQ ID NO: 18140 - DNA, 20 bp, Artificial Sequence
  chemically synthesized
tcataaaggaattcaaacac

SEQ ID NO: 18141 - DNA, 20 bp, Artificial Sequence
  chemically synthesized
gtttatctaacccaaaaccc

SEQ ID NO: 18142 - DNA, 20 bp, Artificial Sequence
  chemically synthesized
ctcaaccaatgtccatcaaa

SEQ ID NO: 18143 - DNA, 20 bp, Artificial Sequence
  chemically synthesized
caatgtccatcaaatggaaa

SEQ ID NO: 18144 - DNA, 20 bp, Artificial Sequence
  chemically synthesized
gcttcccgtatttgaatcct

SEQ ID NO: 18145 - DNA, 20 bp, Artificial Sequence
  chemically synthesized
atccttggcttttcttacct

SEQ ID NO: 18146 - DNA, 20 bp, Artificial Sequence
  chemically synthesized
ggcttttcttacctgagcca

SEQ ID NO: 18147 - DNA, 20 bp, Artificial Sequence
  chemically synthesized
gagccacagttttctctttg

SEQ ID NO: 18148 - DNA, 20 bp, Artificial Sequence
  chemically synthesized
gttttctctttgcggtttct

SEQ ID NO: 18149 - DNA, 20 bp, Artificial Sequence
  chemically synthesized
tctgagcatgacctgaatat

SEQ ID NO: 18150 - DNA, 20 bp, Artificial Sequence
  chemically synthesized
ttggttgtttgctatatcct

SEQ ID NO: 18151 - DNA, 20 bp, Artificial Sequence
  chemically synthesized
tatttactcttaattctgat

SEQ ID NO: 18152 - DNA, 20 bp, Artificial Sequence
  chemically synthesized
tttactcttaattctgatga

SEQ ID NO: 18153 - DNA, 20 bp, Artificial Sequence
  chemically synthesized
ttgttacacaaacaactctc

SEQ ID NO: 18154 - DNA, 20 bp, Artificial Sequence
  chemically synthesized
tgttacacaaacaactctca

SEQ ID NO: 18155 - DNA, 20 bp, Artificial Sequence
  chemically synthesized
gttacacaaacaactctcaa

SEQ ID NO: 18156 - DNA, 20 bp, Artificial Sequence
  chemically synthesized
ttacacaaacaactctcaag

SEQ ID NO: 18157 - DNA, 20 bp, Artificial Sequence
  chemically synthesized
caactctcaaggggttattc

SEQ ID NO: 18158 - DNA, 20 bp, Artificial Sequence
  chemically synthesized
tattctagctcatttccaca

SEQ ID NO: 18159 - DNA, 20 bp, Artificial Sequence
  chemically synthesized
attctagctcatttccacat

SEQ ID NO: 18160 - DNA, 20 bp, Artificial Sequence
  chemically synthesized
tcatttccacataggatatt

SEQ ID NO: 18161 - DNA, 20 bp, Artificial Sequence
  chemically synthesized
catttccacataggatattt

SEQ ID NO: 18162 - DNA, 20 bp, Artificial Sequence
  chemically synthesized
ccacataggatatttgggaa

SEQ ID NO: 18163 - DNA, 20 bp, Artificial Sequence
  chemically synthesized
ttctcttttcctccccaacc

SEQ ID NO: 18164 - DNA, 20 bp, Artificial Sequence
  chemically synthesized
tctcttttcctccccaacct

SEQ ID NO: 18165 - DNA, 20 bp, Artificial Sequence
  chemically synthesized
ttttcctccccaacctggga

SEQ ID NO: 18166 - DNA, 20 bp, Artificial Sequence
  chemically synthesized
tccccaacctgggaaagatc

SEQ ID NO: 18167 - DNA, 20 bp, Artificial Sequence
  chemically synthesized
ccccaacctgggaaagatct

SEQ ID NO: 18168 - DNA, 20 bp, Artificial Sequence
  chemically synthesized
aagatctgggccattgaaac

SEQ ID NO: 18169 - DNA, 20 bp, Artificial Sequence
  chemically synthesized
gccattgaaactggtcccca

SEQ ID NO: 18170 - DNA, 20 bp, Artificial Sequence
  chemically synthesized
catggcctttattttttctt

SEQ ID NO: 18171 - DNA, 20 bp, Artificial Sequence
  chemically synthesized
ggcctttattttttctttgg

SEQ ID NO: 18172 - DNA, 20 bp, Artificial Sequence
  chemically synthesized
gcctttattttttctttgga

SEQ ID NO: 18173 - DNA, 20 bp, Artificial Sequence
  chemically synthesized
ctttattttttctttggaag

SEQ ID NO: 18174 - DNA, 20 bp, Artificial Sequence
  chemically synthesized
ttattttttctttggaagga

SEQ ID NO: 18175 - DNA, 20 bp, Artificial Sequence
  chemically synthesized
tctttggaaggagagtctct

SEQ ID NO: 18176 - DNA, 20 bp, Artificial Sequence
  chemically synthesized
tttggaaggagagtctctaa

SEQ ID NO: 18177 - DNA, 20 bp, Artificial Sequence
  chemically synthesized
ggaaggagagtctctaagag

SEQ ID NO: 18178 - DNA, 20 bp, Artificial Sequence
  chemically synthesized
agaagttgtgtctctaacat

SEQ ID NO: 18179 - DNA, 20 bp, Artificial Sequence
  chemically synthesized
ttgtgtctctaacatcagat

SEQ ID NO: 18180 - DNA, 20 bp, Artificial Sequence
  chemically synthesized
tgtgtctctaacatcagatg

SEQ ID NO: 18181 - DNA, 20 bp, Artificial Sequence
  chemically synthesized
agatgaggcatgaccgaaat

SEQ ID NO: 18182 - DNA, 20 bp, Artificial Sequence
  chemically synthesized
gaccgaaatgagtcactctc

SEQ ID NO: 18183 - DNA, 20 bp, Artificial Sequence
  chemically synthesized
gtcactctcaagtgttccat

SEQ ID NO: 18184 - DNA, 20 bp, Artificial Sequence
  chemically synthesized
ctcaagtgttccattggtct

SEQ ID NO: 18185 - DNA, 20 bp, Artificial Sequence
  chemically synthesized
caagtgttccattggtctta

SEQ ID NO: 18186 - DNA, 20 bp, Artificial Sequence
  chemically synthesized
gtgttccattggtcttagag

SEQ ID NO: 18187 - DNA, 20 bp, Artificial Sequence
  chemically synthesized
tgttccattggtcttagagt

SEQ ID NO: 18188 - DNA, 20 bp, Artificial Sequence
  chemically synthesized
tccattggtcttagagtggg

SEQ ID NO: 18189 - DNA, 20 bp, Artificial Sequence
  chemically synthesized
tggtcttagagtgggaagac

SEQ ID NO: 18190 - DNA, 20 bp, Artificial Sequence
  chemically synthesized
tttgtaaatgttaacatttg

SEQ ID NO: 18191 - DNA, 20 bp, Artificial Sequence
  chemically synthesized
caaccctttacaaaatcctt

SEQ ID NO: 18192 - DNA, 20 bp, Artificial Sequence
  chemically synthesized
tcgtcttgatgattattcat

SEQ ID NO: 18193 - DNA, 20 bp, Artificial Sequence
  chemically synthesized
aaaactcactaccctaccct

SEQ ID NO: 18194 - DNA, 20 bp, Artificial Sequence
  chemically synthesized
ctatctcattcatatatatg

SEQ ID NO: 18195 - DNA, 20 bp, Artificial Sequence
  chemically synthesized
tatctcattcatatatatgt

SEQ ID NO: 18196 - DNA, 20 bp, Artificial Sequence
  chemically synthesized
gtgggtttcatttaattatt

SEQ ID NO: 18197 - DNA, 20 bp, Artificial Sequence
  chemically synthesized
ttatttagtatatgtatata

SEQ ID NO: 18198 - DNA, 20 bp, Artificial Sequence
  chemically synthesized
actatcaatatatgtatgca

SEQ ID NO: 18199 - DNA, 20 bp, Artificial Sequence
  chemically synthesized
ctatcaatatatgtatgcat

SEQ ID NO: 18200 - DNA, 20 bp, Artificial Sequence
  chemically synthesized
tgtgtgtatatatatattca

SEQ ID NO: 18201 - DNA, 20 bp, Artificial Sequence
  chemically synthesized
tgtatatatatattcacaga

SEQ ID NO: 18202 - DNA, 20 bp, Artificial Sequence
  chemically synthesized
tatatatatattcacagaca

SEQ ID NO: 18203 - DNA, 20 bp, Artificial Sequence
  chemically synthesized
tatatattcacagacagaga

SEQ ID NO: 18204 - DNA, 20 bp, Artificial Sequence
  chemically synthesized
tattcacagacagagacagt

SEQ ID NO: 18205 - DNA, 20 bp, Artificial Sequence
  chemically synthesized
ttcacagacagagacagtga

SEQ ID NO: 18206 - DNA, 20 bp, Artificial Sequence
  chemically synthesized
cacagacagagacagtgaga

SEQ ID NO: 18207 - DNA, 20 bp, Artificial Sequence
  chemically synthesized
cagacagagacagtgagaga

SEQ ID NO: 18208 - DNA, 20 bp, Artificial Sequence
  chemically synthesized
gacagagacagtgagagaga

SEQ ID NO: 18209 - DNA, 20 bp, Artificial Sequence
  chemically synthesized
cagagacagtgagagagaga

SEQ ID NO: 18210 - DNA, 20 bp, Artificial Sequence
  chemically synthesized
gagacagtgagagagagaga

SEQ ID NO: 18211 - DNA, 20 bp, Artificial Sequence
  chemically synthesized
taatatctactccttatatt

SEQ ID NO: 18212 - DNA, 20 bp, Artificial Sequence
  chemically synthesized
aatatctactccttatattt

SEQ ID NO: 18213 - DNA, 20 bp, Artificial Sequence
  chemically synthesized
ttatatttaggtctgatctc

SEQ ID NO: 18214 - DNA, 20 bp, Artificial Sequence
  chemically synthesized
agaataaaataaccatatat

SEQ ID NO: 18215 - DNA, 20 bp, Artificial Sequence
  chemically synthesized
attcatacataatttttttc

SEQ ID NO: 18216 - DNA, 20 bp, Artificial Sequence
  chemically synthesized
aatttttttctagatgtata

SEQ ID NO: 18217 - DNA, 20 bp, Artificial Sequence
  chemically synthesized
atatctgcattaaaaaccct

SEQ ID NO: 18218 - DNA, 20 bp, Artificial Sequence
  chemically synthesized
ccctaagacttctttcctga

SEQ ID NO: 18219 - DNA, 20 bp, Artificial Sequence
  chemically synthesized
cctaagacttctttcctgat

SEQ ID NO: 18220 - DNA, 20 bp, Artificial Sequence
  chemically synthesized
gatgggtgaaccaatatcaa

SEQ ID NO: 18221 - DNA, 20 bp, Artificial Sequence
  chemically synthesized
ccttattgaacataataatc

SEQ ID NO: 18222 - DNA, 20 bp, Artificial Sequence
  chemically synthesized
taatccagatgttgtcatat

SEQ ID NO: 18223 - DNA, 20 bp, Artificial Sequence
  chemically synthesized
tctgaaatctcttttttcat

SEQ ID NO: 18224 - DNA, 20 bp, Artificial Sequence
  chemically synthesized
ttttcattggattatgtgct

SEQ ID NO: 18225 - DNA, 20 bp, Artificial Sequence
  chemically synthesized
tatgtgctgagtttctattt

SEQ ID NO: 18226 - DNA, 20 bp, Artificial Sequence
  chemically synthesized
gtgctgagtttctatttaag

SEQ ID NO: 18227 - DNA, 20 bp, Artificial Sequence
  chemically synthesized
agtttctatttaagtagtct

SEQ ID NO: 18228 - DNA, 20 bp, Artificial Sequence
  chemically synthesized
ttaagtagtctaagatcgtg

SEQ ID NO: 18229 - DNA, 20 bp, Artificial Sequence
  chemically synthesized
atctcaaaacatgtcaaatt

SEQ ID NO: 18230 - DNA, 20 bp, Artificial Sequence
  chemically synthesized
acatgtcaaattcagtcttt

SEQ ID NO: 18231 - DNA, 20 bp, Artificial Sequence
  chemically synthesized
tcagtctttcagatttaaaa

SEQ ID NO: 18232 - DNA, 20 bp, Artificial Sequence
  chemically synthesized
cataatatatgtgacactcg

SEQ ID NO: 18233 - DNA, 20 bp, Artificial Sequence
  chemically synthesized
atatatgtgacactcgcagc

SEQ ID NO: 18234 - DNA, 20 bp, Artificial Sequence
  chemically synthesized
tactatcacctgtttatact

SEQ ID NO: 18235 - DNA, 20 bp, Artificial Sequence
  chemically synthesized
actatcacctgtttatactt

SEQ ID NO: 18236 - DNA, 20 bp, Artificial Sequence
  chemically synthesized
ctatcacctgtttatactta

SEQ ID NO: 18237 - DNA, 20 bp, Artificial Sequence
  chemically synthesized
tatcacctgtttatacttag

SEQ ID NO: 18238 - DNA, 20 bp, Artificial Sequence
  chemically synthesized
taaatatcctctcatatatt

SEQ ID NO: 18239 - DNA, 20 bp, Artificial Sequence
  chemically synthesized
aaatatcctctcatatattc

SEQ ID NO: 18240 - DNA, 20 bp, Artificial Sequence
  chemically synthesized
atcctctcatatattcaggt

SEQ ID NO: 18241 - DNA, 20 bp, Artificial Sequence
  chemically synthesized
attttgccaaaacgtgattt

SEQ ID NO: 18242 - DNA, 20 bp, Artificial Sequence
  chemically synthesized
ttttgccaaaacgtgatttt

SEQ ID NO: 18243 - DNA, 20 bp, Artificial Sequence
  chemically synthesized
aaacgtgattttaggtcata

SEQ ID NO: 18244 - DNA, 20 bp, Artificial Sequence
  chemically synthesized
atacagcaataaatgcattc

SEQ ID NO: 18245 - DNA, 20 bp, Artificial Sequence
  chemically synthesized
gcattccagaattcattttg

SEQ ID NO: 18246 - DNA, 20 bp, Artificial Sequence
  chemically synthesized
tttgcagaacctgttgattc

SEQ ID NO: 18247 - DNA, 20 bp, Artificial Sequence
  chemically synthesized
acctgttgattctagacttg

SEQ ID NO: 18248 - DNA, 20 bp, Artificial Sequence
  chemically synthesized
ttgattctagacttgtagct

SEQ ID NO: 18249 - DNA, 20 bp, Artificial Sequence
  chemically synthesized
attctagacttgtagctaag

SEQ ID NO: 18250 - DNA, 20 bp, Artificial Sequence
  chemically synthesized
gacttgtagctaagaagtga

SEQ ID NO: 18251 - DNA, 20 bp, Artificial Sequence
  chemically synthesized
gtagctaagaagtgacggct

SEQ ID NO: 18252 - DNA, 20 bp, Artificial Sequence
  chemically synthesized
tggtaaataaccatatcata

SEQ ID NO: 18253 - DNA, 20 bp, Artificial Sequence
  chemically synthesized
aaataaccatatcataaagt

SEQ ID NO: 18254 - DNA, 20 bp, Artificial Sequence
  chemically synthesized
gtcagttctctttgtactca

SEQ ID NO: 18255 - DNA, 20 bp, Artificial Sequence
  chemically synthesized
cagtaaaacaaaacttctga

SEQ ID NO: 18256 - DNA, 20 bp, Artificial Sequence
  chemically synthesized
caaaacttctgaaagatttt

SEQ ID NO: 18257 - DNA, 20 bp, Artificial Sequence
  chemically synthesized
acttctgaaagattttaagt

SEQ ID NO: 18258 - DNA, 20 bp, Artificial Sequence
  chemically synthesized
ttttaagtgagtgacatttt

SEQ ID NO: 18259 - DNA, 20 bp, Artificial Sequence
  chemically synthesized
gacattttcagtgcttaaaa

SEQ ID NO: 18260 - DNA, 20 bp, Artificial Sequence
  chemically synthesized
cattttcagtgcttaaaatg

SEQ ID NO: 18261 - DNA, 20 bp, Artificial Sequence
  chemically synthesized
ttaaaatggagcttaacata

SEQ ID NO: 18262 - DNA, 20 bp, Artificial Sequence
  chemically synthesized
aaatggagcttaacatatag

SEQ ID NO: 18263 - DNA, 20 bp, Artificial Sequence
  chemically synthesized
aatggagcttaacatatagt

SEQ ID NO: 18264 - DNA, 20 bp, Artificial Sequence
  chemically synthesized
cttaacatatagtgggtgct

SEQ ID NO: 18265 - DNA, 20 bp, Artificial Sequence
  chemically synthesized
acatatagtgggtgctcagt

SEQ ID NO: 18266 - DNA, 20 bp, Artificial Sequence
  chemically synthesized
agtgggtgctcagtaagtac

SEQ ID NO: 18267 - DNA, 20 bp, Artificial Sequence
  chemically synthesized
gtgctcagtaagtactagtt

SEQ ID NO: 18268 - DNA, 20 bp, Artificial Sequence
  chemically synthesized
tgaatgctattcttgtgatc

SEQ ID NO: 18269 - DNA, 20 bp, Artificial Sequence
  chemically synthesized
tattcttgtgatcaagccat

SEQ ID NO: 18270 - DNA, 20 bp, Artificial Sequence
  chemically synthesized
tgatcaagccattggttttg

SEQ ID NO: 18271 - DNA, 20 bp, Artificial Sequence
  chemically synthesized
ttggttttgtagccaaattg

SEQ ID NO: 18272 - DNA, 20 bp, Artificial Sequence
  chemically synthesized
cctctacatctgtttgtaat

SEQ ID NO: 18273 - DNA, 20 bp, Artificial Sequence
  chemically synthesized
tctgtttgtaataagattac

SEQ ID NO: 18274 - DNA, 20 bp, Artificial Sequence
  chemically synthesized
tgtaataagattactagttc

SEQ ID NO: 18275 - DNA, 20 bp, Artificial Sequence
  chemically synthesized
atctccttttctttattgtt

SEQ ID NO: 18276 - DNA, 20 bp, Artificial Sequence
  chemically synthesized
tctaatttttacatcaatca

SEQ ID NO: 18277 - DNA, 20 bp, Artificial Sequence
  chemically synthesized
tttttacatcaatcatggtt

SEQ ID NO: 18278 - DNA, 20 bp, Artificial Sequence
  chemically synthesized
tttacatcaatcatggttca

SEQ ID NO: 18279 - DNA, 20 bp, Artificial Sequence
  chemically synthesized
gaaaaatccataacaacatc

SEQ ID NO: 18280 - DNA, 20 bp, Artificial Sequence
  chemically synthesized
aaatccataacaacatcaag

SEQ ID NO: 18281 - DNA, 20 bp, Artificial Sequence
  chemically synthesized
ccataacaacatcaagaaga

SEQ ID NO: 18282 - DNA, 20 bp, Artificial Sequence
  chemically synthesized
tcaagaagaaagattttttg

SEQ ID NO: 18283 - DNA, 20 bp, Artificial Sequence
  chemically synthesized
tcttttctttcctctctttt

SEQ ID NO: 18284 - DNA, 20 bp, Artificial Sequence
  chemically synthesized
ttctttcctctcttttgaga

SEQ ID NO: 18285 - DNA, 20 bp, Artificial Sequence
  chemically synthesized
cagtgtcttgctctgtcacc

SEQ ID NO: 18286 - DNA, 20 bp, Artificial Sequence
  chemically synthesized
agtgtcttgctctgtcaccc

SEQ ID NO: 18287 - DNA, 20 bp, Artificial Sequence
  chemically synthesized
tgtcttgctctgtcacccag

SEQ ID NO: 18288 - DNA, 20 bp, Artificial Sequence
  chemically synthesized
gtcttgctctgtcacccagg

SEQ ID NO: 18289 - DNA, 20 bp, Artificial Sequence
  chemically synthesized
tcttgctctgtcacccagga

SEQ ID NO: 18290 - DNA, 20 bp, Artificial Sequence
  chemically synthesized
ttgctctgtcacccaggagg

SEQ ID NO: 18291 - DNA, 20 bp, Artificial Sequence
  chemically synthesized
ctgtcacccaggagggagtg

SEQ ID NO: 18292 - DNA, 20 bp, Artificial Sequence
  chemically synthesized
tcacccaggagggagtgcag

SEQ ID NO: 18293 - DNA, 20 bp, Artificial Sequence
  chemically synthesized
ccaggagggagtgcagtggt

SEQ ID NO: 18294 - DNA, 20 bp, Artificial Sequence
  chemically synthesized
ggagtgcagtggtgagatca

SEQ ID NO: 18295 - DNA, 20 bp, Artificial Sequence
  chemically synthesized
ggtgagatcatagtttactg

SEQ ID NO: 18296 - DNA, 20 bp, Artificial Sequence
  chemically synthesized
tcatagtttactgcagcctc

SEQ ID NO: 18297 - DNA, 20 bp, Artificial Sequence
  chemically synthesized
ttactgcagcctcaagcttt

SEQ ID NO: 18298 - DNA, 20 bp, Artificial Sequence
  chemically synthesized
tactgcagcctcaagctttt

SEQ ID NO: 18299 - DNA, 20 bp, Artificial Sequence
  chemically synthesized
agcctcaagcttttaggctt

SEQ ID NO: 18300 - DNA, 20 bp, Artificial Sequence
  chemically synthesized
cttaagtgatttttacacct

SEQ ID NO: 18301 - DNA, 20 bp, Artificial Sequence
  chemically synthesized
ttacacctcagcctcccaaa

SEQ ID NO: 18302 - DNA, 20 bp, Artificial Sequence
  chemically synthesized
ccaaatagctgtgaccacat

SEQ ID NO: 18303 - DNA, 20 bp, Artificial Sequence
  chemically synthesized
aatagctgtgaccacatgag

SEQ ID NO: 18304 - DNA, 20 bp, Artificial Sequence
  chemically synthesized
tagctgtgaccacatgagaa

SEQ ID NO: 18305 - DNA, 20 bp, Artificial Sequence
  chemically synthesized
ttatgtgtttttttccttct

SEQ ID NO: 18306 - DNA, 20 bp, Artificial Sequence
  chemically synthesized
ttttttccttcttagtactt

SEQ ID NO: 18307 - DNA, 20 bp, Artificial Sequence
  chemically synthesized
cttcttagtactttggctgc

SEQ ID NO: 18308 - DNA, 20 bp, Artificial Sequence
  chemically synthesized
ttagtactttggctgcaagt

SEQ ID NO: 18309 - DNA, 20 bp, Artificial Sequence
  chemically synthesized
tttggctgcaagtgagtctc

SEQ ID NO: 18310 - DNA, 20 bp, Artificial Sequence
  chemically synthesized
ttggctgcaagtgagtctca

SEQ ID NO: 18311 - DNA, 20 bp, Artificial Sequence
  chemically synthesized
ctgcaagtgagtctcaaggt

SEQ ID NO: 18312 - DNA, 20 bp, Artificial Sequence
  chemically synthesized
taagatgttttaaccactta

SEQ ID NO: 18313 - DNA, 20 bp, Artificial Sequence
  chemically synthesized
tattctcccattccaatgaa

SEQ ID NO: 18314 - DNA, 20 bp, Artificial Sequence
  chemically synthesized
tgttgatgtctaaatacacc

SEQ ID NO: 18315 - DNA, 20 bp, Artificial Sequence
  chemically synthesized
gatctatctatactactaaa

SEQ ID NO: 18316 - DNA, 20 bp, Artificial Sequence
  chemically synthesized
tatctatactactaaatagc

SEQ ID NO: 18317 - DNA, 20 bp, Artificial Sequence
  chemically synthesized
tagctagaccaatacatgaa

SEQ ID NO: 18318 - DNA, 20 bp, Artificial Sequence
  chemically synthesized
agaaactcttattctcaata

SEQ ID NO: 18319 - DNA, 20 bp, Artificial Sequence
  chemically synthesized
gtaccccaacaataatatat

SEQ ID NO: 18320 - DNA, 20 bp, Artificial Sequence
  chemically synthesized
ttatcttctttgtgtcttat

SEQ ID NO: 18321 - DNA, 20 bp, Artificial Sequence
  chemically synthesized
ttatcagttatgttaccata

SEQ ID NO: 18322 - DNA, 20 bp, Artificial Sequence
  chemically synthesized
tatcagttatgttaccatat

SEQ ID NO: 18323 - DNA, 20 bp, Artificial Sequence
  chemically synthesized
cagttatgttaccatatagg

SEQ ID NO: 18324 - DNA, 20 bp, Artificial Sequence
  chemically synthesized
gttatgttaccatataggaa

SEQ ID NO: 18325 - DNA, 20 bp, Artificial Sequence
  chemically synthesized
tgttaccatataggaagaga

SEQ ID NO: 18326 - DNA, 20 bp, Artificial Sequence
  chemically synthesized
aggaagagaaagaaaattat

SEQ ID NO: 18327 - DNA, 20 bp, Artificial Sequence
  chemically synthesized
gtaccatctcacatctatgc

SEQ ID NO: 18328 - DNA, 20 bp, Artificial Sequence
  chemically synthesized
taccatctcacatctatgca

SEQ ID NO: 18329 - DNA, 20 bp, Artificial Sequence
  chemically synthesized
tcacatctatgcaaggcaaa

SEQ ID NO: 18330 - DNA, 20 bp, Artificial Sequence
  chemically synthesized
cacatctatgcaaggcaaat

SEQ ID NO: 18331 - DNA, 20 bp, Artificial Sequence
  chemically synthesized
tgcaaggcaaataggactaa

SEQ ID NO: 18332 - DNA, 20 bp, Artificial Sequence
  chemically synthesized
ggcaaataggactaatagta

SEQ ID NO: 18333 - DNA, 20 bp, Artificial Sequence
  chemically synthesized
gcaaataggactaatagtac

SEQ ID NO: 18334 - DNA, 20 bp, Artificial Sequence
  chemically synthesized
caaataggactaatagtaca

SEQ ID NO: 18335 - DNA, 20 bp, Artificial Sequence
  chemically synthesized
aggactaatagtacagggac

SEQ ID NO: 18336 - DNA, 20 bp, Artificial Sequence
  chemically synthesized
ggactaatagtacagggaca

SEQ ID NO: 18337 - DNA, 20 bp, Artificial Sequence
  chemically synthesized
tagtacagggacaaggctga

SEQ ID NO: 18338 - DNA, 20 bp, Artificial Sequence
  chemically synthesized
agtacagggacaaggctgaa

SEQ ID NO: 18339 - DNA, 20 bp, Artificial Sequence
  chemically synthesized
tacagggacaaggctgaaag

SEQ ID NO: 18340 - DNA, 20 bp, Artificial Sequence
  chemically synthesized
aggctgaaaggagacatttt

SEQ ID NO: 18341 - DNA, 20 bp, Artificial Sequence
  chemically synthesized
ggctgaaaggagacatttta

SEQ ID NO: 18342 - DNA, 20 bp, Artificial Sequence
  chemically synthesized
aaggagacattttaaggttg

SEQ ID NO: 18343 - DNA, 20 bp, Artificial Sequence
  chemically synthesized
aggagacattttaaggttga

SEQ ID NO: 18344 - DNA, 20 bp, Artificial Sequence
  chemically synthesized
attttaaggttgaaggtatg

SEQ ID NO: 18345 - DNA, 20 bp, Artificial Sequence
  chemically synthesized
atgcagtaaaacttgttttc

SEQ ID NO: 18346 - DNA, 20 bp, Artificial Sequence
  chemically synthesized
gcagtaaaacttgttttctg

SEQ ID NO: 18347 - DNA, 20 bp, Artificial Sequence
  chemically synthesized
ttttctggagattacgttga

SEQ ID NO: 18348 - DNA, 20 bp, Artificial Sequence
  chemically synthesized
tctggagattacgttgaaag

SEQ ID NO: 18349 - DNA, 20 bp, Artificial Sequence
  chemically synthesized
gattacgttgaaagaagtta

SEQ ID NO: 18350 - DNA, 20 bp, Artificial Sequence
  chemically synthesized
acgttgaaagaagttacagt

SEQ ID NO: 18351 - DNA, 20 bp, Artificial Sequence
  chemically synthesized
ttacagtcagtcaatctaat

SEQ ID NO: 18352 - DNA, 20 bp, Artificial Sequence
  chemically synthesized
tacagtcagtcaatctaatg

SEQ ID NO: 18353 - DNA, 20 bp, Artificial Sequence
  chemically synthesized
cagtcaatctaatgaggttg

SEQ ID NO: 18354 - DNA, 20 bp, Artificial Sequence
  chemically synthesized
tcaatctaatgaggttgtag

SEQ ID NO: 18355 - DNA, 20 bp, Artificial Sequence
  chemically synthesized
ttgtagaagatgaaacaact

SEQ ID NO: 18356 - DNA, 20 bp, Artificial Sequence
  chemically synthesized
agaagatgaaacaactaagc

SEQ ID NO: 18357 - DNA, 20 bp, Artificial Sequence
  chemically synthesized
aacaactaagctggtgctcc

SEQ ID NO: 18358 - DNA, 20 bp, Artificial Sequence
  chemically synthesized
gtaatgacttgatacctgcg

SEQ ID NO: 18359 - DNA, 20 bp, Artificial Sequence
  chemically synthesized
gcgaagtgtctaaatatgta

SEQ ID NO: 18360 - DNA, 20 bp, Artificial Sequence
  chemically synthesized
gaagtgtctaaatatgtata

SEQ ID NO: 18361 - DNA, 20 bp, Artificial Sequence
  chemically synthesized
aagtgtctaaatatgtatag

SEQ ID NO: 18362 - DNA, 20 bp, Artificial Sequence
  chemically synthesized
gtgtctaaatatgtatagag

SEQ ID NO: 18363 - DNA, 20 bp, Artificial Sequence
  chemically synthesized
gtatagaggagttgataata

SEQ ID NO: 18364 - DNA, 20 bp, Artificial Sequence
  chemically synthesized
aatatagaccaattgcactt

SEQ ID NO: 18365 - DNA, 20 bp, Artificial Sequence
  chemically synthesized
atatagaccaattgcacttt

SEQ ID NO: 18366 - DNA, 20 bp, Artificial Sequence
  chemically synthesized
ttgcactttgggcccctgct

SEQ ID NO: 18367 - DNA, 20 bp, Artificial Sequence
  chemically synthesized
actttgggcccctgctgagt

SEQ ID NO: 18368 - DNA, 20 bp, Artificial Sequence
  chemically synthesized
gtgtcaactaaacaaaacga

SEQ ID NO: 18369 - DNA, 20 bp, Artificial Sequence
  chemically synthesized
tgtcaactaaacaaaacgat

SEQ ID NO: 18370 - DNA, 20 bp, Artificial Sequence
  chemically synthesized
taggaaattgtatttcccca

SEQ ID NO: 18371 - DNA, 20 bp, Artificial Sequence
  chemically synthesized
gtatttccccaaagacattt

SEQ ID NO: 18372 - DNA, 20 bp, Artificial Sequence
  chemically synthesized
attttggaaacgttctcctt

SEQ ID NO: 18373 - DNA, 20 bp, Artificial Sequence
  chemically synthesized
acgttctccttcagcaccaa

SEQ ID NO: 18374 - DNA, 20 bp, Artificial Sequence
  chemically synthesized
ttctccttcagcaccaatgg

SEQ ID NO: 18375 - DNA, 20 bp, Artificial Sequence
  chemically synthesized
tcagcaccaatggtagcacc

SEQ ID NO: 18376 - DNA, 20 bp, Artificial Sequence
  chemically synthesized
gaactgaccatccaacttcc

SEQ ID NO: 18377 - DNA, 20 bp, Artificial Sequence
  chemically synthesized
ccaatctctttcctccatca

SEQ ID NO: 18378 - DNA, 20 bp, Artificial Sequence
  chemically synthesized
tctttcctccatcatggaaa

SEQ ID NO: 18379 - DNA, 20 bp, Artificial Sequence
  chemically synthesized
aaacagccctgcatattcaa

SEQ ID NO: 18380 - DNA, 20 bp, Artificial Sequence
  chemically synthesized
agccctgcatattcaaaagt

SEQ ID NO: 18381 - DNA, 20 bp, Artificial Sequence
  chemically synthesized
gtccctctcttatacctcgt

SEQ ID NO: 18382 - DNA, 20 bp, Artificial Sequence
  chemically synthesized
ccctctcttatacctcgtca

SEQ ID NO: 18383 - DNA, 20 bp, Artificial Sequence
  chemically synthesized
ctctcttatacctcgtcaga

SEQ ID NO: 18384 - DNA, 20 bp, Artificial Sequence
  chemically synthesized
gtcatattcacaatccacaa

SEQ ID NO: 18385 - DNA, 20 bp, Artificial Sequence
  chemically synthesized
tcatattcacaatccacaac

SEQ ID NO: 18386 - DNA, 20 bp, Artificial Sequence
  chemically synthesized
ttcacaatccacaacaggcc

SEQ ID NO: 18387 - DNA, 20 bp, Artificial Sequence
  chemically synthesized
aacaggcccagataaccgtt

SEQ ID NO: 18388 - DNA, 20 bp, Artificial Sequence
  chemically synthesized
agataaccgttcagtgatgc

SEQ ID NO: 18389 - DNA, 20 bp, Artificial Sequence
  chemically synthesized
agtgatgctggtcatcactg

SEQ ID NO: 18390 - DNA, 20 bp, Artificial Sequence
  chemically synthesized
atgctggtcatcactgaaga

SEQ ID NO: 18391 - DNA, 20 bp, Artificial Sequence
  chemically synthesized
attgaatcttcctttcttct

SEQ ID NO: 18392 - DNA, 20 bp, Artificial Sequence
  chemically synthesized
ttcttcttggacgtaaattg

SEQ ID NO: 18393 - DNA, 20 bp, Artificial Sequence
  chemically synthesized
tcttcttggacgtaaattgc

SEQ ID NO: 18394 - DNA, 20 bp, Artificial Sequence
  chemically synthesized
attgaaaaaactataacttg

SEQ ID NO: 18395 - DNA, 20 bp, Artificial Sequence
  chemically synthesized
aactataacttgaagtttca

SEQ ID NO: 18396 - DNA, 20 bp, Artificial Sequence
  chemically synthesized
tataacttgaagtttcatag

SEQ ID NO: 18397 - DNA, 20 bp, Artificial Sequence
  chemically synthesized
acttgaagtttcatagcaga

SEQ ID NO: 18398 - DNA, 20 bp, Artificial Sequence
  chemically synthesized
gaagtttcatagcagaaagt

SEQ ID NO: 18399 - DNA, 20 bp, Artificial Sequence
  chemically synthesized
aagttggcatctttctcact

SEQ ID NO: 18400 - DNA, 20 bp, Artificial Sequence
  chemically synthesized
gcatctttctcactaagcat

SEQ ID NO: 18401 - DNA, 20 bp, Artificial Sequence
  chemically synthesized
ctaagcatgagaaaaactaa

SEQ ID NO: 18402 - DNA, 20 bp, Artificial Sequence
  chemically synthesized
aagcatgagaaaaactaaca

SEQ ID NO: 18403 - DNA, 20 bp, Artificial Sequence
  chemically synthesized
actaacagagttttaatttg

SEQ ID NO: 18404 - DNA, 20 bp, Artificial Sequence
  chemically synthesized
ctaacagagttttaatttga

SEQ ID NO: 18405 - DNA, 20 bp, Artificial Sequence
  chemically synthesized
taacagagttttaatttgaa

SEQ ID NO: 18406 - DNA, 20 bp, Artificial Sequence
  chemically synthesized
agttttaatttgaagggcct

SEQ ID NO: 18407 - DNA, 20 bp, Artificial Sequence
  chemically synthesized
ttgaagggccttagccaact

SEQ ID NO: 18408 - DNA, 20 bp, Artificial Sequence
  chemically synthesized
ggccttagccaacttagctg

SEQ ID NO: 18409 - DNA, 20 bp, Artificial Sequence
  chemically synthesized
agctgaagtcccttccacct

SEQ ID NO: 18410 - DNA, 20 bp, Artificial Sequence
  chemically synthesized
agtcccttccacctaagata

SEQ ID NO: 18411 - DNA, 20 bp, Artificial Sequence
  chemically synthesized
cacctaagataaagctgtaa

SEQ ID NO: 18412 - DNA, 20 bp, Artificial Sequence
  chemically synthesized
cctaagataaagctgtaaaa

SEQ ID NO: 18413 - DNA, 20 bp, Artificial Sequence
  chemically synthesized
ctaagataaagctgtaaaag

SEQ ID NO: 18414 - DNA, 20 bp, Artificial Sequence
  chemically synthesized
aagataaagctgtaaaagag

SEQ ID NO: 18415 - DNA, 20 bp, Artificial Sequence
  chemically synthesized
ataaagctgtaaaagaggag

SEQ ID NO: 18416 - DNA, 20 bp, Artificial Sequence
  chemically synthesized
agaggagcagatgtataatt

SEQ ID NO: 18417 - DNA, 20 bp, Artificial Sequence
  chemically synthesized
cagatgtataatttagatat

SEQ ID NO: 18418 - DNA, 20 bp, Artificial Sequence
  chemically synthesized
gatgtataatttagatattg

SEQ ID NO: 18419 - DNA, 20 bp, Artificial Sequence
  chemically synthesized
gtataatttagatattggag

SEQ ID NO: 18420 - DNA, 20 bp, Artificial Sequence
  chemically synthesized
ttagatattggagcagcatg

SEQ ID NO: 18421 - DNA, 20 bp, Artificial Sequence
  chemically synthesized
gcagtatcaaaatacctcat

SEQ ID NO: 18422 - DNA, 20 bp, Artificial Sequence
  chemically synthesized
aaaatacctcatgagcacca

SEQ ID NO: 18423 - DNA, 20 bp, Artificial Sequence
  chemically synthesized
atacctcatgagcaccaaag

SEQ ID NO: 18424 - DNA, 20 bp, Artificial Sequence
  chemically synthesized
aagaagccatatatttttca

SEQ ID NO: 18425 - DNA, 20 bp, Artificial Sequence
  chemically synthesized
ttcttccaaaataacttaca

SEQ ID NO: 18426 - DNA, 20 bp, Artificial Sequence
  chemically synthesized
tccaaaataacttacaaaga

SEQ ID NO: 18427 - DNA, 20 bp, Artificial Sequence
  chemically synthesized
gacagtctttcctctgtcat

SEQ ID NO: 18428 - DNA, 20 bp, Artificial Sequence
  chemically synthesized
ctgtcataagaacctgcacc

SEQ ID NO: 18429 - DNA, 20 bp, Artificial Sequence
  chemically synthesized
tgtcataagaacctgcaccc

SEQ ID NO: 18430 - DNA, 20 bp, Artificial Sequence
  chemically synthesized
ataagaacctgcacccaggt

SEQ ID NO: 18431 - DNA, 20 bp, Artificial Sequence
  chemically synthesized
tgcacccaggtcagcaaatc

SEQ ID NO: 18432 - DNA, 20 bp, Artificial Sequence
  chemically synthesized
cccaggtcagcaaatcaaga

SEQ ID NO: 18433 - DNA, 20 bp, Artificial Sequence
  chemically synthesized
caaatcaagatggaaatgat

SEQ ID NO: 18434 - DNA, 20 bp, Artificial Sequence
  chemically synthesized
aaatcaagatggaaatgatc

SEQ ID NO: 18435 - DNA, 20 bp, Artificial Sequence
  chemically synthesized
aatcaagatggaaatgatcg

SEQ ID NO: 18436 - DNA, 20 bp, Artificial Sequence
  chemically synthesized
accaacacactaataaacat

SEQ ID NO: 18437 - DNA, 20 bp, Artificial Sequence
  chemically synthesized
ccaacacactaataaacatt

SEQ ID NO: 18438 - DNA, 20 bp, Artificial Sequence
  chemically synthesized
aataaacattaggaacttac

SEQ ID NO: 18439 - DNA, 20 bp, Artificial Sequence
  chemically synthesized
ataaacattaggaacttact

SEQ ID NO: 18440 - DNA, 20 bp, Artificial Sequence
  chemically synthesized
gaacttactgggcacattat

SEQ ID NO: 18441 - DNA, 20 bp, Artificial Sequence
  chemically synthesized
actgggcacattatgagaaa

SEQ ID NO: 18442 - DNA, 20 bp, Artificial Sequence
  chemically synthesized
tgggcacattatgagaaaca

SEQ ID NO: 18443 - DNA, 20 bp, Artificial Sequence
  chemically synthesized
gggcacattatgagaaacag

SEQ ID NO: 18444 - DNA, 20 bp, Artificial Sequence
  chemically synthesized
gcacattatgagaaacagag

SEQ ID NO: 18445 - DNA, 20 bp, Artificial Sequence
  chemically synthesized
atgagaaacagaggagtctt

SEQ ID NO: 18446 - DNA, 20 bp, Artificial Sequence
  chemically synthesized
tgagaaacagaggagtcttt

SEQ ID NO: 18447 - DNA, 20 bp, Artificial Sequence
  chemically synthesized
gagaaacagaggagtctttg

SEQ ID NO: 18448 - DNA, 20 bp, Artificial Sequence
  chemically synthesized
agaaacagaggagtctttgg

SEQ ID NO: 18449 - DNA, 20 bp, Artificial Sequence
  chemically synthesized
aggagtctttgggggataac

SEQ ID NO: 18450 - DNA, 20 bp, Artificial Sequence
  chemically synthesized
ttgggggataaccagatttt

SEQ ID NO: 18451 - DNA, 20 bp, Artificial Sequence
  chemically synthesized
ttaagatttgtgtttatact

SEQ ID NO: 18452 - DNA, 20 bp, Artificial Sequence
  chemically synthesized
gtgtttatactcagtatcaa

SEQ ID NO: 18453 - DNA, 20 bp, Artificial Sequence
  chemically synthesized
agcttaaacattgtactcaa

SEQ ID NO: 18454 - DNA, 20 bp, Artificial Sequence
  chemically synthesized
atagcatataattttgctta

SEQ ID NO: 18455 - DNA, 20 bp, Artificial Sequence
  chemically synthesized
attttgcttacagcatgcat

SEQ ID NO: 18456 - DNA, 20 bp, Artificial Sequence
  chemically synthesized
ttttgcttacagcatgcatt

SEQ ID NO: 18457 - DNA, 20 bp, Artificial Sequence
  chemically synthesized
gcatgcattgggtaaataat

SEQ ID NO: 18458 - DNA, 20 bp, Artificial Sequence
  chemically synthesized
aatcggttttacaattgatt

SEQ ID NO: 18459 - DNA, 20 bp, Artificial Sequence
  chemically synthesized
acaattgattcagtatgaaa

SEQ ID NO: 18460 - DNA, 20 bp, Artificial Sequence
  chemically synthesized
gtatgaaaaagttttaatac

SEQ ID NO: 18461 - DNA, 20 bp, Artificial Sequence
  chemically synthesized
tatgaaaaagttttaataca

SEQ ID NO: 18462 - DNA, 20 bp, Artificial Sequence
  chemically synthesized
agttttaatacaaggacata

SEQ ID NO: 18463 - DNA, 20 bp, Artificial Sequence
  chemically synthesized
gcgcctacacctattttttt

SEQ ID NO: 18464 - DNA, 20 bp, Artificial Sequence
  chemically synthesized
ctatttttttaagcattcca

SEQ ID NO: 18465 - DNA, 20 bp, Artificial Sequence
  chemically synthesized
tttttaagcattccatagat

SEQ ID NO: 18466 - DNA, 20 bp, Artificial Sequence
  chemically synthesized
tcccaatataaaactttact

SEQ ID NO: 18467 - DNA, 20 bp, Artificial Sequence
  chemically synthesized
cccaatataaaactttactc

SEQ ID NO: 18468 - DNA, 20 bp, Artificial Sequence
  chemically synthesized
atataaaactttactcaggc

SEQ ID NO: 18469 - DNA, 20 bp, Artificial Sequence
  chemically synthesized
tataaaactttactcaggcc

SEQ ID NO: 18470 - DNA, 20 bp, Artificial Sequence
  chemically synthesized
aactttactcaggccgggcg

SEQ ID NO: 18471 - DNA, 20 bp, Artificial Sequence
  chemically synthesized
tttactcaggccgggcgcgg

SEQ ID NO: 18472 - DNA, 20 bp, Artificial Sequence
  chemically synthesized
gtggctcacgcctgtaatcc

SEQ ID NO: 18473 - DNA, 20 bp, Artificial Sequence
  chemically synthesized
cgcctgtaatcccagcactt

SEQ ID NO: 18474 - DNA, 20 bp, Artificial Sequence
  chemically synthesized
gcctgtaatcccagcacttt

SEQ ID NO: 18475 - DNA, 20 bp, Artificial Sequence
  chemically synthesized
ctgtaatcccagcactttgg

SEQ ID NO: 18476 - DNA, 20 bp, Artificial Sequence
  chemically synthesized
tgtaatcccagcactttggg

SEQ ID NO: 18477 - DNA, 20 bp, Artificial Sequence
  chemically synthesized
tcccagcactttgggaggcc

SEQ ID NO: 18478 - DNA, 20 bp, Artificial Sequence
  chemically synthesized
cccagcactttgggaggccg

SEQ ID NO: 18479 - DNA, 20 bp, Artificial Sequence
  chemically synthesized
agcactttgggaggccgagg

SEQ ID NO: 18480 - DNA, 20 bp, Artificial Sequence
  chemically synthesized
gcactttgggaggccgaggc

SEQ ID NO: 18481 - DNA, 20 bp, Artificial Sequence
  chemically synthesized
ctttgggaggccgaggcggg

SEQ ID NO: 18482 - DNA, 20 bp, Artificial Sequence
  chemically synthesized
ggccgaggcgggtggatcac

SEQ ID NO: 18483 - DNA, 20 bp, Artificial Sequence
  chemically synthesized
gccgaggcgggtggatcacg

SEQ ID NO: 18484 - DNA, 20 bp, Artificial Sequence
  chemically synthesized
aggcgggtggatcacgaggt

SEQ ID NO: 18485 - DNA, 20 bp, Artificial Sequence
  chemically synthesized
ggcgggtggatcacgaggtc

SEQ ID NO: 18486 - DNA, 20 bp, Artificial Sequence
  chemically synthesized
cgggtggatcacgaggtcgg

SEQ ID NO: 18487 - DNA, 20 bp, Artificial Sequence
  chemically synthesized
gatcacgaggtcgggagatc

SEQ ID NO: 18488 - DNA, 20 bp, Artificial Sequence
  chemically synthesized
tcgggagatcgagaccatcc

SEQ ID NO: 18489 - DNA, 20 bp, Artificial Sequence
  chemically synthesized
cgagaccatcctggctaaca

SEQ ID NO: 18490 - DNA, 20 bp, Artificial Sequence
  chemically synthesized
gaaaccccgtctctactaaa

SEQ ID NO: 18491 - DNA, 20 bp, Artificial Sequence
  chemically synthesized
aaaagacaaaaaaatttgcc

SEQ ID NO: 18492 - DNA, 20 bp, Artificial Sequence
  chemically synthesized
acaaaaaaatttgcctggcg

SEQ ID NO: 18493 - DNA, 20 bp, Artificial Sequence
  chemically synthesized
aaaaaatttgcctggcgtgg

SEQ ID NO: 18494 - DNA, 20 bp, Artificial Sequence
  chemically synthesized
aaatttgcctggcgtggtgg

SEQ ID NO: 18495 - DNA, 20 bp, Artificial Sequence
  chemically synthesized
aatttgcctggcgtggtggc

SEQ ID NO: 18496 - DNA, 20 bp, Artificial Sequence
  chemically synthesized
ggcgtggtggcgggcgcctg

SEQ ID NO: 18497 - DNA, 20 bp, Artificial Sequence
  chemically synthesized
gtggcgggcgcctgtagtcc

SEQ ID NO: 18498 - DNA, 20 bp, Artificial Sequence
  chemically synthesized
cgcctgtagtcccagctact

SEQ ID NO: 18499 - DNA, 20 bp, Artificial Sequence
  chemically synthesized
gcctgtagtcccagctactc

SEQ ID NO: 18500 - DNA, 20 bp, Artificial Sequence
  chemically synthesized
ctgtagtcccagctactcgg

SEQ ID NO: 18501 - DNA, 20 bp, Artificial Sequence
  chemically synthesized
tgtagtcccagctactcggg

SEQ ID NO: 18502 - DNA, 20 bp, Artificial Sequence
  chemically synthesized
tcccagctactcgggaggct

SEQ ID NO: 18503 - DNA, 20 bp, Artificial Sequence
  chemically synthesized
cccagctactcgggaggctg

SEQ ID NO: 18504 - DNA, 20 bp, Artificial Sequence
  chemically synthesized
agctactcgggaggctgagg

SEQ ID NO: 18505 - DNA, 20 bp, Artificial Sequence
  chemically synthesized
gctactcgggaggctgaggc

SEQ ID NO: 18506 - DNA, 20 bp, Artificial Sequence
  chemically synthesized
tactcgggaggctgaggcag

SEQ ID NO: 18507 - DNA, 20 bp, Artificial Sequence
  chemically synthesized
gggaggctgaggcaggagaa

SEQ ID NO: 18508 - DNA, 20 bp, Artificial Sequence
  chemically synthesized
gcaggagaatggcgtgaacc

SEQ ID NO: 18509 - DNA, 20 bp, Artificial Sequence
  chemically synthesized
caggagaatggcgtgaaccc

SEQ ID NO: 18510 - DNA, 20 bp, Artificial Sequence
  chemically synthesized
ggagaatggcgtgaacccgg

SEQ ID NO: 18511 - DNA, 20 bp, Artificial Sequence
  chemically synthesized
gagaatggcgtgaacccggg

SEQ ID NO: 18512 - DNA, 20 bp, Artificial Sequence
  chemically synthesized
aatggcgtgaacccgggagg

SEQ ID NO: 18513 - DNA, 20 bp, Artificial Sequence
  chemically synthesized
tggcgtgaacccgggaggca

SEQ ID NO: 18514 - DNA, 20 bp, Artificial Sequence
  chemically synthesized
aacccgggaggcagagcttg

SEQ ID NO: 18515 - DNA, 20 bp, Artificial Sequence
  chemically synthesized
cgggaggcagagcttgcagt

SEQ ID NO: 18516 - DNA, 20 bp, Artificial Sequence
  chemically synthesized
ggcagagcttgcagtgagct

SEQ ID NO: 18517 - DNA, 20 bp, Artificial Sequence
  chemically synthesized
gagatcacgccactgcactc

SEQ ID NO: 18518 - DNA, 20 bp, Artificial Sequence
  chemically synthesized
cacgccactgcactccagcc

SEQ ID NO: 18519 - DNA, 20 bp, Artificial Sequence
  chemically synthesized
acgccactgcactccagcct

SEQ ID NO: 18520 - DNA, 20 bp, Artificial Sequence
  chemically synthesized
ctgcactccagcctgggcga

SEQ ID NO: 18521 - DNA, 20 bp, Artificial Sequence
  chemically synthesized
gcactccagcctgggcgaca

SEQ ID NO: 18522 - DNA, 20 bp, Artificial Sequence
  chemically synthesized
tccagcctgggcgacagagc

SEQ ID NO: 18523 - DNA, 20 bp, Artificial Sequence
  chemically synthesized
ctcaaaaacaaaacaaaaca

SEQ ID NO: 18524 - DNA, 20 bp, Artificial Sequence
  chemically synthesized
aaagcaaaaaaaactttact

SEQ ID NO: 18525 - DNA, 20 bp, Artificial Sequence
  chemically synthesized
aaaaaaaactttactcagtg

SEQ ID NO: 18526 - DNA, 20 bp, Artificial Sequence
  chemically synthesized
aaactttactcagtgaagtc

SEQ ID NO: 18527 - DNA, 20 bp, Artificial Sequence
  chemically synthesized
actttactcagtgaagtcca

SEQ ID NO: 18528 - DNA, 20 bp, Artificial Sequence
  chemically synthesized
actcagtgaagtccagagca

SEQ ID NO: 18529 - DNA, 20 bp, Artificial Sequence
  chemically synthesized
atttgttgcaaacaaatcac

SEQ ID NO: 18530 - DNA, 20 bp, Artificial Sequence
  chemically synthesized
gaaaatgtacctgtaaaatg

SEQ ID NO: 18531 - DNA, 20 bp, Artificial Sequence
  chemically synthesized
atgtggatgccacatatttt

SEQ ID NO: 18532 - DNA, 20 bp, Artificial Sequence
  chemically synthesized
tgtggatgccacatattttt

SEQ ID NO: 18533 - DNA, 20 bp, Artificial Sequence
  chemically synthesized
atgccacatatttttaggtc

SEQ ID NO: 18534 - DNA, 20 bp, Artificial Sequence
  chemically synthesized
ccacatatttttaggtctgg

SEQ ID NO: 18535 - DNA, 20 bp, Artificial Sequence
  chemically synthesized
cacatatttttaggtctgga

SEQ ID NO: 18536 - DNA, 20 bp, Artificial Sequence
  chemically synthesized
ttgcattatcataaaatctc

SEQ ID NO: 18537 - DNA, 20 bp, Artificial Sequence
  chemically synthesized
ttatcataaaatctctagtt

SEQ ID NO: 18538 - DNA, 20 bp, Artificial Sequence
  chemically synthesized
ctttaactgaaaactgaacc

SEQ ID NO: 18539 - DNA, 20 bp, Artificial Sequence
  chemically synthesized
tttaactgaaaactgaaccc

SEQ ID NO: 18540 - DNA, 20 bp, Artificial Sequence
  chemically synthesized
taactgaaaactgaacccag

SEQ ID NO: 18541 - DNA, 20 bp, Artificial Sequence
  chemically synthesized
aactgaaaactgaacccagg

SEQ ID NO: 18542 - DNA, 20 bp, Artificial Sequence
  chemically synthesized
tgaaaactgaacccaggagg

SEQ ID NO: 18543 - DNA, 20 bp, Artificial Sequence
  chemically synthesized
aaaactgaacccaggaggca

SEQ ID NO: 18544 - DNA, 20 bp, Artificial Sequence
  chemically synthesized
aaactgaacccaggaggcag

SEQ ID NO: 18545 - DNA, 20 bp, Artificial Sequence
  chemically synthesized
aacccaggaggcagaggttg

SEQ ID NO: 18546 - DNA, 20 bp, Artificial Sequence
  chemically synthesized
caggaggcagaggttgcagt

SEQ ID NO: 18547 - DNA, 20 bp, Artificial Sequence
  chemically synthesized
ggcagaggttgcagtcagcc

SEQ ID NO: 18548 - DNA, 20 bp, Artificial Sequence
  chemically synthesized
ggttgcagtcagccgagatc

SEQ ID NO: 18549 - DNA, 20 bp, Artificial Sequence
  chemically synthesized
gttgcagtcagccgagatca

SEQ ID NO: 18550 - DNA, 20 bp, Artificial Sequence
  chemically synthesized
cactgaaaacttcctttctc

SEQ ID NO: 18551 - DNA, 20 bp, Artificial Sequence
  chemically synthesized
gaaaacttcctttctccaga

SEQ ID NO: 18552 - DNA, 20 bp, Artificial Sequence
  chemically synthesized
tgtctcattttcttcttcca

SEQ ID NO: 18553 - DNA, 20 bp, Artificial Sequence
  chemically synthesized
cttcttccatggaatattcc

SEQ ID NO: 18554 - DNA, 20 bp, Artificial Sequence
  chemically synthesized
ttcttccatggaatattcca

SEQ ID NO: 18555 - DNA, 20 bp, Artificial Sequence
  chemically synthesized
tccaaggaatattctttgaa

SEQ ID NO: 18556 - DNA, 20 bp, Artificial Sequence
  chemically synthesized
aaggaatattctttgaaaag

SEQ ID NO: 18557 - DNA, 20 bp, Artificial Sequence
  chemically synthesized
tctttgaaaagcagaatatt

SEQ ID NO: 18558 - DNA, 20 bp, Artificial Sequence
  chemically synthesized
tttgaaaagcagaatattca

SEQ ID NO: 18559 - DNA, 20 bp, Artificial Sequence
  chemically synthesized
aaaagcagaatattcagagt

SEQ ID NO: 18560 - DNA, 20 bp, Artificial Sequence
  chemically synthesized
aagcagaatattcagagtga

SEQ ID NO: 18561 - DNA, 20 bp, Artificial Sequence
  chemically synthesized
agcagaatattcagagtgag

SEQ ID NO: 18562 - DNA, 20 bp, Artificial Sequence
  chemically synthesized
agaatattcagagtgagagg

SEQ ID NO: 18563 - DNA, 20 bp, Artificial Sequence
  chemically synthesized
atattcagagtgagaggaag

SEQ ID NO: 18564 - DNA, 20 bp, Artificial Sequence
  chemically synthesized
attcagagtgagaggaagta

SEQ ID NO: 18565 - DNA, 20 bp, Artificial Sequence
  chemically synthesized
tcagagtgagaggaagtaga

SEQ ID NO: 18566 - DNA, 20 bp, Artificial Sequence
  chemically synthesized
aggaagtagagagatatatt

SEQ ID NO: 18567 - DNA, 20 bp, Artificial Sequence
  chemically synthesized
ggaagtagagagatatattt

SEQ ID NO: 18568 - DNA, 20 bp, Artificial Sequence
  chemically synthesized
agtagagagatatatttagg

SEQ ID NO: 18569 - DNA, 20 bp, Artificial Sequence
  chemically synthesized
agatatatttaggtagaatc

SEQ ID NO: 18570 - DNA, 20 bp, Artificial Sequence
  chemically synthesized
gatatatttaggtagaatct

SEQ ID NO: 18571 - DNA, 20 bp, Artificial Sequence
  chemically synthesized
ggtagaatctgggcatattg

SEQ ID NO: 18572 - DNA, 20 bp, Artificial Sequence
  chemically synthesized
gtagaatctgggcatattga

SEQ ID NO: 18573 - DNA, 20 bp, Artificial Sequence
  chemically synthesized
tagaatctgggcatattgaa

SEQ ID NO: 18574 - DNA, 20 bp, Artificial Sequence
  chemically synthesized
aatctgggcatattgaaggg

SEQ ID NO: 18575 - DNA, 20 bp, Artificial Sequence
  chemically synthesized
gggaagacatcaataattca

SEQ ID NO: 18576 - DNA, 20 bp, Artificial Sequence
  chemically synthesized
aagacatcaataattcacag

SEQ ID NO: 18577 - DNA, 20 bp, Artificial Sequence
  chemically synthesized
atcaataattcacagtagcc

SEQ ID NO: 18578 - DNA, 20 bp, Artificial Sequence
  chemically synthesized
tcaataattcacagtagcca

SEQ ID NO: 18579 - DNA, 20 bp, Artificial Sequence
  chemically synthesized
aattcacagtagccaaggaa

SEQ ID NO: 18580 - DNA, 20 bp, Artificial Sequence
  chemically synthesized
ccaaggaatagaaacaatac

SEQ ID NO: 18581 - DNA, 20 bp, Artificial Sequence
  chemically synthesized
acaatacaagtatctatcaa

SEQ ID NO: 18582 - DNA, 20 bp, Artificial Sequence
  chemically synthesized
aaaatgtcttatatatgtga

SEQ ID NO: 18583 - DNA, 20 bp, Artificial Sequence
  chemically synthesized
gaatattatttatctataaa

SEQ ID NO: 18584 - DNA, 20 bp, Artificial Sequence
  chemically synthesized
tattatttatctataaaaag

SEQ ID NO: 18585 - DNA, 20 bp, Artificial Sequence
  chemically synthesized
attatttatctataaaaagt

SEQ ID NO: 18586 - DNA, 20 bp, Artificial Sequence
  chemically synthesized
aaaccttaaaaaactatcct

SEQ ID NO: 18587 - DNA, 20 bp, Artificial Sequence
  chemically synthesized
aaaactatcctaagtgcaat

SEQ ID NO: 18588 - DNA, 20 bp, Artificial Sequence
  chemically synthesized
gtgcaataagtcatacgcaa

SEQ ID NO: 18589 - DNA, 20 bp, Artificial Sequence
  chemically synthesized
ttgtctgatttcacttacat

SEQ ID NO: 18590 - DNA, 20 bp, Artificial Sequence
  chemically synthesized
tttcacttacatgagctatc

SEQ ID NO: 18591 - DNA, 20 bp, Artificial Sequence
  chemically synthesized
cttacatgagctatctagaa

SEQ ID NO: 18592 - DNA, 20 bp, Artificial Sequence
  chemically synthesized
ttacatgagctatctagaat

SEQ ID NO: 18593 - DNA, 20 bp, Artificial Sequence
  chemically synthesized
atctagaataggcaaattca

SEQ ID NO: 18594 - DNA, 20 bp, Artificial Sequence
  chemically synthesized
ctagaataggcaaattcata

SEQ ID NO: 18595 - DNA, 20 bp, Artificial Sequence
  chemically synthesized
ggcaaattcatagagacaaa

SEQ ID NO: 18596 - DNA, 20 bp, Artificial Sequence
  chemically synthesized
aaattcatagagacaaaaag

SEQ ID NO: 18597 - DNA, 20 bp, Artificial Sequence
  chemically synthesized
catagagacaaaaagtagat

SEQ ID NO: 18598 - DNA, 20 bp, Artificial Sequence
  chemically synthesized
agagacaaaaagtagattag

SEQ ID NO: 18599 - DNA, 20 bp, Artificial Sequence
  chemically synthesized
aaaagtagattagaagttac

SEQ ID NO: 18600 - DNA, 20 bp, Artificial Sequence
  chemically synthesized
aagtagattagaagttacca

SEQ ID NO: 18601 - DNA, 20 bp, Artificial Sequence
  chemically synthesized
gattagaagttaccagagtg

SEQ ID NO: 18602 - DNA, 20 bp, Artificial Sequence
  chemically synthesized
attagaagttaccagagtgt

SEQ ID NO: 18603 - DNA, 20 bp, Artificial Sequence
  chemically synthesized
agaagttaccagagtgtagg

SEQ ID NO: 18604 - DNA, 20 bp, Artificial Sequence
  chemically synthesized
accagagtgtaggaagaaca

SEQ ID NO: 18605 - DNA, 20 bp, Artificial Sequence
  chemically synthesized
agtgtaggaagaacatggat

SEQ ID NO: 18606 - DNA, 20 bp, Artificial Sequence
  chemically synthesized
gtgtaggaagaacatggatt

SEQ ID NO: 18607 - DNA, 20 bp, Artificial Sequence
  chemically synthesized
tgtaggaagaacatggattg

SEQ ID NO: 18608 - DNA, 20 bp, Artificial Sequence
  chemically synthesized
taggaagaacatggattggg

SEQ ID NO: 18609 - DNA, 20 bp, Artificial Sequence
  chemically synthesized
gagtaactgattaatcaata

SEQ ID NO: 18610 - DNA, 20 bp, Artificial Sequence
  chemically synthesized
gtaactgattaatcaatata

SEQ ID NO: 18611 - DNA, 20 bp, Artificial Sequence
  chemically synthesized
atcaatatagagtttttatt

SEQ ID NO: 18612 - DNA, 20 bp, Artificial Sequence
  chemically synthesized
tttggtgtaatacaaaattt

SEQ ID NO: 18613 - DNA, 20 bp, Artificial Sequence
  chemically synthesized
gtaatacaaaattttagaaa

SEQ ID NO: 18614 - DNA, 20 bp, Artificial Sequence
  chemically synthesized
atacaaaattttagaaatag

SEQ ID NO: 18615 - DNA, 20 bp, Artificial Sequence
  chemically synthesized
caaaattttagaaatagtgg

SEQ ID NO: 18616 - DNA, 20 bp, Artificial Sequence
  chemically synthesized
gtggtggtgattgcacaaca

SEQ ID NO: 18617 - DNA, 20 bp, Artificial Sequence
  chemically synthesized
cacaacatggcaaatgtaat

SEQ ID NO: 18618 - DNA, 20 bp, Artificial Sequence
  chemically synthesized
actgcattatacattataaa

SEQ ID NO: 18619 - DNA, 20 bp, Artificial Sequence
  chemically synthesized
ctgcattatacattataaaa

SEQ ID NO: 18620 - DNA, 20 bp, Artificial Sequence
  chemically synthesized
tatacattataaaaaggcta

SEQ ID NO: 18621 - DNA, 20 bp, Artificial Sequence
  chemically synthesized
acattataaaaaggctaaag

SEQ ID NO: 18622 - DNA, 20 bp, Artificial Sequence
  chemically synthesized
attcattaaatttattgtga

SEQ ID NO: 18623 - DNA, 20 bp, Artificial Sequence
  chemically synthesized
ttcattaaatttattgtgaa

SEQ ID NO: 18624 - DNA, 20 bp, Artificial Sequence
  chemically synthesized
attgtgaaaggtttaaaaac

SEQ ID NO: 18625 - DNA, 20 bp, Artificial Sequence
  chemically synthesized
tgtgaaaggtttaaaaacaa

SEQ ID NO: 18626 - DNA, 20 bp, Artificial Sequence
  chemically synthesized
aggtttaaaaacaagagttt

SEQ ID NO: 18627 - DNA, 20 bp, Artificial Sequence
  chemically synthesized
ggtttaaaaacaagagtttg

SEQ ID NO: 18628 - DNA, 20 bp, Artificial Sequence
  chemically synthesized
tgaggttaaaaattatgtct

SEQ ID NO: 18629 - DNA, 20 bp, Artificial Sequence
  chemically synthesized
tgtctaagataaaatattaa

SEQ ID NO: 18630 - DNA, 20 bp, Artificial Sequence
  chemically synthesized
aaagatttattccacatgtg

SEQ ID NO: 18631 - DNA, 20 bp, Artificial Sequence
  chemically synthesized
aagatttattccacatgtgc

SEQ ID NO: 18632 - DNA, 20 bp, Artificial Sequence
  chemically synthesized
acaactatatatatacatac

SEQ ID NO: 18633 - DNA, 20 bp, Artificial Sequence
  chemically synthesized
caactatatatatacatact

SEQ ID NO: 18634 - DNA, 20 bp, Artificial Sequence
  chemically synthesized
tatatatacatactaggata

SEQ ID NO: 18635 - DNA, 20 bp, Artificial Sequence
  chemically synthesized
ataaagtctcttatatctta

SEQ ID NO: 18636 - DNA, 20 bp, Artificial Sequence
  chemically synthesized
atttatttgattttaataaa

SEQ ID NO: 18637 - DNA, 20 bp, Artificial Sequence
  chemically synthesized
tttgattttaataaatagaa

SEQ ID NO: 18638 - DNA, 20 bp, Artificial Sequence
  chemically synthesized
ttgattttaataaatagaat

SEQ ID NO: 18639 - DNA, 20 bp, Artificial Sequence
  chemically synthesized
ttttaataaatagaatagga

SEQ ID NO: 18640 - DNA, 20 bp, Artificial Sequence
  chemically synthesized
ttgactcaacaatttcactt

SEQ ID NO: 18641 - DNA, 20 bp, Artificial Sequence
  chemically synthesized
gactcaacaatttcacttga

SEQ ID NO: 18642 - DNA, 20 bp, Artificial Sequence
  chemically synthesized
caacaatttcacttgagaga

SEQ ID NO: 18643 - DNA, 20 bp, Artificial Sequence
  chemically synthesized
ttcacttgagagaaagaatc

SEQ ID NO: 18644 - DNA, 20 bp, Artificial Sequence
  chemically synthesized
ttgagagaaagaatcaagca

SEQ ID NO: 18645 - DNA, 20 bp, Artificial Sequence
  chemically synthesized
aatcaagcatagattatttt

SEQ ID NO: 18646 - DNA, 20 bp, Artificial Sequence
  chemically synthesized
agattattttcagttccata

SEQ ID NO: 18647 - DNA, 20 bp, Artificial Sequence
  chemically synthesized
cctcctcaaatatctatgat

SEQ ID NO: 18648 - DNA, 20 bp, Artificial Sequence
  chemically synthesized
tctatgattggacatctgtg

SEQ ID NO: 18649 - DNA, 20 bp, Artificial Sequence
  chemically synthesized
ctatgattggacatctgtga

SEQ ID NO: 18650 - DNA, 20 bp, Artificial Sequence
  chemically synthesized
gtgaaggcatgccgcaaatc

SEQ ID NO: 18651 - DNA, 20 bp, Artificial Sequence
  chemically synthesized
tgaaggcatgccgcaaatct

SEQ ID NO: 18652 - DNA, 20 bp, Artificial Sequence
  chemically synthesized
gaaggcatgccgcaaatcta

SEQ ID NO: 18653 - DNA, 20 bp, Artificial Sequence
  chemically synthesized
aaatctagggtaactaacat

SEQ ID NO: 18654 - DNA, 20 bp, Artificial Sequence
  chemically synthesized
attcttgttatttactcatc

SEQ ID NO: 18655 - DNA, 20 bp, Artificial Sequence
  chemically synthesized
tatttactcatctggtaatt

SEQ ID NO: 18656 - DNA, 20 bp, Artificial Sequence
  chemically synthesized
tcatctggtaattcagaatt

SEQ ID NO: 18657 - DNA, 20 bp, Artificial Sequence
  chemically synthesized
cttcctatttatgtttgtat

SEQ ID NO: 18658 - DNA, 20 bp, Artificial Sequence
  chemically synthesized
tatgtttgtatcagattatc

SEQ ID NO: 18659 - DNA, 20 bp, Artificial Sequence
  chemically synthesized
tcagattatctggctctaac

SEQ ID NO: 18660 - DNA, 20 bp, Artificial Sequence
  chemically synthesized
ttgatatattatctcacgtt

SEQ ID NO: 18661 - DNA, 20 bp, Artificial Sequence
  chemically synthesized
atatattatctcacgtttgg

SEQ ID NO: 18662 - DNA, 20 bp, Artificial Sequence
  chemically synthesized
tcacgtttggcagtattttt

SEQ ID NO: 18663 - DNA, 20 bp, Artificial Sequence
  chemically synthesized
ttggactgctattttaaaac

SEQ ID NO: 18664 - DNA, 20 bp, Artificial Sequence
  chemically synthesized
tggactgctattttaaaact

SEQ ID NO: 18665 - DNA, 20 bp, Artificial Sequence
  chemically synthesized
ttttaaaactgggtctactt

SEQ ID NO: 18666 - DNA, 20 bp, Artificial Sequence
  chemically synthesized
tacttcagtgaatgacaccc

SEQ ID NO: 18667 - DNA, 20 bp, Artificial Sequence
  chemically synthesized
aatgacacccaagaaaaacc

SEQ ID NO: 18668 - DNA, 20 bp, Artificial Sequence
  chemically synthesized
ggatctatcctgctttctcc

SEQ ID NO: 18669 - DNA, 20 bp, Artificial Sequence
  chemically synthesized
gatctatcctgctttctcct

SEQ ID NO: 18670 - DNA, 20 bp, Artificial Sequence
  chemically synthesized
tatcctgctttctcctagga

SEQ ID NO: 18671 - DNA, 20 bp, Artificial Sequence
  chemically synthesized
ctgctttctcctaggatagt

SEQ ID NO: 18672 - DNA, 20 bp, Artificial Sequence
  chemically synthesized
acttattctctgaccttctt

SEQ ID NO: 18673 - DNA, 20 bp, Artificial Sequence
  chemically synthesized
cttattctctgaccttcttt

SEQ ID NO: 18674 - DNA, 20 bp, Artificial Sequence
  chemically synthesized
tctttgggtgtcatctgctt

SEQ ID NO: 18675 - DNA, 20 bp, Artificial Sequence
  chemically synthesized
ttactatgactcttcatgat

SEQ ID NO: 18676 - DNA, 20 bp, Artificial Sequence
  chemically synthesized
tactatgactcttcatgatc

SEQ ID NO: 18677 - DNA, 20 bp, Artificial Sequence
  chemically synthesized
actcttcatgatcaggcaaa

SEQ ID NO: 18678 - DNA, 20 bp, Artificial Sequence
  chemically synthesized
gaatgatttttttaattatt

SEQ ID NO: 18679 - DNA, 20 bp, Artificial Sequence
  chemically synthesized
agctaatattttgtttttaa

SEQ ID NO: 18680 - DNA, 20 bp, Artificial Sequence
  chemically synthesized
atattttgtttttaaaagtc

SEQ ID NO: 18681 - DNA, 20 bp, Artificial Sequence
  chemically synthesized
tttttaaaagtctagttcta

SEQ ID NO: 18682 - DNA, 20 bp, Artificial Sequence
  chemically synthesized
ttattattttgactcattct

SEQ ID NO: 18683 - DNA, 20 bp, Artificial Sequence
  chemically synthesized
ataatgattcttcttattta

SEQ ID NO: 18684 - DNA, 20 bp, Artificial Sequence
  chemically synthesized
atttatagacaatacataat

SEQ ID NO: 18685 - DNA, 20 bp, Artificial Sequence
  chemically synthesized
atcagtgactgcctttcttt

SEQ ID NO: 18686 - DNA, 20 bp, Artificial Sequence
  chemically synthesized
tttggcactgcctttcttcc

SEQ ID NO: 18687 - DNA, 20 bp, Artificial Sequence
  chemically synthesized
cctttcttccaagaacatgt

SEQ ID NO: 18688 - DNA, 20 bp, Artificial Sequence
  chemically synthesized
aagaacatgtcagaaattga

SEQ ID NO: 18689 - DNA, 20 bp, Artificial Sequence
  chemically synthesized
cctgtaaaccttattatatt

SEQ ID NO: 18690 - DNA, 20 bp, Artificial Sequence
  chemically synthesized
catttccactttcctaaatt

SEQ ID NO: 18691 - DNA, 20 bp, Artificial Sequence
  chemically synthesized
ccattttataaataatattg

SEQ ID NO: 18692 - DNA, 20 bp, Artificial Sequence
  chemically synthesized
taaaacatcaatgaattatg

SEQ ID NO: 18693 - DNA, 20 bp, Artificial Sequence
  chemically synthesized
atgaattatgcagcttcttt

SEQ ID NO: 18694 - DNA, 20 bp, Artificial Sequence
  chemically synthesized
aattatgcagcttctttcag

SEQ ID NO: 18695 - DNA, 20 bp, Artificial Sequence
  chemically synthesized
cagtagctttccatgactcc

SEQ ID NO: 18696 - DNA, 20 bp, Artificial Sequence
  chemically synthesized
tagctttccatgactccgag

SEQ ID NO: 18697 - DNA, 20 bp, Artificial Sequence
  chemically synthesized
gctttccatgactccgagta

SEQ ID NO: 18698 - DNA, 20 bp, Artificial Sequence
  chemically synthesized
aaactcttatgatgaccaat

SEQ ID NO: 18699 - DNA, 20 bp, Artificial Sequence
  chemically synthesized
aactcttatgatgaccaata

SEQ ID NO: 18700 - DNA, 20 bp, Artificial Sequence
  chemically synthesized
aaggccattccttccctctt

SEQ ID NO: 18701 - DNA, 20 bp, Artificial Sequence
  chemically synthesized
ccctcttcagcctcttctca

SEQ ID NO: 18702 - DNA, 20 bp, Artificial Sequence
  chemically synthesized
tcaaagcaaacaccctcttc

SEQ ID NO: 18703 - DNA, 20 bp, Artificial Sequence
  chemically synthesized
aagcaaacaccctcttccag

SEQ ID NO: 18704 - DNA, 20 bp, Artificial Sequence
  chemically synthesized
ttccctaatataaaccaacc

SEQ ID NO: 18705 - DNA, 20 bp, Artificial Sequence
  chemically synthesized
taatataaaccaacctagct

SEQ ID NO: 18706 - DNA, 20 bp, Artificial Sequence
  chemically synthesized
aatataaaccaacctagctg

SEQ ID NO: 18707 - DNA, 20 bp, Artificial Sequence
  chemically synthesized
ggtctccacacacactcctt

SEQ ID NO: 18708 - DNA, 20 bp, Artificial Sequence
  chemically synthesized
cacacacactccttcagtct

SEQ ID NO: 18709 - DNA, 20 bp, Artificial Sequence
  chemically synthesized
attcttgtctgtattttcac

SEQ ID NO: 18710 - DNA, 20 bp, Artificial Sequence
  chemically synthesized
ttgtctgtattttcaccagt

SEQ ID NO: 18711 - DNA, 20 bp, Artificial Sequence
  chemically synthesized
gttagtttctaatccatttt

SEQ ID NO: 18712 - DNA, 20 bp, Artificial Sequence
  chemically synthesized
ttagtttctaatccattttc

SEQ ID NO: 18713 - DNA, 20 bp, Artificial Sequence
  chemically synthesized
tctaatccattttcaggtct

SEQ ID NO: 18714 - DNA, 20 bp, Artificial Sequence
  chemically synthesized
ccattttcaggtctcagctg

SEQ ID NO: 18715 - DNA, 20 bp, Artificial Sequence
  chemically synthesized
cattttcaggtctcagctga

SEQ ID NO: 18716 - DNA, 20 bp, Artificial Sequence
  chemically synthesized
attttcaggtctcagctgaa

SEQ ID NO: 18717 - DNA, 20 bp, Artificial Sequence
  chemically synthesized
cagctgaagggacactttct

SEQ ID NO: 18718 - DNA, 20 bp, Artificial Sequence
  chemically synthesized
agctgaagggacactttctc

SEQ ID NO: 18719 - DNA, 20 bp, Artificial Sequence
  chemically synthesized
gctgaagggacactttctca

SEQ ID NO: 18720 - DNA, 20 bp, Artificial Sequence
  chemically synthesized
gggaatcttacccttatttc

SEQ ID NO: 18721 - DNA, 20 bp, Artificial Sequence
  chemically synthesized
ttatttcaagccataacctc

SEQ ID NO: 18722 - DNA, 20 bp, Artificial Sequence
  chemically synthesized
cataacctcaagcctttttt

SEQ ID NO: 18723 - DNA, 20 bp, Artificial Sequence
  chemically synthesized
tgagacccacactctccatt

SEQ ID NO: 18724 - DNA, 20 bp, Artificial Sequence
  chemically synthesized
ttctgctttatgattaatca

SEQ ID NO: 18725 - DNA, 20 bp, Artificial Sequence
  chemically synthesized
cacagcacttgttttaaatt

SEQ ID NO: 18726 - DNA, 20 bp, Artificial Sequence
  chemically synthesized
ttggatttcttttattcttt

SEQ ID NO: 18727 - DNA, 20 bp, Artificial Sequence
  chemically synthesized
tttgagtccccacttatttg

SEQ ID NO: 18728 - DNA, 20 bp, Artificial Sequence
  chemically synthesized
cccacttatttgaagacttt

SEQ ID NO: 18729 - DNA, 20 bp, Artificial Sequence
  chemically synthesized
acttatttgaagactttaag

SEQ ID NO: 18730 - DNA, 20 bp, Artificial Sequence
  chemically synthesized
tttgaagactttaagaagaa

SEQ ID NO: 18731 - DNA, 20 bp, Artificial Sequence
  chemically synthesized
tctcttatatcatttttgct

SEQ ID NO: 18732 - DNA, 20 bp, Artificial Sequence
  chemically synthesized
ttatatcatttttgcttagc

SEQ ID NO: 18733 - DNA, 20 bp, Artificial Sequence
  chemically synthesized
tatatcatttttgcttagca

SEQ ID NO: 18734 - DNA, 20 bp, Artificial Sequence
  chemically synthesized
cttagcaaggtgacccataa

SEQ ID NO: 18735 - DNA, 20 bp, Artificial Sequence
  chemically synthesized
tgcccttaaaaaattaacca

SEQ ID NO: 18736 - DNA, 20 bp, Artificial Sequence
  chemically synthesized
gcccttaaaaaattaaccaa

SEQ ID NO: 18737 - DNA, 20 bp, Artificial Sequence
  chemically synthesized
ccaaaggaatgattaaatat

SEQ ID NO: 18738 - DNA, 20 bp, Artificial Sequence
  chemically synthesized
aaggaatgattaaatattag

SEQ ID NO: 18739 - DNA, 20 bp, Artificial Sequence
  chemically synthesized
tagtggtgtttccacgaaaa

SEQ ID NO: 18740 - DNA, 20 bp, Artificial Sequence
  chemically synthesized
agtggtgtttccacgaaaat

SEQ ID NO: 18741 - DNA, 20 bp, Artificial Sequence
  chemically synthesized
ttccacgaaaataggcacat

SEQ ID NO: 18742 - DNA, 20 bp, Artificial Sequence
  chemically synthesized
tccacgaaaataggcacatg

SEQ ID NO: 18743 - DNA, 20 bp, Artificial Sequence
  chemically synthesized
ggcacatgaggaatgattta

SEQ ID NO: 18744 - DNA, 20 bp, Artificial Sequence
  chemically synthesized
aacacaaacccttttaaaca

SEQ ID NO: 18745 - DNA, 20 bp, Artificial Sequence
  chemically synthesized
acacaaacccttttaaacat

SEQ ID NO: 18746 - DNA, 20 bp, Artificial Sequence
  chemically synthesized
taggatatgtacaaataaat

SEQ ID NO: 18747 - DNA, 20 bp, Artificial Sequence
  chemically synthesized
aggatatgtacaaataaatt

SEQ ID NO: 18748 - DNA, 20 bp, Artificial Sequence
  chemically synthesized
tgtacaaataaattaggcaa

SEQ ID NO: 18749 - DNA, 20 bp, Artificial Sequence
  chemically synthesized
aataaattaggcaaaagtat

SEQ ID NO: 18750 - DNA, 20 bp, Artificial Sequence
  chemically synthesized
ttaggcaaaagtataagaaa

SEQ ID NO: 18751 - DNA, 20 bp, Artificial Sequence
  chemically synthesized
aaaagatataaataaacctg

SEQ ID NO: 18752 - DNA, 20 bp, Artificial Sequence
  chemically synthesized
gatataaataaacctgaagt

SEQ ID NO: 18753 - DNA, 20 bp, Artificial Sequence
  chemically synthesized
taaataaacctgaagtcagc

SEQ ID NO: 18754 - DNA, 20 bp, Artificial Sequence
  chemically synthesized
aaataaacctgaagtcagca

SEQ ID NO: 18755 - DNA, 20 bp, Artificial Sequence
  chemically synthesized
aataaacctgaagtcagcaa

SEQ ID NO: 18756 - DNA, 20 bp, Artificial Sequence
  chemically synthesized
gaagtcagcaagggctttga

SEQ ID NO: 18757 - DNA, 20 bp, Artificial Sequence
  chemically synthesized
cagcaagggctttgatagta

SEQ ID NO: 18758 - DNA, 20 bp, Artificial Sequence
  chemically synthesized
atagtatggctccaatactt

SEQ ID NO: 18759 - DNA, 20 bp, Artificial Sequence
  chemically synthesized
gtatggctccaatacttcag

SEQ ID NO: 18760 - DNA, 20 bp, Artificial Sequence
  chemically synthesized
ctccaatacttcagtagata

SEQ ID NO: 18761 - DNA, 20 bp, Artificial Sequence
  chemically synthesized
taataaaataatgtatatgt

SEQ ID NO: 18762 - DNA, 20 bp, Artificial Sequence
  chemically synthesized
aagcttttaaattgtgtata

SEQ ID NO: 18763 - DNA, 20 bp, Artificial Sequence
  chemically synthesized
ttttaaattgtgtatatagc

SEQ ID NO: 18764 - DNA, 20 bp, Artificial Sequence
  chemically synthesized
tgtgtatatagcaagacaaa

SEQ ID NO: 18765 - DNA, 20 bp, Artificial Sequence
  chemically synthesized
tagcaagacaaacagaaaac

SEQ ID NO: 18766 - DNA, 20 bp, Artificial Sequence
  chemically synthesized
agcaagacaaacagaaaact

SEQ ID NO: 18767 - DNA, 20 bp, Artificial Sequence
  chemically synthesized
gtacactaaaaataaaacac

SEQ ID NO: 18768 - DNA, 20 bp, Artificial Sequence
  chemically synthesized
acactaaaaataaaacacta

SEQ ID NO: 18769 - DNA, 20 bp, Artificial Sequence
  chemically synthesized
cttcttaaaatcaattataa

SEQ ID NO: 18770 - DNA, 20 bp, Artificial Sequence
  chemically synthesized
ttcttaaaatcaattataaa

SEQ ID NO: 18771 - DNA, 20 bp, Artificial Sequence
  chemically synthesized
aattataaaaggatgaaaat

SEQ ID NO: 18772 - DNA, 20 bp, Artificial Sequence
  chemically synthesized
atatatgatcaaataaatcc

SEQ ID NO: 18773 - DNA, 20 bp, Artificial Sequence
  chemically synthesized
atgatcaaataaatcctagt

SEQ ID NO: 18774 - DNA, 20 bp, Artificial Sequence
  chemically synthesized
taaatcctagtgagatttcc

SEQ ID NO: 18775 - DNA, 20 bp, Artificial Sequence
  chemically synthesized
ccaagttgctgcaacaaatt

SEQ ID NO: 18776 - DNA, 20 bp, Artificial Sequence
  chemically synthesized
tgagatcacttgtgatttat

SEQ ID NO: 18777 - DNA, 20 bp, Artificial Sequence
  chemically synthesized
aaataaattgaatatacaaa

SEQ ID NO: 18778 - DNA, 20 bp, Artificial Sequence
  chemically synthesized
aataaattgaatatacaaaa

SEQ ID NO: 18779 - DNA, 20 bp, Artificial Sequence
  chemically synthesized
atatacaaaaaggaaaatat

SEQ ID NO: 18780 - DNA, 20 bp, Artificial Sequence
  chemically synthesized
tcagattatatttcatctat

SEQ ID NO: 18781 - DNA, 20 bp, Artificial Sequence
  chemically synthesized
atttcatctattggacatat

SEQ ID NO: 18782 - DNA, 20 bp, Artificial Sequence
  chemically synthesized
atatcagaaatgtttctatc

SEQ ID NO: 18783 - DNA, 20 bp, Artificial Sequence
  chemically synthesized
aaatgtttctatccagcatt

SEQ ID NO: 18784 - DNA, 20 bp, Artificial Sequence
  chemically synthesized
atgtttctatccagcattta

SEQ ID NO: 18785 - DNA, 20 bp, Artificial Sequence
  chemically synthesized
gtttctatccagcatttaga

SEQ ID NO: 18786 - DNA, 20 bp, Artificial Sequence
  chemically synthesized
ccagcatttagagagaacac

SEQ ID NO: 18787 - DNA, 20 bp, Artificial Sequence
  chemically synthesized
tagagagaacacaagatcaa

SEQ ID NO: 18788 - DNA, 20 bp, Artificial Sequence
  chemically synthesized
aatacattaactcatgaaat

SEQ ID NO: 18789 - DNA, 20 bp, Artificial Sequence
  chemically synthesized
taactcatgaaatgagcaac

SEQ ID NO: 18790 - DNA, 20 bp, Artificial Sequence
  chemically synthesized
aactcatgaaatgagcaact

SEQ ID NO: 18791 - DNA, 20 bp, Artificial Sequence
  chemically synthesized
aactaggaaatttatgaatt

SEQ ID NO: 18792 - DNA, 20 bp, Artificial Sequence
  chemically synthesized
ctaggaaatttatgaattta

SEQ ID NO: 18793 - DNA, 20 bp, Artificial Sequence
  chemically synthesized
aggaaatttatgaatttaga

SEQ ID NO: 18794 - DNA, 20 bp, Artificial Sequence
  chemically synthesized
gtctctactgtaaaacttta

SEQ ID NO: 18795 - DNA, 20 bp, Artificial Sequence
  chemically synthesized
atgacattgtatcattttga

SEQ ID NO: 18796 - DNA, 20 bp, Artificial Sequence
  chemically synthesized
atcattttgaaagaaaactc

SEQ ID NO: 18797 - DNA, 20 bp, Artificial Sequence
  chemically synthesized
aagaaaactcaagacaccaa

SEQ ID NO: 18798 - DNA, 20 bp, Artificial Sequence
  chemically synthesized
tgcaaaaaaaaattgacaaa

SEQ ID NO: 18799 - DNA, 20 bp, Artificial Sequence
  chemically synthesized
gcaaaaaaaaattgacaaat

SEQ ID NO: 18800 - DNA, 20 bp, Artificial Sequence
  chemically synthesized
aatgggatctaattaaatta

SEQ ID NO: 18801 - DNA, 20 bp, Artificial Sequence
  chemically synthesized
tgggatctaattaaattaaa

SEQ ID NO: 18802 - DNA, 20 bp, Artificial Sequence
  chemically synthesized
taaattaaagagcttctgca

SEQ ID NO: 18803 - DNA, 20 bp, Artificial Sequence
  chemically synthesized
aaagagcttctgcacagcaa

SEQ ID NO: 18804 - DNA, 20 bp, Artificial Sequence
  chemically synthesized
acagcaaaagaaactatcat

SEQ ID NO: 18805 - DNA, 20 bp, Artificial Sequence
  chemically synthesized
agcaaaagaaactatcatca

SEQ ID NO: 18806 - DNA, 20 bp, Artificial Sequence
  chemically synthesized
gaaactatcatcagagataa

SEQ ID NO: 18807 - DNA, 20 bp, Artificial Sequence
  chemically synthesized
cagagataacagacaaccta

SEQ ID NO: 18808 - DNA, 20 bp, Artificial Sequence
  chemically synthesized
ataacagacaacctacagaa

SEQ ID NO: 18809 - DNA, 20 bp, Artificial Sequence
  chemically synthesized
acagacaacctacagaatag

SEQ ID NO: 18810 - DNA, 20 bp, Artificial Sequence
  chemically synthesized
gcaatttctccatctgacaa

SEQ ID NO: 18811 - DNA, 20 bp, Artificial Sequence
  chemically synthesized
tctgacaaaagtctaatatc

SEQ ID NO: 18812 - DNA, 20 bp, Artificial Sequence
  chemically synthesized
tgacaaaagtctaatatctg

SEQ ID NO: 18813 - DNA, 20 bp, Artificial Sequence
  chemically synthesized
gtctaatatctggagtctat

SEQ ID NO: 18814 - DNA, 20 bp, Artificial Sequence
  chemically synthesized
tctaatatctggagtctatg

SEQ ID NO: 18815 - DNA, 20 bp, Artificial Sequence
  chemically synthesized
aggaactaaaacaaatttac

SEQ ID NO: 18816 - DNA, 20 bp, Artificial Sequence
  chemically synthesized
aaaaaaacaaccccattaaa

SEQ ID NO: 18817 - DNA, 20 bp, Artificial Sequence
  chemically synthesized
aaaacaaccccattaaaaag

SEQ ID NO: 18818 - DNA, 20 bp, Artificial Sequence
  chemically synthesized
aaacaaccccattaaaaagt

SEQ ID NO: 18819 - DNA, 20 bp, Artificial Sequence
  chemically synthesized
aacaaccccattaaaaagtg

SEQ ID NO: 18820 - DNA, 20 bp, Artificial Sequence
  chemically synthesized
aaagtggggaatgacatgaa

SEQ ID NO: 18821 - DNA, 20 bp, Artificial Sequence
  chemically synthesized
catgaatagacacttctcta

SEQ ID NO: 18822 - DNA, 20 bp, Artificial Sequence
  chemically synthesized
gaatagacacttctctaaag

SEQ ID NO: 18823 - DNA, 20 bp, Artificial Sequence
  chemically synthesized
ataaacatatgaaaaaaaaa

SEQ ID NO: 18824 - DNA, 20 bp, Artificial Sequence
  chemically synthesized
aaaaaaaagctcaaccttac

SEQ ID NO: 18825 - DNA, 20 bp, Artificial Sequence
  chemically synthesized
agctcaaccttactggtcat

SEQ ID NO: 18826 - DNA, 20 bp, Artificial Sequence
  chemically synthesized
aatgcaaatcaaaaccacaa

SEQ ID NO: 18827 - DNA, 20 bp, Artificial Sequence
  chemically synthesized
atgcaaatcaaaaccacaat

SEQ ID NO: 18828 - DNA, 20 bp, Artificial Sequence
  chemically synthesized
aatgggataccatctcacac

SEQ ID NO: 18829 - DNA, 20 bp, Artificial Sequence
  chemically synthesized
ggataccatctcacaccagt

SEQ ID NO: 18830 - DNA, 20 bp, Artificial Sequence
  chemically synthesized
ccatctcacaccagtcagaa

SEQ ID NO: 18831 - DNA, 20 bp, Artificial Sequence
  chemically synthesized
tcagaatggcaattattaaa

SEQ ID NO: 18832 - DNA, 20 bp, Artificial Sequence
  chemically synthesized
atggcaattattaaaaagtc

SEQ ID NO: 18833 - DNA, 20 bp, Artificial Sequence
  chemically synthesized
attaaaaagtcaagaaacaa

SEQ ID NO: 18834 - DNA, 20 bp, Artificial Sequence
  chemically synthesized
agtcaagaaacaacagttgc

SEQ ID NO: 18835 - DNA, 20 bp, Artificial Sequence
  chemically synthesized
aagaaacaacagttgctggc

SEQ ID NO: 18836 - DNA, 20 bp, Artificial Sequence
  chemically synthesized
agaaacaacagttgctggca

SEQ ID NO: 18837 - DNA, 20 bp, Artificial Sequence
  chemically synthesized
aacagttgctggcaaggttg

SEQ ID NO: 18838 - DNA, 20 bp, Artificial Sequence
  chemically synthesized
cagttgctggcaaggttgca

SEQ ID NO: 18839 - DNA, 20 bp, Artificial Sequence
  chemically synthesized
gttgctggcaaggttgcaga

SEQ ID NO: 18840 - DNA, 20 bp, Artificial Sequence
  chemically synthesized
ctggcaaggttgcagagaga

SEQ ID NO: 18841 - DNA, 20 bp, Artificial Sequence
  chemically synthesized
tggcaaggttgcagagagaa

SEQ ID NO: 18842 - DNA, 20 bp, Artificial Sequence
  chemically synthesized
aggttgcagagagaaaggaa

SEQ ID NO: 18843 - DNA, 20 bp, Artificial Sequence
  chemically synthesized
gaatgcttttacactgttaa

SEQ ID NO: 18844 - DNA, 20 bp, Artificial Sequence
  chemically synthesized
aatgcttttacactgttaac

SEQ ID NO: 18845 - DNA, 20 bp, Artificial Sequence
  chemically synthesized
tgcttttacactgttaacgg

SEQ ID NO: 18846 - DNA, 20 bp, Artificial Sequence
  chemically synthesized
cttttacactgttaacggga

SEQ ID NO: 18847 - DNA, 20 bp, Artificial Sequence
  chemically synthesized
ctgttaacgggagagtaaat

SEQ ID NO: 18848 - DNA, 20 bp, Artificial Sequence
  chemically synthesized
gtaaattagttcaaacattg

SEQ ID NO: 18849 - DNA, 20 bp, Artificial Sequence
  chemically synthesized
aattagttcaaacattgtgg

SEQ ID NO: 18850 - DNA, 20 bp, Artificial Sequence
  chemically synthesized
ttagttcaaacattgtggaa

SEQ ID NO: 18851 - DNA, 20 bp, Artificial Sequence
  chemically synthesized
agttcaaacattgtggaaga

SEQ ID NO: 18852 - DNA, 20 bp, Artificial Sequence
  chemically synthesized
aaacattgtggaagagagtg

SEQ ID NO: 18853 - DNA, 20 bp, Artificial Sequence
  chemically synthesized
gagagtgtagcctttcctca

SEQ ID NO: 18854 - DNA, 20 bp, Artificial Sequence
  chemically synthesized
gtagcctttcctcaaagatg

SEQ ID NO: 18855 - DNA, 20 bp, Artificial Sequence
  chemically synthesized
gcctttcctcaaagatgtag

SEQ ID NO: 18856 - DNA, 20 bp, Artificial Sequence
  chemically synthesized
tttcctcaaagatgtagaag

SEQ ID NO: 18857 - DNA, 20 bp, Artificial Sequence
  chemically synthesized
agcagaaataccacttgact

SEQ ID NO: 18858 - DNA, 20 bp, Artificial Sequence
  chemically synthesized
tgactcagcaatctcattac

SEQ ID NO: 18859 - DNA, 20 bp, Artificial Sequence
  chemically synthesized
gactcagcaatctcattact

SEQ ID NO: 18860 - DNA, 20 bp, Artificial Sequence
  chemically synthesized
cattactgggtatataccca

SEQ ID NO: 18861 - DNA, 20 bp, Artificial Sequence
  chemically synthesized
attactgggtatatacccaa

SEQ ID NO: 18862 - DNA, 20 bp, Artificial Sequence
  chemically synthesized
atcaatctattataaaaata

SEQ ID NO: 18863 - DNA, 20 bp, Artificial Sequence
  chemically synthesized
tcaatctattataaaaatac

SEQ ID NO: 18864 - DNA, 20 bp, Artificial Sequence
  chemically synthesized
aggcatgcttatgttcattg

SEQ ID NO: 18865 - DNA, 20 bp, Artificial Sequence
  chemically synthesized
cattgcagcattattcataa

SEQ ID NO: 18866 - DNA, 20 bp, Artificial Sequence
  chemically synthesized
cagcattattcataatagcc

SEQ ID NO: 18867 - DNA, 20 bp, Artificial Sequence
  chemically synthesized
tattcataatagccaagatg

SEQ ID NO: 18868 - DNA, 20 bp, Artificial Sequence
  chemically synthesized
acccaaatgtccatcaatga

SEQ ID NO: 18869 - DNA, 20 bp, Artificial Sequence
  chemically synthesized
ccaaatgtccatcaatgata

SEQ ID NO: 18870 - DNA, 20 bp, Artificial Sequence
  chemically synthesized
aatgtccatcaatgatagag

SEQ ID NO: 18871 - DNA, 20 bp, Artificial Sequence
  chemically synthesized
catcaatgatagagtggata

SEQ ID NO: 18872 - DNA, 20 bp, Artificial Sequence
  chemically synthesized
tagagtggataaagaaaacg

SEQ ID NO: 18873 - DNA, 20 bp, Artificial Sequence
  chemically synthesized
aacgtggtacatatatacca

SEQ ID NO: 18874 - DNA, 20 bp, Artificial Sequence
  chemically synthesized
atataccatggaatactata

SEQ ID NO: 18875 - DNA, 20 bp, Artificial Sequence
  chemically synthesized
gaatactatacagccataaa

SEQ ID NO: 18876 - DNA, 20 bp, Artificial Sequence
  chemically synthesized
aatactatacagccataaaa

SEQ ID NO: 18877 - DNA, 20 bp, Artificial Sequence
  chemically synthesized
tatacagccataaaaaggaa

SEQ ID NO: 18878 - DNA, 20 bp, Artificial Sequence
  chemically synthesized
atacagccataaaaaggaaa

SEQ ID NO: 18879 - DNA, 20 bp, Artificial Sequence
  chemically synthesized
gaaaaggattgtgttccttg

SEQ ID NO: 18880 - DNA, 20 bp, Artificial Sequence
  chemically synthesized
aaaaggattgtgttccttgc

SEQ ID NO: 18881 - DNA, 20 bp, Artificial Sequence
  chemically synthesized
aaaggattgtgttccttgca

SEQ ID NO: 18882 - DNA, 20 bp, Artificial Sequence
  chemically synthesized
gttccttgcagggacatgaa

SEQ ID NO: 18883 - DNA, 20 bp, Artificial Sequence
  chemically synthesized
tccttgcagggacatgaatg

SEQ ID NO: 18884 - DNA, 20 bp, Artificial Sequence
  chemically synthesized
tgcagggacatgaatggagc

SEQ ID NO: 18885 - DNA, 20 bp, Artificial Sequence
  chemically synthesized
agggacatgaatggagctgg

SEQ ID NO: 18886 - DNA, 20 bp, Artificial Sequence
  chemically synthesized
ttatcctcatcaaactaaca

SEQ ID NO: 18887 - DNA, 20 bp, Artificial Sequence
  chemically synthesized
tatcctcatcaaactaacac

SEQ ID NO: 18888 - DNA, 20 bp, Artificial Sequence
  chemically synthesized
tcatcaaactaacacaggaa

SEQ ID NO: 18889 - DNA, 20 bp, Artificial Sequence
  chemically synthesized
caaacacacatgttctcaca

SEQ ID NO: 18890 - DNA, 20 bp, Artificial Sequence
  chemically synthesized
cacatgttctcacacagaaa

SEQ ID NO: 18891 - DNA, 20 bp, Artificial Sequence
  chemically synthesized
acatgttctcacacagaaat

SEQ ID NO: 18892 - DNA, 20 bp, Artificial Sequence
  chemically synthesized
atgttctcacacagaaatgg

SEQ ID NO: 18893 - DNA, 20 bp, Artificial Sequence
  chemically synthesized
acacagaaatgggagctgaa

SEQ ID NO: 18894 - DNA, 20 bp, Artificial Sequence
  chemically synthesized
agaaatgggagctgaacagt

SEQ ID NO: 18895 - DNA, 20 bp, Artificial Sequence
  chemically synthesized
agctgaacagtgagaacaca

SEQ ID NO: 18896 - DNA, 20 bp, Artificial Sequence
  chemically synthesized
tgagaacacatggacacttg

SEQ ID NO: 18897 - DNA, 20 bp, Artificial Sequence
  chemically synthesized
gagaacacatggacacttgt

SEQ ID NO: 18898 - DNA, 20 bp, Artificial Sequence
  chemically synthesized
agaacacatggacacttgtg

SEQ ID NO: 18899 - DNA, 20 bp, Artificial Sequence
  chemically synthesized
cttgtggggaacaacacaca

SEQ ID NO: 18900 - DNA, 20 bp, Artificial Sequence
  chemically synthesized
ttgtggggaacaacacacac

SEQ ID NO: 18901 - DNA, 20 bp, Artificial Sequence
  chemically synthesized
tgtggggaacaacacacaca

SEQ ID NO: 18902 - DNA, 20 bp, Artificial Sequence
  chemically synthesized
gtggggaacaacacacacag

SEQ ID NO: 18903 - DNA, 20 bp, Artificial Sequence
  chemically synthesized
aacacacacaggggcctgtc

SEQ ID NO: 18904 - DNA, 20 bp, Artificial Sequence
  chemically synthesized
acacacaggggcctgtccgg

SEQ ID NO: 18905 - DNA, 20 bp, Artificial Sequence
  chemically synthesized
cacaggggcctgtccggtag

SEQ ID NO: 18906 - DNA, 20 bp, Artificial Sequence
  chemically synthesized
acaggggcctgtccggtagt

SEQ ID NO: 18907 - DNA, 20 bp, Artificial Sequence
  chemically synthesized
ggggcctgtccggtagtggg

SEQ ID NO: 18908 - DNA, 20 bp, Artificial Sequence
  chemically synthesized
gggcctgtccggtagtgggt

SEQ ID NO: 18909 - DNA, 20 bp, Artificial Sequence
  chemically synthesized
ggcctgtccggtagtgggtg

SEQ ID NO: 18910 - DNA, 20 bp, Artificial Sequence
  chemically synthesized
cctgtccggtagtgggtggg

SEQ ID NO: 18911 - DNA, 20 bp, Artificial Sequence
  chemically synthesized
ctgtccggtagtgggtgggg

SEQ ID NO: 18912 - DNA, 20 bp, Artificial Sequence
  chemically synthesized
gtccggtagtgggtggggag

SEQ ID NO: 18913 - DNA, 20 bp, Artificial Sequence
  chemically synthesized
ccggtagtgggtggggagga

SEQ ID NO: 18914 - DNA, 20 bp, Artificial Sequence
  chemically synthesized
cggtagtgggtggggaggag

SEQ ID NO: 18915 - DNA, 20 bp, Artificial Sequence
  chemically synthesized
ggtagtgggtggggaggaga

SEQ ID NO: 18916 - DNA, 20 bp, Artificial Sequence
  chemically synthesized
tagtgggtggggaggagagg

SEQ ID NO: 18917 - DNA, 20 bp, Artificial Sequence
  chemically synthesized
gtgggtggggaggagaggga

SEQ ID NO: 18918 - DNA, 20 bp, Artificial Sequence
  chemically synthesized
ggggaggagagggagagcac

SEQ ID NO: 18919 - DNA, 20 bp, Artificial Sequence
  chemically synthesized
gggaggagagggagagcacc

SEQ ID NO: 18920 - DNA, 20 bp, Artificial Sequence
  chemically synthesized
aggagagggagagcaccagg

SEQ ID NO: 18921 - DNA, 20 bp, Artificial Sequence
  chemically synthesized
agggagagcaccaggaagaa

SEQ ID NO: 18922 - DNA, 20 bp, Artificial Sequence
  chemically synthesized
ggaagaatagctaacgaatg

SEQ ID NO: 18923 - DNA, 20 bp, Artificial Sequence
  chemically synthesized
acgaatgcagcaaacctgca

SEQ ID NO: 18924 - DNA, 20 bp, Artificial Sequence
  chemically synthesized
cacatcctgcacatgtgccc

SEQ ID NO: 18925 - DNA, 20 bp, Artificial Sequence
  chemically synthesized
gaacttaaaatatattatgt

SEQ ID NO: 18926 - DNA, 20 bp, Artificial Sequence
  chemically synthesized
aatatattatgttggtacaa

SEQ ID NO: 18927 - DNA, 20 bp, Artificial Sequence
  chemically synthesized
tacctttgcacctacctaat

SEQ ID NO: 18928 - DNA, 20 bp, Artificial Sequence
  chemically synthesized
tgcacctacctaataagttg

SEQ ID NO: 18929 - DNA, 20 bp, Artificial Sequence
  chemically synthesized
gcacctacctaataagttga

SEQ ID NO: 18930 - DNA, 20 bp, Artificial Sequence
  chemically synthesized
ttttaaaaaaaaaaaaaaaa

SEQ ID NO: 18931 - DNA, 20 bp, Artificial Sequence
  chemically synthesized
tttaaaaaaaaaaaaaaaaa

SEQ ID NO: 18932 - DNA, 20 bp, Artificial Sequence
  chemically synthesized
aaggaaaatctaccctgaaa

SEQ ID NO: 18933 - DNA, 20 bp, Artificial Sequence
  chemically synthesized
ggaaaatctaccctgaaata

SEQ ID NO: 18934 - DNA, 20 bp, Artificial Sequence
  chemically synthesized
aaatctaccctgaaatagag

SEQ ID NO: 18935 - DNA, 20 bp, Artificial Sequence
  chemically synthesized
ccctgaaatagagtagtttt

SEQ ID NO: 18936 - DNA, 20 bp, Artificial Sequence
  chemically synthesized
atagagtagttttgagatta

SEQ ID NO: 18937 - DNA, 20 bp, Artificial Sequence
  chemically synthesized
gagtagttttgagattatag

SEQ ID NO: 18938 - DNA, 20 bp, Artificial Sequence
  chemically synthesized
gtagttttgagattatagta

SEQ ID NO: 18939 - DNA, 20 bp, Artificial Sequence
  chemically synthesized
tgctataattcatctttata

SEQ ID NO: 18940 - DNA, 20 bp, Artificial Sequence
  chemically synthesized
catctttatatggccaaaac

SEQ ID NO: 18941 - DNA, 20 bp, Artificial Sequence
  chemically synthesized
attgcacatttttccttctg

SEQ ID NO: 18942 - DNA, 20 bp, Artificial Sequence
  chemically synthesized
ttgcacatttttccttctgt

SEQ ID NO: 18943 - DNA, 20 bp, Artificial Sequence
  chemically synthesized
atttttccttctgtaggctt

SEQ ID NO: 18944 - DNA, 20 bp, Artificial Sequence
  chemically synthesized
tctgtaggctttggttgaac

SEQ ID NO: 18945 - DNA, 20 bp, Artificial Sequence
  chemically synthesized
aggctttggttgaactagac

SEQ ID NO: 18946 - DNA, 20 bp, Artificial Sequence
  chemically synthesized
ccacttgactcttcctaaaa

SEQ ID NO: 18947 - DNA, 20 bp, Artificial Sequence
  chemically synthesized
tcttcctaaaatggtacttt

SEQ ID NO: 18948 - DNA, 20 bp, Artificial Sequence
  chemically synthesized
actttcagttcttatgaata

SEQ ID NO: 18949 - DNA, 20 bp, Artificial Sequence
  chemically synthesized
ctttcagttcttatgaatac

SEQ ID NO: 18950 - DNA, 20 bp, Artificial Sequence
  chemically synthesized
accatattttccctgattat

SEQ ID NO: 18951 - DNA, 20 bp, Artificial Sequence
  chemically synthesized
ccatattttccctgattatt

SEQ ID NO: 18952 - DNA, 20 bp, Artificial Sequence
  chemically synthesized
catattttccctgattatta

SEQ ID NO: 18953 - DNA, 20 bp, Artificial Sequence
  chemically synthesized
tgttttatctccatattcaa

SEQ ID NO: 18954 - DNA, 20 bp, Artificial Sequence
  chemically synthesized
tcaatagtattccactttcc

SEQ ID NO: 18955 - DNA, 20 bp, Artificial Sequence
  chemically synthesized
actttcctagtatctctcaa

SEQ ID NO: 18956 - DNA, 20 bp, Artificial Sequence
  chemically synthesized
tcctagtatctctcaataga

SEQ ID NO: 18957 - DNA, 20 bp, Artificial Sequence
  chemically synthesized
cctagtatctctcaatagat

SEQ ID NO: 18958 - DNA, 20 bp, Artificial Sequence
  chemically synthesized
ctcaatagataggtaaatta

SEQ ID NO: 18959 - DNA, 20 bp, Artificial Sequence
  chemically synthesized
tagatatatctccctcgata

SEQ ID NO: 18960 - DNA, 20 bp, Artificial Sequence
  chemically synthesized
tttatcaattgatcaattga

SEQ ID NO: 18961 - DNA, 20 bp, Artificial Sequence
  chemically synthesized
cattgtattattgttccatg

SEQ ID NO: 18962 - DNA, 20 bp, Artificial Sequence
  chemically synthesized
ttccatgtagcttttcactt

SEQ ID NO: 18963 - DNA, 20 bp, Artificial Sequence
  chemically synthesized
tagcttttcactttagataa

SEQ ID NO: 18964 - DNA, 20 bp, Artificial Sequence
  chemically synthesized
ttcactttagataatagtta

SEQ ID NO: 18965 - DNA, 20 bp, Artificial Sequence
  chemically synthesized
agcctatctaacactgatac

SEQ ID NO: 18966 - DNA, 20 bp, Artificial Sequence
  chemically synthesized
cctatctaacactgatacaa

SEQ ID NO: 18967 - DNA, 20 bp, Artificial Sequence
  chemically synthesized
aacactgatacaagagatat

SEQ ID NO: 18968 - DNA, 20 bp, Artificial Sequence
  chemically synthesized
acactgatacaagagatatt

SEQ ID NO: 18969 - DNA, 20 bp, Artificial Sequence
  chemically synthesized
agagatattgggtataaaat

SEQ ID NO: 18970 - DNA, 20 bp, Artificial Sequence
  chemically synthesized
gctcctttccaattactcaa

SEQ ID NO: 18971 - DNA, 20 bp, Artificial Sequence
  chemically synthesized
ctcctttccaattactcaaa

SEQ ID NO: 18972 - DNA, 20 bp, Artificial Sequence
  chemically synthesized
ttccaattactcaaaaggcc

SEQ ID NO: 18973 - DNA, 20 bp, Artificial Sequence
  chemically synthesized
caaaaggcccagaaatcatg

SEQ ID NO: 18974 - DNA, 20 bp, Artificial Sequence
  chemically synthesized
agatcacaaaattctgaaaa

SEQ ID NO: 18975 - DNA, 20 bp, Artificial Sequence
  chemically synthesized
gatcacaaaattctgaaaaa

SEQ ID NO: 18976 - DNA, 20 bp, Artificial Sequence
  chemically synthesized
atcacaaaattctgaaaaaa

SEQ ID NO: 18977 - DNA, 20 bp, Artificial Sequence
  chemically synthesized
aaattctgaaaaaagggctc

SEQ ID NO: 18978 - DNA, 20 bp, Artificial Sequence
  chemically synthesized
ggctcaagccattctgtgcc

SEQ ID NO: 18979 - DNA, 20 bp, Artificial Sequence
  chemically synthesized
gccattctgtgcccagaaaa

SEQ ID NO: 18980 - DNA, 20 bp, Artificial Sequence
  chemically synthesized
ccattctgtgcccagaaaat

SEQ ID NO: 18981 - DNA, 20 bp, Artificial Sequence
  chemically synthesized
ataggcgaacaatgcttctt

SEQ ID NO: 18982 - DNA, 20 bp, Artificial Sequence
  chemically synthesized
aatgcttctttggatctgct

SEQ ID NO: 18983 - DNA, 20 bp, Artificial Sequence
  chemically synthesized
tggtttgatgctgtatataa

SEQ ID NO: 18984 - DNA, 20 bp, Artificial Sequence
  chemically synthesized
ggtttgatgctgtatataat

SEQ ID NO: 18985 - DNA, 20 bp, Artificial Sequence
  chemically synthesized
gtttgatgctgtatataata

SEQ ID NO: 18986 - DNA, 20 bp, Artificial Sequence
  chemically synthesized
tatataatagggttcatgaa

SEQ ID NO: 18987 - DNA, 20 bp, Artificial Sequence
  chemically synthesized
tataatagggttcatgaatg

SEQ ID NO: 18988 - DNA, 20 bp, Artificial Sequence
  chemically synthesized
ataatagggttcatgaatgg

SEQ ID NO: 18989 - DNA, 20 bp, Artificial Sequence
  chemically synthesized
gggttcatgaatggaggaaa

SEQ ID NO: 18990 - DNA, 20 bp, Artificial Sequence
  chemically synthesized
tgaatggaggaaaaagaaat

SEQ ID NO: 18991 - DNA, 20 bp, Artificial Sequence
  chemically synthesized
aggaaaaagaaatgagtcat

SEQ ID NO: 18992 - DNA, 20 bp, Artificial Sequence
  chemically synthesized
agaaatgagtcattagctca

SEQ ID NO: 18993 - DNA, 20 bp, Artificial Sequence
  chemically synthesized
acggtaatgtgcaccacatg

SEQ ID NO: 18994 - DNA, 20 bp, Artificial Sequence
  chemically synthesized
tttcccaaacctgtgaatga

SEQ ID NO: 18995 - DNA, 20 bp, Artificial Sequence
  chemically synthesized
aatgaaagtctcactgatca

SEQ ID NO: 18996 - DNA, 20 bp, Artificial Sequence
  chemically synthesized
tcacggtgatgtgaaatacc

SEQ ID NO: 18997 - DNA, 20 bp, Artificial Sequence
  chemically synthesized
tgatgtgaaataccaagaca

SEQ ID NO: 18998 - DNA, 20 bp, Artificial Sequence
  chemically synthesized
ataccaagacacagctgata

SEQ ID NO: 18999 - DNA, 20 bp, Artificial Sequence
  chemically synthesized
taccaagacacagctgatat

SEQ ID NO: 19000 - DNA, 20 bp, Artificial Sequence
  chemically synthesized
ccaagacacagctgatatgg

SEQ ID NO: 19001 - DNA, 20 bp, Artificial Sequence
  chemically synthesized
atatgggagacacacatgtt

SEQ ID NO: 19002 - DNA, 20 bp, Artificial Sequence
  chemically synthesized
atgggagacacacatgttga

SEQ ID NO: 19003 - DNA, 20 bp, Artificial Sequence
  chemically synthesized
gacacacatgttgagagctt

SEQ ID NO: 19004 - DNA, 20 bp, Artificial Sequence
  chemically synthesized
agctttggcttgctcttttc

SEQ ID NO: 19005 - DNA, 20 bp, Artificial Sequence
  chemically synthesized
ctttggcttgctcttttctg

SEQ ID NO: 19006 - DNA, 20 bp, Artificial Sequence
  chemically synthesized
tttggcttgctcttttctgg

SEQ ID NO: 19007 - DNA, 20 bp, Artificial Sequence
  chemically synthesized
gcaatacctttaactgtttt

SEQ ID NO: 19008 - DNA, 20 bp, Artificial Sequence
  chemically synthesized
caatacctttaactgtttta

SEQ ID NO: 19009 - DNA, 20 bp, Artificial Sequence
  chemically synthesized
cctttaactgttttaaggat

SEQ ID NO: 19010 - DNA, 20 bp, Artificial Sequence
  chemically synthesized
ctttaactgttttaaggatc

SEQ ID NO: 19011 - DNA, 20 bp, Artificial Sequence
  chemically synthesized
tgttttaaggatcaggatat

SEQ ID NO: 19012 - DNA, 20 bp, Artificial Sequence
  chemically synthesized
taaggatcaggatataagaa

SEQ ID NO: 19013 - DNA, 20 bp, Artificial Sequence
  chemically synthesized
atataagaaaagacaatgat

SEQ ID NO: 19014 - DNA, 20 bp, Artificial Sequence
  chemically synthesized
ataagaaaagacaatgatca

SEQ ID NO: 19015 - DNA, 20 bp, Artificial Sequence
  chemically synthesized
aagacaatgatcagagcgtc

SEQ ID NO: 19016 - DNA, 20 bp, Artificial Sequence
  chemically synthesized
agacaatgatcagagcgtct

SEQ ID NO: 19017 - DNA, 20 bp, Artificial Sequence
  chemically synthesized
caatgatcagagcgtctagg

SEQ ID NO: 19018 - DNA, 20 bp, Artificial Sequence
  chemically synthesized
agcgtctaggaagaaaatca

SEQ ID NO: 19019 - DNA, 20 bp, Artificial Sequence
  chemically synthesized
aggaagaaaatcaaagcaac

SEQ ID NO: 19020 - DNA, 20 bp, Artificial Sequence
  chemically synthesized
gaaaatcaaagcaaccagaa

SEQ ID NO: 19021 - DNA, 20 bp, Artificial Sequence
  chemically synthesized
atcaaagcaaccagaatagc

SEQ ID NO: 19022 - DNA, 20 bp, Artificial Sequence
  chemically synthesized
tcaaagcaaccagaatagct

SEQ ID NO: 19023 - DNA, 20 bp, Artificial Sequence
  chemically synthesized
caaccagaatagctgggtat

SEQ ID NO: 19024 - DNA, 20 bp, Artificial Sequence
  chemically synthesized
taagtgattgaatgtaatat

SEQ ID NO: 19025 - DNA, 20 bp, Artificial Sequence
  chemically synthesized
gattgaatgtaatatcagca

SEQ ID NO: 19026 - DNA, 20 bp, Artificial Sequence
  chemically synthesized
attgaatgtaatatcagcac

SEQ ID NO: 19027 - DNA, 20 bp, Artificial Sequence
  chemically synthesized
aatgtaatatcagcacaggc

SEQ ID NO: 19028 - DNA, 20 bp, Artificial Sequence
  chemically synthesized
atatcagcacaggcaagttt

SEQ ID NO: 19029 - DNA, 20 bp, Artificial Sequence
  chemically synthesized
tatcagcacaggcaagtttc

SEQ ID NO: 19030 - DNA, 20 bp, Artificial Sequence
  chemically synthesized
caagtttcaggacatcttga

SEQ ID NO: 19031 - DNA, 20 bp, Artificial Sequence
  chemically synthesized
agtttcaggacatcttgatg

SEQ ID NO: 19032 - DNA, 20 bp, Artificial Sequence
  chemically synthesized
ggacatcttgatggagaaaa

SEQ ID NO: 19033 - DNA, 20 bp, Artificial Sequence
  chemically synthesized
gacatcttgatggagaaaaa

SEQ ID NO: 19034 - DNA, 20 bp, Artificial Sequence
  chemically synthesized
cttgatggagaaaaaaggtg

SEQ ID NO: 19035 - DNA, 20 bp, Artificial Sequence
  chemically synthesized
gatggagaaaaaaggtgtgg

SEQ ID NO: 19036 - DNA, 20 bp, Artificial Sequence
  chemically synthesized
tggagaaaaaaggtgtggaa

SEQ ID NO: 19037 - DNA, 20 bp, Artificial Sequence
  chemically synthesized
aaaaggtgtggaagagaaca

SEQ ID NO: 19038 - DNA, 20 bp, Artificial Sequence
  chemically synthesized
aaaggtgtggaagagaacat

SEQ ID NO: 19039 - DNA, 20 bp, Artificial Sequence
  chemically synthesized
agaacatgggaatgacaata

SEQ ID NO: 19040 - DNA, 20 bp, Artificial Sequence
  chemically synthesized
gaacatgggaatgacaatat

SEQ ID NO: 19041 - DNA, 20 bp, Artificial Sequence
  chemically synthesized
catgggaatgacaatatggg

SEQ ID NO: 19042 - DNA, 20 bp, Artificial Sequence
  chemically synthesized
aatgacaatatgggaagcaa

SEQ ID NO: 19043 - DNA, 20 bp, Artificial Sequence
  chemically synthesized
tgacaatatgggaagcaatg

SEQ ID NO: 19044 - DNA, 20 bp, Artificial Sequence
  chemically synthesized
caatatgggaagcaatggag

SEQ ID NO: 19045 - DNA, 20 bp, Artificial Sequence
  chemically synthesized
tatgggaagcaatggagtgg

SEQ ID NO: 19046 - DNA, 20 bp, Artificial Sequence
  chemically synthesized
aagcaatggagtggcagaat

SEQ ID NO: 19047 - DNA, 20 bp, Artificial Sequence
  chemically synthesized
gcaatggagtggcagaattg

SEQ ID NO: 19048 - DNA, 20 bp, Artificial Sequence
  chemically synthesized
caatggagtggcagaattgg

SEQ ID NO: 19049 - DNA, 20 bp, Artificial Sequence
  chemically synthesized
agtggcagaattggaggcac

SEQ ID NO: 19050 - DNA, 20 bp, Artificial Sequence
  chemically synthesized
gtggcagaattggaggcacg

SEQ ID NO: 19051 - DNA, 20 bp, Artificial Sequence
  chemically synthesized
tggcagaattggaggcacga

SEQ ID NO: 19052 - DNA, 20 bp, Artificial Sequence
  chemically synthesized
ttggaggcacgagggataaa

SEQ ID NO: 19053 - DNA, 20 bp, Artificial Sequence
  chemically synthesized
gataaaaagtccctcataaa

SEQ ID NO: 19054 - DNA, 20 bp, Artificial Sequence
  chemically synthesized
aagtccctcataaatagcca

SEQ ID NO: 19055 - DNA, 20 bp, Artificial Sequence
  chemically synthesized
ccacagttctatcttcaccc

SEQ ID NO: 19056 - DNA, 20 bp, Artificial Sequence
  chemically synthesized
ttctatcttcacccaagatt

SEQ ID NO: 19057 - DNA, 20 bp, Artificial Sequence
  chemically synthesized
tatcttcacccaagatttag

SEQ ID NO: 19058 - DNA, 20 bp, Artificial Sequence
  chemically synthesized
cacccaagatttagtagaaa

SEQ ID NO: 19059 - DNA, 20 bp, Artificial Sequence
  chemically synthesized
tagtagaaatagttatacct

SEQ ID NO: 19060 - DNA, 20 bp, Artificial Sequence
  chemically synthesized
tagaaatagttatacctgag

SEQ ID NO: 19061 - DNA, 20 bp, Artificial Sequence
  chemically synthesized
agttatacctgagaagcatg

SEQ ID NO: 19062 - DNA, 20 bp, Artificial Sequence
  chemically synthesized
gcatgtggatgataatgaaa

SEQ ID NO: 19063 - DNA, 20 bp, Artificial Sequence
  chemically synthesized
ggatgataatgaaacggtca

SEQ ID NO: 19064 - DNA, 20 bp, Artificial Sequence
  chemically synthesized
gatgataatgaaacggtcat

SEQ ID NO: 19065 - DNA, 20 bp, Artificial Sequence
  chemically synthesized
aaacggtcataggccattga

SEQ ID NO: 19066 - DNA, 20 bp, Artificial Sequence
  chemically synthesized
aacggtcataggccattgac

SEQ ID NO: 19067 - DNA, 20 bp, Artificial Sequence
  chemically synthesized
cggtcataggccattgacag

SEQ ID NO: 19068 - DNA, 20 bp, Artificial Sequence
  chemically synthesized
aggagaatacctgattctgc

SEQ ID NO: 19069 - DNA, 20 bp, Artificial Sequence
  chemically synthesized
agaatacctgattctgcaag

SEQ ID NO: 19070 - DNA, 20 bp, Artificial Sequence
  chemically synthesized
ctgattctgcaagtggataa

SEQ ID NO: 19071 - DNA, 20 bp, Artificial Sequence
  chemically synthesized
tgattctgcaagtggataat

SEQ ID NO: 19072 - DNA, 20 bp, Artificial Sequence
  chemically synthesized
attctgcaagtggataatgg

SEQ ID NO: 19073 - DNA, 20 bp, Artificial Sequence
  chemically synthesized
ctgcaagtggataatgggag

SEQ ID NO: 19074 - DNA, 20 bp, Artificial Sequence
  chemically synthesized
agtggataatgtaaacctgc

SEQ ID NO: 19075 - DNA, 20 bp, Artificial Sequence
  chemically synthesized
ggataatgtaaacctgcaag

SEQ ID NO: 19076 - DNA, 20 bp, Artificial Sequence
  chemically synthesized
taatgtaaacctgcaagaag

SEQ ID NO: 19077 - DNA, 20 bp, Artificial Sequence
  chemically synthesized
aatgtaaacctgcaagaagc

SEQ ID NO: 19078 - DNA, 20 bp, Artificial Sequence
  chemically synthesized
cctgcaagaagcaggcccca

SEQ ID NO: 19079 - DNA, 20 bp, Artificial Sequence
  chemically synthesized
cctctttgtgattcatccac

SEQ ID NO: 19080 - DNA, 20 bp, Artificial Sequence
  chemically synthesized
catccacaagacgcccatta

SEQ ID NO: 19081 - DNA, 20 bp, Artificial Sequence
  chemically synthesized
ccacaagacgcccattacag

SEQ ID NO: 19082 - DNA, 20 bp, Artificial Sequence
  chemically synthesized
cacaagacgcccattacagt

SEQ ID NO: 19083 - DNA, 20 bp, Artificial Sequence
  chemically synthesized
gcccattacagtgggcatca

SEQ ID NO: 19084 - DNA, 20 bp, Artificial Sequence
  chemically synthesized
atcatggtcaatttcaccat

SEQ ID NO: 19085 - DNA, 20 bp, Artificial Sequence
  chemically synthesized
tcatggtcaatttcaccatg

SEQ ID NO: 19086 - DNA, 20 bp, Artificial Sequence
  chemically synthesized
ttcaccatgaggtcttgcct

SEQ ID NO: 19087 - DNA, 20 bp, Artificial Sequence
  chemically synthesized
catgaggtcttgcctcagtg

SEQ ID NO: 19088 - DNA, 20 bp, Artificial Sequence
  chemically synthesized
aggtcttgcctcagtgtggc

SEQ ID NO: 19089 - DNA, 20 bp, Artificial Sequence
  chemically synthesized
ggtcttgcctcagtgtggca

SEQ ID NO: 19090 - DNA, 20 bp, Artificial Sequence
  chemically synthesized
gcctcagtgtggcaaggaaa

SEQ ID NO: 19091 - DNA, 20 bp, Artificial Sequence
  chemically synthesized
tgtggcaaggaaacagtaca

SEQ ID NO: 19092 - DNA, 20 bp, Artificial Sequence
  chemically synthesized
gtggcaaggaaacagtacat

SEQ ID NO: 19093 - DNA, 20 bp, Artificial Sequence
  chemically synthesized
aaacagtacatgggttcgtg

SEQ ID NO: 19094 - DNA, 20 bp, Artificial Sequence
  chemically synthesized
acatgggttcgtgaagactg

SEQ ID NO: 19095 - DNA, 20 bp, Artificial Sequence
  chemically synthesized
agactgtggtcatgcttgat

SEQ ID NO: 19096 - DNA, 20 bp, Artificial Sequence
  chemically synthesized
gactgtggtcatgcttgatg

SEQ ID NO: 19097 - DNA, 20 bp, Artificial Sequence
  chemically synthesized
tgtggtcatgcttgatgagg

SEQ ID NO: 19098 - DNA, 20 bp, Artificial Sequence
  chemically synthesized
tggtcatgcttgatgaggta

SEQ ID NO: 19099 - DNA, 20 bp, Artificial Sequence
  chemically synthesized
ggtcatgcttgatgaggtag

SEQ ID NO: 19100 - DNA, 20 bp, Artificial Sequence
  chemically synthesized
tcatgcttgatgaggtagag

SEQ ID NO: 19101 - DNA, 20 bp, Artificial Sequence
  chemically synthesized
tagaggagcttgccattgcc

SEQ ID NO: 19102 - DNA, 20 bp, Artificial Sequence
  chemically synthesized
aggagcttgccattgccaag

SEQ ID NO: 19103 - DNA, 20 bp, Artificial Sequence
  chemically synthesized
ggagcttgccattgccaaga

SEQ ID NO: 19104 - DNA, 20 bp, Artificial Sequence
  chemically synthesized
aagaaggacgcacacataaa

SEQ ID NO: 19105 - DNA, 20 bp, Artificial Sequence
  chemically synthesized
ggacgcacacataaacagca

SEQ ID NO: 19106 - DNA, 20 bp, Artificial Sequence
  chemically synthesized
cgcacacataaacagcaaag

SEQ ID NO: 19107 - DNA, 20 bp, Artificial Sequence
  chemically synthesized
gcacacataaacagcaaaga

SEQ ID NO: 19108 - DNA, 20 bp, Artificial Sequence
  chemically synthesized
cacacataaacagcaaagaa

SEQ ID NO: 19109 - DNA, 20 bp, Artificial Sequence
  chemically synthesized
acacataaacagcaaagaag

SEQ ID NO: 19110 - DNA, 20 bp, Artificial Sequence
  chemically synthesized
ataaacagcaaagaagggga

SEQ ID NO: 19111 - DNA, 20 bp, Artificial Sequence
  chemically synthesized
aaacagcaaagaaggggatg

SEQ ID NO: 19112 - DNA, 20 bp, Artificial Sequence
  chemically synthesized
caaagaaggggatggagatc

SEQ ID NO: 19113 - DNA, 20 bp, Artificial Sequence
  chemically synthesized
ggggatggagatcgagtgat

SEQ ID NO: 19114 - DNA, 20 bp, Artificial Sequence
  chemically synthesized
atcgagtgataagttgcctc

SEQ ID NO: 19115 - DNA, 20 bp, Artificial Sequence
  chemically synthesized
aagttgcctccagtactgaa

SEQ ID NO: 19116 - DNA, 20 bp, Artificial Sequence
  chemically synthesized
tgcctccagtactgaaaagc

SEQ ID NO: 19117 - DNA, 20 bp, Artificial Sequence
  chemically synthesized
gcctccagtactgaaaagcc

SEQ ID NO: 19118 - DNA, 20 bp, Artificial Sequence
  chemically synthesized
tccagtactgaaaagccagg

SEQ ID NO: 19119 - DNA, 20 bp, Artificial Sequence
  chemically synthesized
tgaaaagccaggcagcaaaa

SEQ ID NO: 19120 - DNA, 20 bp, Artificial Sequence
  chemically synthesized
gaaaagccaggcagcaaaaa

SEQ ID NO: 19121 - DNA, 20 bp, Artificial Sequence
  chemically synthesized
aaagccaggcagcaaaaaag

SEQ ID NO: 19122 - DNA, 20 bp, Artificial Sequence
  chemically synthesized
gagccgcattgtgtgttcac

SEQ ID NO: 19123 - DNA, 20 bp, Artificial Sequence
  chemically synthesized
ccgcattgtgtgttcacaag

SEQ ID NO: 19124 - DNA, 20 bp, Artificial Sequence
  chemically synthesized
attgtgtgttcacaagtggc

SEQ ID NO: 19125 - DNA, 20 bp, Artificial Sequence
  chemically synthesized
gtgtgttcacaagtggcaag

SEQ ID NO: 19126 - DNA, 20 bp, Artificial Sequence
  chemically synthesized
acaagtggcaagtagcttta

SEQ ID NO: 19127 - DNA, 20 bp, Artificial Sequence
  chemically synthesized
cactgaaatccctgccttat

SEQ ID NO: 19128 - DNA, 20 bp, Artificial Sequence
  chemically synthesized
cttgtgaaactgtatttctg

SEQ ID NO: 19129 - DNA, 20 bp, Artificial Sequence
  chemically synthesized
tcaatcctaatattcatatt

SEQ ID NO: 19130 - DNA, 20 bp, Artificial Sequence
  chemically synthesized
catatttagcaataatttat

SEQ ID NO: 19131 - DNA, 20 bp, Artificial Sequence
  chemically synthesized
aatgtgcaacaattttctta

SEQ ID NO: 19132 - DNA, 20 bp, Artificial Sequence
  chemically synthesized
gtgcaacaattttcttatag

SEQ ID NO: 19133 - DNA, 20 bp, Artificial Sequence
  chemically synthesized
gcaacaattttcttatagaa

SEQ ID NO: 19134 - DNA, 20 bp, Artificial Sequence
  chemically synthesized
atagaagagcaatacattta

SEQ ID NO: 19135 - DNA, 20 bp, Artificial Sequence
  chemically synthesized
aatacatttatagactgtgc

SEQ ID NO: 19136 - DNA, 20 bp, Artificial Sequence
  chemically synthesized
tacatttatagactgtgcta

SEQ ID NO: 19137 - DNA, 20 bp, Artificial Sequence
  chemically synthesized
ttatagactgtgctagagat

SEQ ID NO: 19138 - DNA, 20 bp, Artificial Sequence
  chemically synthesized
tatagactgtgctagagata

SEQ ID NO: 19139 - DNA, 20 bp, Artificial Sequence
  chemically synthesized
aggaatgatgatcatttctt

SEQ ID NO: 19140 - DNA, 20 bp, Artificial Sequence
  chemically synthesized
ttcttcagttatgaataatt

SEQ ID NO: 19141 - DNA, 20 bp, Artificial Sequence
  chemically synthesized
ttcagttatgaataattaag

SEQ ID NO: 19142 - DNA, 20 bp, Artificial Sequence
  chemically synthesized
ttatgaataattaagtagtt

SEQ ID NO: 19143 - DNA, 20 bp, Artificial Sequence
  chemically synthesized
aaatgcatcatgcccctctg

SEQ ID NO: 19144 - DNA, 20 bp, Artificial Sequence
  chemically synthesized
ctgcacaatgtttgaaccaa

SEQ ID NO: 19145 - DNA, 20 bp, Artificial Sequence
  chemically synthesized
ttgaaccaatagtaacaaaa

SEQ ID NO: 19146 - DNA, 20 bp, Artificial Sequence
  chemically synthesized
aaccaatagtaacaaaaaag

SEQ ID NO: 19147 - DNA, 20 bp, Artificial Sequence
  chemically synthesized
accaatagtaacaaaaaaga

SEQ ID NO: 19148 - DNA, 20 bp, Artificial Sequence
  chemically synthesized
agaaggcaaatatatgcaat

SEQ ID NO: 19149 - DNA, 20 bp, Artificial Sequence
  chemically synthesized
aattagataataattgtaca

SEQ ID NO: 19150 - DNA, 20 bp, Artificial Sequence
  chemically synthesized
tacatagttaacctgctgct

SEQ ID NO: 19151 - DNA, 20 bp, Artificial Sequence
  chemically synthesized
gcttagcttaattgcatatt

SEQ ID NO: 19152 - DNA, 20 bp, Artificial Sequence
  chemically synthesized
tatgtttcacaatcatgata

SEQ ID NO: 19153 - DNA, 20 bp, Artificial Sequence
  chemically synthesized
tcacaatcatgatatagaca

SEQ ID NO: 19154 - DNA, 20 bp, Artificial Sequence
  chemically synthesized
atatagacatagtgttttgt

SEQ ID NO: 19155 - DNA, 20 bp, Artificial Sequence
  chemically synthesized
ttagaaaacttttctttgtt

SEQ ID NO: 19156 - DNA, 20 bp, Artificial Sequence
  chemically synthesized
ttctttgtttagttttgaaa

SEQ ID NO: 19157 - DNA, 20 bp, Artificial Sequence
  chemically synthesized
aatagaatgttaatgtttta

SEQ ID NO: 19158 - DNA, 20 bp, Artificial Sequence
  chemically synthesized
gttttatggaattctaacaa

SEQ ID NO: 19159 - DNA, 20 bp, Artificial Sequence
  chemically synthesized
ggaattctaacaaaagccat

SEQ ID NO: 19160 - DNA, 20 bp, Artificial Sequence
  chemically synthesized
caaaagccatgagccctctg

SEQ ID NO: 19161 - DNA, 20 bp, Artificial Sequence
  chemically synthesized
aaagccatgagccctctgtg

SEQ ID NO: 19162 - DNA, 20 bp, Artificial Sequence
  chemically synthesized
gagccctctgtggagaaaaa

SEQ ID NO: 19163 - DNA, 20 bp, Artificial Sequence
  chemically synthesized
ctgtggagaaaaatggacaa

SEQ ID NO: 19164 - DNA, 20 bp, Artificial Sequence
  chemically synthesized
tggagaaaaatggacaaaag

SEQ ID NO: 19165 - DNA, 20 bp, Artificial Sequence
  chemically synthesized
ggagaaaaatggacaaaagc

SEQ ID NO: 19166 - DNA, 20 bp, Artificial Sequence
  chemically synthesized
aaagcaggtgacgtcacatt

SEQ ID NO: 19167 - DNA, 20 bp, Artificial Sequence
  chemically synthesized
aatattcacacgttttcctg

SEQ ID NO: 19168 - DNA, 20 bp, Artificial Sequence
  chemically synthesized
ttttcctgaagctaatccat

SEQ ID NO: 19169 - DNA, 20 bp, Artificial Sequence
  chemically synthesized
agcaccacatttgaaacttc

SEQ ID NO: 19170 - DNA, 20 bp, Artificial Sequence
  chemically synthesized
cctgccttgaaacatgtgtt

SEQ ID NO: 19171 - DNA, 20 bp, Artificial Sequence
  chemically synthesized
aaacatgtgttgagatgaaa

SEQ ID NO: 19172 - DNA, 20 bp, Artificial Sequence
  chemically synthesized
agatgaaaaagtctgtgctt

SEQ ID NO: 19173 - DNA, 20 bp, Artificial Sequence
  chemically synthesized
gatgaaaaagtctgtgcttt

SEQ ID NO: 19174 - DNA, 20 bp, Artificial Sequence
  chemically synthesized
aaagtctgtgctttaggtgt

SEQ ID NO: 19175 - DNA, 20 bp, Artificial Sequence
  chemically synthesized
gctttaggtgttggtcatcc

SEQ ID NO: 19176 - DNA, 20 bp, Artificial Sequence
  chemically synthesized
taggtgttggtcatcccaga

SEQ ID NO: 19177 - DNA, 20 bp, Artificial Sequence
  chemically synthesized
ggtgttggtcatcccagatg

SEQ ID NO: 19178 - DNA, 20 bp, Artificial Sequence
  chemically synthesized
atggagtatgttctcctatg

SEQ ID NO: 19179 - DNA, 20 bp, Artificial Sequence
  chemically synthesized
ctcttcgctgcatctaacat

SEQ ID NO: 19180 - DNA, 20 bp, Artificial Sequence
  chemically synthesized
ttcgctgcatctaacataag

SEQ ID NO: 19181 - DNA, 20 bp, Artificial Sequence
  chemically synthesized
tcgctgcatctaacataaga

SEQ ID NO: 19182 - DNA, 20 bp, Artificial Sequence
  chemically synthesized
ctgcatctaacataagaagg

SEQ ID NO: 19183 - DNA, 20 bp, Artificial Sequence
  chemically synthesized
gcatctaacataagaaggaa

SEQ ID NO: 19184 - DNA, 20 bp, Artificial Sequence
  chemically synthesized
catctaacataagaaggaag

SEQ ID NO: 19185 - DNA, 20 bp, Artificial Sequence
  chemically synthesized
tcattccttattcctgttcc

SEQ ID NO: 19186 - DNA, 20 bp, Artificial Sequence
  chemically synthesized
ctatgctgtcattttcttgc

SEQ ID NO: 19187 - DNA, 20 bp, Artificial Sequence
  chemically synthesized
tgtcattttcttgctggaat

SEQ ID NO: 19188 - DNA, 20 bp, Artificial Sequence
  chemically synthesized
gtcattttcttgctggaata

SEQ ID NO: 19189 - DNA, 20 bp, Artificial Sequence
  chemically synthesized
acccattcctgctctatttg

SEQ ID NO: 19190 - DNA, 20 bp, Artificial Sequence
  chemically synthesized
tcctgctctatttgaagact

SEQ ID NO: 19191 - DNA, 20 bp, Artificial Sequence
  chemically synthesized
ctctatttgaagactcagtt

SEQ ID NO: 19192 - DNA, 20 bp, Artificial Sequence
  chemically synthesized
gttcagacactcacttctca

SEQ ID NO: 19193 - DNA, 20 bp, Artificial Sequence
  chemically synthesized
tcacttctcaaagactattc

SEQ ID NO: 19194 - DNA, 20 bp, Artificial Sequence
  chemically synthesized
acttctcaaagactattcaa

SEQ ID NO: 19195 - DNA, 20 bp, Artificial Sequence
  chemically synthesized
cttctcaaagactattcaag

SEQ ID NO: 19196 - DNA, 20 bp, Artificial Sequence
  chemically synthesized
gactattcaagaggccaaat

SEQ ID NO: 19197 - DNA, 20 bp, Artificial Sequence
  chemically synthesized
ctattcaagaggccaaatta

SEQ ID NO: 19198 - DNA, 20 bp, Artificial Sequence
  chemically synthesized
attcaagaggccaaattaga

SEQ ID NO: 19199 - DNA, 20 bp, Artificial Sequence
  chemically synthesized
aattagagagtttatgtatg

SEQ ID NO: 19200 - DNA, 20 bp, Artificial Sequence
  chemically synthesized
gtatgtggaaatcacttccc

SEQ ID NO: 19201 - DNA, 20 bp, Artificial Sequence
  chemically synthesized
atgtggaaatcacttcccca

SEQ ID NO: 19202 - DNA, 20 bp, Artificial Sequence
  chemically synthesized
gtttcctctttccaaatact

SEQ ID NO: 19203 - DNA, 20 bp, Artificial Sequence
  chemically synthesized
tcctctttccaaatactcag

SEQ ID NO: 19204 - DNA, 20 bp, Artificial Sequence
  chemically synthesized
tctcccctccctcctctgtc

SEQ ID NO: 19205 - DNA, 20 bp, Artificial Sequence
  chemically synthesized
ctcccctccctcctctgtct

SEQ ID NO: 19206 - DNA, 20 bp, Artificial Sequence
  chemically synthesized
cccctccctcctctgtctgg

SEQ ID NO: 19207 - DNA, 20 bp, Artificial Sequence
  chemically synthesized
ctccctcctctgtctgggag

SEQ ID NO: 19208 - DNA, 20 bp, Artificial Sequence
  chemically synthesized
cctcctctgtctgggagaag

SEQ ID NO: 19209 - DNA, 20 bp, Artificial Sequence
  chemically synthesized
ctcctctgtctgggagaagc

SEQ ID NO: 19210 - DNA, 20 bp, Artificial Sequence
  chemically synthesized
tcctctgtctgggagaagca

SEQ ID NO: 19211 - DNA, 20 bp, Artificial Sequence
  chemically synthesized
ggacgctcaaccaatgtcct

SEQ ID NO: 19212 - DNA, 20 bp, Artificial Sequence
  chemically synthesized
accaatgtcctcggaacttt

SEQ ID NO: 19213 - DNA, 20 bp, Artificial Sequence
  chemically synthesized
ccaatgtcctcggaactttc

SEQ ID NO: 19214 - DNA, 20 bp, Artificial Sequence
  chemically synthesized
gaactttcaggtatttctcc

SEQ ID NO: 19215 - DNA, 20 bp, Artificial Sequence
  chemically synthesized
aactttcaggtatttctcca

SEQ ID NO: 19216 - DNA, 20 bp, Artificial Sequence
  chemically synthesized
ttcaggtatttctccaagga

SEQ ID NO: 19217 - DNA, 20 bp, Artificial Sequence
  chemically synthesized
gtatttctccaaggatggat

SEQ ID NO: 19218 - DNA, 20 bp, Artificial Sequence
  chemically synthesized
tctccaaggatggatgagaa

SEQ ID NO: 19219 - DNA, 20 bp, Artificial Sequence
  chemically synthesized
ctccaatgccacctctacat

SEQ ID NO: 19220 - DNA, 20 bp, Artificial Sequence
  chemically synthesized
tccaatgccacctctacatt

SEQ ID NO: 19221 - DNA, 20 bp, Artificial Sequence
  chemically synthesized
ccacctctacattgggatgc

SEQ ID NO: 19222 - DNA, 20 bp, Artificial Sequence
  chemically synthesized
cacctctacattgggatgcc

SEQ ID NO: 19223 - DNA, 20 bp, Artificial Sequence
  chemically synthesized
gacttaattatgtgaccctt

SEQ ID NO: 19224 - DNA, 20 bp, Artificial Sequence
  chemically synthesized
acttaattatgtgacccttc

SEQ ID NO: 19225 - DNA, 20 bp, Artificial Sequence
  chemically synthesized
atgtgacccttcaggaccct

SEQ ID NO: 19226 - DNA, 20 bp, Artificial Sequence
  chemically synthesized
cccttcaggaccctaagcat

SEQ ID NO: 19227 - DNA, 20 bp, Artificial Sequence
  chemically synthesized
ggaccctaagcatcagtaca

SEQ ID NO: 19228 - DNA, 20 bp, Artificial Sequence
  chemically synthesized
gtctgtctcaatacaatgca

SEQ ID NO: 19229 - DNA, 20 bp, Artificial Sequence
  chemically synthesized
tcaatacaatgcaaagtatt

SEQ ID NO: 19230 - DNA, 20 bp, Artificial Sequence
  chemically synthesized
aatacaatgcaaagtattga

SEQ ID NO: 19231 - DNA, 20 bp, Artificial Sequence
  chemically synthesized
tgcaaagtattgagagatac

SEQ ID NO: 19232 - DNA, 20 bp, Artificial Sequence
  chemically synthesized
tgagagatactagttgaatg

SEQ ID NO: 19233 - DNA, 20 bp, Artificial Sequence
  chemically synthesized
gagagatactagttgaatgc

SEQ ID NO: 19234 - DNA, 20 bp, Artificial Sequence
  chemically synthesized
agagatactagttgaatgca

SEQ ID NO: 19235 - DNA, 20 bp, Artificial Sequence
  chemically synthesized
ggtcacatgtgtctttgtcc

SEQ ID NO: 19236 - DNA, 20 bp, Artificial Sequence
  chemically synthesized
tcacatgtgtctttgtcctg

SEQ ID NO: 19237 - DNA, 20 bp, Artificial Sequence
  chemically synthesized
tgttgtcttttctgatactt

SEQ ID NO: 19238 - DNA, 20 bp, Artificial Sequence
  chemically synthesized
gttgtcttttctgatacttt

SEQ ID NO: 19239 - DNA, 20 bp, Artificial Sequence
  chemically synthesized
ttctgatactttgggaaaat

SEQ ID NO: 19240 - DNA, 20 bp, Artificial Sequence
  chemically synthesized
ggaaaatcagttctgatcca

SEQ ID NO: 19241 - DNA, 20 bp, Artificial Sequence
  chemically synthesized
gaaaatcagttctgatccac

SEQ ID NO: 19242 - DNA, 20 bp, Artificial Sequence
  chemically synthesized
ctgatccacaggaacctcaa

SEQ ID NO: 19243 - DNA, 20 bp, Artificial Sequence
  chemically synthesized
aacctcaatggatctattaa

SEQ ID NO: 19244 - DNA, 20 bp, Artificial Sequence
  chemically synthesized
caatggatctattaatagcc

SEQ ID NO: 19245 - DNA, 20 bp, Artificial Sequence
  chemically synthesized
tattaatagccaagtaaatg

SEQ ID NO: 19246 - DNA, 20 bp, Artificial Sequence
  chemically synthesized
attaatagccaagtaaatga

SEQ ID NO: 19247 - DNA, 20 bp, Artificial Sequence
  chemically synthesized
ttaatagccaagtaaatgaa

SEQ ID NO: 19248 - DNA, 20 bp, Artificial Sequence
  chemically synthesized
aatcactgcccatttcatac

SEQ ID NO: 19249 - DNA, 20 bp, Artificial Sequence
  chemically synthesized
atcactgcccatttcatacc

SEQ ID NO: 19250 - DNA, 20 bp, Artificial Sequence
  chemically synthesized
tgcccatttcataccaggtt

SEQ ID NO: 19251 - DNA, 20 bp, Artificial Sequence
  chemically synthesized
gcccatttcataccaggttc

SEQ ID NO: 19252 - DNA, 20 bp, Artificial Sequence
  chemically synthesized
atttcataccaggttcagga

SEQ ID NO: 19253 - DNA, 20 bp, Artificial Sequence
  chemically synthesized
taaattttcaacatttactt

SEQ ID NO: 19254 - DNA, 20 bp, Artificial Sequence
  chemically synthesized
ttcaacatttactttagata

SEQ ID NO: 19255 - DNA, 20 bp, Artificial Sequence
  chemically synthesized
aacatttactttagatacag

SEQ ID NO: 19256 - DNA, 20 bp, Artificial Sequence
  chemically synthesized
acatttactttagatacagt

SEQ ID NO: 19257 - DNA, 20 bp, Artificial Sequence
  chemically synthesized
agatacagtgggtacttgtg

SEQ ID NO: 19258 - DNA, 20 bp, Artificial Sequence
  chemically synthesized
gatacagtgggtacttgtgc

SEQ ID NO: 19259 - DNA, 20 bp, Artificial Sequence
  chemically synthesized
acttgtgcaggttttttaca

SEQ ID NO: 19260 - DNA, 20 bp, Artificial Sequence
  chemically synthesized
ttacatggatatattgcatg

SEQ ID NO: 19261 - DNA, 20 bp, Artificial Sequence
  chemically synthesized
catggatatattgcatgcag

SEQ ID NO: 19262 - DNA, 20 bp, Artificial Sequence
  chemically synthesized
gatatattgcatgcagtggt

SEQ ID NO: 19263 - DNA, 20 bp, Artificial Sequence
  chemically synthesized
gtggtgagcatactatccaa

SEQ ID NO: 19264 - DNA, 20 bp, Artificial Sequence
  chemically synthesized
gcatctctccctgccccttg

SEQ ID NO: 19265 - DNA, 20 bp, Artificial Sequence
  chemically synthesized
tctctccctgccccttgtag

SEQ ID NO: 19266 - DNA, 20 bp, Artificial Sequence
  chemically synthesized
ctgccccttgtagtagtttc

SEQ ID NO: 19267 - DNA, 20 bp, Artificial Sequence
  chemically synthesized
ccccttgtagtagtttcaag

SEQ ID NO: 19268 - DNA, 20 bp, Artificial Sequence
  chemically synthesized
atccacgtgtactcaatgtt

SEQ ID NO: 19269 - DNA, 20 bp, Artificial Sequence
  chemically synthesized
tttagcttccacttataaat

SEQ ID NO: 19270 - DNA, 20 bp, Artificial Sequence
  chemically synthesized
cacttataaatgagaatata

SEQ ID NO: 19271 - DNA, 20 bp, Artificial Sequence
  chemically synthesized
tgttcttgcgttaatttgct

SEQ ID NO: 19272 - DNA, 20 bp, Artificial Sequence
  chemically synthesized
gttcttgcgttaatttgctt

SEQ ID NO: 19273 - DNA, 20 bp, Artificial Sequence
  chemically synthesized
cgttaatttgcttaggatta

SEQ ID NO: 19274 - DNA, 20 bp, Artificial Sequence
  chemically synthesized
ttgcttaggattatagcctc

SEQ ID NO: 19275 - DNA, 20 bp, Artificial Sequence
  chemically synthesized
gctccacccatgttgctgaa

SEQ ID NO: 19276 - DNA, 20 bp, Artificial Sequence
  chemically synthesized
ctccacccatgttgctgaaa

SEQ ID NO: 19277 - DNA, 20 bp, Artificial Sequence
  chemically synthesized
catttgttcttattgccaca

SEQ ID NO: 19278 - DNA, 20 bp, Artificial Sequence
  chemically synthesized
ttgttcttattgccacatag

SEQ ID NO: 19279 - DNA, 20 bp, Artificial Sequence
  chemically synthesized
ttcttattgccacatagtgg

SEQ ID NO: 19280 - DNA, 20 bp, Artificial Sequence
  chemically synthesized
gtggtggtgtatatgtacca

SEQ ID NO: 19281 - DNA, 20 bp, Artificial Sequence
  chemically synthesized
tttatcccgtccgcctttga

SEQ ID NO: 19282 - DNA, 20 bp, Artificial Sequence
  chemically synthesized
gtccgcctttgatagacacc

SEQ ID NO: 19283 - DNA, 20 bp, Artificial Sequence
  chemically synthesized
tccgcctttgatagacacct

SEQ ID NO: 19284 - DNA, 20 bp, Artificial Sequence
  chemically synthesized
cctttgatagacacctaggc

SEQ ID NO: 19285 - DNA, 20 bp, Artificial Sequence
  chemically synthesized
tttgtatttgctattctaaa

SEQ ID NO: 19286 - DNA, 20 bp, Artificial Sequence
  chemically synthesized
tgctattctaaacagcatta

SEQ ID NO: 19287 - DNA, 20 bp, Artificial Sequence
  chemically synthesized
cagcattacagtgaacatgc

SEQ ID NO: 19288 - DNA, 20 bp, Artificial Sequence
  chemically synthesized
aacatgcaagtgcatgtgtc

SEQ ID NO: 19289 - DNA, 20 bp, Artificial Sequence
  chemically synthesized
tgcaagtgcatgtgtctagt

SEQ ID NO: 19290 - DNA, 20 bp, Artificial Sequence
  chemically synthesized
tctaatgctctgttttccta

SEQ ID NO: 19291 - DNA, 20 bp, Artificial Sequence
  chemically synthesized
ttttcctatggatatatacc

SEQ ID NO: 19292 - DNA, 20 bp, Artificial Sequence
  chemically synthesized
tcctatggatatatacccag

SEQ ID NO: 19293 - DNA, 20 bp, Artificial Sequence
  chemically synthesized
tatggatatatacccagtag

SEQ ID NO: 19294 - DNA, 20 bp, Artificial Sequence
  chemically synthesized
atggatatatacccagtagc

SEQ ID NO: 19295 - DNA, 20 bp, Artificial Sequence
  chemically synthesized
gggattgctgtgtcaaattg

SEQ ID NO: 19296 - DNA, 20 bp, Artificial Sequence
  chemically synthesized
tcaaattgtagctctgctta

SEQ ID NO: 19297 - DNA, 20 bp, Artificial Sequence
  chemically synthesized
gctctgcttaaagttctttg

SEQ ID NO: 19298 - DNA, 20 bp, Artificial Sequence
  chemically synthesized
actctccaaactgttttctg

SEQ ID NO: 19299 - DNA, 20 bp, Artificial Sequence
  chemically synthesized
ctccaaactgttttctgcag

SEQ ID NO: 19300 - DNA, 20 bp, Artificial Sequence
  chemically synthesized
catccccatcatcattgtat

SEQ ID NO: 19301 - DNA, 20 bp, Artificial Sequence
  chemically synthesized
taagtgttcccttttctcca

SEQ ID NO: 19302 - DNA, 20 bp, Artificial Sequence
  chemically synthesized
ccttttctccatagcctcat

SEQ ID NO: 19303 - DNA, 20 bp, Artificial Sequence
  chemically synthesized
cctcatgagaatctgttttt

SEQ ID NO: 19304 - DNA, 20 bp, Artificial Sequence
  chemically synthesized
gttttttggctttttaaaaa

SEQ ID NO: 19305 - DNA, 20 bp, Artificial Sequence
  chemically synthesized
ttaaaaatagctattctgac

SEQ ID NO: 19306 - DNA, 20 bp, Artificial Sequence
  chemically synthesized
atagctattctgactggtat

SEQ ID NO: 19307 - DNA, 20 bp, Artificial Sequence
  chemically synthesized
ctattctgactggtatgaga

SEQ ID NO: 19308 - DNA, 20 bp, Artificial Sequence
  chemically synthesized
gtatgagatagtatctcttg

SEQ ID NO: 19309 - DNA, 20 bp, Artificial Sequence
  chemically synthesized
ttgatttgcatttctctcat

SEQ ID NO: 19310 - DNA, 20 bp, Artificial Sequence
  chemically synthesized
tcatttttgtatatatttgt

SEQ ID NO: 19311 - DNA, 20 bp, Artificial Sequence
  chemically synthesized
ctgcctgtatgtcttctctt

SEQ ID NO: 19312 - DNA, 20 bp, Artificial Sequence
  chemically synthesized
cctgtatgtcttctcttgag

SEQ ID NO: 19313 - DNA, 20 bp, Artificial Sequence
  chemically synthesized
tgtatgtcttctcttgagaa

SEQ ID NO: 19314 - DNA, 20 bp, Artificial Sequence
  chemically synthesized
tcttgagaagagtctgttcg

SEQ ID NO: 19315 - DNA, 20 bp, Artificial Sequence
  chemically synthesized
ggattttgcccatttttaaa

SEQ ID NO: 19316 - DNA, 20 bp, Artificial Sequence
  chemically synthesized
tgatatgttcgaattcctta

SEQ ID NO: 19317 - DNA, 20 bp, Artificial Sequence
  chemically synthesized
tccttatagattctgaatat

SEQ ID NO: 19318 - DNA, 20 bp, Artificial Sequence
  chemically synthesized
tctgaatattagaccttttc

SEQ ID NO: 19319 - DNA, 20 bp, Artificial Sequence
  chemically synthesized
ttagaccttttccagatgca

SEQ ID NO: 19320 - DNA, 20 bp, Artificial Sequence
  chemically synthesized
ccagatgcacagtttgtgaa

SEQ ID NO: 19321 - DNA, 20 bp, Artificial Sequence
  chemically synthesized
gaatagtttctcctatcctg

SEQ ID NO: 19322 - DNA, 20 bp, Artificial Sequence
  chemically synthesized
tctcctatcctgtagattgt

SEQ ID NO: 19323 - DNA, 20 bp, Artificial Sequence
  chemically synthesized
ttgtcagtttactctgttga

SEQ ID NO: 19324 - DNA, 20 bp, Artificial Sequence
  chemically synthesized
tgatagtttcttctgctgca

SEQ ID NO: 19325 - DNA, 20 bp, Artificial Sequence
  chemically synthesized
tagtttcttctgctgcacag

SEQ ID NO: 19326 - DNA, 20 bp, Artificial Sequence
  chemically synthesized
tattattattattatacttt

SEQ ID NO: 19327 - DNA, 20 bp, Artificial Sequence
  chemically synthesized
tattattatactttaagttc

SEQ ID NO: 19328 - DNA, 20 bp, Artificial Sequence
  chemically synthesized
attattatactttaagttct

SEQ ID NO: 19329 - DNA, 20 bp, Artificial Sequence
  chemically synthesized
ttattatactttaagttcta

SEQ ID NO: 19330 - DNA, 20 bp, Artificial Sequence
  chemically synthesized
gggtacatgtgcgcaacgtg

SEQ ID NO: 19331 - DNA, 20 bp, Artificial Sequence
  chemically synthesized
ggtacatgtgcgcaacgtgc

SEQ ID NO: 19332 - DNA, 20 bp, Artificial Sequence
  chemically synthesized
tatgtatacatgtgccatgt

SEQ ID NO: 19333 - DNA, 20 bp, Artificial Sequence
  chemically synthesized
cattaactcatcatttacat

SEQ ID NO: 19334 - DNA, 20 bp, Artificial Sequence
  chemically synthesized
attaactcatcatttacatt

SEQ ID NO: 19335 - DNA, 20 bp, Artificial Sequence
  chemically synthesized
cccccacccccaccccacaa

SEQ ID NO: 19336 - DNA, 20 bp, Artificial Sequence
  chemically synthesized
ccccacccccaccccacaac

SEQ ID NO: 19337 - DNA, 20 bp, Artificial Sequence
  chemically synthesized
ccccaccccacaacaggccc

SEQ ID NO: 19338 - DNA, 20 bp, Artificial Sequence
  chemically synthesized
atgttccccttcctctgtcc

SEQ ID NO: 19339 - DNA, 20 bp, Artificial Sequence
  chemically synthesized
attgttcaattcccacctat

SEQ ID NO: 19340 - DNA, 20 bp, Artificial Sequence
  chemically synthesized
ttcaattcccacctataagt

SEQ ID NO: 19341 - DNA, 20 bp, Artificial Sequence
  chemically synthesized
cacctataagtgagaacatg

SEQ ID NO: 19342 - DNA, 20 bp, Artificial Sequence
  chemically synthesized
aagtgagaacatgtggtatt

SEQ ID NO: 19343 - DNA, 20 bp, Artificial Sequence
  chemically synthesized
ttggttttttgtccttgtga

SEQ ID NO: 19344 - DNA, 20 bp, Artificial Sequence
  chemically synthesized
tgtccttgtgatagtttgct

SEQ ID NO: 19345 - DNA, 20 bp, Artificial Sequence
  chemically synthesized
tgatagtttgctgagaatga

SEQ ID NO: 19346 - DNA, 20 bp, Artificial Sequence
  chemically synthesized
ttgctgagaatgatggtttc

SEQ ID NO: 19347 - DNA, 20 bp, Artificial Sequence
  chemically synthesized
gcttcatccatgtccctaca

SEQ ID NO: 19348 - DNA, 20 bp, Artificial Sequence
  chemically synthesized
cttcatccatgtccctacaa

SEQ ID NO: 19349 - DNA, 20 bp, Artificial Sequence
  chemically synthesized
catgaactcatcatttttta

SEQ ID NO: 19350 - DNA, 20 bp, Artificial Sequence
  chemically synthesized
catcattttttatggctgca

SEQ ID NO: 19351 - DNA, 20 bp, Artificial Sequence
  chemically synthesized
tatggctgcatagtattcca

SEQ ID NO: 19352 - DNA, 20 bp, Artificial Sequence
  chemically synthesized
ttaatccattctatcattgt

SEQ ID NO: 19353 - DNA, 20 bp, Artificial Sequence
  chemically synthesized
ttctatcattgttggacatt

SEQ ID NO: 19354 - DNA, 20 bp, Artificial Sequence
  chemically synthesized
tctatcattgttggacattt

SEQ ID NO: 19355 - DNA, 20 bp, Artificial Sequence
  chemically synthesized
tcattgttggacatttgggt

SEQ ID NO: 19356 - DNA, 20 bp, Artificial Sequence
  chemically synthesized
tggacatttgggttggttcc

SEQ ID NO: 19357 - DNA, 20 bp, Artificial Sequence
  chemically synthesized
caagtctttgttattgtgaa

SEQ ID NO: 19358 - DNA, 20 bp, Artificial Sequence
  chemically synthesized
ctttgttattgtgaatagtg

SEQ ID NO: 19359 - DNA, 20 bp, Artificial Sequence
  chemically synthesized
ttgtgaatagtgaagctctt

SEQ ID NO: 19360 - DNA, 20 bp, Artificial Sequence
  chemically synthesized
gtgaagctctttagtttaat

SEQ ID NO: 19361 - DNA, 20 bp, Artificial Sequence
  chemically synthesized
tgaagctctttagtttaatt

SEQ ID NO: 19362 - DNA, 20 bp, Artificial Sequence
  chemically synthesized
ctttgcattgcaattgcttt

SEQ ID NO: 19363 - DNA, 20 bp, Artificial Sequence
  chemically synthesized
tttgcattgcaattgctttt

SEQ ID NO: 19364 - DNA, 20 bp, Artificial Sequence
  chemically synthesized
ttgcattgcaattgcttttg

SEQ ID NO: 19365 - DNA, 20 bp, Artificial Sequence
  chemically synthesized
tgcattgcaattgcttttgg

SEQ ID NO: 19366 - DNA, 20 bp, Artificial Sequence
  chemically synthesized
tgcaattgcttttgggggct

SEQ ID NO: 19367 - DNA, 20 bp, Artificial Sequence
  chemically synthesized
cttagccaaaaatgcactgc

SEQ ID NO: 19368 - DNA, 20 bp, Artificial Sequence
  chemically synthesized
ccaaaaatgcactgccagtg

SEQ ID NO: 19369 - DNA, 20 bp, Artificial Sequence
  chemically synthesized
caaaaatgcactgccagtgc

SEQ ID NO: 19370 - DNA, 20 bp, Artificial Sequence
  chemically synthesized
aatgcactgccagtgcaggt

SEQ ID NO: 19371 - DNA, 20 bp, Artificial Sequence
  chemically synthesized
tgccagtgcaggtaagattt

SEQ ID NO: 19372 - DNA, 20 bp, Artificial Sequence
  chemically synthesized
agatttgagatcttacattt

SEQ ID NO: 19373 - DNA, 20 bp, Artificial Sequence
  chemically synthesized
ttaagttttgaattcatttt

SEQ ID NO: 19374 - DNA, 20 bp, Artificial Sequence
  chemically synthesized
tttcagttgatttctctaaa

SEQ ID NO: 19375 - DNA, 20 bp, Artificial Sequence
  chemically synthesized
ttgatttctctaaatggtgt

SEQ ID NO: 19376 - DNA, 20 bp, Artificial Sequence
  chemically synthesized
tgatttctctaaatggtgta

SEQ ID NO: 19377 - DNA, 20 bp, Artificial Sequence
  chemically synthesized
ttctctaaatggtgtaaggt

SEQ ID NO: 19378 - DNA, 20 bp, Artificial Sequence
  chemically synthesized
tctctaaatggtgtaaggta

SEQ ID NO: 19379 - DNA, 20 bp, Artificial Sequence
  chemically synthesized
ctctaaatggtgtaaggtaa

SEQ ID NO: 19380 - DNA, 20 bp, Artificial Sequence
  chemically synthesized
aatggtgtaaggtaagggtc

SEQ ID NO: 19381 - DNA, 20 bp, Artificial Sequence
  chemically synthesized
tagtttcattcttctgcata

SEQ ID NO: 19382 - DNA, 20 bp, Artificial Sequence
  chemically synthesized
ttcattcttctgcatatggc

SEQ ID NO: 19383 - DNA, 20 bp, Artificial Sequence
  chemically synthesized
atatggctagccacgtattc

SEQ ID NO: 19384 - DNA, 20 bp, Artificial Sequence
  chemically synthesized
gctagccacgtattccagca

SEQ ID NO: 19385 - DNA, 20 bp, Artificial Sequence
  chemically synthesized
cgtattccagcacagtttat

SEQ ID NO: 19386 - DNA, 20 bp, Artificial Sequence
  chemically synthesized
ttccagcacagtttattgga

SEQ ID NO: 19387 - DNA, 20 bp, Artificial Sequence
  chemically synthesized
tccagcacagtttattggat

SEQ ID NO: 19388 - DNA, 20 bp, Artificial Sequence
  chemically synthesized
agcacagtttattggatagg

SEQ ID NO: 19389 - DNA, 20 bp, Artificial Sequence
  chemically synthesized
ttcccgctgcttgtttttgt

SEQ ID NO: 19390 - DNA, 20 bp, Artificial Sequence
  chemically synthesized
tgtttttgtcagtgttgttg

SEQ ID NO: 19391 - DNA, 20 bp, Artificial Sequence
  chemically synthesized
ttgtcagtgttgttgaagat

SEQ ID NO: 19392 - DNA, 20 bp, Artificial Sequence
  chemically synthesized
cagtgttgttgaagatcaga

SEQ ID NO: 19393 - DNA, 20 bp, Artificial Sequence
  chemically synthesized
atcagatggttgtaactatg

SEQ ID NO: 19394 - DNA, 20 bp, Artificial Sequence
  chemically synthesized
aactatgtagctttattttt

SEQ ID NO: 19395 - DNA, 20 bp, Artificial Sequence
  chemically synthesized
agttttctattgtgtttcct

SEQ ID NO: 19396 - DNA, 20 bp, Artificial Sequence
  chemically synthesized
tgtaacaatatcatgctgtt

SEQ ID NO: 19397 - DNA, 20 bp, Artificial Sequence
  chemically synthesized
gtaacaatatcatgctgttt

SEQ ID NO: 19398 - DNA, 20 bp, Artificial Sequence
  chemically synthesized
taacaatatcatgctgtttg

SEQ ID NO: 19399 - DNA, 20 bp, Artificial Sequence
  chemically synthesized
tcatgctgtttggggtactg

SEQ ID NO: 19400 - DNA, 20 bp, Artificial Sequence
  chemically synthesized
ggtactgtggccttataatg

SEQ ID NO: 19401 - DNA, 20 bp, Artificial Sequence
  chemically synthesized
tctttctttttttatttttt

SEQ ID NO: 19402 - DNA, 20 bp, Artificial Sequence
  chemically synthesized
tttctttttttattttttca

SEQ ID NO: 19403 - DNA, 20 bp, Artificial Sequence
  chemically synthesized
cagagtttcactctgtcacc

SEQ ID NO: 19404 - DNA, 20 bp, Artificial Sequence
  chemically synthesized
agagtttcactctgtcaccc

SEQ ID NO: 19405 - DNA, 20 bp, Artificial Sequence
  chemically synthesized
tttcactctgtcacccaggc

SEQ ID NO: 19406 - DNA, 20 bp, Artificial Sequence
  chemically synthesized
tcactctgtcacccaggctg

SEQ ID NO: 19407 - DNA, 20 bp, Artificial Sequence
  chemically synthesized
ctgtcacccaggctggagtg

SEQ ID NO: 19408 - DNA, 20 bp, Artificial Sequence
  chemically synthesized
tcacccaggctggagtgcag

SEQ ID NO: 19409 - DNA, 20 bp, Artificial Sequence
  chemically synthesized
ggagtgcagtggtgcgatct

SEQ ID NO: 19410 - DNA, 20 bp, Artificial Sequence
  chemically synthesized
ctcactgcaccgtctgcctc

SEQ ID NO: 19411 - DNA, 20 bp, Artificial Sequence
  chemically synthesized
cactgcaccgtctgcctcca

SEQ ID NO: 19412 - DNA, 20 bp, Artificial Sequence
  chemically synthesized
accgtctgcctccagagttc

SEQ ID NO: 19413 - DNA, 20 bp, Artificial Sequence
  chemically synthesized
ttcaagcaattctcctgcct

SEQ ID NO: 19414 - DNA, 20 bp, Artificial Sequence
  chemically synthesized
ttctcctgcctcagccttcc

SEQ ID NO: 19415 - DNA, 20 bp, Artificial Sequence
  chemically synthesized
tcctgcctcagccttccgag

SEQ ID NO: 19416 - DNA, 20 bp, Artificial Sequence
  chemically synthesized
gcctcagccttccgagtagc

SEQ ID NO: 19417 - DNA, 20 bp, Artificial Sequence
  chemically synthesized
cctcagccttccgagtagct

SEQ ID NO: 19418 - DNA, 20 bp, Artificial Sequence
  chemically synthesized
cttccgagtagctgggatta

SEQ ID NO: 19419 - DNA, 20 bp, Artificial Sequence
  chemically synthesized
gattacagcccccaccacca

SEQ ID NO: 19420 - DNA, 20 bp, Artificial Sequence
  chemically synthesized
acagcccccaccaccacagc

SEQ ID NO: 19421 - DNA, 20 bp, Artificial Sequence
  chemically synthesized
gccggctaattttgtatttt

SEQ ID NO: 19422 - DNA, 20 bp, Artificial Sequence
  chemically synthesized
ggctaattttgtatttttag

SEQ ID NO: 19423 - DNA, 20 bp, Artificial Sequence
  chemically synthesized
ctaattttgtatttttagta

SEQ ID NO: 19424 - DNA, 20 bp, Artificial Sequence
  chemically synthesized
ttttgtatttttagtagaga

SEQ ID NO: 19425 - DNA, 20 bp, Artificial Sequence
  chemically synthesized
cagtgtttcaccatgttgac

SEQ ID NO: 19426 - DNA, 20 bp, Artificial Sequence
  chemically synthesized
agtgtttcaccatgttgacc

SEQ ID NO: 19427 - DNA, 20 bp, Artificial Sequence
  chemically synthesized
tttcaccatgttgaccaggc

SEQ ID NO: 19428 - DNA, 20 bp, Artificial Sequence
  chemically synthesized
tggtcttgaactcctgacct

SEQ ID NO: 19429 - DNA, 20 bp, Artificial Sequence
  chemically synthesized
ggtcttgaactcctgacctc

SEQ ID NO: 19430 - DNA, 20 bp, Artificial Sequence
  chemically synthesized
ctcaggtgatacacccacct

SEQ ID NO: 19431 - DNA, 20 bp, Artificial Sequence
  chemically synthesized
acacccacctcagcccccta

SEQ ID NO: 19432 - DNA, 20 bp, Artificial Sequence
  chemically synthesized
acctcagccccctaaagtgc

SEQ ID NO: 19433 - DNA, 20 bp, Artificial Sequence
  chemically synthesized
ctcagccccctaaagtgcta

SEQ ID NO: 19434 - DNA, 20 bp, Artificial Sequence
  chemically synthesized
cccctaaagtgctagagtta

SEQ ID NO: 19435 - DNA, 20 bp, Artificial Sequence
  chemically synthesized
ccctaaagtgctagagttac

SEQ ID NO: 19436 - DNA, 20 bp, Artificial Sequence
  chemically synthesized
agtgctagagttacaggcgt

SEQ ID NO: 19437 - DNA, 20 bp, Artificial Sequence
  chemically synthesized
caggcgtgagccaccgtgcc

SEQ ID NO: 19438 - DNA, 20 bp, Artificial Sequence
  chemically synthesized
gagccaccgtgcctggcctg

SEQ ID NO: 19439 - DNA, 20 bp, Artificial Sequence
  chemically synthesized
cgtgcctggcctgtagtttc

SEQ ID NO: 19440 - DNA, 20 bp, Artificial Sequence
  chemically synthesized
cctggcctgtagtttcaagt

SEQ ID NO: 19441 - DNA, 20 bp, Artificial Sequence
  chemically synthesized
ctggcctgtagtttcaagtc

SEQ ID NO: 19442 - DNA, 20 bp, Artificial Sequence
  chemically synthesized
gcctgtagtttcaagtcagg

SEQ ID NO: 19443 - DNA, 20 bp, Artificial Sequence
  chemically synthesized
tagtttcaagtcaggtggtg

SEQ ID NO: 19444 - DNA, 20 bp, Artificial Sequence
  chemically synthesized
caattttgttctttctgctt

SEQ ID NO: 19445 - DNA, 20 bp, Artificial Sequence
  chemically synthesized
ttaagattgctttgcctgtt

SEQ ID NO: 19446 - DNA, 20 bp, Artificial Sequence
  chemically synthesized
taagattgctttgcctgttc

SEQ ID NO: 19447 - DNA, 20 bp, Artificial Sequence
  chemically synthesized
ttgcctgttcaggctctttt

SEQ ID NO: 19448 - DNA, 20 bp, Artificial Sequence
  chemically synthesized
gttccatatgaattttaaac

SEQ ID NO: 19449 - DNA, 20 bp, Artificial Sequence
  chemically synthesized
ctagtttttctaatactgtg

SEQ ID NO: 19450 - DNA, 20 bp, Artificial Sequence
  chemically synthesized
aatactgtgaagaatgacat

SEQ ID NO: 19451 - DNA, 20 bp, Artificial Sequence
  chemically synthesized
tgaagaatgacattggtaat

SEQ ID NO: 19452 - DNA, 20 bp, Artificial Sequence
  chemically synthesized
gaatgacattggtaattgga

SEQ ID NO: 19453 - DNA, 20 bp, Artificial Sequence
  chemically synthesized
atgaatgtctaaattgcttt

SEQ ID NO: 19454 - DNA, 20 bp, Artificial Sequence
  chemically synthesized
aatgtctaaattgctttgag

SEQ ID NO: 19455 - DNA, 20 bp, Artificial Sequence
  chemically synthesized
ctaaattgctttgagcagta

SEQ ID NO: 19456 - DNA, 20 bp, Artificial Sequence
  chemically synthesized
tattgattcttccaatccat

SEQ ID NO: 19457 - DNA, 20 bp, Artificial Sequence
  chemically synthesized
attcttccaatccatgagcc

SEQ ID NO: 19458 - DNA, 20 bp, Artificial Sequence
  chemically synthesized
ttccaatccatgagcctgga

SEQ ID NO: 19459 - DNA, 20 bp, Artificial Sequence
  chemically synthesized
gtgttgtttctgatttcttt

SEQ ID NO: 19460 - DNA, 20 bp, Artificial Sequence
  chemically synthesized
ttgtttctgatttctttcag

SEQ ID NO: 19461 - DNA, 20 bp, Artificial Sequence
  chemically synthesized
tttctttcagcagtgttttg

SEQ ID NO: 19462 - DNA, 20 bp, Artificial Sequence
  chemically synthesized
gtgttttgtagttctccttg

SEQ ID NO: 19463 - DNA, 20 bp, Artificial Sequence
  chemically synthesized
gttttgtagttctccttgta

SEQ ID NO: 19464 - DNA, 20 bp, Artificial Sequence
  chemically synthesized
aaaccatatgatcatctcaa

SEQ ID NO: 19465 - DNA, 20 bp, Artificial Sequence
  chemically synthesized
tatgatcatctcaatagact

SEQ ID NO: 19466 - DNA, 20 bp, Artificial Sequence
  chemically synthesized
ttcatgataaaaacctccaa

SEQ ID NO: 19467 - DNA, 20 bp, Artificial Sequence
  chemically synthesized
gataaaaacctccaacagac

SEQ ID NO: 19468 - DNA, 20 bp, Artificial Sequence
  chemically synthesized
ataaaaacctccaacagact

SEQ ID NO: 19469 - DNA, 20 bp, Artificial Sequence
  chemically synthesized
ctccaacagactaggcatca

SEQ ID NO: 19470 - DNA, 20 bp, Artificial Sequence
  chemically synthesized
tccaacagactaggcatcaa

SEQ ID NO: 19471 - DNA, 20 bp, Artificial Sequence
  chemically synthesized
atcaaaggaacatacctcaa

SEQ ID NO: 19472 - DNA, 20 bp, Artificial Sequence
  chemically synthesized
aacatacctcaaaagaataa

SEQ ID NO: 19473 - DNA, 20 bp, Artificial Sequence
  chemically synthesized
ataaccaaaaccatactgaa

SEQ ID NO: 19474 - DNA, 20 bp, Artificial Sequence
  chemically synthesized
taaccaaaaccatactgaat

SEQ ID NO: 19475 - DNA, 20 bp, Artificial Sequence
  chemically synthesized
aaaccatactgaatgggcaa

SEQ ID NO: 19476 - DNA, 20 bp, Artificial Sequence
  chemically synthesized
catactgaatgggcaaaagc

SEQ ID NO: 19477 - DNA, 20 bp, Artificial Sequence
  chemically synthesized
ttctcctcgaaaactgcaac

SEQ ID NO: 19478 - DNA, 20 bp, Artificial Sequence
  chemically synthesized
ctcgaaaactgcaacaagac

SEQ ID NO: 19479 - DNA, 20 bp, Artificial Sequence
  chemically synthesized
tcgaaaactgcaacaagaca

SEQ ID NO: 19480 - DNA, 20 bp, Artificial Sequence
  chemically synthesized
attcccattctcaccactcc

SEQ ID NO: 19481 - DNA, 20 bp, Artificial Sequence
  chemically synthesized
actcctagtgaacataaaat

SEQ ID NO: 19482 - DNA, 20 bp, Artificial Sequence
  chemically synthesized
cctagtgaacataaaattgg

SEQ ID NO: 19483 - DNA, 20 bp, Artificial Sequence
  chemically synthesized
ataaaattggaagtcctaac

SEQ ID NO: 19484 - DNA, 20 bp, Artificial Sequence
  chemically synthesized
taaaattggaagtcctaacc

SEQ ID NO: 19485 - DNA, 20 bp, Artificial Sequence
  chemically synthesized
aaaattggaagtcctaacca

SEQ ID NO: 19486 - DNA, 20 bp, Artificial Sequence
  chemically synthesized
gaagtcctaaccagggcaat

SEQ ID NO: 19487 - DNA, 20 bp, Artificial Sequence
  chemically synthesized
aagtcctaaccagggcaatc

SEQ ID NO: 19488 - DNA, 20 bp, Artificial Sequence
  chemically synthesized
cctaaccagggcaatcaggc

SEQ ID NO: 19489 - DNA, 20 bp, Artificial Sequence
  chemically synthesized
taaccagggcaatcaggcga

SEQ ID NO: 19490 - DNA, 20 bp, Artificial Sequence
  chemically synthesized
cagggcaatcaggcgagaga

SEQ ID NO: 19491 - DNA, 20 bp, Artificial Sequence
  chemically synthesized
gcaatcaggcgagagaaaga

SEQ ID NO: 19492 - DNA, 20 bp, Artificial Sequence
  chemically synthesized
aggcgagagaaagaaagaaa

SEQ ID NO: 19493 - DNA, 20 bp, Artificial Sequence
  chemically synthesized
agaaagaaatggcatcaaaa

SEQ ID NO: 19494 - DNA, 20 bp, Artificial Sequence
  chemically synthesized
gaaagaaatggcatcaaaat

SEQ ID NO: 19495 - DNA, 20 bp, Artificial Sequence
  chemically synthesized
tggcatcaaaataggacaat

SEQ ID NO: 19496 - DNA, 20 bp, Artificial Sequence
  chemically synthesized
tgatgatatgactctatact

SEQ ID NO: 19497 - DNA, 20 bp, Artificial Sequence
  chemically synthesized
tctatacttagaaaatccta

SEQ ID NO: 19498 - DNA, 20 bp, Artificial Sequence
  chemically synthesized
aatcctacagattcttccaa

SEQ ID NO: 19499 - DNA, 20 bp, Artificial Sequence
  chemically synthesized
atcctacagattcttccaaa

SEQ ID NO: 19500 - DNA, 20 bp, Artificial Sequence
  chemically synthesized
agattcttccaaaaggctgc

SEQ ID NO: 19501 - DNA, 20 bp, Artificial Sequence
  chemically synthesized
ctagaactgataaacaattt

SEQ ID NO: 19502 - DNA, 20 bp, Artificial Sequence
  chemically synthesized
aactgataaacaattttagc

SEQ ID NO: 19503 - DNA, 20 bp, Artificial Sequence
  chemically synthesized
actgataaacaattttagca

SEQ ID NO: 19504 - DNA, 20 bp, Artificial Sequence
  chemically synthesized
aaacaattttagcaaggttt

SEQ ID NO: 19505 - DNA, 20 bp, Artificial Sequence
  chemically synthesized
aacaattttagcaaggtttc

SEQ ID NO: 19506 - DNA, 20 bp, Artificial Sequence
  chemically synthesized
acaaaatcacatacaaaaat

SEQ ID NO: 19507 - DNA, 20 bp, Artificial Sequence
  chemically synthesized
aaatcacatacaaaaatcag

SEQ ID NO: 19508 - DNA, 20 bp, Artificial Sequence
  chemically synthesized
tagcatttccatacaccaat

SEQ ID NO: 19509 - DNA, 20 bp, Artificial Sequence
  chemically synthesized
agcatttccatacaccaata

SEQ ID NO: 19510 - DNA, 20 bp, Artificial Sequence
  chemically synthesized
ttccatacaccaataaggcc

SEQ ID NO: 19511 - DNA, 20 bp, Artificial Sequence
  chemically synthesized
tccatacaccaataaggccc

SEQ ID NO: 19512 - DNA, 20 bp, Artificial Sequence
  chemically synthesized
acaccaataaggcccaggct

SEQ ID NO: 19513 - DNA, 20 bp, Artificial Sequence
  chemically synthesized
accaataaggcccaggctga

SEQ ID NO: 19514 - DNA, 20 bp, Artificial Sequence
  chemically synthesized
cccaggctgagagtcaaatc

SEQ ID NO: 19515 - DNA, 20 bp, Artificial Sequence
  chemically synthesized
atcgagaacacaatcccatt

SEQ ID NO: 19516 - DNA, 20 bp, Artificial Sequence
  chemically synthesized
gaacacaatcccattaagaa

SEQ ID NO: 19517 - DNA, 20 bp, Artificial Sequence
  chemically synthesized
tcccattaagaacagccaca

SEQ ID NO: 19518 - DNA, 20 bp, Artificial Sequence
  chemically synthesized
cacaaagaaaatgaaatacc

SEQ ID NO: 19519 - DNA, 20 bp, Artificial Sequence
  chemically synthesized
acaaagaaaatgaaatacct

SEQ ID NO: 19520 - DNA, 20 bp, Artificial Sequence
  chemically synthesized
tttattgaaatttaaaaccc

SEQ ID NO: 19521 - DNA, 20 bp, Artificial Sequence
  chemically synthesized
attgaaatttaaaacccaag

SEQ ID NO: 19522 - DNA, 20 bp, Artificial Sequence
  chemically synthesized
ttgaaatttaaaacccaagc

SEQ ID NO: 19523 - DNA, 20 bp, Artificial Sequence
  chemically synthesized
tttaaaacccaagcaggcac

SEQ ID NO: 19524 - DNA, 20 bp, Artificial Sequence
  chemically synthesized
aaacccaagcaggcactaga

SEQ ID NO: 19525 - DNA, 20 bp, Artificial Sequence
  chemically synthesized
tatcattactacgtgaatat

SEQ ID NO: 19526 - DNA, 20 bp, Artificial Sequence
  chemically synthesized
cgtgaatattagtgtgctat

SEQ ID NO: 19527 - DNA, 20 bp, Artificial Sequence
  chemically synthesized
tgaatattagtgtgctatga

SEQ ID NO: 19528 - DNA, 20 bp, Artificial Sequence
  chemically synthesized
agacacatcaaataaatttc

SEQ ID NO: 19529 - DNA, 20 bp, Artificial Sequence
  chemically synthesized
gacacatcaaataaatttct

SEQ ID NO: 19530 - DNA, 20 bp, Artificial Sequence
  chemically synthesized
atcaaataaatttctgggat

SEQ ID NO: 19531 - DNA, 20 bp, Artificial Sequence
  chemically synthesized
tcaaataaatttctgggatc

SEQ ID NO: 19532 - DNA, 20 bp, Artificial Sequence
  chemically synthesized
caaataaatttctgggatca

SEQ ID NO: 19533 - DNA, 20 bp, Artificial Sequence
  chemically synthesized
tgggatcagggaacattttc

SEQ ID NO: 19534 - DNA, 20 bp, Artificial Sequence
  chemically synthesized
gatcagggaacattttccag

SEQ ID NO: 19535 - DNA, 20 bp, Artificial Sequence
  chemically synthesized
ttccagaagaaatgctactt

SEQ ID NO: 19536 - DNA, 20 bp, Artificial Sequence
  chemically synthesized
gaagaaatgctacttaagct

SEQ ID NO: 19537 - DNA, 20 bp, Artificial Sequence
  chemically synthesized
agaattaaatgctactatat

SEQ ID NO: 19538 - DNA, 20 bp, Artificial Sequence
  chemically synthesized
attaaatgctactatattag

SEQ ID NO: 19539 - DNA, 20 bp, Artificial Sequence
  chemically synthesized
atgctactatattagtagtg

SEQ ID NO: 19540 - DNA, 20 bp, Artificial Sequence
  chemically synthesized
ctactatattagtagtgtag

SEQ ID NO: 19541 - DNA, 20 bp, Artificial Sequence
  chemically synthesized
attagtagtgtagtagtatt

SEQ ID NO: 19542 - DNA, 20 bp, Artificial Sequence
  chemically synthesized
agtagtgtagtagtatttgg

SEQ ID NO: 19543 - DNA, 20 bp, Artificial Sequence
  chemically synthesized
gtagtgtagtagtatttggt

SEQ ID NO: 19544 - DNA, 20 bp, Artificial Sequence
  chemically synthesized
tagtgtagtagtatttggtg

SEQ ID NO: 19545 - DNA, 20 bp, Artificial Sequence
  chemically synthesized
tgtagtagtatttggtgggg

SEQ ID NO: 19546 - DNA, 20 bp, Artificial Sequence
  chemically synthesized
ggtagtgcaatcattgcgta

SEQ ID NO: 19547 - DNA, 20 bp, Artificial Sequence
  chemically synthesized
gtagtgcaatcattgcgtac

SEQ ID NO: 19548 - DNA, 20 bp, Artificial Sequence
  chemically synthesized
aatcattgcgtacaggtgaa

SEQ ID NO: 19549 - DNA, 20 bp, Artificial Sequence
  chemically synthesized
gaacaaacacaaaacgaaac

SEQ ID NO: 19550 - DNA, 20 bp, Artificial Sequence
  chemically synthesized
cgaaacaagtaaacaaatta

SEQ ID NO: 19551 - DNA, 20 bp, Artificial Sequence
  chemically synthesized
aaagtttgtaaaatgtacat

SEQ ID NO: 19552 - DNA, 20 bp, Artificial Sequence
  chemically synthesized
tgtaaaatgtacattggtaa

SEQ ID NO: 19553 - DNA, 20 bp, Artificial Sequence
  chemically synthesized
gtaaaatgtacattggtaat

SEQ ID NO: 19554 - DNA, 20 bp, Artificial Sequence
  chemically synthesized
taaaatgtacattggtaatg

SEQ ID NO: 19555 - DNA, 20 bp, Artificial Sequence
  chemically synthesized
atgtacattggtaatggggc

SEQ ID NO: 19556 - DNA, 20 bp, Artificial Sequence
  chemically synthesized
ttttattcaaaatatacatt

SEQ ID NO: 19557 - DNA, 20 bp, Artificial Sequence
  chemically synthesized
tttattcaaaatatacatta

SEQ ID NO: 19558 - DNA, 20 bp, Artificial Sequence
  chemically synthesized
attcaaaatatacattaagg

SEQ ID NO: 19559 - DNA, 20 bp, Artificial Sequence
  chemically synthesized
gaacaacaatacatgaaaaa

SEQ ID NO: 19560 - DNA, 20 bp, Artificial Sequence
  chemically synthesized
caatacatgaaaaaaagctt

SEQ ID NO: 19561 - DNA, 20 bp, Artificial Sequence
  chemically synthesized
atacatgaaaaaaagcttga

SEQ ID NO: 19562 - DNA, 20 bp, Artificial Sequence
  chemically synthesized
cttgagagaaaatgaatctg

SEQ ID NO: 19563 - DNA, 20 bp, Artificial Sequence
  chemically synthesized
gagagaaaatgaatctgtag

SEQ ID NO: 19564 - DNA, 20 bp, Artificial Sequence
  chemically synthesized
agaaaatgaatctgtagtag

SEQ ID NO: 19565 - DNA, 20 bp, Artificial Sequence
  chemically synthesized
aaatgaatctgtagtagtag

SEQ ID NO: 19566 - DNA, 20 bp, Artificial Sequence
  chemically synthesized
aatgaatctgtagtagtagc

SEQ ID NO: 19567 - DNA, 20 bp, Artificial Sequence
  chemically synthesized
aaacattttgacattaccat

SEQ ID NO: 19568 - DNA, 20 bp, Artificial Sequence
  chemically synthesized
aacattttgacattaccata

SEQ ID NO: 19569 - DNA, 20 bp, Artificial Sequence
  chemically synthesized
acattttgacattaccataa

SEQ ID NO: 19570 - DNA, 20 bp, Artificial Sequence
  chemically synthesized
taagggaatgaatataaaac

SEQ ID NO: 19571 - DNA, 20 bp, Artificial Sequence
  chemically synthesized
agggaatgaatataaaacaa

SEQ ID NO: 19572 - DNA, 20 bp, Artificial Sequence
  chemically synthesized
gggaatgaatataaaacaag

SEQ ID NO: 19573 - DNA, 20 bp, Artificial Sequence
  chemically synthesized
tataaaacaagaggtatgat

SEQ ID NO: 19574 - DNA, 20 bp, Artificial Sequence
  chemically synthesized
tatgatgagtacttataatc

SEQ ID NO: 19575 - DNA, 20 bp, Artificial Sequence
  chemically synthesized
gatgagtacttataatcaag

SEQ ID NO: 19576 - DNA, 20 bp, Artificial Sequence
  chemically synthesized
aatcaagtagttattgttta

SEQ ID NO: 19577 - DNA, 20 bp, Artificial Sequence
  chemically synthesized
gttattgtttaaagttacta

SEQ ID NO: 19578 - DNA, 20 bp, Artificial Sequence
  chemically synthesized
gtttaaagttactatggcta

SEQ ID NO: 19579 - DNA, 20 bp, Artificial Sequence
  chemically synthesized
agttactatggctacagtat

SEQ ID NO: 19580 - DNA, 20 bp, Artificial Sequence
  chemically synthesized
ctacagtatgagaaacatgt

SEQ ID NO: 19581 - DNA, 20 bp, Artificial Sequence
  chemically synthesized
gtatgagaaacatgttggaa

SEQ ID NO: 19582 - DNA, 20 bp, Artificial Sequence
  chemically synthesized
tatgagaaacatgttggaaa

SEQ ID NO: 19583 - DNA, 20 bp, Artificial Sequence
  chemically synthesized
atgagaaacatgttggaaaa

SEQ ID NO: 19584 - DNA, 20 bp, Artificial Sequence
  chemically synthesized
tgagaaacatgttggaaaag

SEQ ID NO: 19585 - DNA, 20 bp, Artificial Sequence
  chemically synthesized
gagaaacatgttggaaaagg

SEQ ID NO: 19586 - DNA, 20 bp, Artificial Sequence
  chemically synthesized
gaaacatgttggaaaagggg

SEQ ID NO: 19587 - DNA, 20 bp, Artificial Sequence
  chemically synthesized
atgttggaaaagggggagaa

SEQ ID NO: 19588 - DNA, 20 bp, Artificial Sequence
  chemically synthesized
tgttggaaaagggggagaac

SEQ ID NO: 19589 - DNA, 20 bp, Artificial Sequence
  chemically synthesized
aaaagggggagaacaggtaa

SEQ ID NO: 19590 - DNA, 20 bp, Artificial Sequence
  chemically synthesized
agggggagaacaggtaaaag

SEQ ID NO: 19591 - DNA, 20 bp, Artificial Sequence
  chemically synthesized
agaacaggtaaaagaagtat

SEQ ID NO: 19592 - DNA, 20 bp, Artificial Sequence
  chemically synthesized
gaacaggtaaaagaagtatc

SEQ ID NO: 19593 - DNA, 20 bp, Artificial Sequence
  chemically synthesized
atacacgtgtcaaattgtgt

SEQ ID NO: 19594 - DNA, 20 bp, Artificial Sequence
  chemically synthesized
cgtgtcaaattgtgttggtg

SEQ ID NO: 19595 - DNA, 20 bp, Artificial Sequence
  chemically synthesized
tgtgttggtgtggttttgac

SEQ ID NO: 19596 - DNA, 20 bp, Artificial Sequence
  chemically synthesized
tggttttgactagttgttat

SEQ ID NO: 19597 - DNA, 20 bp, Artificial Sequence
  chemically synthesized
ttttgactagttgttatcag

SEQ ID NO: 19598 - DNA, 20 bp, Artificial Sequence
  chemically synthesized
ctagttgttatcagtagcat

SEQ ID NO: 19599 - DNA, 20 bp, Artificial Sequence
  chemically synthesized
ttgttatcagtagcattaga

SEQ ID NO: 19600 - DNA, 20 bp, Artificial Sequence
  chemically synthesized
tgttatcagtagcattagaa

SEQ ID NO: 19601 - DNA, 20 bp, Artificial Sequence
  chemically synthesized
tagcattagaaaggcttgaa

SEQ ID NO: 19602 - DNA, 20 bp, Artificial Sequence
  chemically synthesized
cattagaaaggcttgaatag

SEQ ID NO: 19603 - DNA, 20 bp, Artificial Sequence
  chemically synthesized
ttagaaaggcttgaatagaa

SEQ ID NO: 19604 - DNA, 20 bp, Artificial Sequence
  chemically synthesized
agaaaggcttgaatagaaga

SEQ ID NO: 19605 - DNA, 20 bp, Artificial Sequence
  chemically synthesized
agaagagagattctatgact

SEQ ID NO: 19606 - DNA, 20 bp, Artificial Sequence
  chemically synthesized
agagattctatgacttagaa

SEQ ID NO: 19607 - DNA, 20 bp, Artificial Sequence
  chemically synthesized
ctatgacttagaatagaact

SEQ ID NO: 19608 - DNA, 20 bp, Artificial Sequence
  chemically synthesized
agaatagaactgagtgattg

SEQ ID NO: 19609 - DNA, 20 bp, Artificial Sequence
  chemically synthesized
gaatagaactgagtgattga

SEQ ID NO: 19610 - DNA, 20 bp, Artificial Sequence
  chemically synthesized
tagaactgagtgattgaagg

SEQ ID NO: 19611 - DNA, 20 bp, Artificial Sequence
  chemically synthesized
aactgagtgattgaaggtag

SEQ ID NO: 19612 - DNA, 20 bp, Artificial Sequence
  chemically synthesized
tgattgaaggtagtagatta

SEQ ID NO: 19613 - DNA, 20 bp, Artificial Sequence
  chemically synthesized
attgaaggtagtagattaaa

SEQ ID NO: 19614 - DNA, 20 bp, Artificial Sequence
  chemically synthesized
aaggtagtagattaaagaga

SEQ ID NO: 19615 - DNA, 20 bp, Artificial Sequence
  chemically synthesized
gtagtagattaaagagaaag

SEQ ID NO: 19616 - DNA, 20 bp, Artificial Sequence
  chemically synthesized
gattaaagagaaagaagcgt

SEQ ID NO: 19617 - DNA, 20 bp, Artificial Sequence
  chemically synthesized
gtaatgccacctgaatttct

SEQ ID NO: 19618 - DNA, 20 bp, Artificial Sequence
  chemically synthesized
aatttctgagttttgctgaa

SEQ ID NO: 19619 - DNA, 20 bp, Artificial Sequence
  chemically synthesized
tttctgagttttgctgaatg

SEQ ID NO: 19620 - DNA, 20 bp, Artificial Sequence
  chemically synthesized
tctgagttttgctgaatgga

SEQ ID NO: 19621 - DNA, 20 bp, Artificial Sequence
  chemically synthesized
gagttttgctgaatggagag

SEQ ID NO: 19622 - DNA, 20 bp, Artificial Sequence
  chemically synthesized
agtagttccattgacttcca

SEQ ID NO: 19623 - DNA, 20 bp, Artificial Sequence
  chemically synthesized
ttgacttccatagttatcac

SEQ ID NO: 19624 - DNA, 20 bp, Artificial Sequence
  chemically synthesized
acttccatagttatcacaag

SEQ ID NO: 19625 - DNA, 20 bp, Artificial Sequence
  chemically synthesized
tgactttattcactaatcaa

SEQ ID NO: 19626 - DNA, 20 bp, Artificial Sequence
  chemically synthesized
atcaacagttatttattgat

SEQ ID NO: 19627 - DNA, 20 bp, Artificial Sequence
  chemically synthesized
attggtcattgtacattaat

SEQ ID NO: 19628 - DNA, 20 bp, Artificial Sequence
  chemically synthesized
tgttttacatgctgactttg

SEQ ID NO: 19629 - DNA, 20 bp, Artificial Sequence
  chemically synthesized
tacatgctgactttgtagaa

SEQ ID NO: 19630 - DNA, 20 bp, Artificial Sequence
  chemically synthesized
ctgactttgtagaaaagatg

SEQ ID NO: 19631 - DNA, 20 bp, Artificial Sequence
  chemically synthesized
gactttgtagaaaagatgaa

SEQ ID NO: 19632 - DNA, 20 bp, Artificial Sequence
  chemically synthesized
gtagaaaagatgaagagaat

SEQ ID NO: 19633 - DNA, 20 bp, Artificial Sequence
  chemically synthesized
gaagagaatcagtttcaatg

SEQ ID NO: 19634 - DNA, 20 bp, Artificial Sequence
  chemically synthesized
tcaatgaagtgctttgcaca

SEQ ID NO: 19635 - DNA, 20 bp, Artificial Sequence
  chemically synthesized
caatgaagtgctttgcacaa

SEQ ID NO: 19636 - DNA, 20 bp, Artificial Sequence
  chemically synthesized
gctttgcacaaaggataccc

SEQ ID NO: 19637 - DNA, 20 bp, Artificial Sequence
  chemically synthesized
tttgcacaaaggataccctg

SEQ ID NO: 19638 - DNA, 20 bp, Artificial Sequence
  chemically synthesized
catatcattttcttttctaa

SEQ ID NO: 19639 - DNA, 20 bp, Artificial Sequence
  chemically synthesized
ctaacagtttcattaacata

SEQ ID NO: 19640 - DNA, 20 bp, Artificial Sequence
  chemically synthesized
taacagtttcattaacatat

SEQ ID NO: 19641 - DNA, 20 bp, Artificial Sequence
  chemically synthesized
gtttcattaacatataggta

SEQ ID NO: 19642 - DNA, 20 bp, Artificial Sequence
  chemically synthesized
cattaacatataggtaaaga

SEQ ID NO: 19643 - DNA, 20 bp, Artificial Sequence
  chemically synthesized
attaacatataggtaaagac

SEQ ID NO: 19644 - DNA, 20 bp, Artificial Sequence
  chemically synthesized
acaggatatcataattgaca

SEQ ID NO: 19645 - DNA, 20 bp, Artificial Sequence
  chemically synthesized
atatcataattgacatagta

SEQ ID NO: 19646 - DNA, 20 bp, Artificial Sequence
  chemically synthesized
acatagtacagtgtcattaa

SEQ ID NO: 19647 - DNA, 20 bp, Artificial Sequence
  chemically synthesized
catagtacagtgtcattaat

SEQ ID NO: 19648 - DNA, 20 bp, Artificial Sequence
  chemically synthesized
agtgtcattaataggttaat

SEQ ID NO: 19649 - DNA, 20 bp, Artificial Sequence
  chemically synthesized
gtgtcattaataggttaatc

SEQ ID NO: 19650 - DNA, 20 bp, Artificial Sequence
  chemically synthesized
aataggttaatcaggtcatg

SEQ ID NO: 19651 - DNA, 20 bp, Artificial Sequence
  chemically synthesized
gttaatcaggtcatgtggta

SEQ ID NO: 19652 - DNA, 20 bp, Artificial Sequence
  chemically synthesized
aatcaggtcatgtggtaaag

SEQ ID NO: 19653 - DNA, 20 bp, Artificial Sequence
  chemically synthesized
atcaggtcatgtggtaaagt

SEQ ID NO: 19654 - DNA, 20 bp, Artificial Sequence
  chemically synthesized
aggtcatgtggtaaagtggg

SEQ ID NO: 19655 - DNA, 20 bp, Artificial Sequence
  chemically synthesized
ggtcatgtggtaaagtggga

SEQ ID NO: 19656 - DNA, 20 bp, Artificial Sequence
  chemically synthesized
gtaaagtgggaaggctgaat

SEQ ID NO: 19657 - DNA, 20 bp, Artificial Sequence
  chemically synthesized
taaagtgggaaggctgaata

SEQ ID NO: 19658 - DNA, 20 bp, Artificial Sequence
  chemically synthesized
taaggatattattttgtttt

SEQ ID NO: 19659 - DNA, 20 bp, Artificial Sequence
  chemically synthesized
aggatattattttgttttta

SEQ ID NO: 19660 - DNA, 20 bp, Artificial Sequence
  chemically synthesized
ttttgtttttagagaattta

SEQ ID NO: 19661 - DNA, 20 bp, Artificial Sequence
  chemically synthesized
tttgtttttagagaatttaa

SEQ ID NO: 19662 - DNA, 20 bp, Artificial Sequence
  chemically synthesized
gtttttagagaatttaaagg

SEQ ID NO: 19663 - DNA, 20 bp, Artificial Sequence
  chemically synthesized
cctccttattaaaaatatga

SEQ ID NO: 19664 - DNA, 20 bp, Artificial Sequence
  chemically synthesized
ccttattaaaaatatgacag

SEQ ID NO: 19665 - DNA, 20 bp, Artificial Sequence
  chemically synthesized
ttattaaaaatatgacagaa

SEQ ID NO: 19666 - DNA, 20 bp, Artificial Sequence
  chemically synthesized
aaaatatgacagaagagtga

SEQ ID NO: 19667 - DNA, 20 bp, Artificial Sequence
  chemically synthesized
tatgacagaagagtgatagc

SEQ ID NO: 19668 - DNA, 20 bp, Artificial Sequence
  chemically synthesized
cagaagagtgatagctggtt

SEQ ID NO: 19669 - DNA, 20 bp, Artificial Sequence
  chemically synthesized
atagctggtttggtttaatg

SEQ ID NO: 19670 - DNA, 20 bp, Artificial Sequence
  chemically synthesized
ggtttggtttaatgaagtat

SEQ ID NO: 19671 - DNA, 20 bp, Artificial Sequence
  chemically synthesized
gaagtattggcttgtgccct

SEQ ID NO: 19672 - DNA, 20 bp, Artificial Sequence
  chemically synthesized
gtattggcttgtgccctcag

SEQ ID NO: 19673 - DNA, 20 bp, Artificial Sequence
  chemically synthesized
tattggcttgtgccctcaga

SEQ ID NO: 19674 - DNA, 20 bp, Artificial Sequence
  chemically synthesized
attggcttgtgccctcagaa

SEQ ID NO: 19675 - DNA, 20 bp, Artificial Sequence
  chemically synthesized
ctgtgtatcttttatcatga

SEQ ID NO: 19676 - DNA, 20 bp, Artificial Sequence
  chemically synthesized
tatcatgaaagttgatattt

SEQ ID NO: 19677 - DNA, 20 bp, Artificial Sequence
  chemically synthesized
tcatgaaagttgatatttca

SEQ ID NO: 19678 - DNA, 20 bp, Artificial Sequence
  chemically synthesized
atttcagagcactaataact

SEQ ID NO: 19679 - DNA, 20 bp, Artificial Sequence
  chemically synthesized
cttagtttccttctatgtaa

SEQ ID NO: 19680 - DNA, 20 bp, Artificial Sequence
  chemically synthesized
ccttctatgtaaaagatgaa

SEQ ID NO: 19681 - DNA, 20 bp, Artificial Sequence
  chemically synthesized
gtctcaatgaaataaaatgc

SEQ ID NO: 19682 - DNA, 20 bp, Artificial Sequence
  chemically synthesized
tcaatgaaataaaatgctag

SEQ ID NO: 19683 - DNA, 20 bp, Artificial Sequence
  chemically synthesized
aaataaaatgctagtggatt

SEQ ID NO: 19684 - DNA, 20 bp, Artificial Sequence
  chemically synthesized
gtggattcagatcaccctct

SEQ ID NO: 19685 - DNA, 20 bp, Artificial Sequence
  chemically synthesized
attttctttaaacaaccatg

SEQ ID NO: 19686 - DNA, 20 bp, Artificial Sequence
  chemically synthesized
ttttctttaaacaaccatga

SEQ ID NO: 19687 - DNA, 20 bp, Artificial Sequence
  chemically synthesized
taaacaaccatgaaggcacc

SEQ ID NO: 19688 - DNA, 20 bp, Artificial Sequence
  chemically synthesized
aaccatgaaggcaccaagaa

SEQ ID NO: 19689 - DNA, 20 bp, Artificial Sequence
  chemically synthesized
ccatgaaggcaccaagaaca

SEQ ID NO: 19690 - DNA, 20 bp, Artificial Sequence
  chemically synthesized
agagaattcaacgtctaaac

SEQ ID NO: 19691 - DNA, 20 bp, Artificial Sequence
  chemically synthesized
ttcaacgtctaaaccagttt

SEQ ID NO: 19692 - DNA, 20 bp, Artificial Sequence
  chemically synthesized
tcaacgtctaaaccagttta

SEQ ID NO: 19693 - DNA, 20 bp, Artificial Sequence
  chemically synthesized
aaacatatttcccaataatt

SEQ ID NO: 19694 - DNA, 20 bp, Artificial Sequence
  chemically synthesized
aacatatttcccaataattt

SEQ ID NO: 19695 - DNA, 20 bp, Artificial Sequence
  chemically synthesized
aatttgggcttctttcatct

SEQ ID NO: 19696 - DNA, 20 bp, Artificial Sequence
  chemically synthesized
gaaacaacactgcttatcca

SEQ ID NO: 19697 - DNA, 20 bp, Artificial Sequence
  chemically synthesized
caacactgcttatccaaagt

SEQ ID NO: 19698 - DNA, 20 bp, Artificial Sequence
  chemically synthesized
agcacctccttatacctatt

SEQ ID NO: 19699 - DNA, 20 bp, Artificial Sequence
  chemically synthesized
cctccttatacctattcagt

SEQ ID NO: 19700 - DNA, 20 bp, Artificial Sequence
  chemically synthesized
ctccttatacctattcagtg

SEQ ID NO: 19701 - DNA, 20 bp, Artificial Sequence
  chemically synthesized
tcaacccaccatatacacaa

SEQ ID NO: 19702 - DNA, 20 bp, Artificial Sequence
  chemically synthesized
caacccaccatatacacaaa

SEQ ID NO: 19703 - DNA, 20 bp, Artificial Sequence
  chemically synthesized
catatacacaaaaggcatgc

SEQ ID NO: 19704 - DNA, 20 bp, Artificial Sequence
  chemically synthesized
ccagtgatgctgctccatca

SEQ ID NO: 19705 - DNA, 20 bp, Artificial Sequence
  chemically synthesized
ttccttatttctcacacatg

SEQ ID NO: 19706 - DNA, 20 bp, Artificial Sequence
  chemically synthesized
cttatttctcacacatgtgg

SEQ ID NO: 19707 - DNA, 20 bp, Artificial Sequence
  chemically synthesized
ttatttctcacacatgtggc

SEQ ID NO: 19708 - DNA, 20 bp, Artificial Sequence
  chemically synthesized
tgtggcaggtaattaaacta

SEQ ID NO: 19709 - DNA, 20 bp, Artificial Sequence
  chemically synthesized
ggtaattaaactatggcttg

SEQ ID NO: 19710 - DNA, 20 bp, Artificial Sequence
  chemically synthesized
taaactatggcttgaagtcc

SEQ ID NO: 19711 - DNA, 20 bp, Artificial Sequence
  chemically synthesized
atggcttgaagtcctggcct

SEQ ID NO: 19712 - DNA, 20 bp, Artificial Sequence
  chemically synthesized
cttgaagtcctggccttggc

SEQ ID NO: 19713 - DNA, 20 bp, Artificial Sequence
  chemically synthesized
tggccttggccagttaaact

SEQ ID NO: 19714 - DNA, 20 bp, Artificial Sequence
  chemically synthesized
gccttggccagttaaactaa

SEQ ID NO: 19715 - DNA, 20 bp, Artificial Sequence
  chemically synthesized
tcaaatgtatcactgtaaaa

SEQ ID NO: 19716 - DNA, 20 bp, Artificial Sequence
  chemically synthesized
atgtatcactgtaaaacaga

SEQ ID NO: 19717 - DNA, 20 bp, Artificial Sequence
  chemically synthesized
gatagcctatcctcaaaatt

SEQ ID NO: 19718 - DNA, 20 bp, Artificial Sequence
  chemically synthesized
tatcctcaaaatttagatat

SEQ ID NO: 19719 - DNA, 20 bp, Artificial Sequence
  chemically synthesized
ctcaaaatttagatatcaga

SEQ ID NO: 19720 - DNA, 20 bp, Artificial Sequence
  chemically synthesized
tcaaaatttagatatcagat

SEQ ID NO: 19721 - DNA, 20 bp, Artificial Sequence
  chemically synthesized
caaaatttagatatcagatg

SEQ ID NO: 19722 - DNA, 20 bp, Artificial Sequence
  chemically synthesized
cagatggggatataatatcg

SEQ ID NO: 19723 - DNA, 20 bp, Artificial Sequence
  chemically synthesized
gcagtaacttgtgattacca

SEQ ID NO: 19724 - DNA, 20 bp, Artificial Sequence
  chemically synthesized
cagcaacttgtgatgtccca

SEQ ID NO: 19725 - DNA, 20 bp, Artificial Sequence
  chemically synthesized
cccacagcttctgttctaca

SEQ ID NO: 19726 - DNA, 20 bp, Artificial Sequence
  chemically synthesized
cagcttctgttctacaaaga

SEQ ID NO: 19727 - DNA, 20 bp, Artificial Sequence
  chemically synthesized
agcttctgttctacaaagat

SEQ ID NO: 19728 - DNA, 20 bp, Artificial Sequence
  chemically synthesized
ttctacaaagatgggaaaca

SEQ ID NO: 19729 - DNA, 20 bp, Artificial Sequence
  chemically synthesized
tctacaaagatgggaaacaa

SEQ ID NO: 19730 - DNA, 20 bp, Artificial Sequence
  chemically synthesized
acaaagatgggaaacaaagg

SEQ ID NO: 19731 - DNA, 20 bp, Artificial Sequence
  chemically synthesized
caaagatgggaaacaaaggc

SEQ ID NO: 19732 - DNA, 20 bp, Artificial Sequence
  chemically synthesized
aaacaaaggcaggctttcct

SEQ ID NO: 19733 - DNA, 20 bp, Artificial Sequence
  chemically synthesized
ggcaggctttcctcagctac

SEQ ID NO: 19734 - DNA, 20 bp, Artificial Sequence
  chemically synthesized
caggctttcctcagctacaa

SEQ ID NO: 19735 - DNA, 20 bp, Artificial Sequence
  chemically synthesized
aggctttcctcagctacaag

SEQ ID NO: 19736 - DNA, 20 bp, Artificial Sequence
  chemically synthesized
gctacaagaggttctgcatc

SEQ ID NO: 19737 - DNA, 20 bp, Artificial Sequence
  chemically synthesized
caagaggttctgcatcaaga

SEQ ID NO: 19738 - DNA, 20 bp, Artificial Sequence
  chemically synthesized
ctgcatcaagatagcaaatc

SEQ ID NO: 19739 - DNA, 20 bp, Artificial Sequence
  chemically synthesized
atcaagatagcaaatcaaga

SEQ ID NO: 19740 - DNA, 20 bp, Artificial Sequence
  chemically synthesized
tcaagatagcaaatcaagat

SEQ ID NO: 19741 - DNA, 20 bp, Artificial Sequence
  chemically synthesized
agatgggaattatccgaaat

SEQ ID NO: 19742 - DNA, 20 bp, Artificial Sequence
  chemically synthesized
cgaaatgagatttttccatt

SEQ ID NO: 19743 - DNA, 20 bp, Artificial Sequence
  chemically synthesized
gatttttccattaagatgcc

SEQ ID NO: 19744 - DNA, 20 bp, Artificial Sequence
  chemically synthesized
taagatgcctagatgtatta

SEQ ID NO: 19745 - DNA, 20 bp, Artificial Sequence
  chemically synthesized
tagatgtattatagacctca

SEQ ID NO: 19746 - DNA, 20 bp, Artificial Sequence
  chemically synthesized
tagacctcatggtcacatat

SEQ ID NO: 19747 - DNA, 20 bp, Artificial Sequence
  chemically synthesized
agacctcatggtcacatata

SEQ ID NO: 19748 - DNA, 20 bp, Artificial Sequence
  chemically synthesized
tcatggtcacatataaggaa

SEQ ID NO: 19749 - DNA, 20 bp, Artificial Sequence
  chemically synthesized
atggtcacatataaggaaca

SEQ ID NO: 19750 - DNA, 20 bp, Artificial Sequence
  chemically synthesized
tcacatataaggaacagaga

SEQ ID NO: 19751 - DNA, 20 bp, Artificial Sequence
  chemically synthesized
taaggaacagagaaagtctt

SEQ ID NO: 19752 - DNA, 20 bp, Artificial Sequence
  chemically synthesized
ggaacagagaaagtctttgg

SEQ ID NO: 19753 - DNA, 20 bp, Artificial Sequence
  chemically synthesized
tttggtagataactgacttt

SEQ ID NO: 19754 - DNA, 20 bp, Artificial Sequence
  chemically synthesized
ttggtagataactgactttt

SEQ ID NO: 19755 - DNA, 20 bp, Artificial Sequence
  chemically synthesized
ataactgacttttaggattt

SEQ ID NO: 19756 - DNA, 20 bp, Artificial Sequence
  chemically synthesized
ttaggatttgagtttatatt

SEQ ID NO: 19757 - DNA, 20 bp, Artificial Sequence
  chemically synthesized
taacttgaacattatactct

SEQ ID NO: 19758 - DNA, 20 bp, Artificial Sequence
  chemically synthesized
ttgaacattatactctgaga

SEQ ID NO: 19759 - DNA, 20 bp, Artificial Sequence
  chemically synthesized
tgaacattatactctgagat

SEQ ID NO: 19760 - DNA, 20 bp, Artificial Sequence
  chemically synthesized
ttttccccttttgaaatttg

SEQ ID NO: 19761 - DNA, 20 bp, Artificial Sequence
  chemically synthesized
atcctgtttcacaattaaat

SEQ ID NO: 19762 - DNA, 20 bp, Artificial Sequence
  chemically synthesized
tcacaattaaatcagtctaa

SEQ ID NO: 19763 - DNA, 20 bp, Artificial Sequence
  chemically synthesized
caattaaatcagtctaaaag

SEQ ID NO: 19764 - DNA, 20 bp, Artificial Sequence
  chemically synthesized
atcagtctaaaagaagcttt

SEQ ID NO: 19765 - DNA, 20 bp, Artificial Sequence
  chemically synthesized
taaaagaagcttttagtaca

SEQ ID NO: 19766 - DNA, 20 bp, Artificial Sequence
  chemically synthesized
ctcctcccaccacaattttt

SEQ ID NO: 19767 - DNA, 20 bp, Artificial Sequence
  chemically synthesized
caccacaattttttagtcat

SEQ ID NO: 19768 - DNA, 20 bp, Artificial Sequence
  chemically synthesized
tccatttctctcaacattgt

SEQ ID NO: 19769 - DNA, 20 bp, Artificial Sequence
  chemically synthesized
cattgttggtcttcctaata

SEQ ID NO: 19770 - DNA, 20 bp, Artificial Sequence
  chemically synthesized
ttgttggtcttcctaatata

SEQ ID NO: 19771 - DNA, 20 bp, Artificial Sequence
  chemically synthesized
gttggtcttcctaatataga

SEQ ID NO: 19772 - DNA, 20 bp, Artificial Sequence
  chemically synthesized
ttcctaatatagagagttta

SEQ ID NO: 19773 - DNA, 20 bp, Artificial Sequence
  chemically synthesized
ctaatatagagagtttacag

SEQ ID NO: 19774 - DNA, 20 bp, Artificial Sequence
  chemically synthesized
agagagtttacagtagatgt

SEQ ID NO: 19775 - DNA, 20 bp, Artificial Sequence
  chemically synthesized
agagtttacagtagatgtca

SEQ ID NO: 19776 - DNA, 20 bp, Artificial Sequence
  chemically synthesized
tttacagtagatgtcagaga

SEQ ID NO: 19777 - DNA, 20 bp, Artificial Sequence
  chemically synthesized
gatgtcagagaaagtattta

SEQ ID NO: 19778 - DNA, 20 bp, Artificial Sequence
  chemically synthesized
agagaaagtatttatggcaa

SEQ ID NO: 19779 - DNA, 20 bp, Artificial Sequence
  chemically synthesized
tttccctctgaacatatata

SEQ ID NO: 19780 - DNA, 20 bp, Artificial Sequence
  chemically synthesized
taaagtatatataacttgtg

SEQ ID NO: 19781 - DNA, 20 bp, Artificial Sequence
  chemically synthesized
atgtctcatatttttcattc

SEQ ID NO: 19782 - DNA, 20 bp, Artificial Sequence
  chemically synthesized
tcatatttttcattctagaa

SEQ ID NO: 19783 - DNA, 20 bp, Artificial Sequence
  chemically synthesized
ctatattttctatttttgaa

SEQ ID NO: 19784 - DNA, 20 bp, Artificial Sequence
  chemically synthesized
atattttctatttttgaata

SEQ ID NO: 19785 - DNA, 20 bp, Artificial Sequence
  chemically synthesized
gccttgacccttcctattat

SEQ ID NO: 19786 - DNA, 20 bp, Artificial Sequence
  chemically synthesized
ccttgacccttcctattatt

SEQ ID NO: 19787 - DNA, 20 bp, Artificial Sequence
  chemically synthesized
acccttcctattattaggcc

SEQ ID NO: 19788 - DNA, 20 bp, Artificial Sequence
  chemically synthesized
cccttcctattattaggcca

SEQ ID NO: 19789 - DNA, 20 bp, Artificial Sequence
  chemically synthesized
ccttcctattattaggccaa

SEQ ID NO: 19790 - DNA, 20 bp, Artificial Sequence
  chemically synthesized
ctattattaggccaagggaa

SEQ ID NO: 19791 - DNA, 20 bp, Artificial Sequence
  chemically synthesized
aagtatgttaaaatcatctg

SEQ ID NO: 19792 - DNA, 20 bp, Artificial Sequence
  chemically synthesized
gtatgttaaaatcatctgaa

SEQ ID NO: 19793 - DNA, 20 bp, Artificial Sequence
  chemically synthesized
ctcactttttacttttttac

SEQ ID NO: 19794 - DNA, 20 bp, Artificial Sequence
  chemically synthesized
ttacttttttacgagctgac

SEQ ID NO: 19795 - DNA, 20 bp, Artificial Sequence
  chemically synthesized
cttttttacgagctgacaag

SEQ ID NO: 19796 - DNA, 20 bp, Artificial Sequence
  chemically synthesized
gagctgacaagaagcttgtc

SEQ ID NO: 19797 - DNA, 20 bp, Artificial Sequence
  chemically synthesized
agctgacaagaagcttgtct

SEQ ID NO: 19798 - DNA, 20 bp, Artificial Sequence
  chemically synthesized
ttgtctaggtttttccttct

SEQ ID NO: 19799 - DNA, 20 bp, Artificial Sequence
  chemically synthesized
ttttccttctaagatttttt

SEQ ID NO: 19800 - DNA, 20 bp, Artificial Sequence
  chemically synthesized
tttccttctaagattttttt

SEQ ID NO: 19801 - DNA, 20 bp, Artificial Sequence
  chemically synthesized
tctaagatttttttgggcaa

SEQ ID NO: 19802 - DNA, 20 bp, Artificial Sequence
  chemically synthesized
tttgggcaaaagaatattta

SEQ ID NO: 19803 - DNA, 20 bp, Artificial Sequence
  chemically synthesized
gggcaaaagaatatttatag

SEQ ID NO: 19804 - DNA, 20 bp, Artificial Sequence
  chemically synthesized
aagaatatttatagaagaat

SEQ ID NO: 19805 - DNA, 20 bp, Artificial Sequence
  chemically synthesized
agaatatttatagaagaatg

SEQ ID NO: 19806 - DNA, 20 bp, Artificial Sequence
  chemically synthesized
atttatagaagaatgaggta

SEQ ID NO: 19807 - DNA, 20 bp, Artificial Sequence
  chemically synthesized
aaatacacttttataaaatc

SEQ ID NO: 19808 - DNA, 20 bp, Artificial Sequence
  chemically synthesized
ataaaatccagacatcctgc

SEQ ID NO: 19809 - DNA, 20 bp, Artificial Sequence
  chemically synthesized
taaaatccagacatcctgca

SEQ ID NO: 19810 - DNA, 20 bp, Artificial Sequence
  chemically synthesized
ggaatgtattgaaaattaaa

SEQ ID NO: 19811 - DNA, 20 bp, Artificial Sequence
  chemically synthesized
ctcttattgaaatactctgt

SEQ ID NO: 19812 - DNA, 20 bp, Artificial Sequence
  chemically synthesized
aagtgacttacgactgtatt

SEQ ID NO: 19813 - DNA, 20 bp, Artificial Sequence
  chemically synthesized
aaaatattaaatgcaaatca

SEQ ID NO: 19814 - DNA, 20 bp, Artificial Sequence
  chemically synthesized
ttaaatgcaaatcatggccc

SEQ ID NO: 19815 - DNA, 20 bp, Artificial Sequence
  chemically synthesized
aaatgcaaatcatggcccta

SEQ ID NO: 19816 - DNA, 20 bp, Artificial Sequence
  chemically synthesized
atgcaaatcatggccctaga

SEQ ID NO: 19817 - DNA, 20 bp, Artificial Sequence
  chemically synthesized
ccctagagagtaccctaact

SEQ ID NO: 19818 - DNA, 20 bp, Artificial Sequence
  chemically synthesized
cctagagagtaccctaactc

SEQ ID NO: 19819 - DNA, 20 bp, Artificial Sequence
  chemically synthesized
ctagagagtaccctaactca

SEQ ID NO: 19820 - DNA, 20 bp, Artificial Sequence
  chemically synthesized
gagagtaccctaactcaggg

SEQ ID NO: 19821 - DNA, 20 bp, Artificial Sequence
  chemically synthesized
gagtaccctaactcagggta

SEQ ID NO: 19822 - DNA, 20 bp, Artificial Sequence
  chemically synthesized
agtaccctaactcagggtag

SEQ ID NO: 19823 - DNA, 20 bp, Artificial Sequence
  chemically synthesized
ccctaactcagggtagagga

SEQ ID NO: 19824 - DNA, 20 bp, Artificial Sequence
  chemically synthesized
tcagggtagaggacagttaa

SEQ ID NO: 19825 - DNA, 20 bp, Artificial Sequence
  chemically synthesized
accaacacttacttatttaa

SEQ ID NO: 19826 - DNA, 20 bp, Artificial Sequence
  chemically synthesized
taaaagtaaatttaaaatgt

SEQ ID NO: 19827 - DNA, 20 bp, Artificial Sequence
  chemically synthesized
cttatcactatatttgccat

SEQ ID NO: 19828 - DNA, 20 bp, Artificial Sequence
  chemically synthesized
gaataatgaaaattttaaat

SEQ ID NO: 19829 - DNA, 20 bp, Artificial Sequence
  chemically synthesized
tttaaataagaatttatttc

SEQ ID NO: 19830 - DNA, 20 bp, Artificial Sequence
  chemically synthesized
taaataagaatttatttcta

SEQ ID NO: 19831 - DNA, 20 bp, Artificial Sequence
  chemically synthesized
ttttttacacttgtgtgcat

SEQ ID NO: 19832 - DNA, 20 bp, Artificial Sequence
  chemically synthesized
tatgcacaaatgtgcacact

SEQ ID NO: 19833 - DNA, 20 bp, Artificial Sequence
  chemically synthesized
atgcacaaatgtgcacactg

SEQ ID NO: 19834 - DNA, 20 bp, Artificial Sequence
  chemically synthesized
aaatgtgcacactgaggcaa

SEQ ID NO: 19835 - DNA, 20 bp, Artificial Sequence
  chemically synthesized
actgaggcaaaagtttttca

SEQ ID NO: 19836 - DNA, 20 bp, Artificial Sequence
  chemically synthesized
tgaggcaaaagtttttcata

SEQ ID NO: 19837 - DNA, 20 bp, Artificial Sequence
  chemically synthesized
ccttttcctcaaatttcact

SEQ ID NO: 19838 - DNA, 20 bp, Artificial Sequence
  chemically synthesized
cttttcctcaaatttcactg

SEQ ID NO: 19839 - DNA, 20 bp, Artificial Sequence
  chemically synthesized
ttcctcaaatttcactgagg

SEQ ID NO: 19840 - DNA, 20 bp, Artificial Sequence
  chemically synthesized
ttcactgaggtggctaattt

SEQ ID NO: 19841 - DNA, 20 bp, Artificial Sequence
  chemically synthesized
tcactgaggtggctaatttc

SEQ ID NO: 19842 - DNA, 20 bp, Artificial Sequence
  chemically synthesized
ctaatttcaggtgcatttga

SEQ ID NO: 19843 - DNA, 20 bp, Artificial Sequence
  chemically synthesized
atttcaggtgcatttgaaag

SEQ ID NO: 19844 - DNA, 20 bp, Artificial Sequence
  chemically synthesized
ttgaaagaagaatttaaata

SEQ ID NO: 19845 - DNA, 20 bp, Artificial Sequence
  chemically synthesized
aatttaaatatagacttttt

SEQ ID NO: 19846 - DNA, 20 bp, Artificial Sequence
  chemically synthesized
tagactttttcagttccata

SEQ ID NO: 19847 - DNA, 20 bp, Artificial Sequence
  chemically synthesized
tcagttccatatggtctatt

SEQ ID NO: 19848 - DNA, 20 bp, Artificial Sequence
  chemically synthesized
tctattcagtgttctgtcac

SEQ ID NO: 19849 - DNA, 20 bp, Artificial Sequence
  chemically synthesized
tctgtcaccagacttctcct

SEQ ID NO: 19850 - DNA, 20 bp, Artificial Sequence
  chemically synthesized
aagatatgcccccaacccta

SEQ ID NO: 19851 - DNA, 20 bp, Artificial Sequence
  chemically synthesized
atgcccccaaccctatggta

SEQ ID NO: 19852 - DNA, 20 bp, Artificial Sequence
  chemically synthesized
aaccctatggtaaagtactt

SEQ ID NO: 19853 - DNA, 20 bp, Artificial Sequence
  chemically synthesized
taaagtacttaagtccttgt

SEQ ID NO: 19854 - DNA, 20 bp, Artificial Sequence
  chemically synthesized
tgagtgacaacattgtcttc

SEQ ID NO: 19855 - DNA, 20 bp, Artificial Sequence
  chemically synthesized
gtatacccttgctctttgct

SEQ ID NO: 19856 - DNA, 20 bp, Artificial Sequence
  chemically synthesized
acccttgctctttgctaaga

SEQ ID NO: 19857 - DNA, 20 bp, Artificial Sequence
  chemically synthesized
tctttgctaagaaagaactc

SEQ ID NO: 19858 - DNA, 20 bp, Artificial Sequence
  chemically synthesized
ctttgctaagaaagaactcc

SEQ ID NO: 19859 - DNA, 20 bp, Artificial Sequence
  chemically synthesized
caggctttcatttttcattc

SEQ ID NO: 19860 - DNA, 20 bp, Artificial Sequence
  chemically synthesized
tatgtctgtgtctgattctc

SEQ ID NO: 19861 - DNA, 20 bp, Artificial Sequence
  chemically synthesized
gtgtctgattctccagatcc

SEQ ID NO: 19862 - DNA, 20 bp, Artificial Sequence
  chemically synthesized
ttaactactaaacctatgtt

SEQ ID NO: 19863 - DNA, 20 bp, Artificial Sequence
  chemically synthesized
ctaaacctatgtttagataa

SEQ ID NO: 19864 - DNA, 20 bp, Artificial Sequence
  chemically synthesized
taaacctatgtttagataaa

SEQ ID NO: 19865 - DNA, 20 bp, Artificial Sequence
  chemically synthesized
acctatgtttagataaaagg

SEQ ID NO: 19866 - DNA, 20 bp, Artificial Sequence
  chemically synthesized
aatgccatattgtatttgct

SEQ ID NO: 19867 - DNA, 20 bp, Artificial Sequence
  chemically synthesized
tttgcttggttttgatgctg

SEQ ID NO: 19868 - DNA, 20 bp, Artificial Sequence
  chemically synthesized
ggttttgatgctgtagatga

SEQ ID NO: 19869 - DNA, 20 bp, Artificial Sequence
  chemically synthesized
gttttgatgctgtagatgac

SEQ ID NO: 19870 - DNA, 20 bp, Artificial Sequence
  chemically synthesized
ttttgatgctgtagatgaca

SEQ ID NO: 19871 - DNA, 20 bp, Artificial Sequence
  chemically synthesized
gtagatgacagggttcatta

SEQ ID NO: 19872 - DNA, 20 bp, Artificial Sequence
  chemically synthesized
tagatgacagggttcattaa

SEQ ID NO: 19873 - DNA, 20 bp, Artificial Sequence
  chemically synthesized
gatgacagggttcattaaag

SEQ ID NO: 19874 - DNA, 20 bp, Artificial Sequence
  chemically synthesized
atgacagggttcattaaagg

SEQ ID NO: 19875 - DNA, 20 bp, Artificial Sequence
  chemically synthesized
cagggttcattaaaggagga

SEQ ID NO: 19876 - DNA, 20 bp, Artificial Sequence
  chemically synthesized
gggttcattaaaggaggaaa

SEQ ID NO: 19877 - DNA, 20 bp, Artificial Sequence
  chemically synthesized
ggttcattaaaggaggaaag

SEQ ID NO: 19878 - DNA, 20 bp, Artificial Sequence
  chemically synthesized
tcattaaaggaggaaagagg

SEQ ID NO: 19879 - DNA, 20 bp, Artificial Sequence
  chemically synthesized
ttaaaggaggaaagaggaag

SEQ ID NO: 19880 - DNA, 20 bp, Artificial Sequence
  chemically synthesized
agatgtaactcatgataatg

SEQ ID NO: 19881 - DNA, 20 bp, Artificial Sequence
  chemically synthesized
atgataatgtggacaacctc

SEQ ID NO: 19882 - DNA, 20 bp, Artificial Sequence
  chemically synthesized
tcaaacccatcactgtaaca

SEQ ID NO: 19883 - DNA, 20 bp, Artificial Sequence
  chemically synthesized
aacccatcactgtaacatag

SEQ ID NO: 19884 - DNA, 20 bp, Artificial Sequence
  chemically synthesized
atcactgtaacatagaagat

SEQ ID NO: 19885 - DNA, 20 bp, Artificial Sequence
  chemically synthesized
agataagaacacaactaatg

SEQ ID NO: 19886 - DNA, 20 bp, Artificial Sequence
  chemically synthesized
gataagaacacaactaatgt

SEQ ID NO: 19887 - DNA, 20 bp, Artificial Sequence
  chemically synthesized
taagaacacaactaatgtgg

SEQ ID NO: 19888 - DNA, 20 bp, Artificial Sequence
  chemically synthesized
cacaactaatgtgggagata

SEQ ID NO: 19889 - DNA, 20 bp, Artificial Sequence
  chemically synthesized
acaactaatgtgggagatac

SEQ ID NO: 19890 - DNA, 20 bp, Artificial Sequence
  chemically synthesized
atgtgggagatacaggtatt

SEQ ID NO: 19891 - DNA, 20 bp, Artificial Sequence
  chemically synthesized
tgtgggagatacaggtattg

SEQ ID NO: 19892 - DNA, 20 bp, Artificial Sequence
  chemically synthesized
gtgggagatacaggtattga

SEQ ID NO: 19893 - DNA, 20 bp, Artificial Sequence
  chemically synthesized
gatacaggtattgagggctt

SEQ ID NO: 19894 - DNA, 20 bp, Artificial Sequence
  chemically synthesized
ggctttggctctctcttcac

SEQ ID NO: 19895 - DNA, 20 bp, Artificial Sequence
  chemically synthesized
tttggctctctcttcaccag

SEQ ID NO: 19896 - DNA, 20 bp, Artificial Sequence
  chemically synthesized
accagaagcaatgcctatga

SEQ ID NO: 19897 - DNA, 20 bp, Artificial Sequence
  chemically synthesized
gcaatgcctatgacagtatt

SEQ ID NO: 19898 - DNA, 20 bp, Artificial Sequence
  chemically synthesized
cctatgacagtattaagaat

SEQ ID NO: 19899 - DNA, 20 bp, Artificial Sequence
  chemically synthesized
cagtattaagaattagaata

SEQ ID NO: 19900 - DNA, 20 bp, Artificial Sequence
  chemically synthesized
agtattaagaattagaatat

SEQ ID NO: 19901 - DNA, 20 bp, Artificial Sequence
  chemically synthesized
tattaagaattagaatatag

SEQ ID NO: 19902 - DNA, 20 bp, Artificial Sequence
  chemically synthesized
taagaattagaatataggag

SEQ ID NO: 19903 - DNA, 20 bp, Artificial Sequence
  chemically synthesized
agaattagaatataggagaa

SEQ ID NO: 19904 - DNA, 20 bp, Artificial Sequence
  chemically synthesized
gaattagaatataggagaag

SEQ ID NO: 19905 - DNA, 20 bp, Artificial Sequence
  chemically synthesized
atataggagaagaggatgat

SEQ ID NO: 19906 - DNA, 20 bp, Artificial Sequence
  chemically synthesized
aggagaagaggatgatcaga

SEQ ID NO: 19907 - DNA, 20 bp, Artificial Sequence
  chemically synthesized
aagaggatgatcagacagtc

SEQ ID NO: 19908 - DNA, 20 bp, Artificial Sequence
  chemically synthesized
agaggatgatcagacagtct

SEQ ID NO: 19909 - DNA, 20 bp, Artificial Sequence
  chemically synthesized
ggatgatcagacagtctagg

SEQ ID NO: 19910 - DNA, 20 bp, Artificial Sequence
  chemically synthesized
acagtctaggaagattgtta

SEQ ID NO: 19911 - DNA, 20 bp, Artificial Sequence
  chemically synthesized
agtctaggaagattgttaaa

SEQ ID NO: 19912 - DNA, 20 bp, Artificial Sequence
  chemically synthesized
tgttaaagagatcaaaatta

SEQ ID NO: 19913 - DNA, 20 bp, Artificial Sequence
  chemically synthesized
gttaaagagatcaaaattac

SEQ ID NO: 19914 - DNA, 20 bp, Artificial Sequence
  chemically synthesized
ttaaagagatcaaaattaca

SEQ ID NO: 19915 - DNA, 20 bp, Artificial Sequence
  chemically synthesized
gagatcaaaattacagggta

SEQ ID NO: 19916 - DNA, 20 bp, Artificial Sequence
  chemically synthesized
tacagggtaaagtctattga

SEQ ID NO: 19917 - DNA, 20 bp, Artificial Sequence
  chemically synthesized
aagtctattgaaagttatgt

SEQ ID NO: 19918 - DNA, 20 bp, Artificial Sequence
  chemically synthesized
attgaaagttatgtcagcac

SEQ ID NO: 19919 - DNA, 20 bp, Artificial Sequence
  chemically synthesized
aaagttatgtcagcacaagc

SEQ ID NO: 19920 - DNA, 20 bp, Artificial Sequence
  chemically synthesized
aagccagtctcatgatttct

SEQ ID NO: 19921 - DNA, 20 bp, Artificial Sequence
  chemically synthesized
ccagtctcatgatttcttgg

SEQ ID NO: 19922 - DNA, 20 bp, Artificial Sequence
  chemically synthesized
agtctcatgatttcttggtg

SEQ ID NO: 19923 - DNA, 20 bp, Artificial Sequence
  chemically synthesized
gtctcatgatttcttggtgg

SEQ ID NO: 19924 - DNA, 20 bp, Artificial Sequence
  chemically synthesized
tcatgatttcttggtggagg

SEQ ID NO: 19925 - DNA, 20 bp, Artificial Sequence
  chemically synthesized
gatttcttggtggaggcaga

SEQ ID NO: 19926 - DNA, 20 bp, Artificial Sequence
  chemically synthesized
gaaagcacgtgtgataacat

SEQ ID NO: 19927 - DNA, 20 bp, Artificial Sequence
  chemically synthesized
ttgcaatatgaaaatgaaaa

SEQ ID NO: 19928 - DNA, 20 bp, Artificial Sequence
  chemically synthesized
tgaaaaaagacgcaaaatta

SEQ ID NO: 19929 - DNA, 20 bp, Artificial Sequence
  chemically synthesized
gaaaaaagacgcaaaattac

SEQ ID NO: 19930 - DNA, 20 bp, Artificial Sequence
  chemically synthesized
aaaagacgcaaaattacagg

SEQ ID NO: 19931 - DNA, 20 bp, Artificial Sequence
  chemically synthesized
aaagacgcaaaattacaggc

SEQ ID NO: 19932 - DNA, 20 bp, Artificial Sequence
  chemically synthesized
acgcaaaattacaggcagga

SEQ ID NO: 19933 - DNA, 20 bp, Artificial Sequence
  chemically synthesized
aggatggatacaaaacccct

SEQ ID NO: 19934 - DNA, 20 bp, Artificial Sequence
  chemically synthesized
cactcctaacgctatgactc

SEQ ID NO: 19935 - DNA, 20 bp, Artificial Sequence
  chemically synthesized
taacgctatgactctagtat

SEQ ID NO: 19936 - DNA, 20 bp, Artificial Sequence
  chemically synthesized
gctatgactctagtattggt

SEQ ID NO: 19937 - DNA, 20 bp, Artificial Sequence
  chemically synthesized
gactctagtattggtgagaa

SEQ ID NO: 19938 - DNA, 20 bp, Artificial Sequence
  chemically synthesized
tctagtattggtgagaatgg

SEQ ID NO: 19939 - DNA, 20 bp, Artificial Sequence
  chemically synthesized
gagaatggaagcatatctca

SEQ ID NO: 19940 - DNA, 20 bp, Artificial Sequence
  chemically synthesized
agaatggaagcatatctcaa

SEQ ID NO: 19941 - DNA, 20 bp, Artificial Sequence
  chemically synthesized
aagcatatctcaaaggattg

SEQ ID NO: 19942 - DNA, 20 bp, Artificial Sequence
  chemically synthesized
atatctcaaaggattgcgga

SEQ ID NO: 19943 - DNA, 20 bp, Artificial Sequence
  chemically synthesized
aaacaatcatatgccattgc

SEQ ID NO: 19944 - DNA, 20 bp, Artificial Sequence
  chemically synthesized
aacaatcatatgccattgcc

SEQ ID NO: 19945 - DNA, 20 bp, Artificial Sequence
  chemically synthesized
caatcatatgccattgccag

SEQ ID NO: 19946 - DNA, 20 bp, Artificial Sequence
  chemically synthesized
aatcatatgccattgccagg

SEQ ID NO: 19947 - DNA, 20 bp, Artificial Sequence
  chemically synthesized
atcatatgccattgccagga

SEQ ID NO: 19948 - DNA, 20 bp, Artificial Sequence
  chemically synthesized
gagggaacctgattccacaa

SEQ ID NO: 19949 - DNA, 20 bp, Artificial Sequence
  chemically synthesized
gaacctgattccacaacaga

SEQ ID NO: 19950 - DNA, 20 bp, Artificial Sequence
  chemically synthesized
aacctgattccacaacagaa

SEQ ID NO: 19951 - DNA, 20 bp, Artificial Sequence
  chemically synthesized
acctgattccacaacagaaa

SEQ ID NO: 19952 - DNA, 20 bp, Artificial Sequence
  chemically synthesized
ctgattccacaacagaaagg

SEQ ID NO: 19953 - DNA, 20 bp, Artificial Sequence
  chemically synthesized
caacagaaagggagtgaata

SEQ ID NO: 19954 - DNA, 20 bp, Artificial Sequence
  chemically synthesized
agaaagggagtgaataaagt

SEQ ID NO: 19955 - DNA, 20 bp, Artificial Sequence
  chemically synthesized
gagtgaataaagtaagcctg

SEQ ID NO: 19956 - DNA, 20 bp, Artificial Sequence
  chemically synthesized
agtgaataaagtaagcctgt

SEQ ID NO: 19957 - DNA, 20 bp, Artificial Sequence
  chemically synthesized
gaataaagtaagcctgtagg

SEQ ID NO: 19958 - DNA, 20 bp, Artificial Sequence
  chemically synthesized
taaagtaagcctgtaggaag

SEQ ID NO: 19959 - DNA, 20 bp, Artificial Sequence
  chemically synthesized
atctccctgtgattcaccca

SEQ ID NO: 19960 - DNA, 20 bp, Artificial Sequence
  chemically synthesized
tctccctgtgattcacccat

SEQ ID NO: 19961 - DNA, 20 bp, Artificial Sequence
  chemically synthesized
cacccataggatgcccatta

SEQ ID NO: 19962 - DNA, 20 bp, Artificial Sequence
  chemically synthesized
ccataggatgcccattacag

SEQ ID NO: 19963 - DNA, 20 bp, Artificial Sequence
  chemically synthesized
cataggatgcccattacagt

SEQ ID NO: 19964 - DNA, 20 bp, Artificial Sequence
  chemically synthesized
gcccattacagtaggcatcg

SEQ ID NO: 19965 - DNA, 20 bp, Artificial Sequence
  chemically synthesized
atcgtggtcaatgtcaccat

SEQ ID NO: 19966 - DNA, 20 bp, Artificial Sequence
  chemically synthesized
tcgtggtcaatgtcaccatg

SEQ ID NO: 19967 - DNA, 20 bp, Artificial Sequence
  chemically synthesized
accatgaggtctgtgcctgc

SEQ ID NO: 19968 - DNA, 20 bp, Artificial Sequence
  chemically synthesized
gaggtctgtgcctgccagca

SEQ ID NO: 19969 - DNA, 20 bp, Artificial Sequence
  chemically synthesized
tctgtgcctgccagcatggt

SEQ ID NO: 19970 - DNA, 20 bp, Artificial Sequence
  chemically synthesized
ctgtgcctgccagcatggtg

SEQ ID NO: 19971 - DNA, 20 bp, Artificial Sequence
  chemically synthesized
tgcctgccagcatggtgagg

SEQ ID NO: 19972 - DNA, 20 bp, Artificial Sequence
  chemically synthesized
ctgccagcatggtgaggaag

SEQ ID NO: 19973 - DNA, 20 bp, Artificial Sequence
  chemically synthesized
catggtgaggaagtagtaca

SEQ ID NO: 19974 - DNA, 20 bp, Artificial Sequence
  chemically synthesized
atggtgaggaagtagtacat

SEQ ID NO: 19975 - DNA, 20 bp, Artificial Sequence
  chemically synthesized
aagtagtacatgggctcatg

SEQ ID NO: 19976 - DNA, 20 bp, Artificial Sequence
  chemically synthesized
acatgggctcatgaagactg

SEQ ID NO: 19977 - DNA, 20 bp, Artificial Sequence
  chemically synthesized
agactgtggtcatgcttgat

SEQ ID NO: 19978 - DNA, 20 bp, Artificial Sequence
  chemically synthesized
gactgtggtcatgcttgatg

SEQ ID NO: 19979 - DNA, 20 bp, Artificial Sequence
  chemically synthesized
tgtggtcatgcttgatgagg

SEQ ID NO: 19980 - DNA, 20 bp, Artificial Sequence
  chemically synthesized
tggtcatgcttgatgaggta

SEQ ID NO: 19981 - DNA, 20 bp, Artificial Sequence
  chemically synthesized
ggtcatgcttgatgaggtag

SEQ ID NO: 19982 - DNA, 20 bp, Artificial Sequence
  chemically synthesized
tcatgcttgatgaggtagag

SEQ ID NO: 19983 - DNA, 20 bp, Artificial Sequence
  chemically synthesized
tagaggagcatgccattgcc

SEQ ID NO: 19984 - DNA, 20 bp, Artificial Sequence
  chemically synthesized
aggagcatgccattgcccag

SEQ ID NO: 19985 - DNA, 20 bp, Artificial Sequence
  chemically synthesized
ggagcatgccattgcccaga

SEQ ID NO: 19986 - DNA, 20 bp, Artificial Sequence
  chemically synthesized
cagaaggatgcacacataaa

SEQ ID NO: 19987 - DNA, 20 bp, Artificial Sequence
  chemically synthesized
ggatgcacacataaacagca

SEQ ID NO: 19988 - DNA, 20 bp, Artificial Sequence
  chemically synthesized
tgcacacataaacagcaaag

SEQ ID NO: 19989 - DNA, 20 bp, Artificial Sequence
  chemically synthesized
gcacacataaacagcaaaga

SEQ ID NO: 19990 - DNA, 20 bp, Artificial Sequence
  chemically synthesized
cacacataaacagcaaagaa

SEQ ID NO: 19991 - DNA, 20 bp, Artificial Sequence
  chemically synthesized
acacataaacagcaaagaag

SEQ ID NO: 19992 - DNA, 20 bp, Artificial Sequence
  chemically synthesized
ataaacagcaaagaagggga

SEQ ID NO: 19993 - DNA, 20 bp, Artificial Sequence
  chemically synthesized
aaacagcaaagaaggggatg

SEQ ID NO: 19994 - DNA, 20 bp, Artificial Sequence
  chemically synthesized
caaagaaggggatggagatc

SEQ ID NO: 19995 - DNA, 20 bp, Artificial Sequence
  chemically synthesized
ggggatggagatccagtgat

SEQ ID NO: 19996 - DNA, 20 bp, Artificial Sequence
  chemically synthesized
atccagtgatgagctgcctc

SEQ ID NO: 19997 - DNA, 20 bp, Artificial Sequence
  chemically synthesized
tgatgagctgcctccagccc

SEQ ID NO: 19998 - DNA, 20 bp, Artificial Sequence
  chemically synthesized
gagctgcctccagccctgga

SEQ ID NO: 19999 - DNA, 20 bp, Artificial Sequence
  chemically synthesized
tgcctccagccctggaaagc

SEQ ID NO: 20000 - DNA, 20 bp, Artificial Sequence
  chemically synthesized
tccagccctggaaagccagt

SEQ ID NO: 20001 - DNA, 20 bp, Artificial Sequence
  chemically synthesized
tggaaagccagtcagcaaaa

SEQ ID NO: 20002 - DNA, 20 bp, Artificial Sequence
  chemically synthesized
ggaaagccagtcagcaaaaa

SEQ ID NO: 20003 - DNA, 20 bp, Artificial Sequence
  chemically synthesized
gaaagccagtcagcaaaaaa

SEQ ID NO: 20004 - DNA, 20 bp, Artificial Sequence
  chemically synthesized
aaagccagtcagcaaaaaag

SEQ ID NO: 20005 - DNA, 20 bp, Artificial Sequence
  chemically synthesized
agtcagcaaaaaaggggctg

SEQ ID NO: 20006 - DNA, 20 bp, Artificial Sequence
  chemically synthesized
aaaaggggctgcagtaatat

SEQ ID NO: 20007 - DNA, 20 bp, Artificial Sequence
  chemically synthesized
aaaggggctgcagtaatatt

SEQ ID NO: 20008 - DNA, 20 bp, Artificial Sequence
  chemically synthesized
tgcagtaatattgggccaca

SEQ ID NO: 20009 - DNA, 20 bp, Artificial Sequence
  chemically synthesized
gggccacatagtgtatccac

SEQ ID NO: 20010 - DNA, 20 bp, Artificial Sequence
  chemically synthesized
acatagtgtatccaccggta

SEQ ID NO: 20011 - DNA, 20 bp, Artificial Sequence
  chemically synthesized
gtgtatccaccggtaaagat

SEQ ID NO: 20012 - DNA, 20 bp, Artificial Sequence
  chemically synthesized
atttcttgaaaccttgaaac

SEQ ID NO: 20013 - DNA, 20 bp, Artificial Sequence
  chemically synthesized
tttcttgaaaccttgaaacc

SEQ ID NO: 20014 - DNA, 20 bp, Artificial Sequence
  chemically synthesized
tcttgaaaccttgaaaccag

SEQ ID NO: 20015 - DNA, 20 bp, Artificial Sequence
  chemically synthesized
gagcctccaatcttcctgct

SEQ ID NO: 20016 - DNA, 20 bp, Artificial Sequence
  chemically synthesized
gcctccaatcttcctgcttg

SEQ ID NO: 20017 - DNA, 20 bp, Artificial Sequence
  chemically synthesized
cctgcttggagatgattaac

SEQ ID NO: 20018 - DNA, 20 bp, Artificial Sequence
  chemically synthesized
actctgcaactattttcctg

SEQ ID NO: 20019 - DNA, 20 bp, Artificial Sequence
  chemically synthesized
ctgcaactattttcctgaag

SEQ ID NO: 20020 - DNA, 20 bp, Artificial Sequence
  chemically synthesized
actattttcctgaagaagaa

SEQ ID NO: 20021 - DNA, 20 bp, Artificial Sequence
  chemically synthesized
ctgaagaagaatagcatgta

SEQ ID NO: 20022 - DNA, 20 bp, Artificial Sequence
  chemically synthesized
agaatagcatgtacagacta

SEQ ID NO: 20023 - DNA, 20 bp, Artificial Sequence
  chemically synthesized
actatggttttttccctaat

SEQ ID NO: 20024 - DNA, 20 bp, Artificial Sequence
  chemically synthesized
ccctaattagaaaaaatact

SEQ ID NO: 20025 - DNA, 20 bp, Artificial Sequence
  chemically synthesized
tagaaaaaatactgagttaa

SEQ ID NO: 20026 - DNA, 20 bp, Artificial Sequence
  chemically synthesized
atattatccgcaactatttt

SEQ ID NO: 20027 - DNA, 20 bp, Artificial Sequence
  chemically synthesized
tattatccgcaactattttg

SEQ ID NO: 20028 - DNA, 20 bp, Artificial Sequence
  chemically synthesized
attatccgcaactattttga

SEQ ID NO: 20029 - DNA, 20 bp, Artificial Sequence
  chemically synthesized
cttataaatatttgcaacaa

SEQ ID NO: 20030 - DNA, 20 bp, Artificial Sequence
  chemically synthesized
ataacataaatatacataaa

SEQ ID NO: 20031 - DNA, 20 bp, Artificial Sequence
  chemically synthesized
tacataaatggataataatc

SEQ ID NO: 20032 - DNA, 20 bp, Artificial Sequence
  chemically synthesized
aaatggataataatctggct

SEQ ID NO: 20033 - DNA, 20 bp, Artificial Sequence
  chemically synthesized
tgctgtgattactgaccatt

SEQ ID NO: 20034 - DNA, 20 bp, Artificial Sequence
  chemically synthesized
tacatttcacgattatgatg

SEQ ID NO: 20035 - DNA, 20 bp, Artificial Sequence
  chemically synthesized
tttcacgattatgatgaaga

SEQ ID NO: 20036 - DNA, 20 bp, Artificial Sequence
  chemically synthesized
tatgatgaagacagtttttt

SEQ ID NO: 20037 - DNA, 20 bp, Artificial Sequence
  chemically synthesized
gacagttttttcagttaatg

SEQ ID NO: 20038 - DNA, 20 bp, Artificial Sequence
  chemically synthesized
gcagtttttctcattttttt

SEQ ID NO: 20039 - DNA, 20 bp, Artificial Sequence
  chemically synthesized
tttttttggaaattgaatgt

SEQ ID NO: 20040 - DNA, 20 bp, Artificial Sequence
  chemically synthesized
tgtcagtgttttatgcacta

SEQ ID NO: 20041 - DNA, 20 bp, Artificial Sequence
  chemically synthesized
tcaccatcactaccaatgaa

SEQ ID NO: 20042 - DNA, 20 bp, Artificial Sequence
  chemically synthesized
gaacggctttgtcactctaa

SEQ ID NO: 20043 - DNA, 20 bp, Artificial Sequence
  chemically synthesized
tgtcactctaacagttactt

SEQ ID NO: 20044 - DNA, 20 bp, Artificial Sequence
  chemically synthesized
ctctaacagttacttgagct

SEQ ID NO: 20045 - DNA, 20 bp, Artificial Sequence
  chemically synthesized
agttacttgagcttggccac

SEQ ID NO: 20046 - DNA, 20 bp, Artificial Sequence
  chemically synthesized
ttacttgagcttggccacca

SEQ ID NO: 20047 - DNA, 20 bp, Artificial Sequence
  chemically synthesized
gagcttggccaccagagttg

SEQ ID NO: 20048 - DNA, 20 bp, Artificial Sequence
  chemically synthesized
gccaccagagttgtggatca

SEQ ID NO: 20049 - DNA, 20 bp, Artificial Sequence
  chemically synthesized
cagagttgtggatcacagac

SEQ ID NO: 20050 - DNA, 20 bp, Artificial Sequence
  chemically synthesized
tgtggatcacagactagacg

SEQ ID NO: 20051 - DNA, 20 bp, Artificial Sequence
  chemically synthesized
acagactagacgcagctaac

SEQ ID NO: 20052 - DNA, 20 bp, Artificial Sequence
  chemically synthesized
gactagacgcagctaacaag

SEQ ID NO: 20053 - DNA, 20 bp, Artificial Sequence
  chemically synthesized
tagacgcagctaacaagcag

SEQ ID NO: 20054 - DNA, 20 bp, Artificial Sequence
  chemically synthesized
agacgcagctaacaagcagc

SEQ ID NO: 20055 - DNA, 20 bp, Artificial Sequence
  chemically synthesized
ctaacaagcagcgggcttgt

SEQ ID NO: 20056 - DNA, 20 bp, Artificial Sequence
  chemically synthesized
taacaagcagcgggcttgtt

SEQ ID NO: 20057 - DNA, 20 bp, Artificial Sequence
  chemically synthesized
cagcgggcttgttaggcatg

SEQ ID NO: 20058 - DNA, 20 bp, Artificial Sequence
  chemically synthesized
gcttgttaggcatgcagcct

SEQ ID NO: 20059 - DNA, 20 bp, Artificial Sequence
  chemically synthesized
tgaatcaaattcgctttttt

SEQ ID NO: 20060 - DNA, 20 bp, Artificial Sequence
  chemically synthesized
gaatcaaattcgcttttttc

SEQ ID NO: 20061 - DNA, 20 bp, Artificial Sequence
  chemically synthesized
attcgcttttttcaggtcct

SEQ ID NO: 20062 - DNA, 20 bp, Artificial Sequence
  chemically synthesized
ttcgcttttttcaggtcctc

SEQ ID NO: 20063 - DNA, 20 bp, Artificial Sequence
  chemically synthesized
ttcaggtcctcaggtgattc

SEQ ID NO: 20064 - DNA, 20 bp, Artificial Sequence
  chemically synthesized
ttccagtgcaaaacaatgtc

SEQ ID NO: 20065 - DNA, 20 bp, Artificial Sequence
  chemically synthesized
tccagtgcaaaacaatgtct

SEQ ID NO: 20066 - DNA, 20 bp, Artificial Sequence
  chemically synthesized
tgtctgggcatcactgctat

SEQ ID NO: 20067 - DNA, 20 bp, Artificial Sequence
  chemically synthesized
tcatacctaatccatctttc

SEQ ID NO: 20068 - DNA, 20 bp, Artificial Sequence
  chemically synthesized
acctaatccatctttcgaga

SEQ ID NO: 20069 - DNA, 20 bp, Artificial Sequence
  chemically synthesized
aaccttttaatgcttccatc

SEQ ID NO: 20070 - DNA, 20 bp, Artificial Sequence
  chemically synthesized
atgtttctttcaccatttac

SEQ ID NO: 20071 - DNA, 20 bp, Artificial Sequence
  chemically synthesized
atttcccataattaaatact

SEQ ID NO: 20072 - DNA, 20 bp, Artificial Sequence
  chemically synthesized
cccataattaaatacttagc

SEQ ID NO: 20073 - DNA, 20 bp, Artificial Sequence
  chemically synthesized
tccatcaactccaaactcct

SEQ ID NO: 20074 - DNA, 20 bp, Artificial Sequence
  chemically synthesized
ccatcaactccaaactcctg

SEQ ID NO: 20075 - DNA, 20 bp, Artificial Sequence
  chemically synthesized
aaactcctgaggaactgttg

SEQ ID NO: 20076 - DNA, 20 bp, Artificial Sequence
  chemically synthesized
gaactgttgcagttctgtaa

SEQ ID NO: 20077 - DNA, 20 bp, Artificial Sequence
  chemically synthesized
aactgttgcagttctgtaac

SEQ ID NO: 20078 - DNA, 20 bp, Artificial Sequence
  chemically synthesized
gtaaaattataatgtttcca

SEQ ID NO: 20079 - DNA, 20 bp, Artificial Sequence
  chemically synthesized
ttataatgtttccacagcct

SEQ ID NO: 20080 - DNA, 20 bp, Artificial Sequence
  chemically synthesized
tataatgtttccacagccta

SEQ ID NO: 20081 - DNA, 20 bp, Artificial Sequence
  chemically synthesized
tttccacagcctaaggatgc

SEQ ID NO: 20082 - DNA, 20 bp, Artificial Sequence
  chemically synthesized
cactactgtttctgttttct

SEQ ID NO: 20083 - DNA, 20 bp, Artificial Sequence
  chemically synthesized
tttcttggttgccacgatcc

SEQ ID NO: 20084 - DNA, 20 bp, Artificial Sequence
  chemically synthesized
tcttggttgccacgatccaa

SEQ ID NO: 20085 - DNA, 20 bp, Artificial Sequence
  chemically synthesized
cttggttgccacgatccaag

SEQ ID NO: 20086 - DNA, 20 bp, Artificial Sequence
  chemically synthesized
ttggttgccacgatccaaga

SEQ ID NO: 20087 - DNA, 20 bp, Artificial Sequence
  chemically synthesized
tggttgccacgatccaagag

SEQ ID NO: 20088 - DNA, 20 bp, Artificial Sequence
  chemically synthesized
gccacgatccaagaggggta

SEQ ID NO: 20089 - DNA, 20 bp, Artificial Sequence
  chemically synthesized
ccacgatccaagaggggtat

SEQ ID NO: 20090 - DNA, 20 bp, Artificial Sequence
  chemically synthesized
acgatccaagaggggtatgg

SEQ ID NO: 20091 - DNA, 20 bp, Artificial Sequence
  chemically synthesized
tccaagaggggtatgggaga

SEQ ID NO: 20092 - DNA, 20 bp, Artificial Sequence
  chemically synthesized
aagaggggtatgggagaaag

SEQ ID NO: 20093 - DNA, 20 bp, Artificial Sequence
  chemically synthesized
aggggtatgggagaaagaag

SEQ ID NO: 20094 - DNA, 20 bp, Artificial Sequence
  chemically synthesized
agaaagaagaagcttattac

SEQ ID NO: 20095 - DNA, 20 bp, Artificial Sequence
  chemically synthesized
gcttattaccagctctgctg

SEQ ID NO: 20096 - DNA, 20 bp, Artificial Sequence
  chemically synthesized
ctgctgcagtcttatttaac

SEQ ID NO: 20097 - DNA, 20 bp, Artificial Sequence
  chemically synthesized
gtcttatttaacgagaaatt

SEQ ID NO: 20098 - DNA, 20 bp, Artificial Sequence
  chemically synthesized
taacgagaaattcagaatcc

SEQ ID NO: 20099 - DNA, 20 bp, Artificial Sequence
  chemically synthesized
acgagaaattcagaatcctg

SEQ ID NO: 20100 - DNA, 20 bp, Artificial Sequence
  chemically synthesized
cgagaaattcagaatcctgg

SEQ ID NO: 20101 - DNA, 20 bp, Artificial Sequence
  chemically synthesized
aaattcagaatcctggaggc

SEQ ID NO: 20102 - DNA, 20 bp, Artificial Sequence
  chemically synthesized
gaatcctggaggcaagtctt

SEQ ID NO: 20103 - DNA, 20 bp, Artificial Sequence
  chemically synthesized
ggaggcaagtctttagcacc

SEQ ID NO: 20104 - DNA, 20 bp, Artificial Sequence
  chemically synthesized
ggcaagtctttagcacctag

SEQ ID NO: 20105 - DNA, 20 bp, Artificial Sequence
  chemically synthesized
tagcagttttcttcataaaa

SEQ ID NO: 20106 - DNA, 20 bp, Artificial Sequence
  chemically synthesized
ttttcttcataaaatggcct

SEQ ID NO: 20107 - DNA, 20 bp, Artificial Sequence
  chemically synthesized
cctcagtatcaaaaataaat

SEQ ID NO: 20108 - DNA, 20 bp, Artificial Sequence
  chemically synthesized
tatcaaaaataaatcagaat

SEQ ID NO: 20109 - DNA, 20 bp, Artificial Sequence
  chemically synthesized
caaaaataaatcagaatcag

SEQ ID NO: 20110 - DNA, 20 bp, Artificial Sequence
  chemically synthesized
cagaatcagaagaaatcaca

SEQ ID NO: 20111 - DNA, 20 bp, Artificial Sequence
  chemically synthesized
caaagcatttcatattgtat

SEQ ID NO: 20112 - DNA, 20 bp, Artificial Sequence
  chemically synthesized
aaagcatttcatattgtata

SEQ ID NO: 20113 - DNA, 20 bp, Artificial Sequence
  chemically synthesized
ttctgatgctacctctgtat

SEQ ID NO: 20114 - DNA, 20 bp, Artificial Sequence
  chemically synthesized
acctctgtatcagctcctgt

SEQ ID NO: 20115 - DNA, 20 bp, Artificial Sequence
  chemically synthesized
ctgtatcagctcctgtgagt

SEQ ID NO: 20116 - DNA, 20 bp, Artificial Sequence
  chemically synthesized
tgtatcagctcctgtgagtc

SEQ ID NO: 20117 - DNA, 20 bp, Artificial Sequence
  chemically synthesized
gtcaggattactaacttact

SEQ ID NO: 20118 - DNA, 20 bp, Artificial Sequence
  chemically synthesized
gagattgaaatcaccaacac

SEQ ID NO: 20119 - DNA, 20 bp, Artificial Sequence
  chemically synthesized
agattgaaatcaccaacact

SEQ ID NO: 20120 - DNA, 20 bp, Artificial Sequence
  chemically synthesized
gattgaaatcaccaacacta

SEQ ID NO: 20121 - DNA, 20 bp, Artificial Sequence
  chemically synthesized
taaatcacattgaattcata

SEQ ID NO: 20122 - DNA, 20 bp, Artificial Sequence
  chemically synthesized
atcacattgaattcatatag

SEQ ID NO: 20123 - DNA, 20 bp, Artificial Sequence
  chemically synthesized
aaatgttgttctaccttcga

SEQ ID NO: 20124 - DNA, 20 bp, Artificial Sequence
  chemically synthesized
atccttcatgcttaaaaaca

SEQ ID NO: 20125 - DNA, 20 bp, Artificial Sequence
  chemically synthesized
catgcttaaaaacacagatt

SEQ ID NO: 20126 - DNA, 20 bp, Artificial Sequence
  chemically synthesized
atgcttaaaaacacagattg

SEQ ID NO: 20127 - DNA, 20 bp, Artificial Sequence
  chemically synthesized
aaaaacacagattgaggaat

SEQ ID NO: 20128 - DNA, 20 bp, Artificial Sequence
  chemically synthesized
aaacacagattgaggaataa

SEQ ID NO: 20129 - DNA, 20 bp, Artificial Sequence
  chemically synthesized
aacacagattgaggaataag

SEQ ID NO: 20130 - DNA, 20 bp, Artificial Sequence
  chemically synthesized
ttgaggaataagaggatgta

SEQ ID NO: 20131 - DNA, 20 bp, Artificial Sequence
  chemically synthesized
aataagaggatgtacggaat

SEQ ID NO: 20132 - DNA, 20 bp, Artificial Sequence
  chemically synthesized
ataagaggatgtacggaatg

SEQ ID NO: 20133 - DNA, 20 bp, Artificial Sequence
  chemically synthesized
aggatgtacggaatgaggta

SEQ ID NO: 20134 - DNA, 20 bp, Artificial Sequence
  chemically synthesized
ggatgtacggaatgaggtat

SEQ ID NO: 20135 - DNA, 20 bp, Artificial Sequence
  chemically synthesized
atgtacggaatgaggtatag

SEQ ID NO: 20136 - DNA, 20 bp, Artificial Sequence
  chemically synthesized
tgtacggaatgaggtatagg

SEQ ID NO: 20137 - DNA, 20 bp, Artificial Sequence
  chemically synthesized
acggaatgaggtataggagg

SEQ ID NO: 20138 - DNA, 20 bp, Artificial Sequence
  chemically synthesized
ggaatgaggtataggaggaa

SEQ ID NO: 20139 - DNA, 20 bp, Artificial Sequence
  chemically synthesized
gaggtataggaggaagagaa

SEQ ID NO: 20140 - DNA, 20 bp, Artificial Sequence
  chemically synthesized
gtataggaggaagagaatgg

SEQ ID NO: 20141 - DNA, 20 bp, Artificial Sequence
  chemically synthesized
ggaggaagagaatggcagat

SEQ ID NO: 20142 - DNA, 20 bp, Artificial Sequence
  chemically synthesized
aggaagagaatggcagatta

SEQ ID NO: 20143 - DNA, 20 bp, Artificial Sequence
  chemically synthesized
agagaatggcagattagaga

SEQ ID NO: 20144 - DNA, 20 bp, Artificial Sequence
  chemically synthesized
gagaatggcagattagagaa

SEQ ID NO: 20145 - DNA, 20 bp, Artificial Sequence
  chemically synthesized
agattagagaaaggacaaat

SEQ ID NO: 20146 - DNA, 20 bp, Artificial Sequence
  chemically synthesized
aattggtgacacatattctg

SEQ ID NO: 20147 - DNA, 20 bp, Artificial Sequence
  chemically synthesized
attggtgacacatattctga

SEQ ID NO: 20148 - DNA, 20 bp, Artificial Sequence
  chemically synthesized
ttggtgacacatattctgaa

SEQ ID NO: 20149 - DNA, 20 bp, Artificial Sequence
  chemically synthesized
catattctgaagggtaaaca

SEQ ID NO: 20150 - DNA, 20 bp, Artificial Sequence
  chemically synthesized
attctgaagggtaaacatag

SEQ ID NO: 20151 - DNA, 20 bp, Artificial Sequence
  chemically synthesized
tgaagggtaaacatagaaga

SEQ ID NO: 20152 - DNA, 20 bp, Artificial Sequence
  chemically synthesized
attaaaattttttttaatta

SEQ ID NO: 20153 - DNA, 20 bp, Artificial Sequence
  chemically synthesized
aaaaataaaaaatttttaaa

SEQ ID NO: 20154 - DNA, 20 bp, Artificial Sequence
  chemically synthesized
ataaaaaatttttaaaaaga

SEQ ID NO: 20155 - DNA, 20 bp, Artificial Sequence
  chemically synthesized
aaaaagaaagccataaaatc

SEQ ID NO: 20156 - DNA, 20 bp, Artificial Sequence
  chemically synthesized
aaaagaaagccataaaatct

SEQ ID NO: 20157 - DNA, 20 bp, Artificial Sequence
  chemically synthesized
tcctttaaaaaaaattgtgt

SEQ ID NO: 20158 - DNA, 20 bp, Artificial Sequence
  chemically synthesized
cctttaaaaaaaattgtgta

SEQ ID NO: 20159 - DNA, 20 bp, Artificial Sequence
  chemically synthesized
aaattgtgtaaggatcaaac

SEQ ID NO: 20160 - DNA, 20 bp, Artificial Sequence
  chemically synthesized
taaggatcaaactagatttc

SEQ ID NO: 20161 - DNA, 20 bp, Artificial Sequence
  chemically synthesized
aggatcaaactagatttcca

SEQ ID NO: 20162 - DNA, 20 bp, Artificial Sequence
  chemically synthesized
aaactagatttccagagcac

SEQ ID NO: 20163 - DNA, 20 bp, Artificial Sequence
  chemically synthesized
gtactttttaaaatgtttgt

SEQ ID NO: 20164 - DNA, 20 bp, Artificial Sequence
  chemically synthesized
ttaaaaaacaataacgtctt

SEQ ID NO: 20165 - DNA, 20 bp, Artificial Sequence
  chemically synthesized
aaaaaacaataacgtcttta

SEQ ID NO: 20166 - DNA, 20 bp, Artificial Sequence
  chemically synthesized
aataacgtctttagagaaat

SEQ ID NO: 20167 - DNA, 20 bp, Artificial Sequence
  chemically synthesized
taaaacacttgaaaccaaaa

SEQ ID NO: 20168 - DNA, 20 bp, Artificial Sequence
  chemically synthesized
acacttgaaaccaaaaaaga

SEQ ID NO: 20169 - DNA, 20 bp, Artificial Sequence
  chemically synthesized
aagttttttattatatttat

SEQ ID NO: 20170 - DNA, 20 bp, Artificial Sequence
  chemically synthesized
ttttttattatatttatgag

SEQ ID NO: 20171 - DNA, 20 bp, Artificial Sequence
  chemically synthesized
tgagcagaaaaaaatgttta

SEQ ID NO: 20172 - DNA, 20 bp, Artificial Sequence
  chemically synthesized
tcatatctccctccatctct

SEQ ID NO: 20173 - DNA, 20 bp, Artificial Sequence
  chemically synthesized
tctccctccatctctaagct

SEQ ID NO: 20174 - DNA, 20 bp, Artificial Sequence
  chemically synthesized
ctccctccatctctaagctt

SEQ ID NO: 20175 - DNA, 20 bp, Artificial Sequence
  chemically synthesized
ctctaagcttgggtcattaa

SEQ ID NO: 20176 - DNA, 20 bp, Artificial Sequence
  chemically synthesized
aagcttgggtcattaaaagt

SEQ ID NO: 20177 - DNA, 20 bp, Artificial Sequence
  chemically synthesized
ttgggtcattaaaagtaaga

SEQ ID NO: 20178 - DNA, 20 bp, Artificial Sequence
  chemically synthesized
tgggtcattaaaagtaagac

SEQ ID NO: 20179 - DNA, 20 bp, Artificial Sequence
  chemically synthesized
gggtcattaaaagtaagaca

SEQ ID NO: 20180 - DNA, 20 bp, Artificial Sequence
  chemically synthesized
tcattaaaagtaagacaggg

SEQ ID NO: 20181 - DNA, 20 bp, Artificial Sequence
  chemically synthesized
cattaaaagtaagacaggga

SEQ ID NO: 20182 - DNA, 20 bp, Artificial Sequence
  chemically synthesized
aagtaagacagggaaggtta

SEQ ID NO: 20183 - DNA, 20 bp, Artificial Sequence
  chemically synthesized
gggaaggttatggtacctca

SEQ ID NO: 20184 - DNA, 20 bp, Artificial Sequence
  chemically synthesized
tggtacctcaaagaaaatga

SEQ ID NO: 20185 - DNA, 20 bp, Artificial Sequence
  chemically synthesized
ggtacctcaaagaaaatgaa

SEQ ID NO: 20186 - DNA, 20 bp, Artificial Sequence
  chemically synthesized
atgaaaggtaaatcatgtct

SEQ ID NO: 20187 - DNA, 20 bp, Artificial Sequence
  chemically synthesized
gtaaatcatgtctgagattt

SEQ ID NO: 20188 - DNA, 20 bp, Artificial Sequence
  chemically synthesized
taaatcatgtctgagatttt

SEQ ID NO: 20189 - DNA, 20 bp, Artificial Sequence
  chemically synthesized
tctgagattttgggaataaa

SEQ ID NO: 20190 - DNA, 20 bp, Artificial Sequence
  chemically synthesized
gggaataaaaagaaacacaa

SEQ ID NO: 20191 - DNA, 20 bp, Artificial Sequence
  chemically synthesized
aataaaaagaaacacaaaag

SEQ ID NO: 20192 - DNA, 20 bp, Artificial Sequence
  chemically synthesized
aaaagaagcctgcccaacac

SEQ ID NO: 20193 - DNA, 20 bp, Artificial Sequence
  chemically synthesized
aaagaagcctgcccaacact

SEQ ID NO: 20194 - DNA, 20 bp, Artificial Sequence
  chemically synthesized
gaagcctgcccaacactggg

SEQ ID NO: 20195 - DNA, 20 bp, Artificial Sequence
  chemically synthesized
ggaagccgttgatatttacc

SEQ ID NO: 20196 - DNA, 20 bp, Artificial Sequence
  chemically synthesized
aagccgttgatatttaccca

SEQ ID NO: 20197 - DNA, 20 bp, Artificial Sequence
  chemically synthesized
agccgttgatatttacccag

SEQ ID NO: 20198 - DNA, 20 bp, Artificial Sequence
  chemically synthesized
cgttgatatttacccagagg

SEQ ID NO: 20199 - DNA, 20 bp, Artificial Sequence
  chemically synthesized
gttgatatttacccagaggc

SEQ ID NO: 20200 - DNA, 20 bp, Artificial Sequence
  chemically synthesized
tttacccagaggcaggcgtg

SEQ ID NO: 20201 - DNA, 20 bp, Artificial Sequence
  chemically synthesized
ttacccagaggcaggcgtgt

SEQ ID NO: 20202 - DNA, 20 bp, Artificial Sequence
  chemically synthesized
tacccagaggcaggcgtgtg

SEQ ID NO: 20203 - DNA, 20 bp, Artificial Sequence
  chemically synthesized
aggcaggcgtgtggggattc

SEQ ID NO: 20204 - DNA, 20 bp, Artificial Sequence
  chemically synthesized
ggcaggcgtgtggggattct

SEQ ID NO: 20205 - DNA, 20 bp, Artificial Sequence
  chemically synthesized
caggcgtgtggggattctag

SEQ ID NO: 20206 - DNA, 20 bp, Artificial Sequence
  chemically synthesized
ggcgtgtggggattctagga

SEQ ID NO: 20207 - DNA, 20 bp, Artificial Sequence
  chemically synthesized
tgtggggattctaggagagc

SEQ ID NO: 20208 - DNA, 20 bp, Artificial Sequence
  chemically synthesized
ctagatactgtcatcaaact

SEQ ID NO: 20209 - DNA, 20 bp, Artificial Sequence
  chemically synthesized
tagatactgtcatcaaactg

SEQ ID NO: 20210 - DNA, 20 bp, Artificial Sequence
  chemically synthesized
atcaaactgaggcccactat

SEQ ID NO: 20211 - DNA, 20 bp, Artificial Sequence
  chemically synthesized
aaactgaggcccactataag

SEQ ID NO: 20212 - DNA, 20 bp, Artificial Sequence
  chemically synthesized
cccactataagcagtgtcac

SEQ ID NO: 20213 - DNA, 20 bp, Artificial Sequence
  chemically synthesized
cactataagcagtgtcacca

SEQ ID NO: 20214 - DNA, 20 bp, Artificial Sequence
  chemically synthesized
aagcagtgtcaccagagatg

SEQ ID NO: 20215 - DNA, 20 bp, Artificial Sequence
  chemically synthesized
catactgtatgcatgctccc

SEQ ID NO: 20216 - DNA, 20 bp, Artificial Sequence
  chemically synthesized
atactgtatgcatgctccca

SEQ ID NO: 20217 - DNA, 20 bp, Artificial Sequence
  chemically synthesized
gctcccaaggctgcactatg

SEQ ID NO: 20218 - DNA, 20 bp, Artificial Sequence
  chemically synthesized
ctatgtggcaaaattccatt

SEQ ID NO: 20219 - DNA, 20 bp, Artificial Sequence
  chemically synthesized
gtggcaaaattccattcaga

SEQ ID NO: 20220 - DNA, 20 bp, Artificial Sequence
  chemically synthesized
aaaattccattcagatggct

SEQ ID NO: 20221 - DNA, 20 bp, Artificial Sequence
  chemically synthesized
cagatggcttagctattaac

SEQ ID NO: 20222 - DNA, 20 bp, Artificial Sequence
  chemically synthesized
cttagctattaacaagtgtt

SEQ ID NO: 20223 - DNA, 20 bp, Artificial Sequence
  chemically synthesized
aagtgttaagaaaattatac

SEQ ID NO: 20224 - DNA, 20 bp, Artificial Sequence
  chemically synthesized
tgttaagaaaattatactag

SEQ ID NO: 20225 - DNA, 20 bp, Artificial Sequence
  chemically synthesized
gaaaattatactagaagcac

SEQ ID NO: 20226 - DNA, 20 bp, Artificial Sequence
  chemically synthesized
tatactagaagcacaagaac

SEQ ID NO: 20227 - DNA, 20 bp, Artificial Sequence
  chemically synthesized
agcacaagaactagtttttc

SEQ ID NO: 20228 - DNA, 20 bp, Artificial Sequence
  chemically synthesized
agaactagtttttctggata

SEQ ID NO: 20229 - DNA, 20 bp, Artificial Sequence
  chemically synthesized
gaactagtttttctggataa

SEQ ID NO: 20230 - DNA, 20 bp, Artificial Sequence
  chemically synthesized
ctagtttttctggataaagg

SEQ ID NO: 20231 - DNA, 20 bp, Artificial Sequence
  chemically synthesized
agtttttctggataaaggtg

SEQ ID NO: 20232 - DNA, 20 bp, Artificial Sequence
  chemically synthesized
ttttctggataaaggtggag

SEQ ID NO: 20233 - DNA, 20 bp, Artificial Sequence
  chemically synthesized
ggataaaggtggagcagcta

SEQ ID NO: 20234 - DNA, 20 bp, Artificial Sequence
  chemically synthesized
agctatggctgtgaaattga

SEQ ID NO: 20235 - DNA, 20 bp, Artificial Sequence
  chemically synthesized
gctatggctgtgaaattgat

SEQ ID NO: 20236 - DNA, 20 bp, Artificial Sequence
  chemically synthesized
atggctgtgaaattgatagg

SEQ ID NO: 20237 - DNA, 20 bp, Artificial Sequence
  chemically synthesized
ttgataggcagctctcaact

SEQ ID NO: 20238 - DNA, 20 bp, Artificial Sequence
  chemically synthesized
caactcagaacataaatgtt

SEQ ID NO: 20239 - DNA, 20 bp, Artificial Sequence
  chemically synthesized
taaatgtttagtgatttcct

SEQ ID NO: 20240 - DNA, 20 bp, Artificial Sequence
  chemically synthesized
aaatgtttagtgatttccta

SEQ ID NO: 20241 - DNA, 20 bp, Artificial Sequence
  chemically synthesized
ttagtgatttcctaaggatc

SEQ ID NO: 20242 - DNA, 20 bp, Artificial Sequence
  chemically synthesized
tagtgatttcctaaggatct

SEQ ID NO: 20243 - DNA, 20 bp, Artificial Sequence
  chemically synthesized
agtgatttcctaaggatctg

SEQ ID NO: 20244 - DNA, 20 bp, Artificial Sequence
  chemically synthesized
gaactgatatatcatatatg

SEQ ID NO: 20245 - DNA, 20 bp, Artificial Sequence
  chemically synthesized
tatatcatatatgaagatat

SEQ ID NO: 20246 - DNA, 20 bp, Artificial Sequence
  chemically synthesized
atgaagatataagcaacctg

SEQ ID NO: 20247 - DNA, 20 bp, Artificial Sequence
  chemically synthesized
tgaagatataagcaacctgt

SEQ ID NO: 20248 - DNA, 20 bp, Artificial Sequence
  chemically synthesized
aagatataagcaacctgtag

SEQ ID NO: 20249 - DNA, 20 bp, Artificial Sequence
  chemically synthesized
ctccattcaccaataccatc

SEQ ID NO: 20250 - DNA, 20 bp, Artificial Sequence
  chemically synthesized
tccattcaccaataccatct

SEQ ID NO: 20251 - DNA, 20 bp, Artificial Sequence
  chemically synthesized
tcaccaataccatctgggac

SEQ ID NO: 20252 - DNA, 20 bp, Artificial Sequence
  chemically synthesized
caataccatctgggacaagt

SEQ ID NO: 20253 - DNA, 20 bp, Artificial Sequence
  chemically synthesized
agttggaaaatgactatttt

SEQ ID NO: 20254 - DNA, 20 bp, Artificial Sequence
  chemically synthesized
ggaaaatgactattttgagt

SEQ ID NO: 20255 - DNA, 20 bp, Artificial Sequence
  chemically synthesized
atgactattttgagtcagca

SEQ ID NO: 20256 - DNA, 20 bp, Artificial Sequence
  chemically synthesized
attttgagtcagcacagaat

SEQ ID NO: 20257 - DNA, 20 bp, Artificial Sequence
  chemically synthesized
tgagtcagcacagaattggt

SEQ ID NO: 20258 - DNA, 20 bp, Artificial Sequence
  chemically synthesized
ccacacaactgcactgtgtt

SEQ ID NO: 20259 - DNA, 20 bp, Artificial Sequence
  chemically synthesized
gttctaaataaccatgtaat

SEQ ID NO: 20260 - DNA, 20 bp, Artificial Sequence
  chemically synthesized
aaataaccatgtaataagca

SEQ ID NO: 20261 - DNA, 20 bp, Artificial Sequence
  chemically synthesized
aataagcacagtctgctctt

SEQ ID NO: 20262 - DNA, 20 bp, Artificial Sequence
  chemically synthesized
aagcacagtctgctcttaag

SEQ ID NO: 20263 - DNA, 20 bp, Artificial Sequence
  chemically synthesized
ctcttaagaagctctcaata

SEQ ID NO: 20264 - DNA, 20 bp, Artificial Sequence
  chemically synthesized
aagctctcaatatggcctat

SEQ ID NO: 20265 - DNA, 20 bp, Artificial Sequence
  chemically synthesized
tatggcctatgagtttataa

SEQ ID NO: 20266 - DNA, 20 bp, Artificial Sequence
  chemically synthesized
attctcccttcaattttatg

SEQ ID NO: 20267 - DNA, 20 bp, Artificial Sequence
  chemically synthesized
attgcccttgaatgtctcaa

SEQ ID NO: 20268 - DNA, 20 bp, Artificial Sequence
  chemically synthesized
ttgcccttgaatgtctcaac

SEQ ID NO: 20269 - DNA, 20 bp, Artificial Sequence
  chemically synthesized
atccataatgctgaaaactt

SEQ ID NO: 20270 - DNA, 20 bp, Artificial Sequence
  chemically synthesized
tgaaaacttgagaaaaatca

SEQ ID NO: 20271 - DNA, 20 bp, Artificial Sequence
  chemically synthesized
ttgagaaaaatcatagatct

SEQ ID NO: 20272 - DNA, 20 bp, Artificial Sequence
  chemically synthesized
atctaagccctgcttcattc

SEQ ID NO: 20273 - DNA, 20 bp, Artificial Sequence
  chemically synthesized
gcttcattctagcttcattc

SEQ ID NO: 20274 - DNA, 20 bp, Artificial Sequence
  chemically synthesized
ttcacatgatgatatatttc

SEQ ID NO: 20275 - DNA, 20 bp, Artificial Sequence
  chemically synthesized
tgatatatttctagatgaat

SEQ ID NO: 20276 - DNA, 20 bp, Artificial Sequence
  chemically synthesized
gaataagattcctatacttg

SEQ ID NO: 20277 - DNA, 20 bp, Artificial Sequence
  chemically synthesized
cttgtagcaacactctcacc

SEQ ID NO: 20278 - DNA, 20 bp, Artificial Sequence
  chemically synthesized
ccaagatgcataaatacata

SEQ ID NO: 20279 - DNA, 20 bp, Artificial Sequence
  chemically synthesized
caagatgcataaatacatac

SEQ ID NO: 20280 - DNA, 20 bp, Artificial Sequence
  chemically synthesized
cataaatacatacaggtcca

SEQ ID NO: 20281 - DNA, 20 bp, Artificial Sequence
  chemically synthesized
acatacaggtccatggaaaa

SEQ ID NO: 20282 - DNA, 20 bp, Artificial Sequence
  chemically synthesized
aaagttgtcatgctcacttt

SEQ ID NO: 20283 - DNA, 20 bp, Artificial Sequence
  chemically synthesized
gaacataatttgaatgttac

SEQ ID NO: 20284 - DNA, 20 bp, Artificial Sequence
  chemically synthesized
atttgaatgttaccagatac

SEQ ID NO: 20285 - DNA, 20 bp, Artificial Sequence
  chemically synthesized
tttgaatgttaccagataca

SEQ ID NO: 20286 - DNA, 20 bp, Artificial Sequence
  chemically synthesized
ttgaatgttaccagatacaa

SEQ ID NO: 20287 - DNA, 20 bp, Artificial Sequence
  chemically synthesized
gaatgttaccagatacaagg

SEQ ID NO: 20288 - DNA, 20 bp, Artificial Sequence
  chemically synthesized
ttaccagatacaagggagta

SEQ ID NO: 20289 - DNA, 20 bp, Artificial Sequence
  chemically synthesized
taccagatacaagggagtaa

SEQ ID NO: 20290 - DNA, 20 bp, Artificial Sequence
  chemically synthesized
ccagatacaagggagtaaag

SEQ ID NO: 20291 - DNA, 20 bp, Artificial Sequence
  chemically synthesized
atacaagggagtaaaggaga

SEQ ID NO: 20292 - DNA, 20 bp, Artificial Sequence
  chemically synthesized
acaagggagtaaaggagaca

SEQ ID NO: 20293 - DNA, 20 bp, Artificial Sequence
  chemically synthesized
caagggagtaaaggagacag

SEQ ID NO: 20294 - DNA, 20 bp, Artificial Sequence
  chemically synthesized
aagggagtaaaggagacaga

SEQ ID NO: 20295 - DNA, 20 bp, Artificial Sequence
  chemically synthesized
aggagacagagggaactttg

SEQ ID NO: 20296 - DNA, 20 bp, Artificial Sequence
  chemically synthesized
agagggaactttgtagtatg

SEQ ID NO: 20297 - DNA, 20 bp, Artificial Sequence
  chemically synthesized
gggaactttgtagtatgaag

SEQ ID NO: 20298 - DNA, 20 bp, Artificial Sequence
  chemically synthesized
ggaactttgtagtatgaaga

SEQ ID NO: 20299 - DNA, 20 bp, Artificial Sequence
  chemically synthesized
tttgtagtatgaagaaggaa

SEQ ID NO: 20300 - DNA, 20 bp, Artificial Sequence
  chemically synthesized
tagtatgaagaaggaacaga

SEQ ID NO: 20301 - DNA, 20 bp, Artificial Sequence
  chemically synthesized
agtatgaagaaggaacagac

SEQ ID NO: 20302 - DNA, 20 bp, Artificial Sequence
  chemically synthesized
tgaagaaggaacagacagga

SEQ ID NO: 20303 - DNA, 20 bp, Artificial Sequence
  chemically synthesized
aacagacaggaaagatctgt

SEQ ID NO: 20304 - DNA, 20 bp, Artificial Sequence
  chemically synthesized
aggaaagatctgttagcctc

SEQ ID NO: 20305 - DNA, 20 bp, Artificial Sequence
  chemically synthesized
ctgttagcctcaagaaaatg

SEQ ID NO: 20306 - DNA, 20 bp, Artificial Sequence
  chemically synthesized
cctcaagaaaatgtagtaaa

SEQ ID NO: 20307 - DNA, 20 bp, Artificial Sequence
  chemically synthesized
taaatagtgaatctattata

SEQ ID NO: 20308 - DNA, 20 bp, Artificial Sequence
  chemically synthesized
attatacagtctacataaac

SEQ ID NO: 20309 - DNA, 20 bp, Artificial Sequence
  chemically synthesized
cagtctacataaacaagtga

SEQ ID NO: 20310 - DNA, 20 bp, Artificial Sequence
  chemically synthesized
gtctacataaacaagtgaaa

SEQ ID NO: 20311 - DNA, 20 bp, Artificial Sequence
  chemically synthesized
tctacataaacaagtgaaag

SEQ ID NO: 20312 - DNA, 20 bp, Artificial Sequence
  chemically synthesized
tcctactctgccctccttct

SEQ ID NO: 20313 - DNA, 20 bp, Artificial Sequence
  chemically synthesized
actctgccctccttctgagt

SEQ ID NO: 20314 - DNA, 20 bp, Artificial Sequence
  chemically synthesized
tgccctccttctgagttgga

SEQ ID NO: 20315 - DNA, 20 bp, Artificial Sequence
  chemically synthesized
cctccttctgagttggatgg

SEQ ID NO: 20316 - DNA, 20 bp, Artificial Sequence
  chemically synthesized
atgtgtccccgcaccttcct

SEQ ID NO: 20317 - DNA, 20 bp, Artificial Sequence
  chemically synthesized
tgtgtccccgcaccttccta

SEQ ID NO: 20318 - DNA, 20 bp, Artificial Sequence
  chemically synthesized
tgtccccgcaccttcctaag

SEQ ID NO: 20319 - DNA, 20 bp, Artificial Sequence
  chemically synthesized
cccgcaccttcctaaggaga

SEQ ID NO: 20320 - DNA, 20 bp, Artificial Sequence
  chemically synthesized
ccgcaccttcctaaggagat

SEQ ID NO: 20321 - DNA, 20 bp, Artificial Sequence
  chemically synthesized
aaggagatgggccctgtctc

SEQ ID NO: 20322 - DNA, 20 bp, Artificial Sequence
  chemically synthesized
ccctgtctctagaatttttc

SEQ ID NO: 20323 - DNA, 20 bp, Artificial Sequence
  chemically synthesized
gtctctagaatttttctagt

SEQ ID NO: 20324 - DNA, 20 bp, Artificial Sequence
  chemically synthesized
tgactactcatgccatctct

SEQ ID NO: 20325 - DNA, 20 bp, Artificial Sequence
  chemically synthesized
actactcatgccatctctta

SEQ ID NO: 20326 - DNA, 20 bp, Artificial Sequence
  chemically synthesized
actcatgccatctcttagag

SEQ ID NO: 20327 - DNA, 20 bp, Artificial Sequence
  chemically synthesized
cagttcttcaaacaaacaca

SEQ ID NO: 20328 - DNA, 20 bp, Artificial Sequence
  chemically synthesized
cacatgcatgtgtgtgtttc

SEQ ID NO: 20329 - DNA, 20 bp, Artificial Sequence
  chemically synthesized
acatgcatgtgtgtgtttca

SEQ ID NO: 20330 - DNA, 20 bp, Artificial Sequence
  chemically synthesized
catgcatgtgtgtgtttcaa

SEQ ID NO: 20331 - DNA, 20 bp, Artificial Sequence
  chemically synthesized
atgcatgtgtgtgtttcaag

SEQ ID NO: 20332 - DNA, 20 bp, Artificial Sequence
  chemically synthesized
gtgtttcaaggggtgttgtt

SEQ ID NO: 20333 - DNA, 20 bp, Artificial Sequence
  chemically synthesized
taaattgttatatgttaaaa

SEQ ID NO: 20334 - DNA, 20 bp, Artificial Sequence
  chemically synthesized
acttttctttctataaattt

SEQ ID NO: 20335 - DNA, 20 bp, Artificial Sequence
  chemically synthesized
cttttctttctataaatttc

SEQ ID NO: 20336 - DNA, 20 bp, Artificial Sequence
  chemically synthesized
ttctataaatttcaggatct

SEQ ID NO: 20337 - DNA, 20 bp, Artificial Sequence
  chemically synthesized
tataaatttcaggatcttag

SEQ ID NO: 20338 - DNA, 20 bp, Artificial Sequence
  chemically synthesized
taaatttcaggatcttagca

SEQ ID NO: 20339 - DNA, 20 bp, Artificial Sequence
  chemically synthesized
ttcaggatcttagcagagtg

SEQ ID NO: 20340 - DNA, 20 bp, Artificial Sequence
  chemically synthesized
aggatcttagcagagtgcag

SEQ ID NO: 20341 - DNA, 20 bp, Artificial Sequence
  chemically synthesized
cttagcagagtgcagaagct

SEQ ID NO: 20342 - DNA, 20 bp, Artificial Sequence
  chemically synthesized
gtgcagaagctcagcctgtt

SEQ ID NO: 20343 - DNA, 20 bp, Artificial Sequence
  chemically synthesized
tgcagaagctcagcctgttt

SEQ ID NO: 20344 - DNA, 20 bp, Artificial Sequence
  chemically synthesized
aagctcagcctgtttaggtt

SEQ ID NO: 20345 - DNA, 20 bp, Artificial Sequence
  chemically synthesized
attgtctttaatcttcaaaa

SEQ ID NO: 20346 - DNA, 20 bp, Artificial Sequence
  chemically synthesized
tctttaatcttcaaaaaagt

SEQ ID NO: 20347 - DNA, 20 bp, Artificial Sequence
  chemically synthesized
aaaaaagtgagtcctccatt

SEQ ID NO: 20348 - DNA, 20 bp, Artificial Sequence
  chemically synthesized
gtgagtcctccatttggccc

SEQ ID NO: 20349 - DNA, 20 bp, Artificial Sequence
  chemically synthesized
ctccatttggccccagtcct

SEQ ID NO: 20350 - DNA, 20 bp, Artificial Sequence
  chemically synthesized
tccatttggccccagtcctg

SEQ ID NO: 20351 - DNA, 20 bp, Artificial Sequence
  chemically synthesized
ccatttggccccagtcctga

SEQ ID NO: 20352 - DNA, 20 bp, Artificial Sequence
  chemically synthesized
ccccagtcctgagggcctga

SEQ ID NO: 20353 - DNA, 20 bp, Artificial Sequence
  chemically synthesized
agtcctgagggcctgacagt

SEQ ID NO: 20354 - DNA, 20 bp, Artificial Sequence
  chemically synthesized
gtcctgagggcctgacagtt

SEQ ID NO: 20355 - DNA, 20 bp, Artificial Sequence
  chemically synthesized
agttgggactacccaactct

SEQ ID NO: 20356 - DNA, 20 bp, Artificial Sequence
  chemically synthesized
ctcagatttctattgtccac

SEQ ID NO: 20357 - DNA, 20 bp, Artificial Sequence
  chemically synthesized
tcctcctgccttctccaacc

SEQ ID NO: 20358 - DNA, 20 bp, Artificial Sequence
  chemically synthesized
ttcaatccaatttgctttct

SEQ ID NO: 20359 - DNA, 20 bp, Artificial Sequence
  chemically synthesized
tgctttcttagatcttaatt

SEQ ID NO: 20360 - DNA, 20 bp, Artificial Sequence
  chemically synthesized
taatttggctgcccttttct

SEQ ID NO: 20361 - DNA, 20 bp, Artificial Sequence
  chemically synthesized
ctaagcctttcaactcgatt

SEQ ID NO: 20362 - DNA, 20 bp, Artificial Sequence
  chemically synthesized
agaattttttgtctactctt

SEQ ID NO: 20363 - DNA, 20 bp, Artificial Sequence
  chemically synthesized
aattttttgtctactcttca

SEQ ID NO: 20364 - DNA, 20 bp, Artificial Sequence
  chemically synthesized
tcaacaaaaaatcctctgaa

SEQ ID NO: 20365 - DNA, 20 bp, Artificial Sequence
  chemically synthesized
caacaaaaaatcctctgaac

SEQ ID NO: 20366 - DNA, 20 bp, Artificial Sequence
  chemically synthesized
aaaaaatcctctgaacagga

SEQ ID NO: 20367 - DNA, 20 bp, Artificial Sequence
  chemically synthesized
ataaaaaataaacgtaaaat

SEQ ID NO: 20368 - DNA, 20 bp, Artificial Sequence
  chemically synthesized
aacgtaaaataagccctttc

SEQ ID NO: 20369 - DNA, 20 bp, Artificial Sequence
  chemically synthesized
tttctggataaacaaaaact

SEQ ID NO: 20370 - DNA, 20 bp, Artificial Sequence
  chemically synthesized
aaactgagttgatttcaact

SEQ ID NO: 20371 - DNA, 20 bp, Artificial Sequence
  chemically synthesized
aagttgaaaccaaatgacca

SEQ ID NO: 20372 - DNA, 20 bp, Artificial Sequence
  chemically synthesized
gaatctacataaaatgacaa

SEQ ID NO: 20373 - DNA, 20 bp, Artificial Sequence
  chemically synthesized
acataaaatgacaaaagcac

SEQ ID NO: 20374 - DNA, 20 bp, Artificial Sequence
  chemically synthesized
aaatgacaaaagcaccagta

SEQ ID NO: 20375 - DNA, 20 bp, Artificial Sequence
  chemically synthesized
gacaaaagcaccagtaaaga

SEQ ID NO: 20376 - DNA, 20 bp, Artificial Sequence
  chemically synthesized
taaagatagtcatgtcatta

SEQ ID NO: 20377 - DNA, 20 bp, Artificial Sequence
  chemically synthesized
agatagtcatgtcattatag

SEQ ID NO: 20378 - DNA, 20 bp, Artificial Sequence
  chemically synthesized
gaatgtattacaataaaaaa

SEQ ID NO: 20379 - DNA, 20 bp, Artificial Sequence
  chemically synthesized
aaaaaatagaattgcattgc

SEQ ID NO: 20380 - DNA, 20 bp, Artificial Sequence
  chemically synthesized
tatttaccaataactgaaca

SEQ ID NO: 20381 - DNA, 20 bp, Artificial Sequence
  chemically synthesized
atttaccaataactgaacaa

SEQ ID NO: 20382 - DNA, 20 bp, Artificial Sequence
  chemically synthesized
ttaccaataactgaacaaag

SEQ ID NO: 20383 - DNA, 20 bp, Artificial Sequence
  chemically synthesized
taccaataactgaacaaagg

SEQ ID NO: 20384 - DNA, 20 bp, Artificial Sequence
  chemically synthesized
aataactgaacaaaggaggt

SEQ ID NO: 20385 - DNA, 20 bp, Artificial Sequence
  chemically synthesized
aaaggaggtgagtgataaca

SEQ ID NO: 20386 - DNA, 20 bp, Artificial Sequence
  chemically synthesized
gagtgataacaaagctgttt

SEQ ID NO: 20387 - DNA, 20 bp, Artificial Sequence
  chemically synthesized
aacaaagctgttttggaatg

SEQ ID NO: 20388 - DNA, 20 bp, Artificial Sequence
  chemically synthesized
agaaatattctctgaaaaaa

SEQ ID NO: 20389 - DNA, 20 bp, Artificial Sequence
  chemically synthesized
aaaagctataaacatctaca

SEQ ID NO: 20390 - DNA, 20 bp, Artificial Sequence
  chemically synthesized
aaacatctacatagaaaaat

SEQ ID NO: 20391 - DNA, 20 bp, Artificial Sequence
  chemically synthesized
atctacatagaaaaatgagt

SEQ ID NO: 20392 - DNA, 20 bp, Artificial Sequence
  chemically synthesized
agaatgcacaatgacacatg

SEQ ID NO: 20393 - DNA, 20 bp, Artificial Sequence
  chemically synthesized
acaatgacacatgcagttct

SEQ ID NO: 20394 - DNA, 20 bp, Artificial Sequence
  chemically synthesized
aattatacttatgccaatcc

SEQ ID NO: 20395 - DNA, 20 bp, Artificial Sequence
  chemically synthesized
attatacttatgccaatcca

SEQ ID NO: 20396 - DNA, 20 bp, Artificial Sequence
  chemically synthesized
ttatacttatgccaatccaa

SEQ ID NO: 20397 - DNA, 20 bp, Artificial Sequence
  chemically synthesized
ttatgccaatccaagggtcc

SEQ ID NO: 20398 - DNA, 20 bp, Artificial Sequence
  chemically synthesized
ccaatccaagggtcccagat

SEQ ID NO: 20399 - DNA, 20 bp, Artificial Sequence
  chemically synthesized
tagaaaacctaaatctatca

SEQ ID NO: 20400 - DNA, 20 bp, Artificial Sequence
  chemically synthesized
ccttaaatactctttcaaaa

SEQ ID NO: 20401 - DNA, 20 bp, Artificial Sequence
  chemically synthesized
aaaaaaaaaaatctgtgctg

SEQ ID NO: 20402 - DNA, 20 bp, Artificial Sequence
  chemically synthesized
aaaaaaaaaatctgtgctgt

SEQ ID NO: 20403 - DNA, 20 bp, Artificial Sequence
  chemically synthesized
tgctgtaggatatcccacct

SEQ ID NO: 20404 - DNA, 20 bp, Artificial Sequence
  chemically synthesized
tcagctgtgatctttacctc

SEQ ID NO: 20405 - DNA, 20 bp, Artificial Sequence
  chemically synthesized
cagctgtgatctttacctct

SEQ ID NO: 20406 - DNA, 20 bp, Artificial Sequence
  chemically synthesized
ctgtgatctttacctctagg

SEQ ID NO: 20407 - DNA, 20 bp, Artificial Sequence
  chemically synthesized
tttacctctaggcagacctc

SEQ ID NO: 20408 - DNA, 20 bp, Artificial Sequence
  chemically synthesized
ccttcttatatgctttcctt

SEQ ID NO: 20409 - DNA, 20 bp, Artificial Sequence
  chemically synthesized
tccttgagtgcatctcacat

SEQ ID NO: 20410 - DNA, 20 bp, Artificial Sequence
  chemically synthesized
ttgagtgcatctcacatcag

SEQ ID NO: 20411 - DNA, 20 bp, Artificial Sequence
  chemically synthesized
gagtgcatctcacatcagaa

SEQ ID NO: 20412 - DNA, 20 bp, Artificial Sequence
  chemically synthesized
gtgcatctcacatcagaaga

SEQ ID NO: 20413 - DNA, 20 bp, Artificial Sequence
  chemically synthesized
gcatctcacatcagaagaga

SEQ ID NO: 20414 - DNA, 20 bp, Artificial Sequence
  chemically synthesized
catctcacatcagaagagag

SEQ ID NO: 20415 - DNA, 20 bp, Artificial Sequence
  chemically synthesized
agaggaatcattccatattc

SEQ ID NO: 20416 - DNA, 20 bp, Artificial Sequence
  chemically synthesized
tcattccatattcaagttcc

SEQ ID NO: 20417 - DNA, 20 bp, Artificial Sequence
  chemically synthesized
tcctggcactcacccactca

SEQ ID NO: 20418 - DNA, 20 bp, Artificial Sequence
  chemically synthesized
ctcacccactcacagtattg

SEQ ID NO: 20419 - DNA, 20 bp, Artificial Sequence
  chemically synthesized
tcacagtattgtggctaaaa

SEQ ID NO: 20420 - DNA, 20 bp, Artificial Sequence
  chemically synthesized
cacagtattgtggctaaaat

SEQ ID NO: 20421 - DNA, 20 bp, Artificial Sequence
  chemically synthesized
aacctattcctgtcctcttt

SEQ ID NO: 20422 - DNA, 20 bp, Artificial Sequence
  chemically synthesized
acctattcctgtcctctttg

SEQ ID NO: 20423 - DNA, 20 bp, Artificial Sequence
  chemically synthesized
tcctgtcctctttgaggact

SEQ ID NO: 20424 - DNA, 20 bp, Artificial Sequence
  chemically synthesized
tcctctttgaggactcagtt

SEQ ID NO: 20425 - DNA, 20 bp, Artificial Sequence
  chemically synthesized
cagttcagatcattcactca

SEQ ID NO: 20426 - DNA, 20 bp, Artificial Sequence
  chemically synthesized
ttcactcacagacctctcat

SEQ ID NO: 20427 - DNA, 20 bp, Artificial Sequence
  chemically synthesized
tcactcacagacctctcatg

SEQ ID NO: 20428 - DNA, 20 bp, Artificial Sequence
  chemically synthesized
tctcatgaggcctcatttta

SEQ ID NO: 20429 - DNA, 20 bp, Artificial Sequence
  chemically synthesized
cattttaaagcttatgcatg

SEQ ID NO: 20430 - DNA, 20 bp, Artificial Sequence
  chemically synthesized
atgtggaaatcacctcccct

SEQ ID NO: 20431 - DNA, 20 bp, Artificial Sequence
  chemically synthesized
tcccctgagtttcatctttc

SEQ ID NO: 20432 - DNA, 20 bp, Artificial Sequence
  chemically synthesized
gtttcatctttctagcatct

SEQ ID NO: 20433 - DNA, 20 bp, Artificial Sequence
  chemically synthesized
tttcatctttctagcatctc

SEQ ID NO: 20434 - DNA, 20 bp, Artificial Sequence
  chemically synthesized
tcatctttctagcatctcag

SEQ ID NO: 20435 - DNA, 20 bp, Artificial Sequence
  chemically synthesized
ccttccctctcttctctgtt

SEQ ID NO: 20436 - DNA, 20 bp, Artificial Sequence
  chemically synthesized
cttccctctcttctctgttc

SEQ ID NO: 20437 - DNA, 20 bp, Artificial Sequence
  chemically synthesized
tccctctcttctctgttcgg

SEQ ID NO: 20438 - DNA, 20 bp, Artificial Sequence
  chemically synthesized
ccctctcttctctgttcggg

SEQ ID NO: 20439 - DNA, 20 bp, Artificial Sequence
  chemically synthesized
tcttctctgttcgggaggaa

SEQ ID NO: 20440 - DNA, 20 bp, Artificial Sequence
  chemically synthesized
cttctctgttcgggaggaac

SEQ ID NO: 20441 - DNA, 20 bp, Artificial Sequence
  chemically synthesized
ttctctgttcgggaggaaca

SEQ ID NO: 20442 - DNA, 20 bp, Artificial Sequence
  chemically synthesized
ggccccacaactgatgtcct

SEQ ID NO: 20443 - DNA, 20 bp, Artificial Sequence
  chemically synthesized
gccccacaactgatgtcctc

SEQ ID NO: 20444 - DNA, 20 bp, Artificial Sequence
  chemically synthesized
actgatgtcctcgggatttt

SEQ ID NO: 20445 - DNA, 20 bp, Artificial Sequence
  chemically synthesized
ctgatgtcctcgggattttc

SEQ ID NO: 20446 - DNA, 20 bp, Artificial Sequence
  chemically synthesized
ggattttcaggtgtttcctg

SEQ ID NO: 20447 - DNA, 20 bp, Artificial Sequence
  chemically synthesized
ttcaggtgtttcctgaagaa

SEQ ID NO: 20448 - DNA, 20 bp, Artificial Sequence
  chemically synthesized
tcaggtgtttcctgaagaat

SEQ ID NO: 20449 - DNA, 20 bp, Artificial Sequence
  chemically synthesized
caggtgtttcctgaagaatg

SEQ ID NO: 20450 - DNA, 20 bp, Artificial Sequence
  chemically synthesized
tgtttcctgaagaatggggt

SEQ ID NO: 20451 - DNA, 20 bp, Artificial Sequence
  chemically synthesized
gtttcctgaagaatggggtg

SEQ ID NO: 20452 - DNA, 20 bp, Artificial Sequence
  chemically synthesized
aaaatttgaaattcaaaaac

SEQ ID NO: 20453 - DNA, 20 bp, Artificial Sequence
  chemically synthesized
attcaaaaaccagctgatgt

SEQ ID NO: 20454 - DNA, 20 bp, Artificial Sequence
  chemically synthesized
aaaaaccagctgatgtaaga

SEQ ID NO: 20455 - DNA, 20 bp, Artificial Sequence
  chemically synthesized
aaaaccagctgatgtaagat

SEQ ID NO: 20456 - DNA, 20 bp, Artificial Sequence
  chemically synthesized
aaaccagctgatgtaagata

SEQ ID NO: 20457 - DNA, 20 bp, Artificial Sequence
  chemically synthesized
ctgatgtaagatagggatac

SEQ ID NO: 20458 - DNA, 20 bp, Artificial Sequence
  chemically synthesized
tgatgtaagatagggatacc

SEQ ID NO: 20459 - DNA, 20 bp, Artificial Sequence
  chemically synthesized
gatgtaagatagggatacca

SEQ ID NO: 20460 - DNA, 20 bp, Artificial Sequence
  chemically synthesized
aagatagggataccagggct

SEQ ID NO: 20461 - DNA, 20 bp, Artificial Sequence
  chemically synthesized
agggcttggttatgtgaccc

SEQ ID NO: 20462 - DNA, 20 bp, Artificial Sequence
  chemically synthesized
gggcttggttatgtgaccca

SEQ ID NO: 20463 - DNA, 20 bp, Artificial Sequence
  chemically synthesized
gcttggttatgtgacccaag

SEQ ID NO: 20464 - DNA, 20 bp, Artificial Sequence
  chemically synthesized
cttggttatgtgacccaagg

SEQ ID NO: 20465 - DNA, 20 bp, Artificial Sequence
  chemically synthesized
ttatgtgacccaaggaggct

SEQ ID NO: 20466 - DNA, 20 bp, Artificial Sequence
  chemically synthesized
ggaggctcagcatcataact

SEQ ID NO: 20467 - DNA, 20 bp, Artificial Sequence
  chemically synthesized
tcataacttagtttatttga

SEQ ID NO: 20468 - DNA, 20 bp, Artificial Sequence
  chemically synthesized
cataacttagtttatttgaa

SEQ ID NO: 20469 - DNA, 20 bp, Artificial Sequence
  chemically synthesized
ataacttagtttatttgaaa

SEQ ID NO: 20470 - DNA, 20 bp, Artificial Sequence
  chemically synthesized
cttagtttatttgaaagggt

SEQ ID NO: 20471 - DNA, 20 bp, Artificial Sequence
  chemically synthesized
ttagtttatttgaaagggtt

SEQ ID NO: 20472 - DNA, 20 bp, Artificial Sequence
  chemically synthesized
tagtttatttgaaagggtta

SEQ ID NO: 20473 - DNA, 20 bp, Artificial Sequence
  chemically synthesized
agtttatttgaaagggttag

SEQ ID NO: 20474 - DNA, 20 bp, Artificial Sequence
  chemically synthesized
ttgaaagggttaggggatat

SEQ ID NO: 20475 - DNA, 20 bp, Artificial Sequence
  chemically synthesized
taggggatatcggttgtctt

SEQ ID NO: 20476 - DNA, 20 bp, Artificial Sequence
  chemically synthesized
aggggatatcggttgtcttc

SEQ ID NO: 20477 - DNA, 20 bp, Artificial Sequence
  chemically synthesized
ggggatatcggttgtcttca

SEQ ID NO: 20478 - DNA, 20 bp, Artificial Sequence
  chemically synthesized
agggatcatatgtacctcta

SEQ ID NO: 20479 - DNA, 20 bp, Artificial Sequence
  chemically synthesized
gggatcatatgtacctctac

SEQ ID NO: 20480 - DNA, 20 bp, Artificial Sequence
  chemically synthesized
atatgtacctctacgggtcc

SEQ ID NO: 20481 - DNA, 20 bp, Artificial Sequence
  chemically synthesized
atgtacctctacgggtccta

SEQ ID NO: 20482 - DNA, 20 bp, Artificial Sequence
  chemically synthesized
ttttgtctttcctgttactt

SEQ ID NO: 20483 - DNA, 20 bp, Artificial Sequence
  chemically synthesized
taaaatttgttcttatctac

SEQ ID NO: 20484 - DNA, 20 bp, Artificial Sequence
  chemically synthesized
cttatctactggaacttcaa

SEQ ID NO: 20485 - DNA, 20 bp, Artificial Sequence
  chemically synthesized
aacttcaatggatctgttaa

SEQ ID NO: 20486 - DNA, 20 bp, Artificial Sequence
  chemically synthesized
tggatctgttaatagtcatg

SEQ ID NO: 20487 - DNA, 20 bp, Artificial Sequence
  chemically synthesized
tcatgcagattcatgacatt

SEQ ID NO: 20488 - DNA, 20 bp, Artificial Sequence
  chemically synthesized
tttttttttttttttttttt

SEQ ID NO: 20489 - DNA, 20 bp, Artificial Sequence
  chemically synthesized
tttttttttttttttttaga

SEQ ID NO: 20490 - DNA, 20 bp, Artificial Sequence
  chemically synthesized
tttttttttttttttagata

SEQ ID NO: 20491 - DNA, 20 bp, Artificial Sequence
  chemically synthesized
atagagtctcactctgtcgc

SEQ ID NO: 20492 - DNA, 20 bp, Artificial Sequence
  chemically synthesized
tagagtctcactctgtcgcc

SEQ ID NO: 20493 - DNA, 20 bp, Artificial Sequence
  chemically synthesized
gtctcactctgtcgccaggc

SEQ ID NO: 20494 - DNA, 20 bp, Artificial Sequence
  chemically synthesized
ctcactctgtcgccaggctg

SEQ ID NO: 20495 - DNA, 20 bp, Artificial Sequence
  chemically synthesized
tctgtcgccaggctggagtg

SEQ ID NO: 20496 - DNA, 20 bp, Artificial Sequence
  chemically synthesized
gtcgccaggctggagtgcag

SEQ ID NO: 20497 - DNA, 20 bp, Artificial Sequence
  chemically synthesized
ggagtgcagtagcacaatct

SEQ ID NO: 20498 - DNA, 20 bp, Artificial Sequence
  chemically synthesized
tcactgcaaactccacctcc

SEQ ID NO: 20499 - DNA, 20 bp, Artificial Sequence
  chemically synthesized
cactgcaaactccacctccc

SEQ ID NO: 20500 - DNA, 20 bp, Artificial Sequence
  chemically synthesized
aaactccacctcccaggttc

SEQ ID NO: 20501 - DNA, 20 bp, Artificial Sequence
  chemically synthesized
ttcaagtgattctcctgcca

SEQ ID NO: 20502 - DNA, 20 bp, Artificial Sequence
  chemically synthesized
ttctcctgccacagcctcct

SEQ ID NO: 20503 - DNA, 20 bp, Artificial Sequence
  chemically synthesized
tcctgccacagcctcctgag

SEQ ID NO: 20504 - DNA, 20 bp, Artificial Sequence
  chemically synthesized
gccacagcctcctgagaagc

SEQ ID NO: 20505 - DNA, 20 bp, Artificial Sequence
  chemically synthesized
ccacagcctcctgagaagct

SEQ ID NO: 20506 - DNA, 20 bp, Artificial Sequence
  chemically synthesized
ctcctgagaagctgggacta

SEQ ID NO: 20507 - DNA, 20 bp, Artificial Sequence
  chemically synthesized
ctgagaagctgggactacag

SEQ ID NO: 20508 - DNA, 20 bp, Artificial Sequence
  chemically synthesized
cagtagcgcgtcaccacacc

SEQ ID NO: 20509 - DNA, 20 bp, Artificial Sequence
  chemically synthesized
ccagctaatttttgtatttt

SEQ ID NO: 20510 - DNA, 20 bp, Artificial Sequence
  chemically synthesized
gctaatttttgtatttttag

SEQ ID NO: 20511 - DNA, 20 bp, Artificial Sequence
  chemically synthesized
ttttgtatttttagtagaca

SEQ ID NO: 20512 - DNA, 20 bp, Artificial Sequence
  chemically synthesized
tttgtatttttagtagacac

SEQ ID NO: 20513 - DNA, 20 bp, Artificial Sequence
  chemically synthesized
ttgtatttttagtagacacg

SEQ ID NO: 20514 - DNA, 20 bp, Artificial Sequence
  chemically synthesized
gacacggggtttcaccatat

SEQ ID NO: 20515 - DNA, 20 bp, Artificial Sequence
  chemically synthesized
cggggtttcaccatattggc

SEQ ID NO: 20516 - DNA, 20 bp, Artificial Sequence
  chemically synthesized
ggggtttcaccatattggcc

SEQ ID NO: 20517 - DNA, 20 bp, Artificial Sequence
  chemically synthesized
tttcaccatattggccagga

SEQ ID NO: 20518 - DNA, 20 bp, Artificial Sequence
  chemically synthesized
acctcgtgatccaccctcct

SEQ ID NO: 20519 - DNA, 20 bp, Artificial Sequence
  chemically synthesized
ccaccctccttggcctccca

SEQ ID NO: 20520 - DNA, 20 bp, Artificial Sequence
  chemically synthesized
tccttggcctcccaaagtgc

SEQ ID NO: 20521 - DNA, 20 bp, Artificial Sequence
  chemically synthesized
ccttggcctcccaaagtgct

SEQ ID NO: 20522 - DNA, 20 bp, Artificial Sequence
  chemically synthesized
ctcccaaagtgctgggattg

SEQ ID NO: 20523 - DNA, 20 bp, Artificial Sequence
  chemically synthesized
tcccaaagtgctgggattgc

SEQ ID NO: 20524 - DNA, 20 bp, Artificial Sequence
  chemically synthesized
agtgctgggattgcaggtgt

SEQ ID NO: 20525 - DNA, 20 bp, Artificial Sequence
  chemically synthesized
caggtgtgagtcactgcgcc

SEQ ID NO: 20526 - DNA, 20 bp, Artificial Sequence
  chemically synthesized
cactgcgcccggctgacatt

SEQ ID NO: 20527 - DNA, 20 bp, Artificial Sequence
  chemically synthesized
tcttaaaattatattacttg

SEQ ID NO: 20528 - DNA, 20 bp, Artificial Sequence
  chemically synthesized
ccctttttttttttttttgc

SEQ ID NO: 20529 - DNA, 20 bp, Artificial Sequence
  chemically synthesized
ttttttgccagatacacaat

SEQ ID NO: 20530 - DNA, 20 bp, Artificial Sequence
  chemically synthesized
tttttgccagatacacaatg

SEQ ID NO: 20531 - DNA, 20 bp, Artificial Sequence
  chemically synthesized
tttgccagatacacaatgag

SEQ ID NO: 20532 - DNA, 20 bp, Artificial Sequence
  chemically synthesized
cagatacacaatgaggagca

SEQ ID NO: 20533 - DNA, 20 bp, Artificial Sequence
  chemically synthesized
aggagcatagtctttattca

SEQ ID NO: 20534 - DNA, 20 bp, Artificial Sequence
  chemically synthesized
ctttattcacagaatgtaaa

SEQ ID NO: 20535 - DNA, 20 bp, Artificial Sequence
  chemically synthesized
tgtaaatagtgtgtaatata

SEQ ID NO: 20536 - DNA, 20 bp, Artificial Sequence
  chemically synthesized
agtgtgtaatataaagaaaa

SEQ ID NO: 20537 - DNA, 20 bp, Artificial Sequence
  chemically synthesized
atagttaccacaaattttca

SEQ ID NO: 20538 - DNA, 20 bp, Artificial Sequence
  chemically synthesized
atagcactatcattactgca

SEQ ID NO: 20539 - DNA, 20 bp, Artificial Sequence
  chemically synthesized
cactatcattactgcataga

SEQ ID NO: 20540 - DNA, 20 bp, Artificial Sequence
  chemically synthesized
tatcattactgcatagatgg

SEQ ID NO: 20541 - DNA, 20 bp, Artificial Sequence
  chemically synthesized
gcatagatggtagcatgcta

SEQ ID NO: 20542 - DNA, 20 bp, Artificial Sequence
  chemically synthesized
catagatggtagcatgctaa

SEQ ID NO: 20543 - DNA, 20 bp, Artificial Sequence
  chemically synthesized
atagatggtagcatgctaaa

SEQ ID NO: 20544 - DNA, 20 bp, Artificial Sequence
  chemically synthesized
agatggtagcatgctaaagg

SEQ ID NO: 20545 - DNA, 20 bp, Artificial Sequence
  chemically synthesized
agcatgctaaagggagccca

SEQ ID NO: 20546 - DNA, 20 bp, Artificial Sequence
  chemically synthesized
tgctaaagggagcccacaga

SEQ ID NO: 20547 - DNA, 20 bp, Artificial Sequence
  chemically synthesized
gagcccacagaaagcatctt

SEQ ID NO: 20548 - DNA, 20 bp, Artificial Sequence
  chemically synthesized
agcccacagaaagcatcttt

SEQ ID NO: 20549 - DNA, 20 bp, Artificial Sequence
  chemically synthesized
gcccacagaaagcatctttg

SEQ ID NO: 20550 - DNA, 20 bp, Artificial Sequence
  chemically synthesized
cacagaaagcatctttgggg

SEQ ID NO: 20551 - DNA, 20 bp, Artificial Sequence
  chemically synthesized
acagaaagcatctttggggc

SEQ ID NO: 20552 - DNA, 20 bp, Artificial Sequence
  chemically synthesized
cagaaagcatctttggggca

SEQ ID NO: 20553 - DNA, 20 bp, Artificial Sequence
  chemically synthesized
agaaagcatctttggggcag

SEQ ID NO: 20554 - DNA, 20 bp, Artificial Sequence
  chemically synthesized
ggcaggggaaaatttctcaa

SEQ ID NO: 20555 - DNA, 20 bp, Artificial Sequence
  chemically synthesized
tctcaaaagaaatattattt

SEQ ID NO: 20556 - DNA, 20 bp, Artificial Sequence
  chemically synthesized
taagctaataattgaaaaac

SEQ ID NO: 20557 - DNA, 20 bp, Artificial Sequence
  chemically synthesized
aagctaataattgaaaaaca

SEQ ID NO: 20558 - DNA, 20 bp, Artificial Sequence
  chemically synthesized
ctaataattgaaaaacaagg

SEQ ID NO: 20559 - DNA, 20 bp, Artificial Sequence
  chemically synthesized
taataattgaaaaacaagga

SEQ ID NO: 20560 - DNA, 20 bp, Artificial Sequence
  chemically synthesized
aacaaggaaggtaacaaata

SEQ ID NO: 20561 - DNA, 20 bp, Artificial Sequence
  chemically synthesized
aacaaatatagtgtttgtat

SEQ ID NO: 20562 - DNA, 20 bp, Artificial Sequence
  chemically synthesized
aaatatagtgtttgtataag

SEQ ID NO: 20563 - DNA, 20 bp, Artificial Sequence
  chemically synthesized
aatatagtgtttgtataagt

SEQ ID NO: 20564 - DNA, 20 bp, Artificial Sequence
  chemically synthesized
atatagtgtttgtataagtg

SEQ ID NO: 20565 - DNA, 20 bp, Artificial Sequence
  chemically synthesized
gtgtttgtataagtggggta

SEQ ID NO: 20566 - DNA, 20 bp, Artificial Sequence
  chemically synthesized
taagtggggtacagtttata

SEQ ID NO: 20567 - DNA, 20 bp, Artificial Sequence
  chemically synthesized
aagtggggtacagtttataa

SEQ ID NO: 20568 - DNA, 20 bp, Artificial Sequence
  chemically synthesized
tggggtacagtttataaagg

SEQ ID NO: 20569 - DNA, 20 bp, Artificial Sequence
  chemically synthesized
ataaaggaagaaaaaataca

SEQ ID NO: 20570 - DNA, 20 bp, Artificial Sequence
  chemically synthesized
taaaggaagaaaaaatacac

SEQ ID NO: 20571 - DNA, 20 bp, Artificial Sequence
  chemically synthesized
aagaaaaaatacacaggcta

SEQ ID NO: 20572 - DNA, 20 bp, Artificial Sequence
  chemically synthesized
agaaaaaatacacaggctat

SEQ ID NO: 20573 - DNA, 20 bp, Artificial Sequence
  chemically synthesized
gaaaaaatacacaggctatg

SEQ ID NO: 20574 - DNA, 20 bp, Artificial Sequence
  chemically synthesized
aaatacacaggctatgggga

SEQ ID NO: 20575 - DNA, 20 bp, Artificial Sequence
  chemically synthesized
atacacaggctatggggaaa

SEQ ID NO: 20576 - DNA, 20 bp, Artificial Sequence
  chemically synthesized
aaatatgacaaactcaaatc

SEQ ID NO: 20577 - DNA, 20 bp, Artificial Sequence
  chemically synthesized
atatgacaaactcaaatcaa

SEQ ID NO: 20578 - DNA, 20 bp, Artificial Sequence
  chemically synthesized
aactcaaatcaagagaattc

SEQ ID NO: 20579 - DNA, 20 bp, Artificial Sequence
  chemically synthesized
tcaaatcaagagaattctag

SEQ ID NO: 20580 - DNA, 20 bp, Artificial Sequence
  chemically synthesized
aaatcaagagaattctagca

SEQ ID NO: 20581 - DNA, 20 bp, Artificial Sequence
  chemically synthesized
caagagaattctagcagagc

SEQ ID NO: 20582 - DNA, 20 bp, Artificial Sequence
  chemically synthesized
gccagaataacaaaacatgt

SEQ ID NO: 20583 - DNA, 20 bp, Artificial Sequence
  chemically synthesized
atgtgagaaaattgaacaca

SEQ ID NO: 20584 - DNA, 20 bp, Artificial Sequence
  chemically synthesized
gtgagaaaattgaacacaaa

SEQ ID NO: 20585 - DNA, 20 bp, Artificial Sequence
  chemically synthesized
ttgaacacaaagagaatctg

SEQ ID NO: 20586 - DNA, 20 bp, Artificial Sequence
  chemically synthesized
aacacaaagagaatctgtgg

SEQ ID NO: 20587 - DNA, 20 bp, Artificial Sequence
  chemically synthesized
gagaatctgtggtagcctgt

SEQ ID NO: 20588 - DNA, 20 bp, Artificial Sequence
  chemically synthesized
tattattattattatacttt

SEQ ID NO: 20589 - DNA, 20 bp, Artificial Sequence
  chemically synthesized
tattattatactttaagttt

SEQ ID NO: 20590 - DNA, 20 bp, Artificial Sequence
  chemically synthesized
attattatactttaagtttt

SEQ ID NO: 20591 - DNA, 20 bp, Artificial Sequence
  chemically synthesized
ttattatactttaagtttta

SEQ ID NO: 20592 - DNA, 20 bp, Artificial Sequence
  chemically synthesized
gggtacatgtgcacaatgtg

SEQ ID NO: 20593 - DNA, 20 bp, Artificial Sequence
  chemically synthesized
ggtacatgtgcacaatgtgc

SEQ ID NO: 20594 - DNA, 20 bp, Artificial Sequence
  chemically synthesized
tatgtatacatgtgccatgt

SEQ ID NO: 20595 - DNA, 20 bp, Artificial Sequence
  chemically synthesized
gcacccattaacttgtcact

SEQ ID NO: 20596 - DNA, 20 bp, Artificial Sequence
  chemically synthesized
attaacttgtcacttagcat

SEQ ID NO: 20597 - DNA, 20 bp, Artificial Sequence
  chemically synthesized
ttaacttgtcacttagcatt

SEQ ID NO: 20598 - DNA, 20 bp, Artificial Sequence
  chemically synthesized
cccttccccccacctcacaa

SEQ ID NO: 20599 - DNA, 20 bp, Artificial Sequence
  chemically synthesized
ccccacctcacaacagtccc

SEQ ID NO: 20600 - DNA, 20 bp, Artificial Sequence
  chemically synthesized
ccacctcacaacagtccccg

SEQ ID NO: 20601 - DNA, 20 bp, Artificial Sequence
  chemically synthesized
attgttcaattcccacctat

SEQ ID NO: 20602 - DNA, 20 bp, Artificial Sequence
  chemically synthesized
ttcaattcccacctatgagt

SEQ ID NO: 20603 - DNA, 20 bp, Artificial Sequence
  chemically synthesized
cacctatgagtgagaacatg

SEQ ID NO: 20604 - DNA, 20 bp, Artificial Sequence
  chemically synthesized
gagtgagaacatgcagtgct

SEQ ID NO: 20605 - DNA, 20 bp, Artificial Sequence
  chemically synthesized
ttggttttttgtccttgcga

SEQ ID NO: 20606 - DNA, 20 bp, Artificial Sequence
  chemically synthesized
tgtccttgcgatagtttgct

SEQ ID NO: 20607 - DNA, 20 bp, Artificial Sequence
  chemically synthesized
cgatagtttgctgagaatga

SEQ ID NO: 20608 - DNA, 20 bp, Artificial Sequence
  chemically synthesized
ttgctgagaatgatggtttc

SEQ ID NO: 20609 - DNA, 20 bp, Artificial Sequence
  chemically synthesized
catgaactcttcatttttta

SEQ ID NO: 20610 - DNA, 20 bp, Artificial Sequence
  chemically synthesized
cttcattttttatggctgca

SEQ ID NO: 20611 - DNA, 20 bp, Artificial Sequence
  chemically synthesized
tatggctgcatagtattcca

SEQ ID NO: 20612 - DNA, 20 bp, Artificial Sequence
  chemically synthesized
tgtgccacattttcttaatt

SEQ ID NO: 20613 - DNA, 20 bp, Artificial Sequence
  chemically synthesized
ttaattcagtctatcattgt

SEQ ID NO: 20614 - DNA, 20 bp, Artificial Sequence
  chemically synthesized
gtctatcattgttggacatt

SEQ ID NO: 20615 - DNA, 20 bp, Artificial Sequence
  chemically synthesized
tctatcattgttggacattt

SEQ ID NO: 20616 - DNA, 20 bp, Artificial Sequence
  chemically synthesized
tcattgttggacatttgggt

SEQ ID NO: 20617 - DNA, 20 bp, Artificial Sequence
  chemically synthesized
tggacatttgggttggttcc

SEQ ID NO: 20618 - DNA, 20 bp, Artificial Sequence
  chemically synthesized
caagtctttgctattgtgaa

SEQ ID NO: 20619 - DNA, 20 bp, Artificial Sequence
  chemically synthesized
tgctattgtgaatagtgcca

SEQ ID NO: 20620 - DNA, 20 bp, Artificial Sequence
  chemically synthesized
tacgtgtgcatgtgtcttta

SEQ ID NO: 20621 - DNA, 20 bp, Artificial Sequence
  chemically synthesized
gtgtgcatgtgtctttatag

SEQ ID NO: 20622 - DNA, 20 bp, Artificial Sequence
  chemically synthesized
cagcatgatttataatccgt

SEQ ID NO: 20623 - DNA, 20 bp, Artificial Sequence
  chemically synthesized
agcatgatttataatccgtt

SEQ ID NO: 20624 - DNA, 20 bp, Artificial Sequence
  chemically synthesized
taatccgttgggtatatacc

SEQ ID NO: 20625 - DNA, 20 bp, Artificial Sequence
  chemically synthesized
gttgggtatatacccagtaa

SEQ ID NO: 20626 - DNA, 20 bp, Artificial Sequence
  chemically synthesized
ttgggtatatacccagtaat

SEQ ID NO: 20627 - DNA, 20 bp, Artificial Sequence
  chemically synthesized
gtatatacccagtaatggga

SEQ ID NO: 20628 - DNA, 20 bp, Artificial Sequence
  chemically synthesized
atacccagtaatgggatggc

SEQ ID NO: 20629 - DNA, 20 bp, Artificial Sequence
  chemically synthesized
tacccagtaatgggatggct

SEQ ID NO: 20630 - DNA, 20 bp, Artificial Sequence
  chemically synthesized
aatgggatggctgggtcaaa

SEQ ID NO: 20631 - DNA, 20 bp, Artificial Sequence
  chemically synthesized
gctgggtcaaatggtatttc

SEQ ID NO: 20632 - DNA, 20 bp, Artificial Sequence
  chemically synthesized
tcaaatggtatttctagttc

SEQ ID NO: 20633 - DNA, 20 bp, Artificial Sequence
  chemically synthesized
atttctagttctagatccct

SEQ ID NO: 20634 - DNA, 20 bp, Artificial Sequence
  chemically synthesized
tttctagttctagatccctg

SEQ ID NO: 20635 - DNA, 20 bp, Artificial Sequence
  chemically synthesized
cgccacactgacttccacaa

SEQ ID NO: 20636 - DNA, 20 bp, Artificial Sequence
  chemically synthesized
gacttccacaatggttgaac

SEQ ID NO: 20637 - DNA, 20 bp, Artificial Sequence
  chemically synthesized
acaatggttgaactagttta

SEQ ID NO: 20638 - DNA, 20 bp, Artificial Sequence
  chemically synthesized
aactagtttacagtcccacc

SEQ ID NO: 20639 - DNA, 20 bp, Artificial Sequence
  chemically synthesized
ctagtttacagtcccaccaa

SEQ ID NO: 20640 - DNA, 20 bp, Artificial Sequence
  chemically synthesized
cagtcccaccaagagtgtaa

SEQ ID NO: 20641 - DNA, 20 bp, Artificial Sequence
  chemically synthesized
ctatttctccacatcctctc

SEQ ID NO: 20642 - DNA, 20 bp, Artificial Sequence
  chemically synthesized
ttaatgattgccattctaac

SEQ ID NO: 20643 - DNA, 20 bp, Artificial Sequence
  chemically synthesized
attgccattctaactggtgt

SEQ ID NO: 20644 - DNA, 20 bp, Artificial Sequence
  chemically synthesized
ccattctaactggtgtgaga

SEQ ID NO: 20645 - DNA, 20 bp, Artificial Sequence
  chemically synthesized
tgtgagatggtatctctttg

SEQ ID NO: 20646 - DNA, 20 bp, Artificial Sequence
  chemically synthesized
tgatttgcattgtgacgtgt

SEQ ID NO: 20647 - DNA, 20 bp, Artificial Sequence
  chemically synthesized
attgtgacgtgttagtttta

SEQ ID NO: 20648 - DNA, 20 bp, Artificial Sequence
  chemically synthesized
ttcttaacatttttttgatg

SEQ ID NO: 20649 - DNA, 20 bp, Artificial Sequence
  chemically synthesized
aacatttttttgatgaagca

SEQ ID NO: 20650 - DNA, 20 bp, Artificial Sequence
  chemically synthesized
tgatgaagcacagtgtctga

SEQ ID NO: 20651 - DNA, 20 bp, Artificial Sequence
  chemically synthesized
gatgaagcacagtgtctgaa

SEQ ID NO: 20652 - DNA, 20 bp, Artificial Sequence
  chemically synthesized
atgaagcacagtgtctgaaa

SEQ ID NO: 20653 - DNA, 20 bp, Artificial Sequence
  chemically synthesized
aagcacagtgtctgaaaggg

SEQ ID NO: 20654 - DNA, 20 bp, Artificial Sequence
  chemically synthesized
cacagtgtctgaaagggtgg

SEQ ID NO: 20655 - DNA, 20 bp, Artificial Sequence
  chemically synthesized
gaaagggtggtagcccaatc

SEQ ID NO: 20656 - DNA, 20 bp, Artificial Sequence
  chemically synthesized
aatcaagtgacattaaaaac

SEQ ID NO: 20657 - DNA, 20 bp, Artificial Sequence
  chemically synthesized
tgacattaaaaaccagaaca

SEQ ID NO: 20658 - DNA, 20 bp, Artificial Sequence
  chemically synthesized
aaccagaacacagctaatgt

SEQ ID NO: 20659 - DNA, 20 bp, Artificial Sequence
  chemically synthesized
acagctaatgtgagaaatac

SEQ ID NO: 20660 - DNA, 20 bp, Artificial Sequence
  chemically synthesized
atgtgagaaatacaagtatt

SEQ ID NO: 20661 - DNA, 20 bp, Artificial Sequence
  chemically synthesized
tgtgagaaatacaagtattt

SEQ ID NO: 20662 - DNA, 20 bp, Artificial Sequence
  chemically synthesized
gtgagaaatacaagtattta

SEQ ID NO: 20663 - DNA, 20 bp, Artificial Sequence
  chemically synthesized
aatacaagtatttagggcct

SEQ ID NO: 20664 - DNA, 20 bp, Artificial Sequence
  chemically synthesized
ccttagtctgctccttgtct

SEQ ID NO: 20665 - DNA, 20 bp, Artificial Sequence
  chemically synthesized
cttagtctgctccttgtctg

SEQ ID NO: 20666 - DNA, 20 bp, Artificial Sequence
  chemically synthesized
gcaattcccatgaccttctt

SEQ ID NO: 20667 - DNA, 20 bp, Artificial Sequence
  chemically synthesized
caattcccatgaccttctta

SEQ ID NO: 20668 - DNA, 20 bp, Artificial Sequence
  chemically synthesized
cccatgaccttcttaaggat

SEQ ID NO: 20669 - DNA, 20 bp, Artificial Sequence
  chemically synthesized
cttcttaaggatcagaatgt

SEQ ID NO: 20670 - DNA, 20 bp, Artificial Sequence
  chemically synthesized
tcttaaggatcagaatgtaa

SEQ ID NO: 20671 - DNA, 20 bp, Artificial Sequence
  chemically synthesized
aggatcagaatgtaagagat

SEQ ID NO: 20672 - DNA, 20 bp, Artificial Sequence
  chemically synthesized
ggatcagaatgtaagagata

SEQ ID NO: 20673 - DNA, 20 bp, Artificial Sequence
  chemically synthesized
agaatgtaagagataaggat

SEQ ID NO: 20674 - DNA, 20 bp, Artificial Sequence
  chemically synthesized
aagagataaggataagcaca

SEQ ID NO: 20675 - DNA, 20 bp, Artificial Sequence
  chemically synthesized
taaggataagcacaaagtcc

SEQ ID NO: 20676 - DNA, 20 bp, Artificial Sequence
  chemically synthesized
aagcacaaagtccaagaaac

SEQ ID NO: 20677 - DNA, 20 bp, Artificial Sequence
  chemically synthesized
agtccaagaaaccagttgat

SEQ ID NO: 20678 - DNA, 20 bp, Artificial Sequence
  chemically synthesized
aagaaaccagttgatgagac

SEQ ID NO: 20679 - DNA, 20 bp, Artificial Sequence
  chemically synthesized
agaaaccagttgatgagacc

SEQ ID NO: 20680 - DNA, 20 bp, Artificial Sequence
  chemically synthesized
agttgatgagaccaggacta

SEQ ID NO: 20681 - DNA, 20 bp, Artificial Sequence
  chemically synthesized
gttgatgagaccaggactat

SEQ ID NO: 20682 - DNA, 20 bp, Artificial Sequence
  chemically synthesized
gagaccaggactataggata

SEQ ID NO: 20683 - DNA, 20 bp, Artificial Sequence
  chemically synthesized
ctataggataaagtctatta

SEQ ID NO: 20684 - DNA, 20 bp, Artificial Sequence
  chemically synthesized
tataggataaagtctattaa

SEQ ID NO: 20685 - DNA, 20 bp, Artificial Sequence
  chemically synthesized
tattaaaggtgatgtctgca

SEQ ID NO: 20686 - DNA, 20 bp, Artificial Sequence
  chemically synthesized
attaaaggtgatgtctgcac

SEQ ID NO: 20687 - DNA, 20 bp, Artificial Sequence
  chemically synthesized
aaggtgatgtctgcacaggc

SEQ ID NO: 20688 - DNA, 20 bp, Artificial Sequence
  chemically synthesized
caggccagtttgatcacatc

SEQ ID NO: 20689 - DNA, 20 bp, Artificial Sequence
  chemically synthesized
cagtttgatcacatctggtg

SEQ ID NO: 20690 - DNA, 20 bp, Artificial Sequence
  chemically synthesized
agtttgatcacatctggtgc

SEQ ID NO: 20691 - DNA, 20 bp, Artificial Sequence
  chemically synthesized
ttgatcacatctggtgcagg

SEQ ID NO: 20692 - DNA, 20 bp, Artificial Sequence
  chemically synthesized
tcacatctggtgcaggcaga

SEQ ID NO: 20693 - DNA, 20 bp, Artificial Sequence
  chemically synthesized
tctggtgcaggcagaaagca

SEQ ID NO: 20694 - DNA, 20 bp, Artificial Sequence
  chemically synthesized
ctggtgcaggcagaaagcat

SEQ ID NO: 20695 - DNA, 20 bp, Artificial Sequence
  chemically synthesized
ggtgcaggcagaaagcatgg

SEQ ID NO: 20696 - DNA, 20 bp, Artificial Sequence
  chemically synthesized
tgcaggcagaaagcatggga

SEQ ID NO: 20697 - DNA, 20 bp, Artificial Sequence
  chemically synthesized
gcaggcagaaagcatgggag

SEQ ID NO: 20698 - DNA, 20 bp, Artificial Sequence
  chemically synthesized
agaaagcatgggagaggaca

SEQ ID NO: 20699 - DNA, 20 bp, Artificial Sequence
  chemically synthesized
gaaagcatgggagaggacat

SEQ ID NO: 20700 - DNA, 20 bp, Artificial Sequence
  chemically synthesized
gggagaggacatgggattga

SEQ ID NO: 20701 - DNA, 20 bp, Artificial Sequence
  chemically synthesized
agaggacatgggattgacag

SEQ ID NO: 20702 - DNA, 20 bp, Artificial Sequence
  chemically synthesized
gaggacatgggattgacagt

SEQ ID NO: 20703 - DNA, 20 bp, Artificial Sequence
  chemically synthesized
aggacatgggattgacagta

SEQ ID NO: 20704 - DNA, 20 bp, Artificial Sequence
  chemically synthesized
ggacatgggattgacagtag

SEQ ID NO: 20705 - DNA, 20 bp, Artificial Sequence
  chemically synthesized
ggattgacagtaggggaatc

SEQ ID NO: 20706 - DNA, 20 bp, Artificial Sequence
  chemically synthesized
attgacagtaggggaatcca

SEQ ID NO: 20707 - DNA, 20 bp, Artificial Sequence
  chemically synthesized
tgacagtaggggaatccaga

SEQ ID NO: 20708 - DNA, 20 bp, Artificial Sequence
  chemically synthesized
gacagtaggggaatccagag

SEQ ID NO: 20709 - DNA, 20 bp, Artificial Sequence
  chemically synthesized
acagtaggggaatccagaga

SEQ ID NO: 20710 - DNA, 20 bp, Artificial Sequence
  chemically synthesized
tccagagagggtgatgatta

SEQ ID NO: 20711 - DNA, 20 bp, Artificial Sequence
  chemically synthesized
ccagagagggtgatgattat

SEQ ID NO: 20712 - DNA, 20 bp, Artificial Sequence
  chemically synthesized
gtgatgattatgggcacaat

SEQ ID NO: 20713 - DNA, 20 bp, Artificial Sequence
  chemically synthesized
aatcccctcatttgaacccc

SEQ ID NO: 20714 - DNA, 20 bp, Artificial Sequence
  chemically synthesized
cagatctatcttcaccacct

SEQ ID NO: 20715 - DNA, 20 bp, Artificial Sequence
  chemically synthesized
tatcttcaccaccttagcat

SEQ ID NO: 20716 - DNA, 20 bp, Artificial Sequence
  chemically synthesized
ttcaccaccttagcattggt

SEQ ID NO: 20717 - DNA, 20 bp, Artificial Sequence
  chemically synthesized
caccttagcattggtgagaa

SEQ ID NO: 20718 - DNA, 20 bp, Artificial Sequence
  chemically synthesized
ccttagcattggtgagaatg

SEQ ID NO: 20719 - DNA, 20 bp, Artificial Sequence
  chemically synthesized
cttagcattggtgagaatgg

SEQ ID NO: 20720 - DNA, 20 bp, Artificial Sequence
  chemically synthesized
gtgagaatggaggtgtatct

SEQ ID NO: 20721 - DNA, 20 bp, Artificial Sequence
  chemically synthesized
tgagaatggaggtgtatctc

SEQ ID NO: 20722 - DNA, 20 bp, Artificial Sequence
  chemically synthesized
gagaatggaggtgtatctca

SEQ ID NO: 20723 - DNA, 20 bp, Artificial Sequence
  chemically synthesized
agaatggaggtgtatctcag

SEQ ID NO: 20724 - DNA, 20 bp, Artificial Sequence
  chemically synthesized
aggtgtatctcaggggatta

SEQ ID NO: 20725 - DNA, 20 bp, Artificial Sequence
  chemically synthesized
gattatggatgccaataaaa

SEQ ID NO: 20726 - DNA, 20 bp, Artificial Sequence
  chemically synthesized
ggatgccaataaaacagtca

SEQ ID NO: 20727 - DNA, 20 bp, Artificial Sequence
  chemically synthesized
gatgccaataaaacagtcat

SEQ ID NO: 20728 - DNA, 20 bp, Artificial Sequence
  chemically synthesized
aaacagtcatgggccatgat

SEQ ID NO: 20729 - DNA, 20 bp, Artificial Sequence
  chemically synthesized
ggccatgatgagcaacactc

SEQ ID NO: 20730 - DNA, 20 bp, Artificial Sequence
  chemically synthesized
caacactctggactccacga

SEQ ID NO: 20731 - DNA, 20 bp, Artificial Sequence
  chemically synthesized
acactctggactccacgata

SEQ ID NO: 20732 - DNA, 20 bp, Artificial Sequence
  chemically synthesized
actctggactccacgataga

SEQ ID NO: 20733 - DNA, 20 bp, Artificial Sequence
  chemically synthesized
ctctggactccacgatagag

SEQ ID NO: 20734 - DNA, 20 bp, Artificial Sequence
  chemically synthesized
tctggactccacgatagaga

SEQ ID NO: 20735 - DNA, 20 bp, Artificial Sequence
  chemically synthesized
tggactccacgatagagagg

SEQ ID NO: 20736 - DNA, 20 bp, Artificial Sequence
  chemically synthesized
actccacgatagagagggag

SEQ ID NO: 20737 - DNA, 20 bp, Artificial Sequence
  chemically synthesized
acgatagagagggagtggat

SEQ ID NO: 20738 - DNA, 20 bp, Artificial Sequence
  chemically synthesized
tagagagggagtggattaga

SEQ ID NO: 20739 - DNA, 20 bp, Artificial Sequence
  chemically synthesized
agagagggagtggattagat

SEQ ID NO: 20740 - DNA, 20 bp, Artificial Sequence
  chemically synthesized
gggagtggattagataggcc

SEQ ID NO: 20741 - DNA, 20 bp, Artificial Sequence
  chemically synthesized
gagtggattagataggcctg

SEQ ID NO: 20742 - DNA, 20 bp, Artificial Sequence
  chemically synthesized
agtggattagataggcctgg

SEQ ID NO: 20743 - DNA, 20 bp, Artificial Sequence
  chemically synthesized
ggattagataggcctggagg

SEQ ID NO: 20744 - DNA, 20 bp, Artificial Sequence
  chemically synthesized
ttagataggcctggaggaag

SEQ ID NO: 20745 - DNA, 20 bp, Artificial Sequence
  chemically synthesized
tagataggcctggaggaagc

SEQ ID NO: 20746 - DNA, 20 bp, Artificial Sequence
  chemically synthesized
cctggaggaagcaggctcca

SEQ ID NO: 20747 - DNA, 20 bp, Artificial Sequence
  chemically synthesized
tggctcattttcctgtgatc

SEQ ID NO: 20748 - DNA, 20 bp, Artificial Sequence
  chemically synthesized
tcattttcctgtgatctagc

SEQ ID NO: 20749 - DNA, 20 bp, Artificial Sequence
  chemically synthesized
attttcctgtgatctagcca

SEQ ID NO: 20750 - DNA, 20 bp, Artificial Sequence
  chemically synthesized
tgatctagccagagaacacc

SEQ ID NO: 20751 - DNA, 20 bp, Artificial Sequence
  chemically synthesized
gatctagccagagaacacca

SEQ ID NO: 20752 - DNA, 20 bp, Artificial Sequence
  chemically synthesized
tagccagagaacaccaagga

SEQ ID NO: 20753 - DNA, 20 bp, Artificial Sequence
  chemically synthesized
ccagagaacaccaaggacag

SEQ ID NO: 20754 - DNA, 20 bp, Artificial Sequence
  chemically synthesized
gacagtggacattgttgtca

SEQ ID NO: 20755 - DNA, 20 bp, Artificial Sequence
  chemically synthesized
attgttgtcaaagttacacc

SEQ ID NO: 20756 - DNA, 20 bp, Artificial Sequence
  chemically synthesized
ttgttgtcaaagttacacca

SEQ ID NO: 20757 - DNA, 20 bp, Artificial Sequence
  chemically synthesized
caaagttacaccaaggtcta

SEQ ID NO: 20758 - DNA, 20 bp, Artificial Sequence
  chemically synthesized
acaccaaggtctatggctgc

SEQ ID NO: 20759 - DNA, 20 bp, Artificial Sequence
  chemically synthesized
aaggtctatggctgccagta

SEQ ID NO: 20760 - DNA, 20 bp, Artificial Sequence
  chemically synthesized
tctatggctgccagtatagt

SEQ ID NO: 20761 - DNA, 20 bp, Artificial Sequence
  chemically synthesized
tatggctgccagtatagtca

SEQ ID NO: 20762 - DNA, 20 bp, Artificial Sequence
  chemically synthesized
tggctgccagtatagtcaga

SEQ ID NO: 20763 - DNA, 20 bp, Artificial Sequence
  chemically synthesized
ctgccagtatagtcagagag

SEQ ID NO: 20764 - DNA, 20 bp, Artificial Sequence
  chemically synthesized
tatagtcagagagtagtaca

SEQ ID NO: 20765 - DNA, 20 bp, Artificial Sequence
  chemically synthesized
atagtcagagagtagtacac

SEQ ID NO: 20766 - DNA, 20 bp, Artificial Sequence
  chemically synthesized
gagtagtacacgggctcatg

SEQ ID NO: 20767 - DNA, 20 bp, Artificial Sequence
  chemically synthesized
gtagtacacgggctcatgaa

SEQ ID NO: 20768 - DNA, 20 bp, Artificial Sequence
  chemically synthesized
acacgggctcatgaagagtg

SEQ ID NO: 20769 - DNA, 20 bp, Artificial Sequence
  chemically synthesized
gagtgcagtcttctctgata

SEQ ID NO: 20770 - DNA, 20 bp, Artificial Sequence
  chemically synthesized
gtgcagtcttctctgataaa

SEQ ID NO: 20771 - DNA, 20 bp, Artificial Sequence
  chemically synthesized
tgcagtcttctctgataaag

SEQ ID NO: 20772 - DNA, 20 bp, Artificial Sequence
  chemically synthesized
cagtcttctctgataaagag

SEQ ID NO: 20773 - DNA, 20 bp, Artificial Sequence
  chemically synthesized
agtcttctctgataaagagg

SEQ ID NO: 20774 - DNA, 20 bp, Artificial Sequence
  chemically synthesized
tcttctctgataaagaggag

SEQ ID NO: 20775 - DNA, 20 bp, Artificial Sequence
  chemically synthesized
cttctctgataaagaggagg

SEQ ID NO: 20776 - DNA, 20 bp, Artificial Sequence
  chemically synthesized
aggaggaggctgccattgcc

SEQ ID NO: 20777 - DNA, 20 bp, Artificial Sequence
  chemically synthesized
ggaggaggctgccattgcca

SEQ ID NO: 20778 - DNA, 20 bp, Artificial Sequence
  chemically synthesized
gctgccattgccaaggactg

SEQ ID NO: 20779 - DNA, 20 bp, Artificial Sequence
  chemically synthesized
tgccattgccaaggactgta

SEQ ID NO: 20780 - DNA, 20 bp, Artificial Sequence
  chemically synthesized
tgccaaggactgtagagaca

SEQ ID NO: 20781 - DNA, 20 bp, Artificial Sequence
  chemically synthesized
ctgtagagacatagatgata

SEQ ID NO: 20782 - DNA, 20 bp, Artificial Sequence
  chemically synthesized
tagagacatagatgataaag

SEQ ID NO: 20783 - DNA, 20 bp, Artificial Sequence
  chemically synthesized
agagacatagatgataaaga

SEQ ID NO: 20784 - DNA, 20 bp, Artificial Sequence
  chemically synthesized
agacatagatgataaagaag

SEQ ID NO: 20785 - DNA, 20 bp, Artificial Sequence
  chemically synthesized
atagatgataaagaaggaga

SEQ ID NO: 20786 - DNA, 20 bp, Artificial Sequence
  chemically synthesized
aaagaaggagatagaactcc

SEQ ID NO: 20787 - DNA, 20 bp, Artificial Sequence
  chemically synthesized
aagaaggagatagaactcca

SEQ ID NO: 20788 - DNA, 20 bp, Artificial Sequence
  chemically synthesized
ctccaaggatgaaatctctc

SEQ ID NO: 20789 - DNA, 20 bp, Artificial Sequence
  chemically synthesized
ggatgaaatctctccagacc

SEQ ID NO: 20790 - DNA, 20 bp, Artificial Sequence
  chemically synthesized
gaaatctctccagacctgga

SEQ ID NO: 20791 - DNA, 20 bp, Artificial Sequence
  chemically synthesized
tctctccagacctggaaagc

SEQ ID NO: 20792 - DNA, 20 bp, Artificial Sequence
  chemically synthesized
tccagacctggaaagccagt

SEQ ID NO: 20793 - DNA, 20 bp, Artificial Sequence
  chemically synthesized
ccagacctggaaagccagtg

SEQ ID NO: 20794 - DNA, 20 bp, Artificial Sequence
  chemically synthesized
agacctggaaagccagtgag

SEQ ID NO: 20795 - DNA, 20 bp, Artificial Sequence
  chemically synthesized
tggaaagccagtgaggagaa

SEQ ID NO: 20796 - DNA, 20 bp, Artificial Sequence
  chemically synthesized
ggaaagccagtgaggagaaa

SEQ ID NO: 20797 - DNA, 20 bp, Artificial Sequence
  chemically synthesized
gaaagccagtgaggagaaaa

SEQ ID NO: 20798 - DNA, 20 bp, Artificial Sequence
  chemically synthesized
aaagccagtgaggagaaaag

SEQ ID NO: 20799 - DNA, 20 bp, Artificial Sequence
  chemically synthesized
gccagtgaggagaaaagggg

SEQ ID NO: 20800 - DNA, 20 bp, Artificial Sequence
  chemically synthesized
agtgaggagaaaaggggcag

SEQ ID NO: 20801 - DNA, 20 bp, Artificial Sequence
  chemically synthesized
gagaaaaggggcagcagtaa

SEQ ID NO: 20802 - DNA, 20 bp, Artificial Sequence
  chemically synthesized
aaaaggggcagcagtaatgg

SEQ ID NO: 20803 - DNA, 20 bp, Artificial Sequence
  chemically synthesized
aaaggggcagcagtaatggt

SEQ ID NO: 20804 - DNA, 20 bp, Artificial Sequence
  chemically synthesized
agcagtaatggtgggtgaca

SEQ ID NO: 20805 - DNA, 20 bp, Artificial Sequence
  chemically synthesized
agtaatggtgggtgacatgg

SEQ ID NO: 20806 - DNA, 20 bp, Artificial Sequence
  chemically synthesized
gggtgacatggtggatacct

SEQ ID NO: 20807 - DNA, 20 bp, Artificial Sequence
  chemically synthesized
ggtgacatggtggatacctg

SEQ ID NO: 20808 - DNA, 20 bp, Artificial Sequence
  chemically synthesized
tgacatggtggatacctgag

SEQ ID NO: 20809 - DNA, 20 bp, Artificial Sequence
  chemically synthesized
ggagaaacaaacaaacaaaa

SEQ ID NO: 20810 - DNA, 20 bp, Artificial Sequence
  chemically synthesized
aaacaaacaaaacagctctc

SEQ ID NO: 20811 - DNA, 20 bp, Artificial Sequence
  chemically synthesized
aacaaaacagctctctagac

SEQ ID NO: 20812 - DNA, 20 bp, Artificial Sequence
  chemically synthesized
ctctctagaccagcactatg

SEQ ID NO: 20813 - DNA, 20 bp, Artificial Sequence
  chemically synthesized
tctagaccagcactatgtgg

SEQ ID NO: 20814 - DNA, 20 bp, Artificial Sequence
  chemically synthesized
ctatgtggtggaaatataat

SEQ ID NO: 20815 - DNA, 20 bp, Artificial Sequence
  chemically synthesized
atgtggtggaaatataatta

SEQ ID NO: 20816 - DNA, 20 bp, Artificial Sequence
  chemically synthesized
atatgtgatgttaaatgttc

SEQ ID NO: 20817 - DNA, 20 bp, Artificial Sequence
  chemically synthesized
tgtgatgttaaatgttctgg

SEQ ID NO: 20818 - DNA, 20 bp, Artificial Sequence
  chemically synthesized
tgttctggtagtcacattaa

SEQ ID NO: 20819 - DNA, 20 bp, Artificial Sequence
  chemically synthesized
gttctggtagtcacattaaa

SEQ ID NO: 20820 - DNA, 20 bp, Artificial Sequence
  chemically synthesized
tctggtagtcacattaaaag

SEQ ID NO: 20821 - DNA, 20 bp, Artificial Sequence
  chemically synthesized
gtcacattaaaaggagtaaa

SEQ ID NO: 20822 - DNA, 20 bp, Artificial Sequence
  chemically synthesized
attaaaaggagtaaaaagaa

SEQ ID NO: 20823 - DNA, 20 bp, Artificial Sequence
  chemically synthesized
aaaaggagtaaaaagaaaag

SEQ ID NO: 20824 - DNA, 20 bp, Artificial Sequence
  chemically synthesized
aaaagtggtaaaattaatat

SEQ ID NO: 20825 - DNA, 20 bp, Artificial Sequence
  chemically synthesized
aatattagtatgtcttattt

SEQ ID NO: 20826 - DNA, 20 bp, Artificial Sequence
  chemically synthesized
caaaaatattatcattttaa

SEQ ID NO: 20827 - DNA, 20 bp, Artificial Sequence
  chemically synthesized
ttatcattttaatagataat

SEQ ID NO: 20828 - DNA, 20 bp, Artificial Sequence
  chemically synthesized
tcagcataaaaatcatatat

SEQ ID NO: 20829 - DNA, 20 bp, Artificial Sequence
  chemically synthesized
cataaaaatcatatatgaga

SEQ ID NO: 20830 - DNA, 20 bp, Artificial Sequence
  chemically synthesized
tagttcccacgatttttttt

SEQ ID NO: 20831 - DNA, 20 bp, Artificial Sequence
  chemically synthesized
ggtacaaattcttcaaaatc

SEQ ID NO: 20832 - DNA, 20 bp, Artificial Sequence
  chemically synthesized
aaatcgagtgtttacactta

SEQ ID NO: 20833 - DNA, 20 bp, Artificial Sequence
  chemically synthesized
cttacagaaaattctgactc

SEQ ID NO: 20834 - DNA, 20 bp, Artificial Sequence
  chemically synthesized
aaattctgactcaagctaac

SEQ ID NO: 20835 - DNA, 20 bp, Artificial Sequence
  chemically synthesized
ctaaccagatgctactgttt

SEQ ID NO: 20836 - DNA, 20 bp, Artificial Sequence
  chemically synthesized
ccagatgctactgttttgga

SEQ ID NO: 20837 - DNA, 20 bp, Artificial Sequence
  chemically synthesized
tgctactgttttggacagca

SEQ ID NO: 20838 - DNA, 20 bp, Artificial Sequence
  chemically synthesized
tgttttggacagcacagctc

SEQ ID NO: 20839 - DNA, 20 bp, Artificial Sequence
  chemically synthesized
agactatacgacttcatcct

SEQ ID NO: 20840 - DNA, 20 bp, Artificial Sequence
  chemically synthesized
ttcatcctcagtttcgactc

SEQ ID NO: 20841 - DNA, 20 bp, Artificial Sequence
  chemically synthesized
gctgctttctaccacccttt

SEQ ID NO: 20842 - DNA, 20 bp, Artificial Sequence
  chemically synthesized
tgcttcatcaaaaaaatgtt

SEQ ID NO: 20843 - DNA, 20 bp, Artificial Sequence
  chemically synthesized
tttaaaactaacacatatat

SEQ ID NO: 20844 - DNA, 20 bp, Artificial Sequence
  chemically synthesized
aactaacacatatattggaa

SEQ ID NO: 20845 - DNA, 20 bp, Artificial Sequence
  chemically synthesized
aacacatatattggaaaaga

SEQ ID NO: 20846 - DNA, 20 bp, Artificial Sequence
  chemically synthesized
aagaaagtctcctctctcac

SEQ ID NO: 20847 - DNA, 20 bp, Artificial Sequence
  chemically synthesized
ctcactagctattttttaaa

SEQ ID NO: 20848 - DNA, 20 bp, Artificial Sequence
  chemically synthesized
ctattttttaaatggtgtga

SEQ ID NO: 20849 - DNA, 20 bp, Artificial Sequence
  chemically synthesized
tattttttaaatggtgtgat

SEQ ID NO: 20850 - DNA, 20 bp, Artificial Sequence
  chemically synthesized
tttaaaaacctttctaccac

SEQ ID NO: 20851 - DNA, 20 bp, Artificial Sequence
  chemically synthesized
agatttcctatcctaatttc

SEQ ID NO: 20852 - DNA, 20 bp, Artificial Sequence
  chemically synthesized
gatttcctatcctaatttct

SEQ ID NO: 20853 - DNA, 20 bp, Artificial Sequence
  chemically synthesized
atatgatacaatatcatgct

SEQ ID NO: 20854 - DNA, 20 bp, Artificial Sequence
  chemically synthesized
tatgatacaatatcatgctt

SEQ ID NO: 20855 - DNA, 20 bp, Artificial Sequence
  chemically synthesized
atgatacaatatcatgcttg

SEQ ID NO: 20856 - DNA, 20 bp, Artificial Sequence
  chemically synthesized
atatcatgcttggggttata

SEQ ID NO: 20857 - DNA, 20 bp, Artificial Sequence
  chemically synthesized
gggttatacagatgtaatta

SEQ ID NO: 20858 - DNA, 20 bp, Artificial Sequence
  chemically synthesized
gttgctgatctattgacttt

SEQ ID NO: 20859 - DNA, 20 bp, Artificial Sequence
  chemically synthesized
ttgactttgagttaattgaa

SEQ ID NO: 20860 - DNA, 20 bp, Artificial Sequence
  chemically synthesized
tgactttgagttaattgaaa

SEQ ID NO: 20861 - DNA, 20 bp, Artificial Sequence
  chemically synthesized
taattgaaaaggaaattact

SEQ ID NO: 20862 - DNA, 20 bp, Artificial Sequence
  chemically synthesized
aattgaaaaggaaattactc

SEQ ID NO: 20863 - DNA, 20 bp, Artificial Sequence
  chemically synthesized
attgaaaaggaaattactca

SEQ ID NO: 20864 - DNA, 20 bp, Artificial Sequence
  chemically synthesized
ttgaaaaggaaattactcag

SEQ ID NO: 20865 - DNA, 20 bp, Artificial Sequence
  chemically synthesized
ggaaattactcaggggaacc

SEQ ID NO: 20866 - DNA, 20 bp, Artificial Sequence
  chemically synthesized
ggaacctagtctaattccat

SEQ ID NO: 20867 - DNA, 20 bp, Artificial Sequence
  chemically synthesized
ctaattccatgagcccctaa

SEQ ID NO: 20868 - DNA, 20 bp, Artificial Sequence
  chemically synthesized
attccatgagcccctaaaag

SEQ ID NO: 20869 - DNA, 20 bp, Artificial Sequence
  chemically synthesized
tccatgagcccctaaaagca

SEQ ID NO: 20870 - DNA, 20 bp, Artificial Sequence
  chemically synthesized
ctaaaagcagagttttcacc

SEQ ID NO: 20871 - DNA, 20 bp, Artificial Sequence
  chemically synthesized
aaagcagagttttcaccaag

SEQ ID NO: 20872 - DNA, 20 bp, Artificial Sequence
  chemically synthesized
gcagagttttcaccaagtag

SEQ ID NO: 20873 - DNA, 20 bp, Artificial Sequence
  chemically synthesized
cagagttttcaccaagtagt

SEQ ID NO: 20874 - DNA, 20 bp, Artificial Sequence
  chemically synthesized
gagttttcaccaagtagtag

SEQ ID NO: 20875 - DNA, 20 bp, Artificial Sequence
  chemically synthesized
ttcaccaagtagtaggagaa

SEQ ID NO: 20876 - DNA, 20 bp, Artificial Sequence
  chemically synthesized
tcaccaagtagtaggagaat

SEQ ID NO: 20877 - DNA, 20 bp, Artificial Sequence
  chemically synthesized
ccaagtagtaggagaatagg

SEQ ID NO: 20878 - DNA, 20 bp, Artificial Sequence
  chemically synthesized
gtagtaggagaataggaagc

SEQ ID NO: 20879 - DNA, 20 bp, Artificial Sequence
  chemically synthesized
gccagacatattcaaaattt

SEQ ID NO: 20880 - DNA, 20 bp, Artificial Sequence
  chemically synthesized
gacatattcaaaatttgaga

SEQ ID NO: 20881 - DNA, 20 bp, Artificial Sequence
  chemically synthesized
acatattcaaaatttgagaa

SEQ ID NO: 20882 - DNA, 20 bp, Artificial Sequence
  chemically synthesized
caaaatttgagaaaggttca

SEQ ID NO: 20883 - DNA, 20 bp, Artificial Sequence
  chemically synthesized
aaaatttgagaaaggttcat

SEQ ID NO: 20884 - DNA, 20 bp, Artificial Sequence
  chemically synthesized
tttgagaaaggttcatgggt

SEQ ID NO: 20885 - DNA, 20 bp, Artificial Sequence
  chemically synthesized
aaggttcatgggtcagttgc

SEQ ID NO: 20886 - DNA, 20 bp, Artificial Sequence
  chemically synthesized
cagttgctggtttgaaatat

SEQ ID NO: 20887 - DNA, 20 bp, Artificial Sequence
  chemically synthesized
agttgctggtttgaaatata

SEQ ID NO: 20888 - DNA, 20 bp, Artificial Sequence
  chemically synthesized
ttgctggtttgaaatataag

SEQ ID NO: 20889 - DNA, 20 bp, Artificial Sequence
  chemically synthesized
tgctggtttgaaatataagg

SEQ ID NO: 20890 - DNA, 20 bp, Artificial Sequence
  chemically synthesized
gaaatataaggaggtcacaa

SEQ ID NO: 20891 - DNA, 20 bp, Artificial Sequence
  chemically synthesized
atataaggaggtcacaaaag

SEQ ID NO: 20892 - DNA, 20 bp, Artificial Sequence
  chemically synthesized
tataaggaggtcacaaaaga

SEQ ID NO: 20893 - DNA, 20 bp, Artificial Sequence
  chemically synthesized
ggtcacaaaagaaggaatgc

SEQ ID NO: 20894 - DNA, 20 bp, Artificial Sequence
  chemically synthesized
cacaaaagaaggaatgcaag

SEQ ID NO: 20895 - DNA, 20 bp, Artificial Sequence
  chemically synthesized
gaaggaatgcaagaagcccc

SEQ ID NO: 20896 - DNA, 20 bp, Artificial Sequence
  chemically synthesized
aaggaatgcaagaagcccct

SEQ ID NO: 20897 - DNA, 20 bp, Artificial Sequence
  chemically synthesized
atgcaagaagcccctaggta

SEQ ID NO: 20898 - DNA, 20 bp, Artificial Sequence
  chemically synthesized
agaagcccctaggtacagaa

SEQ ID NO: 20899 - DNA, 20 bp, Artificial Sequence
  chemically synthesized
gaagcccctaggtacagaac

SEQ ID NO: 20900 - DNA, 20 bp, Artificial Sequence
  chemically synthesized
taggtacagaacgggcatcc

SEQ ID NO: 20901 - DNA, 20 bp, Artificial Sequence
  chemically synthesized
agaacgggcatcctagctaa

SEQ ID NO: 20902 - DNA, 20 bp, Artificial Sequence
  chemically synthesized
aaaacaaaaacaaaaacaaa

SEQ ID NO: 20903 - DNA, 20 bp, Artificial Sequence
  chemically synthesized
aaacaaaaacaaaaacaaac

SEQ ID NO: 20904 - DNA, 20 bp, Artificial Sequence
  chemically synthesized
aacaaaaacaaaaacaaaca

SEQ ID NO: 20905 - DNA, 20 bp, Artificial Sequence
  chemically synthesized
acaaaaacaaacagggactt

SEQ ID NO: 20906 - DNA, 20 bp, Artificial Sequence
  chemically synthesized
aaaaacaaacagggacttca

SEQ ID NO: 20907 - DNA, 20 bp, Artificial Sequence
  chemically synthesized
caaacagggacttcagagtt

SEQ ID NO: 20908 - DNA, 20 bp, Artificial Sequence
  chemically synthesized
acagggacttcagagttcag

SEQ ID NO: 20909 - DNA, 20 bp, Artificial Sequence
  chemically synthesized
gggacttcagagttcagcag

SEQ ID NO: 20910 - DNA, 20 bp, Artificial Sequence
  chemically synthesized
ggacttcagagttcagcagt

SEQ ID NO: 20911 - DNA, 20 bp, Artificial Sequence
  chemically synthesized
agtaggaaactgaactctga

SEQ ID NO: 20912 - DNA, 20 bp, Artificial Sequence
  chemically synthesized
ggaaactgaactctgacagc

SEQ ID NO: 20913 - DNA, 20 bp, Artificial Sequence
  chemically synthesized
gaaactgaactctgacagcc

SEQ ID NO: 20914 - DNA, 20 bp, Artificial Sequence
  chemically synthesized
actctgacagccgggtgcaa

SEQ ID NO: 20915 - DNA, 20 bp, Artificial Sequence
  chemically synthesized
ccgggtgcaatggctcattc

SEQ ID NO: 20916 - DNA, 20 bp, Artificial Sequence
  chemically synthesized
ctcattcaagcctgtaatcc

SEQ ID NO: 20917 - DNA, 20 bp, Artificial Sequence
  chemically synthesized
agcctgtaatcccagcactt

SEQ ID NO: 20918 - DNA, 20 bp, Artificial Sequence
  chemically synthesized
gcctgtaatcccagcacttt

SEQ ID NO: 20919 - DNA, 20 bp, Artificial Sequence
  chemically synthesized
ctgtaatcccagcactttgg

SEQ ID NO: 20920 - DNA, 20 bp, Artificial Sequence
  chemically synthesized
tgtaatcccagcactttggg

SEQ ID NO: 20921 - DNA, 20 bp, Artificial Sequence
  chemically synthesized
tcccagcactttgggaggcc

SEQ ID NO: 20922 - DNA, 20 bp, Artificial Sequence
  chemically synthesized
cccagcactttgggaggcca

SEQ ID NO: 20923 - DNA, 20 bp, Artificial Sequence
  chemically synthesized
agcactttgggaggccaagg

SEQ ID NO: 20924 - DNA, 20 bp, Artificial Sequence
  chemically synthesized
gcactttgggaggccaaggc

SEQ ID NO: 20925 - DNA, 20 bp, Artificial Sequence
  chemically synthesized
ctttgggaggccaaggcggg

SEQ ID NO: 20926 - DNA, 20 bp, Artificial Sequence
  chemically synthesized
ccaaggcgggcggatcacct

SEQ ID NO: 20927 - DNA, 20 bp, Artificial Sequence
  chemically synthesized
caaggcgggcggatcacctg

SEQ ID NO: 20928 - DNA, 20 bp, Artificial Sequence
  chemically synthesized
gcgggcggatcacctgaggt

SEQ ID NO: 20929 - DNA, 20 bp, Artificial Sequence
  chemically synthesized
cgggcggatcacctgaggtc

SEQ ID NO: 20930 - DNA, 20 bp, Artificial Sequence
  chemically synthesized
ggcggatcacctgaggtcag

SEQ ID NO: 20931 - DNA, 20 bp, Artificial Sequence
  chemically synthesized
tcacctgaggtcaggagttc

SEQ ID NO: 20932 - DNA, 20 bp, Artificial Sequence
  chemically synthesized
tgaggtcaggagttccagac

SEQ ID NO: 20933 - DNA, 20 bp, Artificial Sequence
  chemically synthesized
tcaggagttccagaccagcc

SEQ ID NO: 20934 - DNA, 20 bp, Artificial Sequence
  chemically synthesized
ccagaccagcctggccaaca

SEQ ID NO: 20935 - DNA, 20 bp, Artificial Sequence
  chemically synthesized
ctaccaaaaaatataaaaat

SEQ ID NO: 20936 - DNA, 20 bp, Artificial Sequence
  chemically synthesized
caaaaaatataaaaattagc

SEQ ID NO: 20937 - DNA, 20 bp, Artificial Sequence
  chemically synthesized
aaaaaatataaaaattagcc

SEQ ID NO: 20938 - DNA, 20 bp, Artificial Sequence
  chemically synthesized
atataaaaattagccaggtg

SEQ ID NO: 20939 - DNA, 20 bp, Artificial Sequence
  chemically synthesized
aaattagccaggtgtggttg

SEQ ID NO: 20940 - DNA, 20 bp, Artificial Sequence
  chemically synthesized
ggtgtggttgcagttgcctg

SEQ ID NO: 20941 - DNA, 20 bp, Artificial Sequence
  chemically synthesized
gttgcagttgcctgtagttc

SEQ ID NO: 20942 - DNA, 20 bp, Artificial Sequence
  chemically synthesized
tgcctgtagttccagctact

SEQ ID NO: 20943 - DNA, 20 bp, Artificial Sequence
  chemically synthesized
gcctgtagttccagctactt

SEQ ID NO: 20944 - DNA, 20 bp, Artificial Sequence
  chemically synthesized
ttccagctacttgggaaact

SEQ ID NO: 20945 - DNA, 20 bp, Artificial Sequence
  chemically synthesized
tccagctacttgggaaactg

SEQ ID NO: 20946 - DNA, 20 bp, Artificial Sequence
  chemically synthesized
agctacttgggaaactgagg

SEQ ID NO: 20947 - DNA, 20 bp, Artificial Sequence
  chemically synthesized
gctacttgggaaactgaggc

SEQ ID NO: 20948 - DNA, 20 bp, Artificial Sequence
  chemically synthesized
tacttgggaaactgaggcag

SEQ ID NO: 20949 - DNA, 20 bp, Artificial Sequence
  chemically synthesized
gcaggagaattgcttgaacc

SEQ ID NO: 20950 - DNA, 20 bp, Artificial Sequence
  chemically synthesized
caggagaattgcttgaaccc

SEQ ID NO: 20951 - DNA, 20 bp, Artificial Sequence
  chemically synthesized
ggagaattgcttgaacccgg

SEQ ID NO: 20952 - DNA, 20 bp, Artificial Sequence
  chemically synthesized
gagaattgcttgaacccggg

SEQ ID NO: 20953 - DNA, 20 bp, Artificial Sequence
  chemically synthesized
ttgcttgaacccgggaggca

SEQ ID NO: 20954 - DNA, 20 bp, Artificial Sequence
  chemically synthesized
tgcttgaacccgggaggcac

SEQ ID NO: 20955 - DNA, 20 bp, Artificial Sequence
  chemically synthesized
aacccgggaggcacaggttg

SEQ ID NO: 20956 - DNA, 20 bp, Artificial Sequence
  chemically synthesized
acccgggaggcacaggttgc

SEQ ID NO: 20957 - DNA, 20 bp, Artificial Sequence
  chemically synthesized
cccgggaggcacaggttgca

SEQ ID NO: 20958 - DNA, 20 bp, Artificial Sequence
  chemically synthesized
cgggaggcacaggttgcagg

SEQ ID NO: 20959 - DNA, 20 bp, Artificial Sequence
  chemically synthesized
aggcacaggttgcagggagc

SEQ ID NO: 20960 - DNA, 20 bp, Artificial Sequence
  chemically synthesized
gcacaggttgcagggagcaa

SEQ ID NO: 20961 - DNA, 20 bp, Artificial Sequence
  chemically synthesized
gagattgtgccactgcactc

SEQ ID NO: 20962 - DNA, 20 bp, Artificial Sequence
  chemically synthesized
agattgtgccactgcactcc

SEQ ID NO: 20963 - DNA, 20 bp, Artificial Sequence
  chemically synthesized
tgtgccactgcactccaggc

SEQ ID NO: 20964 - DNA, 20 bp, Artificial Sequence
  chemically synthesized
gtgccactgcactccaggct

SEQ ID NO: 20965 - DNA, 20 bp, Artificial Sequence
  chemically synthesized
ctgcactccaggctgggtga

SEQ ID NO: 20966 - DNA, 20 bp, Artificial Sequence
  chemically synthesized
gcactccaggctgggtgaca

SEQ ID NO: 20967 - DNA, 20 bp, Artificial Sequence
  chemically synthesized
tccaggctgggtgacagagc

SEQ ID NO: 20968 - DNA, 20 bp, Artificial Sequence
  chemically synthesized
tcaaaaaaaaaaaaaaaaaa

SEQ ID NO: 20969 - DNA, 20 bp, Artificial Sequence
  chemically synthesized
aaaaaaaaaaaagaaaaaaa

SEQ ID NO: 20970 - DNA, 20 bp, Artificial Sequence
  chemically synthesized
aaaagaaaaaaaaagaaact

SEQ ID NO: 20971 - DNA, 20 bp, Artificial Sequence
  chemically synthesized
gactacaatctgaatgaacg

SEQ ID NO: 20972 - DNA, 20 bp, Artificial Sequence
  chemically synthesized
tacaatctgaatgaacgtgg

SEQ ID NO: 20973 - DNA, 20 bp, Artificial Sequence
  chemically synthesized
cgtggaagcgaattcttccc

SEQ ID NO: 20974 - DNA, 20 bp, Artificial Sequence
  chemically synthesized
tggaagcgaattcttcccca

SEQ ID NO: 20975 - DNA, 20 bp, Artificial Sequence
  chemically synthesized
gaattcttccccagagcctt

SEQ ID NO: 20976 - DNA, 20 bp, Artificial Sequence
  chemically synthesized
cttccccagagcctttggat

SEQ ID NO: 20977 - DNA, 20 bp, Artificial Sequence
  chemically synthesized
tccccagagcctttggataa

SEQ ID NO: 20978 - DNA, 20 bp, Artificial Sequence
  chemically synthesized
agagcctttggataagagcc

SEQ ID NO: 20979 - DNA, 20 bp, Artificial Sequence
  chemically synthesized
atttgaccttatgataccct

SEQ ID NO: 20980 - DNA, 20 bp, Artificial Sequence
  chemically synthesized
tgaccttatgataccctaag

SEQ ID NO: 20981 - DNA, 20 bp, Artificial Sequence
  chemically synthesized
accttatgataccctaagca

SEQ ID NO: 20982 - DNA, 20 bp, Artificial Sequence
  chemically synthesized
gataccctaagcagagaact

SEQ ID NO: 20983 - DNA, 20 bp, Artificial Sequence
  chemically synthesized
cctaagcagagaactcagtt

SEQ ID NO: 20984 - DNA, 20 bp, Artificial Sequence
  chemically synthesized
gagaactcagttaagcctat

SEQ ID NO: 20985 - DNA, 20 bp, Artificial Sequence
  chemically synthesized
gaactcagttaagcctatga

SEQ ID NO: 20986 - DNA, 20 bp, Artificial Sequence
  chemically synthesized
cagttaagcctatgagagtg

SEQ ID NO: 20987 - DNA, 20 bp, Artificial Sequence
  chemically synthesized
cctatgagagtgcagaccta

SEQ ID NO: 20988 - DNA, 20 bp, Artificial Sequence
  chemically synthesized
taataaactaataatgtttg

SEQ ID NO: 20989 - DNA, 20 bp, Artificial Sequence
  chemically synthesized
taaactaataatgtttgaag

SEQ ID NO: 20990 - DNA, 20 bp, Artificial Sequence
  chemically synthesized
aataatgtttgaagcagctc

SEQ ID NO: 20991 - DNA, 20 bp, Artificial Sequence
  chemically synthesized
gtttgaagcagctcaagttg

SEQ ID NO: 20992 - DNA, 20 bp, Artificial Sequence
  chemically synthesized
cagtaatttatgtataacaa

SEQ ID NO: 20993 - DNA, 20 bp, Artificial Sequence
  chemically synthesized
aacaatagaaaactaatgca

SEQ ID NO: 20994 - DNA, 20 bp, Artificial Sequence
  chemically synthesized
actattatccatattttatt

SEQ ID NO: 20995 - DNA, 20 bp, Artificial Sequence
  chemically synthesized
tattatccatattttattaa

SEQ ID NO: 20996 - DNA, 20 bp, Artificial Sequence
  chemically synthesized
catattttattaagagttta

SEQ ID NO: 20997 - DNA, 20 bp, Artificial Sequence
  chemically synthesized
tattttattaagagtttata

SEQ ID NO: 20998 - DNA, 20 bp, Artificial Sequence
  chemically synthesized
ctataataaactaatattta

SEQ ID NO: 20999 - DNA, 20 bp, Artificial Sequence
  chemically synthesized
tataataaactaatatttac

SEQ ID NO: 21000 - DNA, 20 bp, Artificial Sequence
  chemically synthesized
ataataaactaatatttaca

SEQ ID NO: 21001 - DNA, 20 bp, Artificial Sequence
  chemically synthesized
gtatcatttatctattatca

SEQ ID NO: 21002 - DNA, 20 bp, Artificial Sequence
  chemically synthesized
cacagaattgtcacatcaca

SEQ ID NO: 21003 - DNA, 20 bp, Artificial Sequence
  chemically synthesized
tcacatcacaaagccctgta

SEQ ID NO: 21004 - DNA, 20 bp, Artificial Sequence
  chemically synthesized
cacaaagccctgtatagcat

SEQ ID NO: 21005 - DNA, 20 bp, Artificial Sequence
  chemically synthesized
aaagccctgtatagcatcag

SEQ ID NO: 21006 - DNA, 20 bp, Artificial Sequence
  chemically synthesized
ttatttttcactctaatgca

SEQ ID NO: 21007 - DNA, 20 bp, Artificial Sequence
  chemically synthesized
aatgcatggttcaacttatt

SEQ ID NO: 21008 - DNA, 20 bp, Artificial Sequence
  chemically synthesized
atgcatggttcaacttattt

SEQ ID NO: 21009 - DNA, 20 bp, Artificial Sequence
  chemically synthesized
atggttcaacttatttaggc

SEQ ID NO: 21010 - DNA, 20 bp, Artificial Sequence
  chemically synthesized
tggttcaacttatttaggct

SEQ ID NO: 21011 - DNA, 20 bp, Artificial Sequence
  chemically synthesized
caacttatttaggctgggct

SEQ ID NO: 21012 - DNA, 20 bp, Artificial Sequence
  chemically synthesized
ttatttaggctgggcttggc

SEQ ID NO: 21013 - DNA, 20 bp, Artificial Sequence
  chemically synthesized
tatttaggctgggcttggct

SEQ ID NO: 21014 - DNA, 20 bp, Artificial Sequence
  chemically synthesized
ttaggctgggcttggctggg

SEQ ID NO: 21015 - DNA, 20 bp, Artificial Sequence
  chemically synthesized
tcatttctgcaccatctgct

SEQ ID NO: 21016 - DNA, 20 bp, Artificial Sequence
  chemically synthesized
catttctgcaccatctgctc

SEQ ID NO: 21017 - DNA, 20 bp, Artificial Sequence
  chemically synthesized
gcaccatctgctcaggtaca

SEQ ID NO: 21018 - DNA, 20 bp, Artificial Sequence
  chemically synthesized
caccatctgctcaggtacat

SEQ ID NO: 21019 - DNA, 20 bp, Artificial Sequence
  chemically synthesized
accatctgctcaggtacata

SEQ ID NO: 21020 - DNA, 20 bp, Artificial Sequence
  chemically synthesized
ctgctcaggtacatagggtg

SEQ ID NO: 21021 - DNA, 20 bp, Artificial Sequence
  chemically synthesized
tgccctctctaactaaaccc

SEQ ID NO: 21022 - DNA, 20 bp, Artificial Sequence
  chemically synthesized
gatgtctcttttgcatcacc

SEQ ID NO: 21023 - DNA, 20 bp, Artificial Sequence
  chemically synthesized
cttttgcatcacccagactt

SEQ ID NO: 21024 - DNA, 20 bp, Artificial Sequence
  chemically synthesized
ccagactttagcataaaact

SEQ ID NO: 21025 - DNA, 20 bp, Artificial Sequence
  chemically synthesized
tactgtttacattcttttac

SEQ ID NO: 21026 - DNA, 20 bp, Artificial Sequence
  chemically synthesized
acattcttttactagtctct

SEQ ID NO: 21027 - DNA, 20 bp, Artificial Sequence
  chemically synthesized
ttttactagtctctcagacc

SEQ ID NO: 21028 - DNA, 20 bp, Artificial Sequence
  chemically synthesized
tactagtctctcagacctag

SEQ ID NO: 21029 - DNA, 20 bp, Artificial Sequence
  chemically synthesized
ctagtggctctaactcattg

SEQ ID NO: 21030 - DNA, 20 bp, Artificial Sequence
  chemically synthesized
actcattgtagtaaaaaaca

SEQ ID NO: 21031 - DNA, 20 bp, Artificial Sequence
  chemically synthesized
ctaacattgcttactttact

SEQ ID NO: 21032 - DNA, 20 bp, Artificial Sequence
  chemically synthesized
gtgttgtattaacacaccaa

SEQ ID NO: 21033 - DNA, 20 bp, Artificial Sequence
  chemically synthesized
tattaacacaccaatggccc

SEQ ID NO: 21034 - DNA, 20 bp, Artificial Sequence
  chemically synthesized
taacacaccaatggccctgg

SEQ ID NO: 21035 - DNA, 20 bp, Artificial Sequence
  chemically synthesized
aatggccctggaagcaatga

SEQ ID NO: 21036 - DNA, 20 bp, Artificial Sequence
  chemically synthesized
tggccctggaagcaatgaca

SEQ ID NO: 21037 - DNA, 20 bp, Artificial Sequence
  chemically synthesized
gagtttgacatattgattgt

SEQ ID NO: 21038 - DNA, 20 bp, Artificial Sequence
  chemically synthesized
agtttgacatattgattgta

SEQ ID NO: 21039 - DNA, 20 bp, Artificial Sequence
  chemically synthesized
cacattgatcactaactgac

SEQ ID NO: 21040 - DNA, 20 bp, Artificial Sequence
  chemically synthesized
tgctgattgttaaactgact

SEQ ID NO: 21041 - DNA, 20 bp, Artificial Sequence
  chemically synthesized
gctgattgttaaactgactt

SEQ ID NO: 21042 - DNA, 20 bp, Artificial Sequence
  chemically synthesized
attgttaaactgacttaggt

SEQ ID NO: 21043 - DNA, 20 bp, Artificial Sequence
  chemically synthesized
taaactgacttaggtaagaa

SEQ ID NO: 21044 - DNA, 20 bp, Artificial Sequence
  chemically synthesized
aatattactaatatactaat

SEQ ID NO: 21045 - DNA, 20 bp, Artificial Sequence
  chemically synthesized
atactaattggctaatatat

SEQ ID NO: 21046 - DNA, 20 bp, Artificial Sequence
  chemically synthesized
taatatataagctgaaaatg

SEQ ID NO: 21047 - DNA, 20 bp, Artificial Sequence
  chemically synthesized
aatatataagctgaaaatgt

SEQ ID NO: 21048 - DNA, 20 bp, Artificial Sequence
  chemically synthesized
tatataagctgaaaatgtgg

SEQ ID NO: 21049 - DNA, 20 bp, Artificial Sequence
  chemically synthesized
ctgaaaatgtgggagctaca

SEQ ID NO: 21050 - DNA, 20 bp, Artificial Sequence
  chemically synthesized
aaaatgtgggagctacaaag

SEQ ID NO: 21051 - DNA, 20 bp, Artificial Sequence
  chemically synthesized
aatgtgggagctacaaagta

SEQ ID NO: 21052 - DNA, 20 bp, Artificial Sequence
  chemically synthesized
atgtgggagctacaaagtag

SEQ ID NO: 21053 - DNA, 20 bp, Artificial Sequence
  chemically synthesized
gtgggagctacaaagtagag

SEQ ID NO: 21054 - DNA, 20 bp, Artificial Sequence
  chemically synthesized
tgggagctacaaagtagagg

SEQ ID NO: 21055 - DNA, 20 bp, Artificial Sequence
  chemically synthesized
gagctacaaagtagaggagg

SEQ ID NO: 21056 - DNA, 20 bp, Artificial Sequence
  chemically synthesized
ctacaaagtagaggaggaag

SEQ ID NO: 21057 - DNA, 20 bp, Artificial Sequence
  chemically synthesized
tacaaagtagaggaggaaga

SEQ ID NO: 21058 - DNA, 20 bp, Artificial Sequence
  chemically synthesized
aaagtagaggaggaagaagg

SEQ ID NO: 21059 - DNA, 20 bp, Artificial Sequence
  chemically synthesized
tagaggaggaagaaggcaga

SEQ ID NO: 21060 - DNA, 20 bp, Artificial Sequence
  chemically synthesized
agaggaggaagaaggcagaa

SEQ ID NO: 21061 - DNA, 20 bp, Artificial Sequence
  chemically synthesized
gaggaggaagaaggcagaaa

SEQ ID NO: 21062 - DNA, 20 bp, Artificial Sequence
  chemically synthesized
aagaaggcagaaagggaaca

SEQ ID NO: 21063 - DNA, 20 bp, Artificial Sequence
  chemically synthesized
agaaggcagaaagggaacat

SEQ ID NO: 21064 - DNA, 20 bp, Artificial Sequence
  chemically synthesized
aggcagaaagggaacatagg

SEQ ID NO: 21065 - DNA, 20 bp, Artificial Sequence
  chemically synthesized
aagggaacataggtggatgt

SEQ ID NO: 21066 - DNA, 20 bp, Artificial Sequence
  chemically synthesized
gaacataggtggatgtaaga

SEQ ID NO: 21067 - DNA, 20 bp, Artificial Sequence
  chemically synthesized
acataggtggatgtaagata

SEQ ID NO: 21068 - DNA, 20 bp, Artificial Sequence
  chemically synthesized
gatgtaagatagagaaaact

SEQ ID NO: 21069 - DNA, 20 bp, Artificial Sequence
  chemically synthesized
aagatagagaaaactgagcc

SEQ ID NO: 21070 - DNA, 20 bp, Artificial Sequence
  chemically synthesized
gatagagaaaactgagccta

SEQ ID NO: 21071 - DNA, 20 bp, Artificial Sequence
  chemically synthesized
tgagcctagagaactgcatc

SEQ ID NO: 21072 - DNA, 20 bp, Artificial Sequence
  chemically synthesized
agcctagagaactgcatcaa

SEQ ID NO: 21073 - DNA, 20 bp, Artificial Sequence
  chemically synthesized
gcctagagaactgcatcaag

SEQ ID NO: 21074 - DNA, 20 bp, Artificial Sequence
  chemically synthesized
ctagagaactgcatcaagag

SEQ ID NO: 21075 - DNA, 20 bp, Artificial Sequence
  chemically synthesized
tagagaactgcatcaagagg

SEQ ID NO: 21076 - DNA, 20 bp, Artificial Sequence
  chemically synthesized
gagaactgcatcaagaggag

SEQ ID NO: 21077 - DNA, 20 bp, Artificial Sequence
  chemically synthesized
agaactgcatcaagaggagg

SEQ ID NO: 21078 - DNA, 20 bp, Artificial Sequence
  chemically synthesized
aactgcatcaagaggaggag

SEQ ID NO: 21079 - DNA, 20 bp, Artificial Sequence
  chemically synthesized
ctgcatcaagaggaggagga

SEQ ID NO: 21080 - DNA, 20 bp, Artificial Sequence
  chemically synthesized
tgcatcaagaggaggaggag

SEQ ID NO: 21081 - DNA, 20 bp, Artificial Sequence
  chemically synthesized
atcaagaggaggaggagagg

SEQ ID NO: 21082 - DNA, 20 bp, Artificial Sequence
  chemically synthesized
gaggaggaggagaggtagta

SEQ ID NO: 21083 - DNA, 20 bp, Artificial Sequence
  chemically synthesized
ggaggaggagaggtagtata

SEQ ID NO: 21084 - DNA, 20 bp, Artificial Sequence
  chemically synthesized
agaggtagtatagagaccta

SEQ ID NO: 21085 - DNA, 20 bp, Artificial Sequence
  chemically synthesized
gaggtagtatagagacctac

SEQ ID NO: 21086 - DNA, 20 bp, Artificial Sequence
  chemically synthesized
atagagacctacaggtgtca

SEQ ID NO: 21087 - DNA, 20 bp, Artificial Sequence
  chemically synthesized
ccaccctgcacattcactcc

SEQ ID NO: 21088 - DNA, 20 bp, Artificial Sequence
  chemically synthesized
accctgcacattcactccca

SEQ ID NO: 21089 - DNA, 20 bp, Artificial Sequence
  chemically synthesized
tgcacattcactcccagagt

SEQ ID NO: 21090 - DNA, 20 bp, Artificial Sequence
  chemically synthesized
ttcctctcctgcctcttcca

SEQ ID NO: 21091 - DNA, 20 bp, Artificial Sequence
  chemically synthesized
tccaaagaaaatttctattg

SEQ ID NO: 21092 - DNA, 20 bp, Artificial Sequence
  chemically synthesized
ccaaagaaaatttctattgt

SEQ ID NO: 21093 - DNA, 20 bp, Artificial Sequence
  chemically synthesized
gaaaatttctattgtaggaa

SEQ ID NO: 21094 - DNA, 20 bp, Artificial Sequence
  chemically synthesized
tgtaggaaaagtgttcttaa

SEQ ID NO: 21095 - DNA, 20 bp, Artificial Sequence
  chemically synthesized
aaagtgttcttaatagcgct

SEQ ID NO: 21096 - DNA, 20 bp, Artificial Sequence
  chemically synthesized
cttaatagcgctgagctaac

SEQ ID NO: 21097 - DNA, 20 bp, Artificial Sequence
  chemically synthesized
gctgagctaacaagaacttc

SEQ ID NO: 21098 - DNA, 20 bp, Artificial Sequence
  chemically synthesized
agaacttctagatatcaact

SEQ ID NO: 21099 - DNA, 20 bp, Artificial Sequence
  chemically synthesized
gaactcttaattattcatgt

SEQ ID NO: 21100 - DNA, 20 bp, Artificial Sequence
  chemically synthesized
taaaactactgtttttattt

SEQ ID NO: 21101 - DNA, 20 bp, Artificial Sequence
  chemically synthesized
aaactactgtttttatttca

SEQ ID NO: 21102 - DNA, 20 bp, Artificial Sequence
  chemically synthesized
atttcagagttaacatttgc

SEQ ID NO: 21103 - DNA, 20 bp, Artificial Sequence
  chemically synthesized
tttcagagttaacatttgct

SEQ ID NO: 21104 - DNA, 20 bp, Artificial Sequence
  chemically synthesized
cagagttaacatttgctagg

SEQ ID NO: 21105 - DNA, 20 bp, Artificial Sequence
  chemically synthesized
aggaagttgaacttttatgt

SEQ ID NO: 21106 - DNA, 20 bp, Artificial Sequence
  chemically synthesized
gaagttgaacttttatgttg

SEQ ID NO: 21107 - DNA, 20 bp, Artificial Sequence
  chemically synthesized
aagttgaacttttatgttgg

SEQ ID NO: 21108 - DNA, 20 bp, Artificial Sequence
  chemically synthesized
atgttggaggttgatacacc

SEQ ID NO: 21109 - DNA, 20 bp, Artificial Sequence
  chemically synthesized
ttggaggttgatacacccgg

SEQ ID NO: 21110 - DNA, 20 bp, Artificial Sequence
  chemically synthesized
gatacacccggcagaatctg

SEQ ID NO: 21111 - DNA, 20 bp, Artificial Sequence
  chemically synthesized
cccggcagaatctgtagata

SEQ ID NO: 21112 - DNA, 20 bp, Artificial Sequence
  chemically synthesized
accctcttgcaacaactatg

SEQ ID NO: 21113 - DNA, 20 bp, Artificial Sequence
  chemically synthesized
ctcttgcaacaactatgtgg

SEQ ID NO: 21114 - DNA, 20 bp, Artificial Sequence
  chemically synthesized
ttgcaacaactatgtggtgg

SEQ ID NO: 21115 - DNA, 20 bp, Artificial Sequence
  chemically synthesized
gcaacaactatgtggtggaa

SEQ ID NO: 21116 - DNA, 20 bp, Artificial Sequence
  chemically synthesized
tatgtggtggaagagaatcc

SEQ ID NO: 21117 - DNA, 20 bp, Artificial Sequence
  chemically synthesized
gtggtggaagagaatccaag

SEQ ID NO: 21118 - DNA, 20 bp, Artificial Sequence
  chemically synthesized
ggaagagaatccaagaagat

SEQ ID NO: 21119 - DNA, 20 bp, Artificial Sequence
  chemically synthesized
accttcattccattctccca

SEQ ID NO: 21120 - DNA, 20 bp, Artificial Sequence
  chemically synthesized
ttccattctcccatagtcac

SEQ ID NO: 21121 - DNA, 20 bp, Artificial Sequence
  chemically synthesized
ccattctcccatagtcacta

SEQ ID NO: 21122 - DNA, 20 bp, Artificial Sequence
  chemically synthesized
atagtcactagagcctgacc

SEQ ID NO: 21123 - DNA, 20 bp, Artificial Sequence
  chemically synthesized
tagtcactagagcctgacct

SEQ ID NO: 21124 - DNA, 20 bp, Artificial Sequence
  chemically synthesized
agtcactagagcctgacctg

SEQ ID NO: 21125 - DNA, 20 bp, Artificial Sequence
  chemically synthesized
tagagcctgacctggggtat

SEQ ID NO: 21126 - DNA, 20 bp, Artificial Sequence
  chemically synthesized
gacctggggtatcagaaatt

SEQ ID NO: 21127 - DNA, 20 bp, Artificial Sequence
  chemically synthesized
acctggggtatcagaaatta

SEQ ID NO: 21128 - DNA, 20 bp, Artificial Sequence
  chemically synthesized
cctggggtatcagaaattaa

SEQ ID NO: 21129 - DNA, 20 bp, Artificial Sequence
  chemically synthesized
ctggggtatcagaaattaag

SEQ ID NO: 21130 - DNA, 20 bp, Artificial Sequence
  chemically synthesized
ggggtatcagaaattaaggg

SEQ ID NO: 21131 - DNA, 20 bp, Artificial Sequence
  chemically synthesized
ggtatcagaaattaagggga

SEQ ID NO: 21132 - DNA, 20 bp, Artificial Sequence
  chemically synthesized
gtatcagaaattaaggggag

SEQ ID NO: 21133 - DNA, 20 bp, Artificial Sequence
  chemically synthesized
taaggggagaggtaattgct

SEQ ID NO: 21134 - DNA, 20 bp, Artificial Sequence
  chemically synthesized
gagaggtaattgctgagtcc

SEQ ID NO: 21135 - DNA, 20 bp, Artificial Sequence
  chemically synthesized
gtaattgctgagtcctggtg

SEQ ID NO: 21136 - DNA, 20 bp, Artificial Sequence
  chemically synthesized
ctgagtcctggtgtagaaat

SEQ ID NO: 21137 - DNA, 20 bp, Artificial Sequence
  chemically synthesized
ggtgtagaaattggtttaaa

SEQ ID NO: 21138 - DNA, 20 bp, Artificial Sequence
  chemically synthesized
tggtttaaatggtatctctg

SEQ ID NO: 21139 - DNA, 20 bp, Artificial Sequence
  chemically synthesized
gtatctctgaagactgctaa

SEQ ID NO: 21140 - DNA, 20 bp, Artificial Sequence
  chemically synthesized
tatctctgaagactgctaac

SEQ ID NO: 21141 - DNA, 20 bp, Artificial Sequence
  chemically synthesized
atctctgaagactgctaaca

SEQ ID NO: 21142 - DNA, 20 bp, Artificial Sequence
  chemically synthesized
tgctaacagggttaatttgt

SEQ ID NO: 21143 - DNA, 20 bp, Artificial Sequence
  chemically synthesized
gctaacagggttaatttgtg

SEQ ID NO: 21144 - DNA, 20 bp, Artificial Sequence
  chemically synthesized
ttgtattcaaaattgttccc

SEQ ID NO: 21145 - DNA, 20 bp, Artificial Sequence
  chemically synthesized
cccagtatctgtcttgatgc

SEQ ID NO: 21146 - DNA, 20 bp, Artificial Sequence
  chemically synthesized
ctgtcttgatgctggataat

SEQ ID NO: 21147 - DNA, 20 bp, Artificial Sequence
  chemically synthesized
tgtcttgatgctggataatt

SEQ ID NO: 21148 - DNA, 20 bp, Artificial Sequence
  chemically synthesized
atgctggataattaggctac

SEQ ID NO: 21149 - DNA, 20 bp, Artificial Sequence
  chemically synthesized
tgctggataattaggctact

SEQ ID NO: 21150 - DNA, 20 bp, Artificial Sequence
  chemically synthesized
ctactgggatattttttttc

SEQ ID NO: 21151 - DNA, 20 bp, Artificial Sequence
  chemically synthesized
attttttttcaagcctcctt

SEQ ID NO: 21152 - DNA, 20 bp, Artificial Sequence
  chemically synthesized
tttttttcaagcctcctttg

SEQ ID NO: 21153 - DNA, 20 bp, Artificial Sequence
  chemically synthesized
ttttcaagcctcctttggag

SEQ ID NO: 21154 - DNA, 20 bp, Artificial Sequence
  chemically synthesized
tttcaagcctcctttggaga

SEQ ID NO: 21155 - DNA, 20 bp, Artificial Sequence
  chemically synthesized
caagcctcctttggagaagg

SEQ ID NO: 21156 - DNA, 20 bp, Artificial Sequence
  chemically synthesized
gcctcctttggagaaggaag

SEQ ID NO: 21157 - DNA, 20 bp, Artificial Sequence
  chemically synthesized
cctcctttggagaaggaagt

SEQ ID NO: 21158 - DNA, 20 bp, Artificial Sequence
  chemically synthesized
ttggagaaggaagtgggctc

SEQ ID NO: 21159 - DNA, 20 bp, Artificial Sequence
  chemically synthesized
gctccagaactgtgttctta

SEQ ID NO: 21160 - DNA, 20 bp, Artificial Sequence
  chemically synthesized
ccccatattttctttgcaaa

SEQ ID NO: 21161 - DNA, 20 bp, Artificial Sequence
  chemically synthesized
ttttctttgcaaaaagaaaa

SEQ ID NO: 21162 - DNA, 20 bp, Artificial Sequence
  chemically synthesized
gcaaaaagaaaacagaattg

SEQ ID NO: 21163 - DNA, 20 bp, Artificial Sequence
  chemically synthesized
aacagaattgtagcttcatc

SEQ ID NO: 21164 - DNA, 20 bp, Artificial Sequence
  chemically synthesized
ttgtagcttcatccagcaca

SEQ ID NO: 21165 - DNA, 20 bp, Artificial Sequence
  chemically synthesized
tagcttcatccagcacatgg

SEQ ID NO: 21166 - DNA, 20 bp, Artificial Sequence
  chemically synthesized
gtatgattccccacctcaaa

SEQ ID NO: 21167 - DNA, 20 bp, Artificial Sequence
  chemically synthesized
tgattccccacctcaaaaag

SEQ ID NO: 21168 - DNA, 20 bp, Artificial Sequence
  chemically synthesized
ctcaaaaagaagataccgtg

SEQ ID NO: 21169 - DNA, 20 bp, Artificial Sequence
  chemically synthesized
tttgttattccttaaccctg

SEQ ID NO: 21170 - DNA, 20 bp, Artificial Sequence
  chemically synthesized
tccttaaccctgtagccaat

SEQ ID NO: 21171 - DNA, 20 bp, Artificial Sequence
  chemically synthesized
gccaataagctcactcaact

SEQ ID NO: 21172 - DNA, 20 bp, Artificial Sequence
  chemically synthesized
aagctcactcaacttagaca

SEQ ID NO: 21173 - DNA, 20 bp, Artificial Sequence
  chemically synthesized
cctcacacttaatcttttct

SEQ ID NO: 21174 - DNA, 20 bp, Artificial Sequence
  chemically synthesized
atcttttcttggtttcaaat

SEQ ID NO: 21175 - DNA, 20 bp, Artificial Sequence
  chemically synthesized
tgttatatatactcacaaat

SEQ ID NO: 21176 - DNA, 20 bp, Artificial Sequence
  chemically synthesized
cacaaatgagtgctgctgat

SEQ ID NO: 21177 - DNA, 20 bp, Artificial Sequence
  chemically synthesized
tgctgataagttctttcaaa

SEQ ID NO: 21178 - DNA, 20 bp, Artificial Sequence
  chemically synthesized
gataagttctttcaaacagt

SEQ ID NO: 21179 - DNA, 20 bp, Artificial Sequence
  chemically synthesized
taagcttgttttctgtctct

SEQ ID NO: 21180 - DNA, 20 bp, Artificial Sequence
  chemically synthesized
cttgttttctgtctcttggt

SEQ ID NO: 21181 - DNA, 20 bp, Artificial Sequence
  chemically synthesized
tctcttggtaagtcttgccc

SEQ ID NO: 21182 - DNA, 20 bp, Artificial Sequence
  chemically synthesized
ggtaagtcttgcccaagaat

SEQ ID NO: 21183 - DNA, 20 bp, Artificial Sequence
  chemically synthesized
taagtcttgcccaagaatca

SEQ ID NO: 21184 - DNA, 20 bp, Artificial Sequence
  chemically synthesized
agaatcagagttactgcttc

SEQ ID NO: 21185 - DNA, 20 bp, Artificial Sequence
  chemically synthesized
aatcagagttactgcttctg

SEQ ID NO: 21186 - DNA, 20 bp, Artificial Sequence
  chemically synthesized
cttctggagcaatataaatc

SEQ ID NO: 21187 - DNA, 20 bp, Artificial Sequence
  chemically synthesized
aagtttaaaaaattttattt

SEQ ID NO: 21188 - DNA, 20 bp, Artificial Sequence
  chemically synthesized
aattttatttaagtgtcctg

SEQ ID NO: 21189 - DNA, 20 bp, Artificial Sequence
  chemically synthesized
tgtcctgtagtaatgttaaa

SEQ ID NO: 21190 - DNA, 20 bp, Artificial Sequence
  chemically synthesized
gtcctgtagtaatgttaaaa

SEQ ID NO: 21191 - DNA, 20 bp, Artificial Sequence
  chemically synthesized
tcctgtagtaatgttaaaaa

SEQ ID NO: 21192 - DNA, 20 bp, Artificial Sequence
  chemically synthesized
cctgtagtaatgttaaaaag

SEQ ID NO: 21193 - DNA, 20 bp, Artificial Sequence
  chemically synthesized
gtaatgttaaaaaggggaca

SEQ ID NO: 21194 - DNA, 20 bp, Artificial Sequence
  chemically synthesized
atgttaaaaaggggacatgg

SEQ ID NO: 21195 - DNA, 20 bp, Artificial Sequence
  chemically synthesized
gttaaaaaggggacatggtg

SEQ ID NO: 21196 - DNA, 20 bp, Artificial Sequence
  chemically synthesized
ttaaaaaggggacatggtgg

SEQ ID NO: 21197 - DNA, 20 bp, Artificial Sequence
  chemically synthesized
tggaggtattctttaatccc

SEQ ID NO: 21198 - DNA, 20 bp, Artificial Sequence
  chemically synthesized
acttgaatacaatcatctca

SEQ ID NO: 21199 - DNA, 20 bp, Artificial Sequence
  chemically synthesized
acaatcatctcatagtctgt

SEQ ID NO: 21200 - DNA, 20 bp, Artificial Sequence
  chemically synthesized
aatcatctcatagtctgtca

SEQ ID NO: 21201 - DNA, 20 bp, Artificial Sequence
  chemically synthesized
tcatagtctgtcagagaaat

SEQ ID NO: 21202 - DNA, 20 bp, Artificial Sequence
  chemically synthesized
catagtctgtcagagaaata

SEQ ID NO: 21203 - DNA, 20 bp, Artificial Sequence
  chemically synthesized
tgtcagagaaataaggatct

SEQ ID NO: 21204 - DNA, 20 bp, Artificial Sequence
  chemically synthesized
gagaatttctattgtctcat

SEQ ID NO: 21205 - DNA, 20 bp, Artificial Sequence
  chemically synthesized
cttaaatcctaaatttatcc

SEQ ID NO: 21206 - DNA, 20 bp, Artificial Sequence
  chemically synthesized
cctaaatttatcctggaact

SEQ ID NO: 21207 - DNA, 20 bp, Artificial Sequence
  chemically synthesized
ctggaacttagcccaactat

SEQ ID NO: 21208 - DNA, 20 bp, Artificial Sequence
  chemically synthesized
caactatgagattttaaaat

SEQ ID NO: 21209 - DNA, 20 bp, Artificial Sequence
  chemically synthesized
atgagattttaaaatgagta

SEQ ID NO: 21210 - DNA, 20 bp, Artificial Sequence
  chemically synthesized
tgagattttaaaatgagtat

SEQ ID NO: 21211 - DNA, 20 bp, Artificial Sequence
  chemically synthesized
aaatgagtatgggtgcaatg

SEQ ID NO: 21212 - DNA, 20 bp, Artificial Sequence
  chemically synthesized
ggtgcaatgtggtgaaccat

SEQ ID NO: 21213 - DNA, 20 bp, Artificial Sequence
  chemically synthesized
gtgcaatgtggtgaaccatg

SEQ ID NO: 21214 - DNA, 20 bp, Artificial Sequence
  chemically synthesized
tgcaatgtggtgaaccatga

SEQ ID NO: 21215 - DNA, 20 bp, Artificial Sequence
  chemically synthesized
gaaccatgagggtcacattt

SEQ ID NO: 21216 - DNA, 20 bp, Artificial Sequence
  chemically synthesized
tggtgcctgacatttcacat

SEQ ID NO: 21217 - DNA, 20 bp, Artificial Sequence
  chemically synthesized
cctgacatttcacatcagtt

SEQ ID NO: 21218 - DNA, 20 bp, Artificial Sequence
  chemically synthesized
cctgaactgcattctgctca

SEQ ID NO: 21219 - DNA, 20 bp, Artificial Sequence
  chemically synthesized
ctgaactgcattctgctcat

SEQ ID NO: 21220 - DNA, 20 bp, Artificial Sequence
  chemically synthesized
tcataggtcttcctaaatgt

SEQ ID NO: 21221 - DNA, 20 bp, Artificial Sequence
  chemically synthesized
taggtcttcctaaatgtaag

SEQ ID NO: 21222 - DNA, 20 bp, Artificial Sequence
  chemically synthesized
cttcctaaatgtaagcagaa

SEQ ID NO: 21223 - DNA, 20 bp, Artificial Sequence
  chemically synthesized
cctaaatgtaagcagaatag

SEQ ID NO: 21224 - DNA, 20 bp, Artificial Sequence
  chemically synthesized
aaatgtaagcagaatagtag

SEQ ID NO: 21225 - DNA, 20 bp, Artificial Sequence
  chemically synthesized
aatgtaagcagaatagtagt

SEQ ID NO: 21226 - DNA, 20 bp, Artificial Sequence
  chemically synthesized
tagtaggaaatcatgattaa

SEQ ID NO: 21227 - DNA, 20 bp, Artificial Sequence
  chemically synthesized
aggaaatcatgattaaaagt

SEQ ID NO: 21228 - DNA, 20 bp, Artificial Sequence
  chemically synthesized
catgattaaaagtcagtctc

SEQ ID NO: 21229 - DNA, 20 bp, Artificial Sequence
  chemically synthesized
taaaagtcagtctctggaaa

SEQ ID NO: 21230 - DNA, 20 bp, Artificial Sequence
  chemically synthesized
tcagtctctggaaatggctt

SEQ ID NO: 21231 - DNA, 20 bp, Artificial Sequence
  chemically synthesized
ttgtgtgtcctctttgtact

SEQ ID NO: 21232 - DNA, 20 bp, Artificial Sequence
  chemically synthesized
ctttgtactaagttaaaatt

SEQ ID NO: 21233 - DNA, 20 bp, Artificial Sequence
  chemically synthesized
tttgtactaagttaaaattt

SEQ ID NO: 21234 - DNA, 20 bp, Artificial Sequence
  chemically synthesized
actaagttaaaatttaggtc

SEQ ID NO: 21235 - DNA, 20 bp, Artificial Sequence
  chemically synthesized
aatttaggtctggattgatt

SEQ ID NO: 21236 - DNA, 20 bp, Artificial Sequence
  chemically synthesized
atttaggtctggattgattt

SEQ ID NO: 21237 - DNA, 20 bp, Artificial Sequence
  chemically synthesized
tttaggtctggattgattta

SEQ ID NO: 21238 - DNA, 20 bp, Artificial Sequence
  chemically synthesized
ttaggtctggattgatttag

SEQ ID NO: 21239 - DNA, 20 bp, Artificial Sequence
  chemically synthesized
aggtctggattgatttaggg

SEQ ID NO: 21240 - DNA, 20 bp, Artificial Sequence
  chemically synthesized
ccatgctttgaacttaaaat

SEQ ID NO: 21241 - DNA, 20 bp, Artificial Sequence
  chemically synthesized
catgctttgaacttaaaatg

SEQ ID NO: 21242 - DNA, 20 bp, Artificial Sequence
  chemically synthesized
ctttgaacttaaaatgaggt

SEQ ID NO: 21243 - DNA, 20 bp, Artificial Sequence
  chemically synthesized
tttgaacttaaaatgaggtg

SEQ ID NO: 21244 - DNA, 20 bp, Artificial Sequence
  chemically synthesized
gaacttaaaatgaggtgagg

SEQ ID NO: 21245 - DNA, 20 bp, Artificial Sequence
  chemically synthesized
ttaaaatgaggtgaggtagt

SEQ ID NO: 21246 - DNA, 20 bp, Artificial Sequence
  chemically synthesized
aggtgaggtagtaagaccct

SEQ ID NO: 21247 - DNA, 20 bp, Artificial Sequence
  chemically synthesized
tgagataactgatttaattt

SEQ ID NO: 21248 - DNA, 20 bp, Artificial Sequence
  chemically synthesized
gagataactgatttaatttc

SEQ ID NO: 21249 - DNA, 20 bp, Artificial Sequence
  chemically synthesized
aggctgccctcccatttcat

SEQ ID NO: 21250 - DNA, 20 bp, Artificial Sequence
  chemically synthesized
ctgccctcccatttcattag

SEQ ID NO: 21251 - DNA, 20 bp, Artificial Sequence
  chemically synthesized
tgccctcccatttcattagt

SEQ ID NO: 21252 - DNA, 20 bp, Artificial Sequence
  chemically synthesized
aggtatattgaccctctcac

SEQ ID NO: 21253 - DNA, 20 bp, Artificial Sequence
  chemically synthesized
tatattgaccctctcactgg

SEQ ID NO: 21254 - DNA, 20 bp, Artificial Sequence
  chemically synthesized
cataaatatgactctattcc

SEQ ID NO: 21255 - DNA, 20 bp, Artificial Sequence
  chemically synthesized
cctggaaacatcacttatct

SEQ ID NO: 21256 - DNA, 20 bp, Artificial Sequence
  chemically synthesized
aaacatcacttatcttagaa

SEQ ID NO: 21257 - DNA, 20 bp, Artificial Sequence
  chemically synthesized
cttatcttagaacagatata

SEQ ID NO: 21258 - DNA, 20 bp, Artificial Sequence
  chemically synthesized
agatataaagtaatttcctg

SEQ ID NO: 21259 - DNA, 20 bp, Artificial Sequence
  chemically synthesized
taatttcctgcagactgccc

SEQ ID NO: 21260 - DNA, 20 bp, Artificial Sequence
  chemically synthesized
atttcctgcagactgcccca

SEQ ID NO: 21261 - DNA, 20 bp, Artificial Sequence
  chemically synthesized
cctgcagactgccccagagt

SEQ ID NO: 21262 - DNA, 20 bp, Artificial Sequence
  chemically synthesized
ctgcagactgccccagagtt

SEQ ID NO: 21263 - DNA, 20 bp, Artificial Sequence
  chemically synthesized
ttgggataaaatctcatgtg

SEQ ID NO: 21264 - DNA, 20 bp, Artificial Sequence
  chemically synthesized
ctcatgtgaagtgacactgt

SEQ ID NO: 21265 - DNA, 20 bp, Artificial Sequence
  chemically synthesized
atgtgaagtgacactgttgg

SEQ ID NO: 21266 - DNA, 20 bp, Artificial Sequence
  chemically synthesized
gtgaagtgacactgttggtg

SEQ ID NO: 21267 - DNA, 20 bp, Artificial Sequence
  chemically synthesized
tgaagtgacactgttggtgg

SEQ ID NO: 21268 - DNA, 20 bp, Artificial Sequence
  chemically synthesized
tgacactgttggtggaggat

SEQ ID NO: 21269 - DNA, 20 bp, Artificial Sequence
  chemically synthesized
gttggtggaggataagcctc

SEQ ID NO: 21270 - DNA, 20 bp, Artificial Sequence
  chemically synthesized
tggtggaggataagcctcca

SEQ ID NO: 21271 - DNA, 20 bp, Artificial Sequence
  chemically synthesized
gaggataagcctccagagaa

SEQ ID NO: 21272 - DNA, 20 bp, Artificial Sequence
  chemically synthesized
aggataagcctccagagaat

SEQ ID NO: 21273 - DNA, 20 bp, Artificial Sequence
  chemically synthesized
agaatgggaacaactattat

SEQ ID NO: 21274 - DNA, 20 bp, Artificial Sequence
  chemically synthesized
ctattatcagccaacactca

SEQ ID NO: 21275 - DNA, 20 bp, Artificial Sequence
  chemically synthesized
agccaacactcaaagtcacc

SEQ ID NO: 21276 - DNA, 20 bp, Artificial Sequence
  chemically synthesized
acactcaaagtcaccaagct

SEQ ID NO: 21277 - DNA, 20 bp, Artificial Sequence
  chemically synthesized
cactcaaagtcaccaagctt

SEQ ID NO: 21278 - DNA, 20 bp, Artificial Sequence
  chemically synthesized
actcaaagtcaccaagctta

SEQ ID NO: 21279 - DNA, 20 bp, Artificial Sequence
  chemically synthesized
ctcaaagtcaccaagcttag

SEQ ID NO: 21280 - DNA, 20 bp, Artificial Sequence
  chemically synthesized
gtcaccaagcttaggggcac

SEQ ID NO: 21281 - DNA, 20 bp, Artificial Sequence
  chemically synthesized
tcaccaagcttaggggcact

SEQ ID NO: 21282 - DNA, 20 bp, Artificial Sequence
  chemically synthesized
accaagcttaggggcactgg

SEQ ID NO: 21283 - DNA, 20 bp, Artificial Sequence
  chemically synthesized
ccaagcttaggggcactggg

SEQ ID NO: 21284 - DNA, 20 bp, Artificial Sequence
  chemically synthesized
agcttaggggcactgggagg

SEQ ID NO: 21285 - DNA, 20 bp, Artificial Sequence
  chemically synthesized
ttaggggcactgggaggaag

SEQ ID NO: 21286 - DNA, 20 bp, Artificial Sequence
  chemically synthesized
taggggcactgggaggaagt

SEQ ID NO: 21287 - DNA, 20 bp, Artificial Sequence
  chemically synthesized
gggcactgggaggaagtagg

SEQ ID NO: 21288 - DNA, 20 bp, Artificial Sequence
  chemically synthesized
ggcactgggaggaagtaggc

SEQ ID NO: 21289 - DNA, 20 bp, Artificial Sequence
  chemically synthesized
gcactgggaggaagtaggca

SEQ ID NO: 21290 - DNA, 20 bp, Artificial Sequence
  chemically synthesized
atatcttctatttccttaaa

SEQ ID NO: 21291 - DNA, 20 bp, Artificial Sequence
  chemically synthesized
ctctcattcatgtattttct

SEQ ID NO: 21292 - DNA, 20 bp, Artificial Sequence
  chemically synthesized
ttcctgctgtattgcctgtg

SEQ ID NO: 21293 - DNA, 20 bp, Artificial Sequence
  chemically synthesized
gctgtattgcctgtgaagta

SEQ ID NO: 21294 - DNA, 20 bp, Artificial Sequence
  chemically synthesized
tgaagtaaagtatcatgtca

SEQ ID NO: 21295 - DNA, 20 bp, Artificial Sequence
  chemically synthesized
agtaaagtatcatgtcacag

SEQ ID NO: 21296 - DNA, 20 bp, Artificial Sequence
  chemically synthesized
atgtcacagcagcataatct

SEQ ID NO: 21297 - DNA, 20 bp, Artificial Sequence
  chemically synthesized
acagcagcataatctcagat

SEQ ID NO: 21298 - DNA, 20 bp, Artificial Sequence
  chemically synthesized
cagcagcataatctcagatt

SEQ ID NO: 21299 - DNA, 20 bp, Artificial Sequence
  chemically synthesized
cagcataatctcagattggg

SEQ ID NO: 21300 - DNA, 20 bp, Artificial Sequence
  chemically synthesized
agcataatctcagattggga

SEQ ID NO: 21301 - DNA, 20 bp, Artificial Sequence
  chemically synthesized
acctccatctcctgtaataa

SEQ ID NO: 21302 - DNA, 20 bp, Artificial Sequence
  chemically synthesized
aataaaagccttctttgatg

SEQ ID NO: 21303 - DNA, 20 bp, Artificial Sequence
  chemically synthesized
ttgatgcagtgtttcctgac

SEQ ID NO: 21304 - DNA, 20 bp, Artificial Sequence
  chemically synthesized
tgatgcagtgtttcctgaca

SEQ ID NO: 21305 - DNA, 20 bp, Artificial Sequence
  chemically synthesized
gatgcagtgtttcctgacaa

SEQ ID NO: 21306 - DNA, 20 bp, Artificial Sequence
  chemically synthesized
cctgacaagggtcatccgct

SEQ ID NO: 21307 - DNA, 20 bp, Artificial Sequence
  chemically synthesized
tcacataacacaatatttat

SEQ ID NO: 21308 - DNA, 20 bp, Artificial Sequence
  chemically synthesized
atatctgtgctgaaaatact

SEQ ID NO: 21309 - DNA, 20 bp, Artificial Sequence
  chemically synthesized
tatctgtgctgaaaatactc

SEQ ID NO: 21310 - DNA, 20 bp, Artificial Sequence
  chemically synthesized
ctgtgctgaaaatactcagg

SEQ ID NO: 21311 - DNA, 20 bp, Artificial Sequence
  chemically synthesized
tactcaggcagccacattat

SEQ ID NO: 21312 - DNA, 20 bp, Artificial Sequence
  chemically synthesized
ttaaaatgaaaatatttttc

SEQ ID NO: 21313 - DNA, 20 bp, Artificial Sequence
  chemically synthesized
tttctggtcttcctattcct

SEQ ID NO: 21314 - DNA, 20 bp, Artificial Sequence
  chemically synthesized
tcttcctattccttggctct

SEQ ID NO: 21315 - DNA, 20 bp, Artificial Sequence
  chemically synthesized
tattccttggctcttggtct

SEQ ID NO: 21316 - DNA, 20 bp, Artificial Sequence
  chemically synthesized
ttggctcttggtctgagctc

SEQ ID NO: 21317 - DNA, 20 bp, Artificial Sequence
  chemically synthesized
tggtctgagctctggcatca

SEQ ID NO: 21318 - DNA, 20 bp, Artificial Sequence
  chemically synthesized
ctgctgccttatattacata

SEQ ID NO: 21319 - DNA, 20 bp, Artificial Sequence
  chemically synthesized
cttatattacatatggcata

SEQ ID NO: 21320 - DNA, 20 bp, Artificial Sequence
  chemically synthesized
ttatattacatatggcatat

SEQ ID NO: 21321 - DNA, 20 bp, Artificial Sequence
  chemically synthesized
tattacatatggcatatagg

SEQ ID NO: 21322 - DNA, 20 bp, Artificial Sequence
  chemically synthesized
attacatatggcatatagga

SEQ ID NO: 21323 - DNA, 20 bp, Artificial Sequence
  chemically synthesized
catataggaaggcaacattc

SEQ ID NO: 21324 - DNA, 20 bp, Artificial Sequence
  chemically synthesized
aggcaacattcaagtataat

SEQ ID NO: 21325 - DNA, 20 bp, Artificial Sequence
  chemically synthesized
agcttatatcgctaacgatt

SEQ ID NO: 21326 - DNA, 20 bp, Artificial Sequence
  chemically synthesized
gcttatatcgctaacgattc

SEQ ID NO: 21327 - DNA, 20 bp, Artificial Sequence
  chemically synthesized
tatatcgctaacgattcagg

SEQ ID NO: 21328 - DNA, 20 bp, Artificial Sequence
  chemically synthesized
atatcgctaacgattcagga

SEQ ID NO: 21329 - DNA, 20 bp, Artificial Sequence
  chemically synthesized
attcaggaaggtctctatcc

SEQ ID NO: 21330 - DNA, 20 bp, Artificial Sequence
  chemically synthesized
ttcaggaaggtctctatcct

SEQ ID NO: 21331 - DNA, 20 bp, Artificial Sequence
  chemically synthesized
taggatttttgctgtttgtt

SEQ ID NO: 21332 - DNA, 20 bp, Artificial Sequence
  chemically synthesized
atttttgctgtttgttgagt

SEQ ID NO: 21333 - DNA, 20 bp, Artificial Sequence
  chemically synthesized
taagtctgtgctgacaatac

SEQ ID NO: 21334 - DNA, 20 bp, Artificial Sequence
  chemically synthesized
cttttttttttttttctgtg

SEQ ID NO: 21335 - DNA, 20 bp, Artificial Sequence
  chemically synthesized
agtttgattctattatctgt

SEQ ID NO: 21336 - DNA, 20 bp, Artificial Sequence
  chemically synthesized
tctattatctgtcagccttc

SEQ ID NO: 21337 - DNA, 20 bp, Artificial Sequence
  chemically synthesized
ggattccacaattatctccg

SEQ ID NO: 21338 - DNA, 20 bp, Artificial Sequence
  chemically synthesized
atcctttaactcatcctcta

SEQ ID NO: 21339 - DNA, 20 bp, Artificial Sequence
  chemically synthesized
tcctttaactcatcctctac

SEQ ID NO: 21340 - DNA, 20 bp, Artificial Sequence
  chemically synthesized
tcatcctctacaggctctga

SEQ ID NO: 21341 - DNA, 20 bp, Artificial Sequence
  chemically synthesized
attttatatgccaatttgac

SEQ ID NO: 21342 - DNA, 20 bp, Artificial Sequence
  chemically synthesized
ttttatatgccaatttgact

SEQ ID NO: 21343 - DNA, 20 bp, Artificial Sequence
  chemically synthesized
atgccaatttgactgggcca

SEQ ID NO: 21344 - DNA, 20 bp, Artificial Sequence
  chemically synthesized
tgccaatttgactgggccat

SEQ ID NO: 21345 - DNA, 20 bp, Artificial Sequence
  chemically synthesized
gccaatttgactgggccatg

SEQ ID NO: 21346 - DNA, 20 bp, Artificial Sequence
  chemically synthesized
atatttgtcaaacattattc

SEQ ID NO: 21347 - DNA, 20 bp, Artificial Sequence
  chemically synthesized
attattctagatgtttttgt

SEQ ID NO: 21348 - DNA, 20 bp, Artificial Sequence
  chemically synthesized
ttattctagatgtttttgtg

SEQ ID NO: 21349 - DNA, 20 bp, Artificial Sequence
  chemically synthesized
tattctagatgtttttgtga

SEQ ID NO: 21350 - DNA, 20 bp, Artificial Sequence
  chemically synthesized
tgtttttgtgagggtgtttt

SEQ ID NO: 21351 - DNA, 20 bp, Artificial Sequence
  chemically synthesized
gtttttgtgagggtgttttt

SEQ ID NO: 21352 - DNA, 20 bp, Artificial Sequence
  chemically synthesized
ttgtgagggtgtttttaggc

SEQ ID NO: 21353 - DNA, 20 bp, Artificial Sequence
  chemically synthesized
ggcaagattaacatttaaat

SEQ ID NO: 21354 - DNA, 20 bp, Artificial Sequence
  chemically synthesized
aagattaacatttaaatcgg

SEQ ID NO: 21355 - DNA, 20 bp, Artificial Sequence
  chemically synthesized
aacatttaaatcggtagacc

SEQ ID NO: 21356 - DNA, 20 bp, Artificial Sequence
  chemically synthesized
atttaaatcggtagaccaag

SEQ ID NO: 21357 - DNA, 20 bp, Artificial Sequence
  chemically synthesized
ttaaatcggtagaccaagta

SEQ ID NO: 21358 - DNA, 20 bp, Artificial Sequence
  chemically synthesized
aatcggtagaccaagtagag

SEQ ID NO: 21359 - DNA, 20 bp, Artificial Sequence
  chemically synthesized
ggtagaccaagtagagcaga

SEQ ID NO: 21360 - DNA, 20 bp, Artificial Sequence
  chemically synthesized
gcagatggtccttcctattg

SEQ ID NO: 21361 - DNA, 20 bp, Artificial Sequence
  chemically synthesized
cagatggtccttcctattgc

SEQ ID NO: 21362 - DNA, 20 bp, Artificial Sequence
  chemically synthesized
atggtccttcctattgcagg

SEQ ID NO: 21363 - DNA, 20 bp, Artificial Sequence
  chemically synthesized
tgcaggcggcttcctccaat

SEQ ID NO: 21364 - DNA, 20 bp, Artificial Sequence
  chemically synthesized
caatcagttgaaaacctgaa

SEQ ID NO: 21365 - DNA, 20 bp, Artificial Sequence
  chemically synthesized
gaaaacctgaatagaacaaa

SEQ ID NO: 21366 - DNA, 20 bp, Artificial Sequence
  chemically synthesized
agtctgacccttccccaaat

SEQ ID NO: 21367 - DNA, 20 bp, Artificial Sequence
  chemically synthesized
tctgacccttccccaaatca

SEQ ID NO: 21368 - DNA, 20 bp, Artificial Sequence
  chemically synthesized
tgacccttccccaaatcaga

SEQ ID NO: 21369 - DNA, 20 bp, Artificial Sequence
  chemically synthesized
agagaattattccttattga

SEQ ID NO: 21370 - DNA, 20 bp, Artificial Sequence
  chemically synthesized
cttattgatggccttcaaac

SEQ ID NO: 21371 - DNA, 20 bp, Artificial Sequence
  chemically synthesized
atggccttcaaactggaatc

SEQ ID NO: 21372 - DNA, 20 bp, Artificial Sequence
  chemically synthesized
tagacctttttttctgcctt

SEQ ID NO: 21373 - DNA, 20 bp, Artificial Sequence
  chemically synthesized
actgaaacatcaaaacttcc

SEQ ID NO: 21374 - DNA, 20 bp, Artificial Sequence
  chemically synthesized
ctgaaacatcaaaacttcct

SEQ ID NO: 21375 - DNA, 20 bp, Artificial Sequence
  chemically synthesized
atcaaaacttcctgggtctg

SEQ ID NO: 21376 - DNA, 20 bp, Artificial Sequence
  chemically synthesized
ttcctgggtctgaagcctga

SEQ ID NO: 21377 - DNA, 20 bp, Artificial Sequence
  chemically synthesized
gtctgaagcctgatggcttt

SEQ ID NO: 21378 - DNA, 20 bp, Artificial Sequence
  chemically synthesized
tctgaagcctgatggctttt

SEQ ID NO: 21379 - DNA, 20 bp, Artificial Sequence
  chemically synthesized
cctgatggcttttgggttgc

SEQ ID NO: 21380 - DNA, 20 bp, Artificial Sequence
  chemically synthesized
ccatcaatcctcctgtttcc

SEQ ID NO: 21381 - DNA, 20 bp, Artificial Sequence
  chemically synthesized
catcaatcctcctgtttccc

SEQ ID NO: 21382 - DNA, 20 bp, Artificial Sequence
  chemically synthesized
cctcctgtttcccaggcctt

SEQ ID NO: 21383 - DNA, 20 bp, Artificial Sequence
  chemically synthesized
gtttcccaggccttcagact

SEQ ID NO: 21384 - DNA, 20 bp, Artificial Sequence
  chemically synthesized
ccaggccttcagacttggac

SEQ ID NO: 21385 - DNA, 20 bp, Artificial Sequence
  chemically synthesized
caggccttcagacttggact

SEQ ID NO: 21386 - DNA, 20 bp, Artificial Sequence
  chemically synthesized
ttggactgggactaaactac

SEQ ID NO: 21387 - DNA, 20 bp, Artificial Sequence
  chemically synthesized
tggactgggactaaactacc

SEQ ID NO: 21388 - DNA, 20 bp, Artificial Sequence
  chemically synthesized
ctaaactaccaggctctctt

SEQ ID NO: 21389 - DNA, 20 bp, Artificial Sequence
  chemically synthesized
atgactcactctgcatatct

SEQ ID NO: 21390 - DNA, 20 bp, Artificial Sequence
  chemically synthesized
tgactcactctgcatatctt

SEQ ID NO: 21391 - DNA, 20 bp, Artificial Sequence
  chemically synthesized
catctgctatttccttatat

SEQ ID NO: 21392 - DNA, 20 bp, Artificial Sequence
  chemically synthesized
atctgctatttccttatatt

SEQ ID NO: 21393 - DNA, 20 bp, Artificial Sequence
  chemically synthesized
gctatttccttatattaggt

SEQ ID NO: 21394 - DNA, 20 bp, Artificial Sequence
  chemically synthesized
cttatattaggttggtgcaa

SEQ ID NO: 21395 - DNA, 20 bp, Artificial Sequence
  chemically synthesized
ggttggtgcaacagtaattg

SEQ ID NO: 21396 - DNA, 20 bp, Artificial Sequence
  chemically synthesized
gccattatttttttttaatg

SEQ ID NO: 21397 - DNA, 20 bp, Artificial Sequence
  chemically synthesized
attcaatttttttaattttt

SEQ ID NO: 21398 - DNA, 20 bp, Artificial Sequence
  chemically synthesized
ttttttaatttttaagttct

SEQ ID NO: 21399 - DNA, 20 bp, Artificial Sequence
  chemically synthesized
tttttaatttttaagttctg

SEQ ID NO: 21400 - DNA, 20 bp, Artificial Sequence
  chemically synthesized
taagttctgaggtacatgtg

SEQ ID NO: 21401 - DNA, 20 bp, Artificial Sequence
  chemically synthesized
aagttctgaggtacatgtgc

SEQ ID NO: 21402 - DNA, 20 bp, Artificial Sequence
  chemically synthesized
aggtacatgtgcaggatgtg

SEQ ID NO: 21403 - DNA, 20 bp, Artificial Sequence
  chemically synthesized
ggtacatgtgcaggatgtgc

SEQ ID NO: 21404 - DNA, 20 bp, Artificial Sequence
  chemically synthesized
acatacgtaaatgtgtgcaa

SEQ ID NO: 21405 - DNA, 20 bp, Artificial Sequence
  chemically synthesized
tacgtaaatgtgtgcaatgg

SEQ ID NO: 21406 - DNA, 20 bp, Artificial Sequence
  chemically synthesized
gtacctatcaacccatcacc

SEQ ID NO: 21407 - DNA, 20 bp, Artificial Sequence
  chemically synthesized
tacctatcaacccatcacct

SEQ ID NO: 21408 - DNA, 20 bp, Artificial Sequence
  chemically synthesized
caacccatcacctaggtgtt

SEQ ID NO: 21409 - DNA, 20 bp, Artificial Sequence
  chemically synthesized
catcacctaggtgttaagcc

SEQ ID NO: 21410 - DNA, 20 bp, Artificial Sequence
  chemically synthesized
gtgttaagcccagcatgcat

SEQ ID NO: 21411 - DNA, 20 bp, Artificial Sequence
  chemically synthesized
caccacaccccatgccctga

SEQ ID NO: 21412 - DNA, 20 bp, Artificial Sequence
  chemically synthesized
accacaccccatgccctgac

SEQ ID NO: 21413 - DNA, 20 bp, Artificial Sequence
  chemically synthesized
ccccatgccctgacaggctc

SEQ ID NO: 21414 - DNA, 20 bp, Artificial Sequence
  chemically synthesized
gtgttctcattctcattgtt

SEQ ID NO: 21415 - DNA, 20 bp, Artificial Sequence
  chemically synthesized
attgttcagctcccacttct

SEQ ID NO: 21416 - DNA, 20 bp, Artificial Sequence
  chemically synthesized
ttcagctcccacttctaagt

SEQ ID NO: 21417 - DNA, 20 bp, Artificial Sequence
  chemically synthesized
cacttctaagtgagaacatg

SEQ ID NO: 21418 - DNA, 20 bp, Artificial Sequence
  chemically synthesized
aagtgagaacatgtggtgtt

SEQ ID NO: 21419 - DNA, 20 bp, Artificial Sequence
  chemically synthesized
ttggttttctgttcctgcat

SEQ ID NO: 21420 - DNA, 20 bp, Artificial Sequence
  chemically synthesized
gttcctgcattagtttactg

SEQ ID NO: 21421 - DNA, 20 bp, Artificial Sequence
  chemically synthesized
cattagtttactgaagataa

SEQ ID NO: 21422 - DNA, 20 bp, Artificial Sequence
  chemically synthesized
ttactgaagataatggcttt

SEQ ID NO: 21423 - DNA, 20 bp, Artificial Sequence
  chemically synthesized
tttcggctccatccatgtcc

SEQ ID NO: 21424 - DNA, 20 bp, Artificial Sequence
  chemically synthesized
gctccatccatgtcccagca

SEQ ID NO: 21425 - DNA, 20 bp, Artificial Sequence
  chemically synthesized
ctccatccatgtcccagcaa

SEQ ID NO: 21426 - DNA, 20 bp, Artificial Sequence
  chemically synthesized
tccatccatgtcccagcaaa

SEQ ID NO: 21427 - DNA, 20 bp, Artificial Sequence
  chemically synthesized
catgatctcatcccttttta

SEQ ID NO: 21428 - DNA, 20 bp, Artificial Sequence
  chemically synthesized
atctcatccctttttatggt

SEQ ID NO: 21429 - DNA, 20 bp, Artificial Sequence
  chemically synthesized
catccctttttatggttaga

SEQ ID NO: 21430 - DNA, 20 bp, Artificial Sequence
  chemically synthesized
tatggttagatagtatttca

SEQ ID NO: 21431 - DNA, 20 bp, Artificial Sequence
  chemically synthesized
tttaaattgtctatcattga

SEQ ID NO: 21432 - DNA, 20 bp, Artificial Sequence
  chemically synthesized
gtctatcattgatggccatt

SEQ ID NO: 21433 - DNA, 20 bp, Artificial Sequence
  chemically synthesized
tctatcattgatggccattt

SEQ ID NO: 21434 - DNA, 20 bp, Artificial Sequence
  chemically synthesized
tatgtctttgctattgtgaa

SEQ ID NO: 21435 - DNA, 20 bp, Artificial Sequence
  chemically synthesized
acatacatgtgcatgtatct

SEQ ID NO: 21436 - DNA, 20 bp, Artificial Sequence
  chemically synthesized
atgtgcatgtatcttagtaa

SEQ ID NO: 21437 - DNA, 20 bp, Artificial Sequence
  chemically synthesized
tagaatgatttatactcctt

SEQ ID NO: 21438 - DNA, 20 bp, Artificial Sequence
  chemically synthesized
agaatgatttatactccttt

SEQ ID NO: 21439 - DNA, 20 bp, Artificial Sequence
  chemically synthesized
tactcctttaggtatatacc

SEQ ID NO: 21440 - DNA, 20 bp, Artificial Sequence
  chemically synthesized
tttaggtatatacccagtaa

SEQ ID NO: 21441 - DNA, 20 bp, Artificial Sequence
  chemically synthesized
ttaggtatatacccagtaat

SEQ ID NO: 21442 - DNA, 20 bp, Artificial Sequence
  chemically synthesized
atacccagtaatgggattgt

SEQ ID NO: 21443 - DNA, 20 bp, Artificial Sequence
  chemically synthesized
tacccagtaatgggattgtg

SEQ ID NO: 21444 - DNA, 20 bp, Artificial Sequence
  chemically synthesized
aatgggattgtgaggtcaaa

SEQ ID NO: 21445 - DNA, 20 bp, Artificial Sequence
  chemically synthesized
gtgaggtcaaatggtatttc

SEQ ID NO: 21446 - DNA, 20 bp, Artificial Sequence
  chemically synthesized
atttctggttctaaatcttt

SEQ ID NO: 21447 - DNA, 20 bp, Artificial Sequence
  chemically synthesized
tttctggttctaaatctttg

SEQ ID NO: 21448 - DNA, 20 bp, Artificial Sequence
  chemically synthesized
tgccacactgtcttccacaa

SEQ ID NO: 21449 - DNA, 20 bp, Artificial Sequence
  chemically synthesized
gtcttccacaatggttgaat

SEQ ID NO: 21450 - DNA, 20 bp, Artificial Sequence
  chemically synthesized
acaatggttgaattagttta

SEQ ID NO: 21451 - DNA, 20 bp, Artificial Sequence
  chemically synthesized
ttagtttacagtcccaccaa

SEQ ID NO: 21452 - DNA, 20 bp, Artificial Sequence
  chemically synthesized
cagtcccaccaacagtgtaa

SEQ ID NO: 21453 - DNA, 20 bp, Artificial Sequence
  chemically synthesized
ctatttctctgcaaccttgc

SEQ ID NO: 21454 - DNA, 20 bp, Artificial Sequence
  chemically synthesized
ttaaaaaccaccattctgac

SEQ ID NO: 21455 - DNA, 20 bp, Artificial Sequence
  chemically synthesized
accaccattctgactggtgt

SEQ ID NO: 21456 - DNA, 20 bp, Artificial Sequence
  chemically synthesized
ccattctgactggtgtcaga

SEQ ID NO: 21457 - DNA, 20 bp, Artificial Sequence
  chemically synthesized
tgtcagatggtatttcattg

SEQ ID NO: 21458 - DNA, 20 bp, Artificial Sequence
  chemically synthesized
atttgcatttctctaatgat

SEQ ID NO: 21459 - DNA, 20 bp, Artificial Sequence
  chemically synthesized
ctctaatgatcagtgacatt

SEQ ID NO: 21460 - DNA, 20 bp, Artificial Sequence
  chemically synthesized
gacttttttcgtatgtttct

SEQ ID NO: 21461 - DNA, 20 bp, Artificial Sequence
  chemically synthesized
ccacataaatgtcttctttt

SEQ ID NO: 21462 - DNA, 20 bp, Artificial Sequence
  chemically synthesized
cataaatgtcttcttttgag

SEQ ID NO: 21463 - DNA, 20 bp, Artificial Sequence
  chemically synthesized
gtcctttgcccactttttaa

SEQ ID NO: 21464 - DNA, 20 bp, Artificial Sequence
  chemically synthesized
tcctttgcccactttttaat

SEQ ID NO: 21465 - DNA, 20 bp, Artificial Sequence
  chemically synthesized
cctttgcccactttttaatg

SEQ ID NO: 21466 - DNA, 20 bp, Artificial Sequence
  chemically synthesized
tttcttttgtaaatatgtct

SEQ ID NO: 21467 - DNA, 20 bp, Artificial Sequence
  chemically synthesized
aaatatgtctaagttcctca

SEQ ID NO: 21468 - DNA, 20 bp, Artificial Sequence
  chemically synthesized
tctaagttcctcatagattc

SEQ ID NO: 21469 - DNA, 20 bp, Artificial Sequence
  chemically synthesized
tcctcatagattctggatat

SEQ ID NO: 21470 - DNA, 20 bp, Artificial Sequence
  chemically synthesized
tctggatattagacctttgt

SEQ ID NO: 21471 - DNA, 20 bp, Artificial Sequence
  chemically synthesized
gatattagacctttgtcaga

SEQ ID NO: 21472 - DNA, 20 bp, Artificial Sequence
  chemically synthesized
atattagacctttgtcagat

SEQ ID NO: 21473 - DNA, 20 bp, Artificial Sequence
  chemically synthesized
ttagacctttgtcagatggg

SEQ ID NO: 21474 - DNA, 20 bp, Artificial Sequence
  chemically synthesized
tttgtcagatgggtagattg

SEQ ID NO: 21475 - DNA, 20 bp, Artificial Sequence
  chemically synthesized
agaaattttctcccattctg

SEQ ID NO: 21476 - DNA, 20 bp, Artificial Sequence
  chemically synthesized
gaaattttctcccattctgt

SEQ ID NO: 21477 - DNA, 20 bp, Artificial Sequence
  chemically synthesized
ttgcctgttcgctctgatga

SEQ ID NO: 21478 - DNA, 20 bp, Artificial Sequence
  chemically synthesized
tgatagtttattttgctgtt

SEQ ID NO: 21479 - DNA, 20 bp, Artificial Sequence
  chemically synthesized
tagtttattttgctgtttag

SEQ ID NO: 21480 - DNA, 20 bp, Artificial Sequence
  chemically synthesized
attgtatttttctttatttt

SEQ ID NO: 21481 - DNA, 20 bp, Artificial Sequence
  chemically synthesized
tttttctttattttgagatg

SEQ ID NO: 21482 - DNA, 20 bp, Artificial Sequence
  chemically synthesized
tctcactctttcacccatgc

SEQ ID NO: 21483 - DNA, 20 bp, Artificial Sequence
  chemically synthesized
tcactctttcacccatgcta

SEQ ID NO: 21484 - DNA, 20 bp, Artificial Sequence
  chemically synthesized
ctttcacccatgctagagtg

SEQ ID NO: 21485 - DNA, 20 bp, Artificial Sequence
  chemically synthesized
tcacccatgctagagtgcag

SEQ ID NO: 21486 - DNA, 20 bp, Artificial Sequence
  chemically synthesized
agagtgcagtggtgcgatct

SEQ ID NO: 21487 - DNA, 20 bp, Artificial Sequence
  chemically synthesized
tcactgcaacctctgcctcc

SEQ ID NO: 21488 - DNA, 20 bp, Artificial Sequence
  chemically synthesized
cactgcaacctctgcctcct

SEQ ID NO: 21489 - DNA, 20 bp, Artificial Sequence
  chemically synthesized
aacctctgcctcctgggttc

SEQ ID NO: 21490 - DNA, 20 bp, Artificial Sequence
  chemically synthesized
ttcaagcaattctcctgcct

SEQ ID NO: 21491 - DNA, 20 bp, Artificial Sequence
  chemically synthesized
ttctcctgcctcagcctcct

SEQ ID NO: 21492 - DNA, 20 bp, Artificial Sequence
  chemically synthesized
tcctgcctcagcctcctgag

SEQ ID NO: 21493 - DNA, 20 bp, Artificial Sequence
  chemically synthesized
cctcagcctcctgagtagct

SEQ ID NO: 21494 - DNA, 20 bp, Artificial Sequence
  chemically synthesized
ctcctgagtagctgagatta

SEQ ID NO: 21495 - DNA, 20 bp, Artificial Sequence
  chemically synthesized
tcctgagtagctgagattac

SEQ ID NO: 21496 - DNA, 20 bp, Artificial Sequence
  chemically synthesized
caggtacgcaccaccatacc

SEQ ID NO: 21497 - DNA, 20 bp, Artificial Sequence
  chemically synthesized
cagcacattttttgtatttt

SEQ ID NO: 21498 - DNA, 20 bp, Artificial Sequence
  chemically synthesized
cacattttttgtatttttag

SEQ ID NO: 21499 - DNA, 20 bp, Artificial Sequence
  chemically synthesized
cattttttgtatttttagta

SEQ ID NO: 21500 - DNA, 20 bp, Artificial Sequence
  chemically synthesized
ttttgtatttttagtagaga

SEQ ID NO: 21501 - DNA, 20 bp, Artificial Sequence
  chemically synthesized
ttgtatttttagtagagatg

SEQ ID NO: 21502 - DNA, 20 bp, Artificial Sequence
  chemically synthesized
gagatggagtttcaccatgt

SEQ ID NO: 21503 - DNA, 20 bp, Artificial Sequence
  chemically synthesized
tggagtttcaccatgttggc

SEQ ID NO: 21504 - DNA, 20 bp, Artificial Sequence
  chemically synthesized
ggagtttcaccatgttggcc

SEQ ID NO: 21505 - DNA, 20 bp, Artificial Sequence
  chemically synthesized
gctcttatactccccacctc

SEQ ID NO: 21506 - DNA, 20 bp, Artificial Sequence
  chemically synthesized
ctcaagtgatccacccacct

SEQ ID NO: 21507 - DNA, 20 bp, Artificial Sequence
  chemically synthesized
ccacccaccttggcctccca

SEQ ID NO: 21508 - DNA, 20 bp, Artificial Sequence
  chemically synthesized
accttggcctcccaaagtgc

SEQ ID NO: 21509 - DNA, 20 bp, Artificial Sequence
  chemically synthesized
ccttggcctcccaaagtgct

SEQ ID NO: 21510 - DNA, 20 bp, Artificial Sequence
  chemically synthesized
ctcccaaagtgctgggatta

SEQ ID NO: 21511 - DNA, 20 bp, Artificial Sequence
  chemically synthesized
tcccaaagtgctgggattac

SEQ ID NO: 21512 - DNA, 20 bp, Artificial Sequence
  chemically synthesized
agtgctgggattacaggcgt

SEQ ID NO: 21513 - DNA, 20 bp, Artificial Sequence
  chemically synthesized
gccaccatgcccgatctctt

SEQ ID NO: 21514 - DNA, 20 bp, Artificial Sequence
  chemically synthesized
cccgatctctttagtttaat

SEQ ID NO: 21515 - DNA, 20 bp, Artificial Sequence
  chemically synthesized
tttaattagatctcatttga

SEQ ID NO: 21516 - DNA, 20 bp, Artificial Sequence
  chemically synthesized
tctttgcctgtgtctatgtc

SEQ ID NO: 21517 - DNA, 20 bp, Artificial Sequence
  chemically synthesized
gcctgtgtctatgtccggaa

SEQ ID NO: 21518 - DNA, 20 bp, Artificial Sequence
  chemically synthesized
atgtccggaatggtattgcc

SEQ ID NO: 21519 - DNA, 20 bp, Artificial Sequence
  chemically synthesized
tgtccggaatggtattgcct

SEQ ID NO: 21520 - DNA, 20 bp, Artificial Sequence
  chemically synthesized
attgcctaggttttcttcta

SEQ ID NO: 21521 - DNA, 20 bp, Artificial Sequence
  chemically synthesized
gttttcttctaaagttttta

SEQ ID NO: 21522 - DNA, 20 bp, Artificial Sequence
  chemically synthesized
ttctaaagtttttatagttt

SEQ ID NO: 21523 - DNA, 20 bp, Artificial Sequence
  chemically synthesized
tctaaagtttttatagtttt

SEQ ID NO: 21524 - DNA, 20 bp, Artificial Sequence
  chemically synthesized
tagttttgggttttacactt

SEQ ID NO: 21525 - DNA, 20 bp, Artificial Sequence
  chemically synthesized
ttaagtctttaatgcatctt

SEQ ID NO: 21526 - DNA, 20 bp, Artificial Sequence
  chemically synthesized
tcttgagttaatttatgtat

SEQ ID NO: 21527 - DNA, 20 bp, Artificial Sequence
  chemically synthesized
ttaatttatgtataagatgt

SEQ ID NO: 21528 - DNA, 20 bp, Artificial Sequence
  chemically synthesized
taatttatgtataagatgta

SEQ ID NO: 21529 - DNA, 20 bp, Artificial Sequence
  chemically synthesized
tttatgtataagatgtaagg

SEQ ID NO: 21530 - DNA, 20 bp, Artificial Sequence
  chemically synthesized
ttatgtataagatgtaagga

SEQ ID NO: 21531 - DNA, 20 bp, Artificial Sequence
  chemically synthesized
tatgtataagatgtaaggaa

SEQ ID NO: 21532 - DNA, 20 bp, Artificial Sequence
  chemically synthesized
atgtataagatgtaaggaag

SEQ ID NO: 21533 - DNA, 20 bp, Artificial Sequence
  chemically synthesized
taagatgtaaggaaggggtc

SEQ ID NO: 21534 - DNA, 20 bp, Artificial Sequence
  chemically synthesized
cagtttcaattttctgcata

SEQ ID NO: 21535 - DNA, 20 bp, Artificial Sequence
  chemically synthesized
ttcaattttctgcatatggc

SEQ ID NO: 21536 - DNA, 20 bp, Artificial Sequence
  chemically synthesized
attttctgcatatggctagc

SEQ ID NO: 21537 - DNA, 20 bp, Artificial Sequence
  chemically synthesized
atatggctagccagttctcc

SEQ ID NO: 21538 - DNA, 20 bp, Artificial Sequence
  chemically synthesized
tcccagcacaatttataaaa

SEQ ID NO: 21539 - DNA, 20 bp, Artificial Sequence
  chemically synthesized
cccagcacaatttataaaat

SEQ ID NO: 21540 - DNA, 20 bp, Artificial Sequence
  chemically synthesized
ccagcacaatttataaaata

SEQ ID NO: 21541 - DNA, 20 bp, Artificial Sequence
  chemically synthesized
tccccattacttgtttttac

SEQ ID NO: 21542 - DNA, 20 bp, Artificial Sequence
  chemically synthesized
ccccattacttgtttttacc

SEQ ID NO: 21543 - DNA, 20 bp, Artificial Sequence
  chemically synthesized
tgtttttaccaggtttgttg

SEQ ID NO: 21544 - DNA, 20 bp, Artificial Sequence
  chemically synthesized
ttaccaggtttgttgaagat

SEQ ID NO: 21545 - DNA, 20 bp, Artificial Sequence
  chemically synthesized
tgttgaagatcagattgttt

SEQ ID NO: 21546 - DNA, 20 bp, Artificial Sequence
  chemically synthesized
atcagattgtttcagatgcg

SEQ ID NO: 21547 - DNA, 20 bp, Artificial Sequence
  chemically synthesized
agatgcgcggtcttacttct

SEQ ID NO: 21548 - DNA, 20 bp, Artificial Sequence
  chemically synthesized
agttctccattctgttccat

SEQ ID NO: 21549 - DNA, 20 bp, Artificial Sequence
  chemically synthesized
ctccattctgttccattagt

SEQ ID NO: 21550 - DNA, 20 bp, Artificial Sequence
  chemically synthesized
cattagtcagtgtgtctgtt

SEQ ID NO: 21551 - DNA, 20 bp, Artificial Sequence
  chemically synthesized
tcagtgtgtctgtttggtat

SEQ ID NO: 21552 - DNA, 20 bp, Artificial Sequence
  chemically synthesized
gtatcagtaccatgctgttt

SEQ ID NO: 21553 - DNA, 20 bp, Artificial Sequence
  chemically synthesized
cagtaccatgctgtttcagt

SEQ ID NO: 21554 - DNA, 20 bp, Artificial Sequence
  chemically synthesized
agttagttactgtcaccttg

SEQ ID NO: 21555 - DNA, 20 bp, Artificial Sequence
  chemically synthesized
tcaccttgtagtataatttg

SEQ ID NO: 21556 - DNA, 20 bp, Artificial Sequence
  chemically synthesized
cttgtagtataatttgaagt

SEQ ID NO: 21557 - DNA, 20 bp, Artificial Sequence
  chemically synthesized
ttgtagtataatttgaagtt

SEQ ID NO: 21558 - DNA, 20 bp, Artificial Sequence
  chemically synthesized
tcctgttgattctatttttc

SEQ ID NO: 21559 - DNA, 20 bp, Artificial Sequence
  chemically synthesized
ctgttgattctatttttctg

SEQ ID NO: 21560 - DNA, 20 bp, Artificial Sequence
  chemically synthesized
ctggagaaccatgactaaca

SEQ ID NO: 21561 - DNA, 20 bp, Artificial Sequence
  chemically synthesized
tggagaaccatgactaacat

SEQ ID NO: 21562 - DNA, 20 bp, Artificial Sequence
  chemically synthesized
ggagaaccatgactaacata

SEQ ID NO: 21563 - DNA, 20 bp, Artificial Sequence
  chemically synthesized
acatagggccatctattttt

SEQ ID NO: 21564 - DNA, 20 bp, Artificial Sequence
  chemically synthesized
catagggccatctatttttg

SEQ ID NO: 21565 - DNA, 20 bp, Artificial Sequence
  chemically synthesized
gactaatcactgtcatctgt

SEQ ID NO: 21566 - DNA, 20 bp, Artificial Sequence
  chemically synthesized
atcactgtcatctgtcagtt

SEQ ID NO: 21567 - DNA, 20 bp, Artificial Sequence
  chemically synthesized
actgtcatctgtcagtttgg

SEQ ID NO: 21568 - DNA, 20 bp, Artificial Sequence
  chemically synthesized
ggtggcatgtacttgaaatc

SEQ ID NO: 21569 - DNA, 20 bp, Artificial Sequence
  chemically synthesized
gtggcatgtacttgaaatct

SEQ ID NO: 21570 - DNA, 20 bp, Artificial Sequence
  chemically synthesized
tggcatgtacttgaaatcta

SEQ ID NO: 21571 - DNA, 20 bp, Artificial Sequence
  chemically synthesized
ataaaataaattttgtctat

SEQ ID NO: 21572 - DNA, 20 bp, Artificial Sequence
  chemically synthesized
taataacaatgactgtgtct

SEQ ID NO: 21573 - DNA, 20 bp, Artificial Sequence
  chemically synthesized
aataacaatgactgtgtcta

SEQ ID NO: 21574 - DNA, 20 bp, Artificial Sequence
  chemically synthesized
aatgactgtgtctaaggatt

SEQ ID NO: 21575 - DNA, 20 bp, Artificial Sequence
  chemically synthesized
atgactgtgtctaaggattt

SEQ ID NO: 21576 - DNA, 20 bp, Artificial Sequence
  chemically synthesized
ttaggctataaaatcaaaaa

SEQ ID NO: 21577 - DNA, 20 bp, Artificial Sequence
  chemically synthesized
acagatttacattctttaat

SEQ ID NO: 21578 - DNA, 20 bp, Artificial Sequence
  chemically synthesized
ttacattctttaattggaca

SEQ ID NO: 21579 - DNA, 20 bp, Artificial Sequence
  chemically synthesized
acattctttaattggacatg

SEQ ID NO: 21580 - DNA, 20 bp, Artificial Sequence
  chemically synthesized
taattggacatggagacctc

SEQ ID NO: 21581 - DNA, 20 bp, Artificial Sequence
  chemically synthesized
aattggacatggagacctct

SEQ ID NO: 21582 - DNA, 20 bp, Artificial Sequence
  chemically synthesized
aatttaatactcatataatc

SEQ ID NO: 21583 - DNA, 20 bp, Artificial Sequence
  chemically synthesized
taatactcatataatctagt

SEQ ID NO: 21584 - DNA, 20 bp, Artificial Sequence
  chemically synthesized
cctataaaaatctgcatctc

SEQ ID NO: 21585 - DNA, 20 bp, Artificial Sequence
  chemically synthesized
aaaaatctgcatctctggtg

SEQ ID NO: 21586 - DNA, 20 bp, Artificial Sequence
  chemically synthesized
aaaatctgcatctctggtga

SEQ ID NO: 21587 - DNA, 20 bp, Artificial Sequence
  chemically synthesized
gcatctctggtgaaggaacc

SEQ ID NO: 21588 - DNA, 20 bp, Artificial Sequence
  chemically synthesized
cccagcaattatttgttaat

SEQ ID NO: 21589 - DNA, 20 bp, Artificial Sequence
  chemically synthesized
cagcaattatttgttaatga

SEQ ID NO: 21590 - DNA, 20 bp, Artificial Sequence
  chemically synthesized
agcaattatttgttaatgag

SEQ ID NO: 21591 - DNA, 20 bp, Artificial Sequence
  chemically synthesized
atttgttaatgagaggaata

SEQ ID NO: 21592 - DNA, 20 bp, Artificial Sequence
  chemically synthesized
aagttcatcttccccttatc

SEQ ID NO: 21593 - DNA, 20 bp, Artificial Sequence
  chemically synthesized
tagtataaattcattttata

SEQ ID NO: 21594 - DNA, 20 bp, Artificial Sequence
  chemically synthesized
agtataaattcattttatat

SEQ ID NO: 21595 - DNA, 20 bp, Artificial Sequence
  chemically synthesized
tataaattcattttatatgg

SEQ ID NO: 21596 - DNA, 20 bp, Artificial Sequence
  chemically synthesized
ataaattcattttatatggg

SEQ ID NO: 21597 - DNA, 20 bp, Artificial Sequence
  chemically synthesized
ttcattttatatgggaggaa

SEQ ID NO: 21598 - DNA, 20 bp, Artificial Sequence
  chemically synthesized
aaagtgatctgtaaactcat

SEQ ID NO: 21599 - DNA, 20 bp, Artificial Sequence
  chemically synthesized
ttagaccatacatatttttt

SEQ ID NO: 21600 - DNA, 20 bp, Artificial Sequence
  chemically synthesized
tattttttcagtgtgtctct

SEQ ID NO: 21601 - DNA, 20 bp, Artificial Sequence
  chemically synthesized
acgtcttcttaatcatttct

SEQ ID NO: 21602 - DNA, 20 bp, Artificial Sequence
  chemically synthesized
ttcttaatcatttctaagat

SEQ ID NO: 21603 - DNA, 20 bp, Artificial Sequence
  chemically synthesized
aatcatttctaagattggct

SEQ ID NO: 21604 - DNA, 20 bp, Artificial Sequence
  chemically synthesized
tctaagattggcttagtcta

SEQ ID NO: 21605 - DNA, 20 bp, Artificial Sequence
  chemically synthesized
agtctacagaaatgcacact

SEQ ID NO: 21606 - DNA, 20 bp, Artificial Sequence
  chemically synthesized
actcaaattaaatattctta

SEQ ID NO: 21607 - DNA, 20 bp, Artificial Sequence
  chemically synthesized
ttatggtatgttatcccttc

SEQ ID NO: 21608 - DNA, 20 bp, Artificial Sequence
  chemically synthesized
ccttcaagcccatactacac

SEQ ID NO: 21609 - DNA, 20 bp, Artificial Sequence
  chemically synthesized
aagtatattattatttgaaa

SEQ ID NO: 21610 - DNA, 20 bp, Artificial Sequence
  chemically synthesized
atattattatttgaaaaaga

SEQ ID NO: 21611 - DNA, 20 bp, Artificial Sequence
  chemically synthesized
tattattatttgaaaaagaa

SEQ ID NO: 21612 - DNA, 20 bp, Artificial Sequence
  chemically synthesized
attatttgaaaaagaaagga

SEQ ID NO: 21613 - DNA, 20 bp, Artificial Sequence
  chemically synthesized
gaaaaagaaaggatggtatt

SEQ ID NO: 21614 - DNA, 20 bp, Artificial Sequence
  chemically synthesized
aagaaaggatggtatttggc

SEQ ID NO: 21615 - DNA, 20 bp, Artificial Sequence
  chemically synthesized
agaaaggatggtatttggca

SEQ ID NO: 21616 - DNA, 20 bp, Artificial Sequence
  chemically synthesized
gaaaggatggtatttggcaa

SEQ ID NO: 21617 - DNA, 20 bp, Artificial Sequence
  chemically synthesized
atgtatattcttttacacct

SEQ ID NO: 21618 - DNA, 20 bp, Artificial Sequence
  chemically synthesized
ttagatttcccataactaca

SEQ ID NO: 21619 - DNA, 20 bp, Artificial Sequence
  chemically synthesized
atggtacttatttatcttaa

SEQ ID NO: 21620 - DNA, 20 bp, Artificial Sequence
  chemically synthesized
tggtacttatttatcttaat

SEQ ID NO: 21621 - DNA, 20 bp, Artificial Sequence
  chemically synthesized
ccatgaaatttattcctcat

SEQ ID NO: 21622 - DNA, 20 bp, Artificial Sequence
  chemically synthesized
catgaaatttattcctcatg

SEQ ID NO: 21623 - DNA, 20 bp, Artificial Sequence
  chemically synthesized
catgaggtccttctctatat

SEQ ID NO: 21624 - DNA, 20 bp, Artificial Sequence
  chemically synthesized
tataagttatattcttcttt

SEQ ID NO: 21625 - DNA, 20 bp, Artificial Sequence
  chemically synthesized
tttcagtcttgaatgatgaa

SEQ ID NO: 21626 - DNA, 20 bp, Artificial Sequence
  chemically synthesized
aatgatgaaaagctgaatta

SEQ ID NO: 21627 - DNA, 20 bp, Artificial Sequence
  chemically synthesized
atgatgaaaagctgaattac

SEQ ID NO: 21628 - DNA, 20 bp, Artificial Sequence
  chemically synthesized
ttacaggcttcacctgctgt

SEQ ID NO: 21629 - DNA, 20 bp, Artificial Sequence
  chemically synthesized
caggcttcacctgctgtaag

SEQ ID NO: 21630 - DNA, 20 bp, Artificial Sequence
  chemically synthesized
aggcttcacctgctgtaaga

SEQ ID NO: 21631 - DNA, 20 bp, Artificial Sequence
  chemically synthesized
cttcacctgctgtaagaagg

SEQ ID NO: 21632 - DNA, 20 bp, Artificial Sequence
  chemically synthesized
gctgtaagaaggtggttcac

SEQ ID NO: 21633 - DNA, 20 bp, Artificial Sequence
  chemically synthesized
aaggtggttcaccagtttgt

SEQ ID NO: 21634 - DNA, 20 bp, Artificial Sequence
  chemically synthesized
tcaccagtttgttagtccac

SEQ ID NO: 21635 - DNA, 20 bp, Artificial Sequence
  chemically synthesized
tatgaatacaaattcatgtg

SEQ ID NO: 21636 - DNA, 20 bp, Artificial Sequence
  chemically synthesized
aattcatgtgcagtgtttcc

SEQ ID NO: 21637 - DNA, 20 bp, Artificial Sequence
  chemically synthesized
attcatgtgcagtgtttcct

SEQ ID NO: 21638 - DNA, 20 bp, Artificial Sequence
  chemically synthesized
tcatgtgcagtgtttcctag

SEQ ID NO: 21639 - DNA, 20 bp, Artificial Sequence
  chemically synthesized
gtgcagtgtttcctaggaga

SEQ ID NO: 21640 - DNA, 20 bp, Artificial Sequence
  chemically synthesized
ctaggagatagtgttataaa

SEQ ID NO: 21641 - DNA, 20 bp, Artificial Sequence
  chemically synthesized
taggagatagtgttataaat

SEQ ID NO: 21642 - DNA, 20 bp, Artificial Sequence
  chemically synthesized
ttcctaactaacttttattt

SEQ ID NO: 21643 - DNA, 20 bp, Artificial Sequence
  chemically synthesized
tcctaactaacttttatttt

SEQ ID NO: 21644 - DNA, 20 bp, Artificial Sequence
  chemically synthesized
actaacttttattttaggtt

SEQ ID NO: 21645 - DNA, 20 bp, Artificial Sequence
  chemically synthesized
ctaacttttattttaggttc

SEQ ID NO: 21646 - DNA, 20 bp, Artificial Sequence
  chemically synthesized
aacttttattttaggttcag

SEQ ID NO: 21647 - DNA, 20 bp, Artificial Sequence
  chemically synthesized
tattttaggttcaggagtac

SEQ ID NO: 21648 - DNA, 20 bp, Artificial Sequence
  chemically synthesized
ttttaggttcaggagtacaa

SEQ ID NO: 21649 - DNA, 20 bp, Artificial Sequence
  chemically synthesized
taggttcaggagtacaagag

SEQ ID NO: 21650 - DNA, 20 bp, Artificial Sequence
  chemically synthesized
aggttcaggagtacaagagc

SEQ ID NO: 21651 - DNA, 20 bp, Artificial Sequence
  chemically synthesized
catatttaaacttgtgtcac

SEQ ID NO: 21652 - DNA, 20 bp, Artificial Sequence
  chemically synthesized
atatttaaacttgtgtcacg

SEQ ID NO: 21653 - DNA, 20 bp, Artificial Sequence
  chemically synthesized
tatttaaacttgtgtcacga

SEQ ID NO: 21654 - DNA, 20 bp, Artificial Sequence
  chemically synthesized
tgtcacgagggtttgttgta

SEQ ID NO: 21655 - DNA, 20 bp, Artificial Sequence
  chemically synthesized
agattatgtcatcactcact

SEQ ID NO: 21656 - DNA, 20 bp, Artificial Sequence
  chemically synthesized
gattatgtcatcactcactc

SEQ ID NO: 21657 - DNA, 20 bp, Artificial Sequence
  chemically synthesized
tcatcactcactcaggtatt

SEQ ID NO: 21658 - DNA, 20 bp, Artificial Sequence
  chemically synthesized
actcactcaggtattaagcc

SEQ ID NO: 21659 - DNA, 20 bp, Artificial Sequence
  chemically synthesized
tttcaccctccatcctccaa

SEQ ID NO: 21660 - DNA, 20 bp, Artificial Sequence
  chemically synthesized
ttcaccctccatcctccaat

SEQ ID NO: 21661 - DNA, 20 bp, Artificial Sequence
  chemically synthesized
ctccatcctccaataggccc

SEQ ID NO: 21662 - DNA, 20 bp, Artificial Sequence
  chemically synthesized
gtccatgtgttctcatcatt

SEQ ID NO: 21663 - DNA, 20 bp, Artificial Sequence
  chemically synthesized
atcatttagctcccactcat

SEQ ID NO: 21664 - DNA, 20 bp, Artificial Sequence
  chemically synthesized
tttagctcccactcataagt

SEQ ID NO: 21665 - DNA, 20 bp, Artificial Sequence
  chemically synthesized
cactcataagtgagaacacg

SEQ ID NO: 21666 - DNA, 20 bp, Artificial Sequence
  chemically synthesized
aagtgagaacacgtggtatt

SEQ ID NO: 21667 - DNA, 20 bp, Artificial Sequence
  chemically synthesized
tgttcctgtattaatttgct

SEQ ID NO: 21668 - DNA, 20 bp, Artificial Sequence
  chemically synthesized
gttcctgtattaatttgcta

SEQ ID NO: 21669 - DNA, 20 bp, Artificial Sequence
  chemically synthesized
taatttgctaaggcttctaa

SEQ ID NO: 21670 - DNA, 20 bp, Artificial Sequence
  chemically synthesized
ctaaggcttctaatagtaca

SEQ ID NO: 21671 - DNA, 20 bp, Artificial Sequence
  chemically synthesized
tagtacatagcattttacca

SEQ ID NO: 21672 - DNA, 20 bp, Artificial Sequence
  chemically synthesized
agtacatagcattttaccac

SEQ ID NO: 21673 - DNA, 20 bp, Artificial Sequence
  chemically synthesized
acatagcattttaccacagg

SEQ ID NO: 21674 - DNA, 20 bp, Artificial Sequence
  chemically synthesized
ttttaccacaggaagacttg

SEQ ID NO: 21675 - DNA, 20 bp, Artificial Sequence
  chemically synthesized
tttaccacaggaagacttgt

SEQ ID NO: 21676 - DNA, 20 bp, Artificial Sequence
  chemically synthesized
taccacaggaagacttgtag

SEQ ID NO: 21677 - DNA, 20 bp, Artificial Sequence
  chemically synthesized
ggaagacttgtaggagatca

SEQ ID NO: 21678 - DNA, 20 bp, Artificial Sequence
  chemically synthesized
gacttgtaggagatcacaga

SEQ ID NO: 21679 - DNA, 20 bp, Artificial Sequence
  chemically synthesized
gtttatgttgattgttacaa

SEQ ID NO: 21680 - DNA, 20 bp, Artificial Sequence
  chemically synthesized
tttatgttgattgttacaat

SEQ ID NO: 21681 - DNA, 20 bp, Artificial Sequence
  chemically synthesized
ttgttacaatgggttttgaa

SEQ ID NO: 21682 - DNA, 20 bp, Artificial Sequence
  chemically synthesized
ttgaatagaaaaacatgtct

SEQ ID NO: 21683 - DNA, 20 bp, Artificial Sequence
  chemically synthesized
aatagaaaaacatgtctgag

SEQ ID NO: 21684 - DNA, 20 bp, Artificial Sequence
  chemically synthesized
ctgagtggatttccaccatg

SEQ ID NO: 21685 - DNA, 20 bp, Artificial Sequence
  chemically synthesized
atgtagccttctgtataact

SEQ ID NO: 21686 - DNA, 20 bp, Artificial Sequence
  chemically synthesized
ccttctgtataactaagttt

SEQ ID NO: 21687 - DNA, 20 bp, Artificial Sequence
  chemically synthesized
ctaagtttgagataattatt

SEQ ID NO: 21688 - DNA, 20 bp, Artificial Sequence
  chemically synthesized
ctgtgtctgtattcatccta

SEQ ID NO: 21689 - DNA, 20 bp, Artificial Sequence
  chemically synthesized
ttcatcctacagcatcttct

SEQ ID NO: 21690 - DNA, 20 bp, Artificial Sequence
  chemically synthesized
cagcatcttctcagtgaatt

SEQ ID NO: 21691 - DNA, 20 bp, Artificial Sequence
  chemically synthesized
ttagtttcacacttactttc

SEQ ID NO: 21692 - DNA, 20 bp, Artificial Sequence
  chemically synthesized
tttcacacttactttcaagt

SEQ ID NO: 21693 - DNA, 20 bp, Artificial Sequence
  chemically synthesized
cagaaatgaacttcttaaac

SEQ ID NO: 21694 - DNA, 20 bp, Artificial Sequence
  chemically synthesized
agaaatgaacttcttaaaca

SEQ ID NO: 21695 - DNA, 20 bp, Artificial Sequence
  chemically synthesized
gaaatgaacttcttaaacaa

SEQ ID NO: 21696 - DNA, 20 bp, Artificial Sequence
  chemically synthesized
ttcataaatcattcaccaaa

SEQ ID NO: 21697 - DNA, 20 bp, Artificial Sequence
  chemically synthesized
gtcaactttcctgccatttt

SEQ ID NO: 21698 - DNA, 20 bp, Artificial Sequence
  chemically synthesized
tcaactttcctgccattttt

SEQ ID NO: 21699 - DNA, 20 bp, Artificial Sequence
  chemically synthesized
aggttccatttcctgtattt

SEQ ID NO: 21700 - DNA, 20 bp, Artificial Sequence
  chemically synthesized
catttcctgtattttagaaa

SEQ ID NO: 21701 - DNA, 20 bp, Artificial Sequence
  chemically synthesized
tttcctgtattttagaaaaa

SEQ ID NO: 21702 - DNA, 20 bp, Artificial Sequence
  chemically synthesized
ttcctgtattttagaaaaag

SEQ ID NO: 21703 - DNA, 20 bp, Artificial Sequence
  chemically synthesized
ctgtattttagaaaaagagg

SEQ ID NO: 21704 - DNA, 20 bp, Artificial Sequence
  chemically synthesized
gaggcagctcttctacctaa

SEQ ID NO: 21705 - DNA, 20 bp, Artificial Sequence
  chemically synthesized
ttctacctaacagtattttc

SEQ ID NO: 21706 - DNA, 20 bp, Artificial Sequence
  chemically synthesized
tattttccagttttaaatat

SEQ ID NO: 21707 - DNA, 20 bp, Artificial Sequence
  chemically synthesized
ttccagttttaaatattagt

SEQ ID NO: 21708 - DNA, 20 bp, Artificial Sequence
  chemically synthesized
ccagttttaaatattagtta

SEQ ID NO: 21709 - DNA, 20 bp, Artificial Sequence
  chemically synthesized
gttttaaatattagttagag

SEQ ID NO: 21710 - DNA, 20 bp, Artificial Sequence
  chemically synthesized
agattcacatatctataact

SEQ ID NO: 21711 - DNA, 20 bp, Artificial Sequence
  chemically synthesized
tgagatgatataattattaa

SEQ ID NO: 21712 - DNA, 20 bp, Artificial Sequence
  chemically synthesized
atataattattaatagcctt

SEQ ID NO: 21713 - DNA, 20 bp, Artificial Sequence
  chemically synthesized
tattaatagcctttggttat

SEQ ID NO: 21714 - DNA, 20 bp, Artificial Sequence
  chemically synthesized
aagtgaaactcaactgaaac

SEQ ID NO: 21715 - DNA, 20 bp, Artificial Sequence
  chemically synthesized
agtgaaactcaactgaaact

SEQ ID NO: 21716 - DNA, 20 bp, Artificial Sequence
  chemically synthesized
ggctgaacaaaacaaattac

SEQ ID NO: 21717 - DNA, 20 bp, Artificial Sequence
  chemically synthesized
tgaacaaaacaaattacaag

SEQ ID NO: 21718 - DNA, 20 bp, Artificial Sequence
  chemically synthesized
aacaaaacaaattacaagaa

SEQ ID NO: 21719 - DNA, 20 bp, Artificial Sequence
  chemically synthesized
acaaaacaaattacaagaag

SEQ ID NO: 21720 - DNA, 20 bp, Artificial Sequence
  chemically synthesized
aaaacaaattacaagaagag

SEQ ID NO: 21721 - DNA, 20 bp, Artificial Sequence
  chemically synthesized
ttacaagaagaggagtttat

SEQ ID NO: 21722 - DNA, 20 bp, Artificial Sequence
  chemically synthesized
tacaagaagaggagtttatt

SEQ ID NO: 21723 - DNA, 20 bp, Artificial Sequence
  chemically synthesized
aagaggagtttattaggctg

SEQ ID NO: 21724 - DNA, 20 bp, Artificial Sequence
  chemically synthesized
taggctgtggaatcaaaaaa

SEQ ID NO: 21725 - DNA, 20 bp, Artificial Sequence
  chemically synthesized
aaactgtcctccttgtcact

SEQ ID NO: 21726 - DNA, 20 bp, Artificial Sequence
  chemically synthesized
tcctccttgtcactgagtct

SEQ ID NO: 21727 - DNA, 20 bp, Artificial Sequence
  chemically synthesized
cctccttgtcactgagtctc

SEQ ID NO: 21728 - DNA, 20 bp, Artificial Sequence
  chemically synthesized
cactgagtctcaggaaaaca

SEQ ID NO: 21729 - DNA, 20 bp, Artificial Sequence
  chemically synthesized
gtctcaggaaaacatggaat

SEQ ID NO: 21730 - DNA, 20 bp, Artificial Sequence
  chemically synthesized
ctcaggaaaacatggaatca

SEQ ID NO: 21731 - DNA, 20 bp, Artificial Sequence
  chemically synthesized
aacatggaatcagagatttg

SEQ ID NO: 21732 - DNA, 20 bp, Artificial Sequence
  chemically synthesized
tttactctaaatatttatta

SEQ ID NO: 21733 - DNA, 20 bp, Artificial Sequence
  chemically synthesized
taaatatttattatagtttg

SEQ ID NO: 21734 - DNA, 20 bp, Artificial Sequence
  chemically synthesized
acattgtcattaacaattct

SEQ ID NO: 21735 - DNA, 20 bp, Artificial Sequence
  chemically synthesized
caattctaagcattgcattt

SEQ ID NO: 21736 - DNA, 20 bp, Artificial Sequence
  chemically synthesized
ttttagtaattctacaacaa

SEQ ID NO: 21737 - DNA, 20 bp, Artificial Sequence
  chemically synthesized
ttgaaaaattctttttaaaa

SEQ ID NO: 21738 - DNA, 20 bp, Artificial Sequence
  chemically synthesized
ttaaaaaagttcttctactg

SEQ ID NO: 21739 - DNA, 20 bp, Artificial Sequence
  chemically synthesized
aaaagttcttctactgcggt

SEQ ID NO: 21740 - DNA, 20 bp, Artificial Sequence
  chemically synthesized
aaagttcttctactgcggtt

SEQ ID NO: 21741 - DNA, 20 bp, Artificial Sequence
  chemically synthesized
agttcttctactgcggttag

SEQ ID NO: 21742 - DNA, 20 bp, Artificial Sequence
  chemically synthesized
ttctactgcggttaggagtt

SEQ ID NO: 21743 - DNA, 20 bp, Artificial Sequence
  chemically synthesized
ctactgcggttaggagtttg

SEQ ID NO: 21744 - DNA, 20 bp, Artificial Sequence
  chemically synthesized
ggagatacaatgcaaaatat

SEQ ID NO: 21745 - DNA, 20 bp, Artificial Sequence
  chemically synthesized
atgcaaaatatcagttttca

SEQ ID NO: 21746 - DNA, 20 bp, Artificial Sequence
  chemically synthesized
tgcaaaatatcagttttcat

SEQ ID NO: 21747 - DNA, 20 bp, Artificial Sequence
  chemically synthesized
gcaaaatatcagttttcata

SEQ ID NO: 21748 - DNA, 20 bp, Artificial Sequence
  chemically synthesized
ttcatagggaacaatatttt

SEQ ID NO: 21749 - DNA, 20 bp, Artificial Sequence
  chemically synthesized
catagggaacaatatttttg

SEQ ID NO: 21750 - DNA, 20 bp, Artificial Sequence
  chemically synthesized
agggaacaatatttttggag

SEQ ID NO: 21751 - DNA, 20 bp, Artificial Sequence
  chemically synthesized
gaacaatatttttggagtag

SEQ ID NO: 21752 - DNA, 20 bp, Artificial Sequence
  chemically synthesized
aacaatatttttggagtaga

SEQ ID NO: 21753 - DNA, 20 bp, Artificial Sequence
  chemically synthesized
caatatttttggagtagaag

SEQ ID NO: 21754 - DNA, 20 bp, Artificial Sequence
  chemically synthesized
aatatttttggagtagaagg

SEQ ID NO: 21755 - DNA, 20 bp, Artificial Sequence
  chemically synthesized
tatttttggagtagaaggag

SEQ ID NO: 21756 - DNA, 20 bp, Artificial Sequence
  chemically synthesized
gtagaaggaggagaaatttt

SEQ ID NO: 21757 - DNA, 20 bp, Artificial Sequence
  chemically synthesized
ggaggagaaattttcagaaa

SEQ ID NO: 21758 - DNA, 20 bp, Artificial Sequence
  chemically synthesized
gagaaattttcagaaaaaga

SEQ ID NO: 21759 - DNA, 20 bp, Artificial Sequence
  chemically synthesized
aaattttcagaaaaagaaag

SEQ ID NO: 21760 - DNA, 20 bp, Artificial Sequence
  chemically synthesized
aattttcagaaaaagaaagt

SEQ ID NO: 21761 - DNA, 20 bp, Artificial Sequence
  chemically synthesized
aaaaagaaagtaggtactac

SEQ ID NO: 21762 - DNA, 20 bp, Artificial Sequence
  chemically synthesized
agtaggtactacaagcatga

SEQ ID NO: 21763 - DNA, 20 bp, Artificial Sequence
  chemically synthesized
ctacaagcatgacggaatac

SEQ ID NO: 21764 - DNA, 20 bp, Artificial Sequence
  chemically synthesized
tacaagcatgacggaataca

SEQ ID NO: 21765 - DNA, 20 bp, Artificial Sequence
  chemically synthesized
atgacggaatacaaggcaaa

SEQ ID NO: 21766 - DNA, 20 bp, Artificial Sequence
  chemically synthesized
acggaatacaaggcaaaaag

SEQ ID NO: 21767 - DNA, 20 bp, Artificial Sequence
  chemically synthesized
gaatacaaggcaaaaagtag

SEQ ID NO: 21768 - DNA, 20 bp, Artificial Sequence
  chemically synthesized
ggcaaaaagtagaagccact

SEQ ID NO: 21769 - DNA, 20 bp, Artificial Sequence
  chemically synthesized
gcaaaaagtagaagccacta

SEQ ID NO: 21770 - DNA, 20 bp, Artificial Sequence
  chemically synthesized
aaagtagaagccactaagga

SEQ ID NO: 21771 - DNA, 20 bp, Artificial Sequence
  chemically synthesized
ccactaaggatagtctactg

SEQ ID NO: 21772 - DNA, 20 bp, Artificial Sequence
  chemically synthesized
ctaaggatagtctactgtag

SEQ ID NO: 21773 - DNA, 20 bp, Artificial Sequence
  chemically synthesized
aaggatagtctactgtagtg

SEQ ID NO: 21774 - DNA, 20 bp, Artificial Sequence
  chemically synthesized
tagtggagtaccattcacac

SEQ ID NO: 21775 - DNA, 20 bp, Artificial Sequence
  chemically synthesized
taccattcacactggcctta

SEQ ID NO: 21776 - DNA, 20 bp, Artificial Sequence
  chemically synthesized
attcacactggccttatagt

SEQ ID NO: 21777 - DNA, 20 bp, Artificial Sequence
  chemically synthesized
cacactggccttatagttag

SEQ ID NO: 21778 - DNA, 20 bp, Artificial Sequence
  chemically synthesized
aattaaaaatgttatgccct

SEQ ID NO: 21779 - DNA, 20 bp, Artificial Sequence
  chemically synthesized
ttaaaaatgttatgcccttg

SEQ ID NO: 21780 - DNA, 20 bp, Artificial Sequence
  chemically synthesized
taaaaatgttatgcccttgg

SEQ ID NO: 21781 - DNA, 20 bp, Artificial Sequence
  chemically synthesized
aaaaatgttatgcccttgga

SEQ ID NO: 21782 - DNA, 20 bp, Artificial Sequence
  chemically synthesized
ttatattaaatttccccatc

SEQ ID NO: 21783 - DNA, 20 bp, Artificial Sequence
  chemically synthesized
aaatttccccatcaagaaaa

SEQ ID NO: 21784 - DNA, 20 bp, Artificial Sequence
  chemically synthesized
aatatttttatgaataaaat

SEQ ID NO: 21785 - DNA, 20 bp, Artificial Sequence
  chemically synthesized
tttatgaataaaataagttg

SEQ ID NO: 21786 - DNA, 20 bp, Artificial Sequence
  chemically synthesized
aataaaataagttgtggatg

SEQ ID NO: 21787 - DNA, 20 bp, Artificial Sequence
  chemically synthesized
aaaataagttgtggatgtag

SEQ ID NO: 21788 - DNA, 20 bp, Artificial Sequence
  chemically synthesized
aataagttgtggatgtagta

SEQ ID NO: 21789 - DNA, 20 bp, Artificial Sequence
  chemically synthesized
ggatgtagtagagcataatt

SEQ ID NO: 21790 - DNA, 20 bp, Artificial Sequence
  chemically synthesized
gatgtagtagagcataatta

SEQ ID NO: 21791 - DNA, 20 bp, Artificial Sequence
  chemically synthesized
atgtagtagagcataattaa

SEQ ID NO: 21792 - DNA, 20 bp, Artificial Sequence
  chemically synthesized
ataattaagggacacatgtt

SEQ ID NO: 21793 - DNA, 20 bp, Artificial Sequence
  chemically synthesized
gttttatgaatgattgaaaa

SEQ ID NO: 21794 - DNA, 20 bp, Artificial Sequence
  chemically synthesized
ttttatgaatgattgaaaac

SEQ ID NO: 21795 - DNA, 20 bp, Artificial Sequence
  chemically synthesized
atgcactcacactcacaatt

SEQ ID NO: 21796 - DNA, 20 bp, Artificial Sequence
  chemically synthesized
cacactcacaatttagtatt

SEQ ID NO: 21797 - DNA, 20 bp, Artificial Sequence
  chemically synthesized
agtattcagactgtgttgct

SEQ ID NO: 21798 - DNA, 20 bp, Artificial Sequence
  chemically synthesized
gtattcagactgtgttgctc

SEQ ID NO: 21799 - DNA, 20 bp, Artificial Sequence
  chemically synthesized
actgtgttgctcaggtgaca

SEQ ID NO: 21800 - DNA, 20 bp, Artificial Sequence
  chemically synthesized
ctcaggtgacatggcgtgac

SEQ ID NO: 21801 - DNA, 20 bp, Artificial Sequence
  chemically synthesized
tcaggtgacatggcgtgaca

SEQ ID NO: 21802 - DNA, 20 bp, Artificial Sequence
  chemically synthesized
caaggataaaaaacatgata

SEQ ID NO: 21803 - DNA, 20 bp, Artificial Sequence
  chemically synthesized
agctgatttttttatatgtt

SEQ ID NO: 21804 - DNA, 20 bp, Artificial Sequence
  chemically synthesized
aattacatctcttaatgaaa

SEQ ID NO: 21805 - DNA, 20 bp, Artificial Sequence
  chemically synthesized
taatgaaacagaatataaat

SEQ ID NO: 21806 - DNA, 20 bp, Artificial Sequence
  chemically synthesized
aatgaaacagaatataaata

SEQ ID NO: 21807 - DNA, 20 bp, Artificial Sequence
  chemically synthesized
cagaatataaataaggattg

SEQ ID NO: 21808 - DNA, 20 bp, Artificial Sequence
  chemically synthesized
taaggattgcagtttttctt

SEQ ID NO: 21809 - DNA, 20 bp, Artificial Sequence
  chemically synthesized
gattgcagtttttcttaagt

SEQ ID NO: 21810 - DNA, 20 bp, Artificial Sequence
  chemically synthesized
tcttaagttggactctctat

SEQ ID NO: 21811 - DNA, 20 bp, Artificial Sequence
  chemically synthesized
actctctatgagcaatacct

SEQ ID NO: 21812 - DNA, 20 bp, Artificial Sequence
  chemically synthesized
tctatgagcaatacctgaga

SEQ ID NO: 21813 - DNA, 20 bp, Artificial Sequence
  chemically synthesized
ctatgagcaatacctgagat

SEQ ID NO: 21814 - DNA, 20 bp, Artificial Sequence
  chemically synthesized
tatgagcaatacctgagata

SEQ ID NO: 21815 - DNA, 20 bp, Artificial Sequence
  chemically synthesized
aatttattaatgaatgctct

SEQ ID NO: 21816 - DNA, 20 bp, Artificial Sequence
  chemically synthesized
atttattaatgaatgctctc

SEQ ID NO: 21817 - DNA, 20 bp, Artificial Sequence
  chemically synthesized
ttattaatgaatgctctcag

SEQ ID NO: 21818 - DNA, 20 bp, Artificial Sequence
  chemically synthesized
taatgaatgctctcaggaga

SEQ ID NO: 21819 - DNA, 20 bp, Artificial Sequence
  chemically synthesized
aatgaatgctctcaggagac

SEQ ID NO: 21820 - DNA, 20 bp, Artificial Sequence
  chemically synthesized
atgaatgctctcaggagaca

SEQ ID NO: 21821 - DNA, 20 bp, Artificial Sequence
  chemically synthesized
gaatgctctcaggagacagg

SEQ ID NO: 21822 - DNA, 20 bp, Artificial Sequence
  chemically synthesized
gctctcaggagacagggagc

SEQ ID NO: 21823 - DNA, 20 bp, Artificial Sequence
  chemically synthesized
aggagacagggagcaagtaa

SEQ ID NO: 21824 - DNA, 20 bp, Artificial Sequence
  chemically synthesized
agacagggagcaagtaaaag

SEQ ID NO: 21825 - DNA, 20 bp, Artificial Sequence
  chemically synthesized
gggagcaagtaaaagcagtg

SEQ ID NO: 21826 - DNA, 20 bp, Artificial Sequence
  chemically synthesized
gcaagtaaaagcagtgtgga

SEQ ID NO: 21827 - DNA, 20 bp, Artificial Sequence
  chemically synthesized
caagtaaaagcagtgtggac

SEQ ID NO: 21828 - DNA, 20 bp, Artificial Sequence
  chemically synthesized
aagtaaaagcagtgtggaca

SEQ ID NO: 21829 - DNA, 20 bp, Artificial Sequence
  chemically synthesized
agtaaaagcagtgtggacag

SEQ ID NO: 21830 - DNA, 20 bp, Artificial Sequence
  chemically synthesized
aaaagcagtgtggacagggg

SEQ ID NO: 21831 - DNA, 20 bp, Artificial Sequence
  chemically synthesized
aaagcagtgtggacagggga

SEQ ID NO: 21832 - DNA, 20 bp, Artificial Sequence
  chemically synthesized
agcagtgtggacaggggaag

SEQ ID NO: 21833 - DNA, 20 bp, Artificial Sequence
  chemically synthesized
gcagtgtggacaggggaagg

SEQ ID NO: 21834 - DNA, 20 bp, Artificial Sequence
  chemically synthesized
tgtggacaggggaaggaggt

SEQ ID NO: 21835 - DNA, 20 bp, Artificial Sequence
  chemically synthesized
gacaggggaaggaggtaagc

SEQ ID NO: 21836 - DNA, 20 bp, Artificial Sequence
  chemically synthesized
aggtaagcaagtgcatactg

SEQ ID NO: 21837 - DNA, 20 bp, Artificial Sequence
  chemically synthesized
aagcaagtgcatactgaagc

SEQ ID NO: 21838 - DNA, 20 bp, Artificial Sequence
  chemically synthesized
gcaagtgcatactgaagctg

SEQ ID NO: 21839 - DNA, 20 bp, Artificial Sequence
  chemically synthesized
tgcatactgaagctggagct

SEQ ID NO: 21840 - DNA, 20 bp, Artificial Sequence
  chemically synthesized
ctgaagctggagcttagctt

SEQ ID NO: 21841 - DNA, 20 bp, Artificial Sequence
  chemically synthesized
aagctggagcttagcttcag

SEQ ID NO: 21842 - DNA, 20 bp, Artificial Sequence
  chemically synthesized
agctggagcttagcttcaga

SEQ ID NO: 21843 - DNA, 20 bp, Artificial Sequence
  chemically synthesized
ggagcttagcttcagaaggc

SEQ ID NO: 21844 - DNA, 20 bp, Artificial Sequence
  chemically synthesized
agcttagcttcagaaggcaa

SEQ ID NO: 21845 - DNA, 20 bp, Artificial Sequence
  chemically synthesized
gcttagcttcagaaggcaag

SEQ ID NO: 21846 - DNA, 20 bp, Artificial Sequence
  chemically synthesized
cttagcttcagaaggcaaga

SEQ ID NO: 21847 - DNA, 20 bp, Artificial Sequence
  chemically synthesized
gcttcagaaggcaagagggt

SEQ ID NO: 21848 - DNA, 20 bp, Artificial Sequence
  chemically synthesized
agagggtcagtatttgccta

SEQ ID NO: 21849 - DNA, 20 bp, Artificial Sequence
  chemically synthesized
ttgcctatggcctgctacct

SEQ ID NO: 21850 - DNA, 20 bp, Artificial Sequence
  chemically synthesized
tgcctatggcctgctaccta

SEQ ID NO: 21851 - DNA, 20 bp, Artificial Sequence
  chemically synthesized
cctatggcctgctacctaag

SEQ ID NO: 21852 - DNA, 20 bp, Artificial Sequence
  chemically synthesized
atggcctgctacctaaggag

SEQ ID NO: 21853 - DNA, 20 bp, Artificial Sequence
  chemically synthesized
tggcctgctacctaaggagc

SEQ ID NO: 21854 - DNA, 20 bp, Artificial Sequence
  chemically synthesized
ggcctgctacctaaggagca

SEQ ID NO: 21855 - DNA, 20 bp, Artificial Sequence
  chemically synthesized
gcctgctacctaaggagcag

SEQ ID NO: 21856 - DNA, 20 bp, Artificial Sequence
  chemically synthesized
gcaggggccattttcttcat

SEQ ID NO: 21857 - DNA, 20 bp, Artificial Sequence
  chemically synthesized
ttcataagacatttcctgct

SEQ ID NO: 21858 - DNA, 20 bp, Artificial Sequence
  chemically synthesized
aagacatttcctgctgagtt

SEQ ID NO: 21859 - DNA, 20 bp, Artificial Sequence
  chemically synthesized
gagttgagaacaacaacctg

SEQ ID NO: 21860 - DNA, 20 bp, Artificial Sequence
  chemically synthesized
tgagaacaacaacctgcaga

SEQ ID NO: 21861 - DNA, 20 bp, Artificial Sequence
  chemically synthesized
gaacaacaacctgcagaaag

SEQ ID NO: 21862 - DNA, 20 bp, Artificial Sequence
  chemically synthesized
aaagcagaaacatgaacaat

SEQ ID NO: 21863 - DNA, 20 bp, Artificial Sequence
  chemically synthesized
gcagaaacatgaacaatgag

SEQ ID NO: 21864 - DNA, 20 bp, Artificial Sequence
  chemically synthesized
caatgagcagccaacattca

SEQ ID NO: 21865 - DNA, 20 bp, Artificial Sequence
  chemically synthesized
aatgagcagccaacattcac

SEQ ID NO: 21866 - DNA, 20 bp, Artificial Sequence
  chemically synthesized
gcacaattctgtaaaatgat

SEQ ID NO: 21867 - DNA, 20 bp, Artificial Sequence
  chemically synthesized
cacaattctgtaaaatgatc

SEQ ID NO: 21868 - DNA, 20 bp, Artificial Sequence
  chemically synthesized
acaattctgtaaaatgatcg

SEQ ID NO: 21869 - DNA, 20 bp, Artificial Sequence
  chemically synthesized
atgatcggggtaaaacacca

SEQ ID NO: 21870 - DNA, 20 bp, Artificial Sequence
  chemically synthesized
cataaacaatatcttctata

SEQ ID NO: 21871 - DNA, 20 bp, Artificial Sequence
  chemically synthesized
tcccctctcttgtctcactg

SEQ ID NO: 21872 - DNA, 20 bp, Artificial Sequence
  chemically synthesized
tattatttttgctctgatta

SEQ ID NO: 21873 - DNA, 20 bp, Artificial Sequence
  chemically synthesized
gctctgattaaagtataatt

SEQ ID NO: 21874 - DNA, 20 bp, Artificial Sequence
  chemically synthesized
agacataacctccctctttt

SEQ ID NO: 21875 - DNA, 20 bp, Artificial Sequence
  chemically synthesized
gacataacctccctcttttt

SEQ ID NO: 21876 - DNA, 20 bp, Artificial Sequence
  chemically synthesized
tttttaggatattttaaatt

SEQ ID NO: 21877 - DNA, 20 bp, Artificial Sequence
  chemically synthesized
ggatattttaaattgagtta

SEQ ID NO: 21878 - DNA, 20 bp, Artificial Sequence
  chemically synthesized
gatattttaaattgagttat

SEQ ID NO: 21879 - DNA, 20 bp, Artificial Sequence
  chemically synthesized
tgggtcccttcctaactcat

SEQ ID NO: 21880 - DNA, 20 bp, Artificial Sequence
  chemically synthesized
tcagacaattttaatcaaat

SEQ ID NO: 21881 - DNA, 20 bp, Artificial Sequence
  chemically synthesized
aatgacattgttgtattctt

SEQ ID NO: 21882 - DNA, 20 bp, Artificial Sequence
  chemically synthesized
atgacattgttgtattcttt

SEQ ID NO: 21883 - DNA, 20 bp, Artificial Sequence
  chemically synthesized
ggaaatttacacttattaca

SEQ ID NO: 21884 - DNA, 20 bp, Artificial Sequence
  chemically synthesized
ttacacttattacatggaat

SEQ ID NO: 21885 - DNA, 20 bp, Artificial Sequence
  chemically synthesized
atggaatcagaatgtatgta

SEQ ID NO: 21886 - DNA, 20 bp, Artificial Sequence
  chemically synthesized
aatcagaatgtatgtacaga

SEQ ID NO: 21887 - DNA, 20 bp, Artificial Sequence
  chemically synthesized
aatcattcttcaaaaaaatg

SEQ ID NO: 21888 - DNA, 20 bp, Artificial Sequence
  chemically synthesized
cctatttttttttgttcctt

SEQ ID NO: 21889 - DNA, 20 bp, Artificial Sequence
  chemically synthesized
gttccttcagacctttttca

SEQ ID NO: 21890 - DNA, 20 bp, Artificial Sequence
  chemically synthesized
tcagacctttttcatagcaa

SEQ ID NO: 21891 - DNA, 20 bp, Artificial Sequence
  chemically synthesized
cagacctttttcatagcaaa

SEQ ID NO: 21892 - DNA, 20 bp, Artificial Sequence
  chemically synthesized
gacctttttcatagcaaaag

SEQ ID NO: 21893 - DNA, 20 bp, Artificial Sequence
  chemically synthesized
acctttttcatagcaaaagg

SEQ ID NO: 21894 - DNA, 20 bp, Artificial Sequence
  chemically synthesized
cctttttcatagcaaaagga

SEQ ID NO: 21895 - DNA, 20 bp, Artificial Sequence
  chemically synthesized
ttcatagcaaaaggagggtg

SEQ ID NO: 21896 - DNA, 20 bp, Artificial Sequence
  chemically synthesized
tcatagcaaaaggagggtga

SEQ ID NO: 21897 - DNA, 20 bp, Artificial Sequence
  chemically synthesized
aactgtctcttccactaatt

SEQ ID NO: 21898 - DNA, 20 bp, Artificial Sequence
  chemically synthesized
tctcttccactaatttggac

SEQ ID NO: 21899 - DNA, 20 bp, Artificial Sequence
  chemically synthesized
ttccactaatttggactagt

SEQ ID NO: 21900 - DNA, 20 bp, Artificial Sequence
  chemically synthesized
actaatttggactagtcagc

SEQ ID NO: 21901 - DNA, 20 bp, Artificial Sequence
  chemically synthesized
tttggactagtcagccagcg

SEQ ID NO: 21902 - DNA, 20 bp, Artificial Sequence
  chemically synthesized
gtcagccagcgtagatatct

SEQ ID NO: 21903 - DNA, 20 bp, Artificial Sequence
  chemically synthesized
tcagccagcgtagatatctg

SEQ ID NO: 21904 - DNA, 20 bp, Artificial Sequence
  chemically synthesized
ccagcgtagatatctgagga

SEQ ID NO: 21905 - DNA, 20 bp, Artificial Sequence
  chemically synthesized
tctgaggatggcctcaacat

SEQ ID NO: 21906 - DNA, 20 bp, Artificial Sequence
  chemically synthesized
tgaggatggcctcaacattg

SEQ ID NO: 21907 - DNA, 20 bp, Artificial Sequence
  chemically synthesized
gatggcctcaacattggagc

SEQ ID NO: 21908 - DNA, 20 bp, Artificial Sequence
  chemically synthesized
tcaacattggagctagcaac

SEQ ID NO: 21909 - DNA, 20 bp, Artificial Sequence
  chemically synthesized
caacattggagctagcaact

SEQ ID NO: 21910 - DNA, 20 bp, Artificial Sequence
  chemically synthesized
aacattggagctagcaacta

SEQ ID NO: 21911 - DNA, 20 bp, Artificial Sequence
  chemically synthesized
attggagctagcaactaggg

SEQ ID NO: 21912 - DNA, 20 bp, Artificial Sequence
  chemically synthesized
ggagctagcaactagggtag

SEQ ID NO: 21913 - DNA, 20 bp, Artificial Sequence
  chemically synthesized
agcaactagggtagtagaat

SEQ ID NO: 21914 - DNA, 20 bp, Artificial Sequence
  chemically synthesized
tagggtagtagaataagaat

SEQ ID NO: 21915 - DNA, 20 bp, Artificial Sequence
  chemically synthesized
gggtagtagaataagaatga

SEQ ID NO: 21916 - DNA, 20 bp, Artificial Sequence
  chemically synthesized
agtagaataagaatgagagc

SEQ ID NO: 21917 - DNA, 20 bp, Artificial Sequence
  chemically synthesized
gaataagaatgagagcaaga

SEQ ID NO: 21918 - DNA, 20 bp, Artificial Sequence
  chemically synthesized
taagaatgagagcaagatag

SEQ ID NO: 21919 - DNA, 20 bp, Artificial Sequence
  chemically synthesized
aagaatgagagcaagataga

SEQ ID NO: 21920 - DNA, 20 bp, Artificial Sequence
  chemically synthesized
gaatgagagcaagatagaag

SEQ ID NO: 21921 - DNA, 20 bp, Artificial Sequence
  chemically synthesized
aatgagagcaagatagaagg

SEQ ID NO: 21922 - DNA, 20 bp, Artificial Sequence
  chemically synthesized
ttctcacatttttttgttac

SEQ ID NO: 21923 - DNA, 20 bp, Artificial Sequence
  chemically synthesized
tttttttgttacaagtttgt

SEQ ID NO: 21924 - DNA, 20 bp, Artificial Sequence
  chemically synthesized
ttttgttacaagtttgtcag

SEQ ID NO: 21925 - DNA, 20 bp, Artificial Sequence
  chemically synthesized
tttgttacaagtttgtcaga

SEQ ID NO: 21926 - DNA, 20 bp, Artificial Sequence
  chemically synthesized
tttgtcagaaggtactgcct

SEQ ID NO: 21927 - DNA, 20 bp, Artificial Sequence
  chemically synthesized
ttgtcagaaggtactgcctt

SEQ ID NO: 21928 - DNA, 20 bp, Artificial Sequence
  chemically synthesized
tgtcagaaggtactgccttg

SEQ ID NO: 21929 - DNA, 20 bp, Artificial Sequence
  chemically synthesized
ctgccttggggaataaatat

SEQ ID NO: 21930 - DNA, 20 bp, Artificial Sequence
  chemically synthesized
ggggaataaatatgagttta

SEQ ID NO: 21931 - DNA, 20 bp, Artificial Sequence
  chemically synthesized
aatatgagtttatggttttt

SEQ ID NO: 21932 - DNA, 20 bp, Artificial Sequence
  chemically synthesized
acaaattcattataatttga

SEQ ID NO: 21933 - DNA, 20 bp, Artificial Sequence
  chemically synthesized
aaattcattataatttgatg

SEQ ID NO: 21934 - DNA, 20 bp, Artificial Sequence
  chemically synthesized
aattcattataatttgatgg

SEQ ID NO: 21935 - DNA, 20 bp, Artificial Sequence
  chemically synthesized
attcattataatttgatgga

SEQ ID NO: 21936 - DNA, 20 bp, Artificial Sequence
  chemically synthesized
tcattataatttgatggagg

SEQ ID NO: 21937 - DNA, 20 bp, Artificial Sequence
  chemically synthesized
cattataatttgatggaggg

SEQ ID NO: 21938 - DNA, 20 bp, Artificial Sequence
  chemically synthesized
ttataatttgatggagggag

SEQ ID NO: 21939 - DNA, 20 bp, Artificial Sequence
  chemically synthesized
tataatttgatggagggagg

SEQ ID NO: 21940 - DNA, 20 bp, Artificial Sequence
  chemically synthesized
tggagggaggaggaaccaac

SEQ ID NO: 21941 - DNA, 20 bp, Artificial Sequence
  chemically synthesized
gaggaaccaactagactgtt

SEQ ID NO: 21942 - DNA, 20 bp, Artificial Sequence
  chemically synthesized
aactagactgttgagatgat

SEQ ID NO: 21943 - DNA, 20 bp, Artificial Sequence
  chemically synthesized
ctgttgagatgataagtaat

SEQ ID NO: 21944 - DNA, 20 bp, Artificial Sequence
  chemically synthesized
tgttgagatgataagtaatt

SEQ ID NO: 21945 - DNA, 20 bp, Artificial Sequence
  chemically synthesized
agtaattaggtcactgatca

SEQ ID NO: 21946 - DNA, 20 bp, Artificial Sequence
  chemically synthesized
aattaggtcactgatcaaag

SEQ ID NO: 21947 - DNA, 20 bp, Artificial Sequence
  chemically synthesized
gaagattatattcttttttg

SEQ ID NO: 21948 - DNA, 20 bp, Artificial Sequence
  chemically synthesized
aagattatattcttttttgc

SEQ ID NO: 21949 - DNA, 20 bp, Artificial Sequence
  chemically synthesized
cttttttgcaggaaaattcc

SEQ ID NO: 21950 - DNA, 20 bp, Artificial Sequence
  chemically synthesized
gcaggaaaattcctggactt

SEQ ID NO: 21951 - DNA, 20 bp, Artificial Sequence
  chemically synthesized
gacttcagtgaccaaattta

SEQ ID NO: 21952 - DNA, 20 bp, Artificial Sequence
  chemically synthesized
acttcagtgaccaaatttat

SEQ ID NO: 21953 - DNA, 20 bp, Artificial Sequence
  chemically synthesized
ataggttcccattgtttgta

SEQ ID NO: 21954 - DNA, 20 bp, Artificial Sequence
  chemically synthesized
attgtttgtatggacacctg

SEQ ID NO: 21955 - DNA, 20 bp, Artificial Sequence
  chemically synthesized
tgtttgtatggacacctgca

SEQ ID NO: 21956 - DNA, 20 bp, Artificial Sequence
  chemically synthesized
acacctgcagagaaattcat

SEQ ID NO: 21957 - DNA, 20 bp, Artificial Sequence
  chemically synthesized
acctgcagagaaattcataa

SEQ ID NO: 21958 - DNA, 20 bp, Artificial Sequence
  chemically synthesized
gcagagaaattcataagagt

SEQ ID NO: 21959 - DNA, 20 bp, Artificial Sequence
  chemically synthesized
aattcataagagttggaaat

SEQ ID NO: 21960 - DNA, 20 bp, Artificial Sequence
  chemically synthesized
gttggaaattagatttgaca

SEQ ID NO: 21961 - DNA, 20 bp, Artificial Sequence
  chemically synthesized
accatgaaataaacatatgt

SEQ ID NO: 21962 - DNA, 20 bp, Artificial Sequence
  chemically synthesized
aacatatgttagttacatta

SEQ ID NO: 21963 - DNA, 20 bp, Artificial Sequence
  chemically synthesized
ttacattatagacataccaa

SEQ ID NO: 21964 - DNA, 20 bp, Artificial Sequence
  chemically synthesized
agacataccaatagatgcct

SEQ ID NO: 21965 - DNA, 20 bp, Artificial Sequence
  chemically synthesized
gacataccaatagatgccta

SEQ ID NO: 21966 - DNA, 20 bp, Artificial Sequence
  chemically synthesized
gtattgttatcacaataatt

SEQ ID NO: 21967 - DNA, 20 bp, Artificial Sequence
  chemically synthesized
ttgttatcacaataatttag

SEQ ID NO: 21968 - DNA, 20 bp, Artificial Sequence
  chemically synthesized
tatcacaataatttagtgga

SEQ ID NO: 21969 - DNA, 20 bp, Artificial Sequence
  chemically synthesized
caataatttagtggaaagct

SEQ ID NO: 21970 - DNA, 20 bp, Artificial Sequence
  chemically synthesized
ataatttagtggaaagctta

SEQ ID NO: 21971 - DNA, 20 bp, Artificial Sequence
  chemically synthesized
ttagagaaatattccgttta

SEQ ID NO: 21972 - DNA, 20 bp, Artificial Sequence
  chemically synthesized
tagagaaatattccgtttac

SEQ ID NO: 21973 - DNA, 20 bp, Artificial Sequence
  chemically synthesized
aaatttgtacaaactacatt

SEQ ID NO: 21974 - DNA, 20 bp, Artificial Sequence
  chemically synthesized
gtacaaactacatttagcta

SEQ ID NO: 21975 - DNA, 20 bp, Artificial Sequence
  chemically synthesized
acaaactacatttagctaaa

SEQ ID NO: 21976 - DNA, 20 bp, Artificial Sequence
  chemically synthesized
actacatttagctaaagagt

SEQ ID NO: 21977 - DNA, 20 bp, Artificial Sequence
  chemically synthesized
ctacatttagctaaagagtt

SEQ ID NO: 21978 - DNA, 20 bp, Artificial Sequence
  chemically synthesized
tagctaaagagttgggctta

SEQ ID NO: 21979 - DNA, 20 bp, Artificial Sequence
  chemically synthesized
gctaaagagttgggcttaaa

SEQ ID NO: 21980 - DNA, 20 bp, Artificial Sequence
  chemically synthesized
ttgggcttaaagagatacct

SEQ ID NO: 21981 - DNA, 20 bp, Artificial Sequence
  chemically synthesized
tgggcttaaagagatacctt

SEQ ID NO: 21982 - DNA, 20 bp, Artificial Sequence
  chemically synthesized
gggcttaaagagatacctta

SEQ ID NO: 21983 - DNA, 20 bp, Artificial Sequence
  chemically synthesized
agataccttagggaaacttg

SEQ ID NO: 21984 - DNA, 20 bp, Artificial Sequence
  chemically synthesized
attttaacacctattttacc

SEQ ID NO: 21985 - DNA, 20 bp, Artificial Sequence
  chemically synthesized
cctattttaccaagtcatat

SEQ ID NO: 21986 - DNA, 20 bp, Artificial Sequence
  chemically synthesized
agtcatatgagcatgcatgc

SEQ ID NO: 21987 - DNA, 20 bp, Artificial Sequence
  chemically synthesized
tgagcatgcatgctagatat

SEQ ID NO: 21988 - DNA, 20 bp, Artificial Sequence
  chemically synthesized
tttgctctcctgctaaatat

SEQ ID NO: 21989 - DNA, 20 bp, Artificial Sequence
  chemically synthesized
tgctctcctgctaaatatta

SEQ ID NO: 21990 - DNA, 20 bp, Artificial Sequence
  chemically synthesized
ttagagtttttacattctgt

SEQ ID NO: 21991 - DNA, 20 bp, Artificial Sequence
  chemically synthesized
agagtttttacattctgtga

SEQ ID NO: 21992 - DNA, 20 bp, Artificial Sequence
  chemically synthesized
gtgagagtgactgtgatgat

SEQ ID NO: 21993 - DNA, 20 bp, Artificial Sequence
  chemically synthesized
gagagtgactgtgatgattg

SEQ ID NO: 21994 - DNA, 20 bp, Artificial Sequence
  chemically synthesized
tgactgtgatgattggagat

SEQ ID NO: 21995 - DNA, 20 bp, Artificial Sequence
  chemically synthesized
gactgtgatgattggagatc

SEQ ID NO: 21996 - DNA, 20 bp, Artificial Sequence
  chemically synthesized
gagatcaggttccaattcta

SEQ ID NO: 21997 - DNA, 20 bp, Artificial Sequence
  chemically synthesized
agatcaggttccaattctat

SEQ ID NO: 21998 - DNA, 20 bp, Artificial Sequence
  chemically synthesized
tcaggttccaattctatggg

SEQ ID NO: 21999 - DNA, 20 bp, Artificial Sequence
  chemically synthesized
ccaattctatgggtagtaaa

SEQ ID NO: 22000 - DNA, 20 bp, Artificial Sequence
  chemically synthesized
caattctatgggtagtaaaa

SEQ ID NO: 22001 - DNA, 20 bp, Artificial Sequence
  chemically synthesized
ctatgggtagtaaaaaggtg

SEQ ID NO: 22002 - DNA, 20 bp, Artificial Sequence
  chemically synthesized
ggtagtaaaaaggtgaagaa

SEQ ID NO: 22003 - DNA, 20 bp, Artificial Sequence
  chemically synthesized
aatggcattctgaatctgct

SEQ ID NO: 22004 - DNA, 20 bp, Artificial Sequence
  chemically synthesized
ggtcttgacactatatgtta

SEQ ID NO: 22005 - DNA, 20 bp, Artificial Sequence
  chemically synthesized
gtcttgacactatatgttat

SEQ ID NO: 22006 - DNA, 20 bp, Artificial Sequence
  chemically synthesized
ctatatgttataggattcat

SEQ ID NO: 22007 - DNA, 20 bp, Artificial Sequence
  chemically synthesized
tatgttataggattcattag

SEQ ID NO: 22008 - DNA, 20 bp, Artificial Sequence
  chemically synthesized
tgttataggattcattagtg

SEQ ID NO: 22009 - DNA, 20 bp, Artificial Sequence
  chemically synthesized
gttataggattcattagtgg

SEQ ID NO: 22010 - DNA, 20 bp, Artificial Sequence
  chemically synthesized
ttataggattcattagtgga

SEQ ID NO: 22011 - DNA, 20 bp, Artificial Sequence
  chemically synthesized
ggattcattagtggagggaa

SEQ ID NO: 22012 - DNA, 20 bp, Artificial Sequence
  chemically synthesized
ttagtggagggaacagaaaa

SEQ ID NO: 22013 - DNA, 20 bp, Artificial Sequence
  chemically synthesized
tagtggagggaacagaaaat

SEQ ID NO: 22014 - DNA, 20 bp, Artificial Sequence
  chemically synthesized
gagggaacagaaaataggca

SEQ ID NO: 22015 - DNA, 20 bp, Artificial Sequence
  chemically synthesized
aaataggcatagctcataat

SEQ ID NO: 22016 - DNA, 20 bp, Artificial Sequence
  chemically synthesized
aataggcatagctcataatg

SEQ ID NO: 22017 - DNA, 20 bp, Artificial Sequence
  chemically synthesized
ataatgaggtgaacaatatg

SEQ ID NO: 22018 - DNA, 20 bp, Artificial Sequence
  chemically synthesized
tgctttccaaaacgatgaat

SEQ ID NO: 22019 - DNA, 20 bp, Artificial Sequence
  chemically synthesized
ctttccaaaacgatgaatca

SEQ ID NO: 22020 - DNA, 20 bp, Artificial Sequence
  chemically synthesized
atcactgtgacataaaaaac

SEQ ID NO: 22021 - DNA, 20 bp, Artificial Sequence
  chemically synthesized
tcactgtgacataaaaaacc

SEQ ID NO: 22022 - DNA, 20 bp, Artificial Sequence
  chemically synthesized
tgacataaaaaaccaggaca

SEQ ID NO: 22023 - DNA, 20 bp, Artificial Sequence
  chemically synthesized
cataaaaaaccaggacacag

SEQ ID NO: 22024 - DNA, 20 bp, Artificial Sequence
  chemically synthesized
aaaccaggacacagcagata

SEQ ID NO: 22025 - DNA, 20 bp, Artificial Sequence
  chemically synthesized
aaccaggacacagcagatat

SEQ ID NO: 22026 - DNA, 20 bp, Artificial Sequence
  chemically synthesized
ccaggacacagcagatatgg

SEQ ID NO: 22027 - DNA, 20 bp, Artificial Sequence
  chemically synthesized
cacagcagatatgggagaca

SEQ ID NO: 22028 - DNA, 20 bp, Artificial Sequence
  chemically synthesized
acagcagatatgggagacac

SEQ ID NO: 22029 - DNA, 20 bp, Artificial Sequence
  chemically synthesized
atatgggagacacaggtaat

SEQ ID NO: 22030 - DNA, 20 bp, Artificial Sequence
  chemically synthesized
atgggagacacaggtaatga

SEQ ID NO: 22031 - DNA, 20 bp, Artificial Sequence
  chemically synthesized
gacacaggtaatgagagcct

SEQ ID NO: 22032 - DNA, 20 bp, Artificial Sequence
  chemically synthesized
agccttggccctctcctctc

SEQ ID NO: 22033 - DNA, 20 bp, Artificial Sequence
  chemically synthesized
ccttggccctctcctctctg

SEQ ID NO: 22034 - DNA, 20 bp, Artificial Sequence
  chemically synthesized
cttggccctctcctctctgg

SEQ ID NO: 22035 - DNA, 20 bp, Artificial Sequence
  chemically synthesized
tcctctctggaggcaatgct

SEQ ID NO: 22036 - DNA, 20 bp, Artificial Sequence
  chemically synthesized
cctctctggaggcaatgctc

SEQ ID NO: 22037 - DNA, 20 bp, Artificial Sequence
  chemically synthesized
tctggaggcaatgctcagga

SEQ ID NO: 22038 - DNA, 20 bp, Artificial Sequence
  chemically synthesized
gcaatgctcaggacagtctt

SEQ ID NO: 22039 - DNA, 20 bp, Artificial Sequence
  chemically synthesized
cagtcttgagtatcaacaca

SEQ ID NO: 22040 - DNA, 20 bp, Artificial Sequence
  chemically synthesized
agtcttgagtatcaacacat

SEQ ID NO: 22041 - DNA, 20 bp, Artificial Sequence
  chemically synthesized
tcttgagtatcaacacatag

SEQ ID NO: 22042 - DNA, 20 bp, Artificial Sequence
  chemically synthesized
gtatcaacacataggagatg

SEQ ID NO: 22043 - DNA, 20 bp, Artificial Sequence
  chemically synthesized
acataggagatgaagataat

SEQ ID NO: 22044 - DNA, 20 bp, Artificial Sequence
  chemically synthesized
atgaagataatcagataatc

SEQ ID NO: 22045 - DNA, 20 bp, Artificial Sequence
  chemically synthesized
gataatccagcacaaatata

SEQ ID NO: 22046 - DNA, 20 bp, Artificial Sequence
  chemically synthesized
agcacaaatataaagactac

SEQ ID NO: 22047 - DNA, 20 bp, Artificial Sequence
  chemically synthesized
aaatataaagactacaagca

SEQ ID NO: 22048 - DNA, 20 bp, Artificial Sequence
  chemically synthesized
ataaagactacaagcacagc

SEQ ID NO: 22049 - DNA, 20 bp, Artificial Sequence
  chemically synthesized
taaagactacaagcacagct

SEQ ID NO: 22050 - DNA, 20 bp, Artificial Sequence
  chemically synthesized
actacaagcacagctgggta

SEQ ID NO: 22051 - DNA, 20 bp, Artificial Sequence
  chemically synthesized
caagcacagctgggtacagt

SEQ ID NO: 22052 - DNA, 20 bp, Artificial Sequence
  chemically synthesized
cagctgggtacagtcggttg

SEQ ID NO: 22053 - DNA, 20 bp, Artificial Sequence
  chemically synthesized
agctgggtacagtcggttga

SEQ ID NO: 22054 - DNA, 20 bp, Artificial Sequence
  chemically synthesized
tgggtacagtcggttgaagg

SEQ ID NO: 22055 - DNA, 20 bp, Artificial Sequence
  chemically synthesized
cagtcggttgaaggtggtat

SEQ ID NO: 22056 - DNA, 20 bp, Artificial Sequence
  chemically synthesized
ggttgaaggtggtatcagca

SEQ ID NO: 22057 - DNA, 20 bp, Artificial Sequence
  chemically synthesized
gttgaaggtggtatcagcac

SEQ ID NO: 22058 - DNA, 20 bp, Artificial Sequence
  chemically synthesized
aaggtggtatcagcacaggc

SEQ ID NO: 22059 - DNA, 20 bp, Artificial Sequence
  chemically synthesized
aggcgagtttaatgacatcc

SEQ ID NO: 22060 - DNA, 20 bp, Artificial Sequence
  chemically synthesized
agtttaatgacatcctggtg

SEQ ID NO: 22061 - DNA, 20 bp, Artificial Sequence
  chemically synthesized
gtttaatgacatcctggtga

SEQ ID NO: 22062 - DNA, 20 bp, Artificial Sequence
  chemically synthesized
taatgacatcctggtgaagg

SEQ ID NO: 22063 - DNA, 20 bp, Artificial Sequence
  chemically synthesized
tgaaggcagaatgcatgtga

SEQ ID NO: 22064 - DNA, 20 bp, Artificial Sequence
  chemically synthesized
agaatgcatgtgaaagaaca

SEQ ID NO: 22065 - DNA, 20 bp, Artificial Sequence
  chemically synthesized
gaatgcatgtgaaagaacat

SEQ ID NO: 22066 - DNA, 20 bp, Artificial Sequence
  chemically synthesized
atgcatgtgaaagaacatgg

SEQ ID NO: 22067 - DNA, 20 bp, Artificial Sequence
  chemically synthesized
agaacatgggagtgacaata

SEQ ID NO: 22068 - DNA, 20 bp, Artificial Sequence
  chemically synthesized
agtgacaatacagaaaaaaa

SEQ ID NO: 22069 - DNA, 20 bp, Artificial Sequence
  chemically synthesized
tgacaatacagaaaaaaata

SEQ ID NO: 22070 - DNA, 20 bp, Artificial Sequence
  chemically synthesized
gacaatacagaaaaaaatag

SEQ ID NO: 22071 - DNA, 20 bp, Artificial Sequence
  chemically synthesized
acaatacagaaaaaaataga

SEQ ID NO: 22072 - DNA, 20 bp, Artificial Sequence
  chemically synthesized
caatacagaaaaaaatagag

SEQ ID NO: 22073 - DNA, 20 bp, Artificial Sequence
  chemically synthesized
aaaaaatagaggggcctgat

SEQ ID NO: 22074 - DNA, 20 bp, Artificial Sequence
  chemically synthesized
aaaaatagaggggcctgatt

SEQ ID NO: 22075 - DNA, 20 bp, Artificial Sequence
  chemically synthesized
aaaatagaggggcctgattg

SEQ ID NO: 22076 - DNA, 20 bp, Artificial Sequence
  chemically synthesized
aaatagaggggcctgattgg

SEQ ID NO: 22077 - DNA, 20 bp, Artificial Sequence
  chemically synthesized
gggcctgattgggggaacaa

SEQ ID NO: 22078 - DNA, 20 bp, Artificial Sequence
  chemically synthesized
acggatacaaatcccctcat

SEQ ID NO: 22079 - DNA, 20 bp, Artificial Sequence
  chemically synthesized
aatcccctcatcagaactcc

SEQ ID NO: 22080 - DNA, 20 bp, Artificial Sequence
  chemically synthesized
cagcccaatcttcactactc

SEQ ID NO: 22081 - DNA, 20 bp, Artificial Sequence
  chemically synthesized
aatcttcactactcgagtat

SEQ ID NO: 22082 - DNA, 20 bp, Artificial Sequence
  chemically synthesized
ttcactactcgagtattagt

SEQ ID NO: 22083 - DNA, 20 bp, Artificial Sequence
  chemically synthesized
tactcgagtattagtaagta

SEQ ID NO: 22084 - DNA, 20 bp, Artificial Sequence
  chemically synthesized
ctcgagtattagtaagtaca

SEQ ID NO: 22085 - DNA, 20 bp, Artificial Sequence
  chemically synthesized
tcgagtattagtaagtacag

SEQ ID NO: 22086 - DNA, 20 bp, Artificial Sequence
  chemically synthesized
gtaagtacagaggtatatct

SEQ ID NO: 22087 - DNA, 20 bp, Artificial Sequence
  chemically synthesized
aagtacagaggtatatctaa

SEQ ID NO: 22088 - DNA, 20 bp, Artificial Sequence
  chemically synthesized
agtacagaggtatatctaag

SEQ ID NO: 22089 - DNA, 20 bp, Artificial Sequence
  chemically synthesized
gtacagaggtatatctaaga

SEQ ID NO: 22090 - DNA, 20 bp, Artificial Sequence
  chemically synthesized
aggtatatctaagagggttg

SEQ ID NO: 22091 - DNA, 20 bp, Artificial Sequence
  chemically synthesized
atatctaagagggttgcaga

SEQ ID NO: 22092 - DNA, 20 bp, Artificial Sequence
  chemically synthesized
ggttgcagatggcaataaaa

SEQ ID NO: 22093 - DNA, 20 bp, Artificial Sequence
  chemically synthesized
agatggcaataaaacggtca

SEQ ID NO: 22094 - DNA, 20 bp, Artificial Sequence
  chemically synthesized
gatggcaataaaacggtcat

SEQ ID NO: 22095 - DNA, 20 bp, Artificial Sequence
  chemically synthesized
aataaaacggtcataggcca

SEQ ID NO: 22096 - DNA, 20 bp, Artificial Sequence
  chemically synthesized
aaacggtcataggccatggc

SEQ ID NO: 22097 - DNA, 20 bp, Artificial Sequence
  chemically synthesized
cggtcataggccatggcaag

SEQ ID NO: 22098 - DNA, 20 bp, Artificial Sequence
  chemically synthesized
ggccatggcaagcagaatgc

SEQ ID NO: 22099 - DNA, 20 bp, Artificial Sequence
  chemically synthesized
gcaagcagaatgccagactc

SEQ ID NO: 22100 - DNA, 20 bp, Artificial Sequence
  chemically synthesized
gcagaatgccagactcgaga

SEQ ID NO: 22101 - DNA, 20 bp, Artificial Sequence
  chemically synthesized
cagaatgccagactcgagaa

SEQ ID NO: 22102 - DNA, 20 bp, Artificial Sequence
  chemically synthesized
atgccagactcgagaaagga

SEQ ID NO: 22103 - DNA, 20 bp, Artificial Sequence
  chemically synthesized
cagactcgagaaaggaaagt

SEQ ID NO: 22104 - DNA, 20 bp, Artificial Sequence
  chemically synthesized
gaaaggaaagtgagtgtata

SEQ ID NO: 22105 - DNA, 20 bp, Artificial Sequence
  chemically synthesized
aggaaagtgagtgtataaag

SEQ ID NO: 22106 - DNA, 20 bp, Artificial Sequence
  chemically synthesized
ggaaagtgagtgtataaagt

SEQ ID NO: 22107 - DNA, 20 bp, Artificial Sequence
  chemically synthesized
gtgagtgtataaagtaggcc

SEQ ID NO: 22108 - DNA, 20 bp, Artificial Sequence
  chemically synthesized
tgagtgtataaagtaggcct

SEQ ID NO: 22109 - DNA, 20 bp, Artificial Sequence
  chemically synthesized
gtataaagtaggcctgggaa

SEQ ID NO: 22110 - DNA, 20 bp, Artificial Sequence
  chemically synthesized
taaagtaggcctgggaaaag

SEQ ID NO: 22111 - DNA, 20 bp, Artificial Sequence
  chemically synthesized
aaagtaggcctgggaaaagc

SEQ ID NO: 22112 - DNA, 20 bp, Artificial Sequence
  chemically synthesized
cttccaatctccctgtgatc

SEQ ID NO: 22113 - DNA, 20 bp, Artificial Sequence
  chemically synthesized
caatctccctgtgatccagc

SEQ ID NO: 22114 - DNA, 20 bp, Artificial Sequence
  chemically synthesized
atctccctgtgatccagcca

SEQ ID NO: 22115 - DNA, 20 bp, Artificial Sequence
  chemically synthesized
tctccctgtgatccagccag

SEQ ID NO: 22116 - DNA, 20 bp, Artificial Sequence
  chemically synthesized
tgatccagccagaggactcc

SEQ ID NO: 22117 - DNA, 20 bp, Artificial Sequence
  chemically synthesized
ccagaggactcccagcaccg

SEQ ID NO: 22118 - DNA, 20 bp, Artificial Sequence
  chemically synthesized
cagaggactcccagcaccgt

SEQ ID NO: 22119 - DNA, 20 bp, Artificial Sequence
  chemically synthesized
tcccagcaccgtgggcattg

SEQ ID NO: 22120 - DNA, 20 bp, Artificial Sequence
  chemically synthesized
agcaccgtgggcattgtggt

SEQ ID NO: 22121 - DNA, 20 bp, Artificial Sequence
  chemically synthesized
gcaccgtgggcattgtggtc

SEQ ID NO: 22122 - DNA, 20 bp, Artificial Sequence
  chemically synthesized
caccgtgggcattgtggtca

SEQ ID NO: 22123 - DNA, 20 bp, Artificial Sequence
  chemically synthesized
gtgggcattgtggtcagggc

SEQ ID NO: 22124 - DNA, 20 bp, Artificial Sequence
  chemically synthesized
attgtggtcagggccagccc

SEQ ID NO: 22125 - DNA, 20 bp, Artificial Sequence
  chemically synthesized
ttgtggtcagggccagcccc

SEQ ID NO: 22126 - DNA, 20 bp, Artificial Sequence
  chemically synthesized
cagggccagccccaggtctg

SEQ ID NO: 22127 - DNA, 20 bp, Artificial Sequence
  chemically synthesized
ggccagccccaggtctgtgg

SEQ ID NO: 22128 - DNA, 20 bp, Artificial Sequence
  chemically synthesized
agccccaggtctgtggcagc

SEQ ID NO: 22129 - DNA, 20 bp, Artificial Sequence
  chemically synthesized
caggtctgtggcagccagca

SEQ ID NO: 22130 - DNA, 20 bp, Artificial Sequence
  chemically synthesized
tctgtggcagccagcatggc

SEQ ID NO: 22131 - DNA, 20 bp, Artificial Sequence
  chemically synthesized
tggcagccagcatggccaga

SEQ ID NO: 22132 - DNA, 20 bp, Artificial Sequence
  chemically synthesized
cagccagcatggccagaaag

SEQ ID NO: 22133 - DNA, 20 bp, Artificial Sequence
  chemically synthesized
catggccagaaagaagtaca

SEQ ID NO: 22134 - DNA, 20 bp, Artificial Sequence
  chemically synthesized
atggccagaaagaagtacat

SEQ ID NO: 22135 - DNA, 20 bp, Artificial Sequence
  chemically synthesized
aagaagtacatgggctcatg

SEQ ID NO: 22136 - DNA, 20 bp, Artificial Sequence
  chemically synthesized
agattgtgatcttccttaat

SEQ ID NO: 22137 - DNA, 20 bp, Artificial Sequence
  chemically synthesized
ttgtgatcttccttaatgag

SEQ ID NO: 22138 - DNA, 20 bp, Artificial Sequence
  chemically synthesized
tgatcttccttaatgagaag

SEQ ID NO: 22139 - DNA, 20 bp, Artificial Sequence
  chemically synthesized
gatcttccttaatgagaaga

SEQ ID NO: 22140 - DNA, 20 bp, Artificial Sequence
  chemically synthesized
tcttccttaatgagaagaag

SEQ ID NO: 22141 - DNA, 20 bp, Artificial Sequence
  chemically synthesized
cttccttaatgagaagaagg

SEQ ID NO: 22142 - DNA, 20 bp, Artificial Sequence
  chemically synthesized
ttccttaatgagaagaagga

SEQ ID NO: 22143 - DNA, 20 bp, Artificial Sequence
  chemically synthesized
aggagggtgccattgccaaa

SEQ ID NO: 22144 - DNA, 20 bp, Artificial Sequence
  chemically synthesized
ggagggtgccattgccaaaa

SEQ ID NO: 22145 - DNA, 20 bp, Artificial Sequence
  chemically synthesized
ggtgccattgccaaaaagga

SEQ ID NO: 22146 - DNA, 20 bp, Artificial Sequence
  chemically synthesized
ggatggatatatacatgaac

SEQ ID NO: 22147 - DNA, 20 bp, Artificial Sequence
  chemically synthesized
atacatgaacaagaaaaata

SEQ ID NO: 22148 - DNA, 20 bp, Artificial Sequence
  chemically synthesized
acaagaaaaatacggaaatc

SEQ ID NO: 22149 - DNA, 20 bp, Artificial Sequence
  chemically synthesized
aaatacggaaatccagtgat

SEQ ID NO: 22150 - DNA, 20 bp, Artificial Sequence
  chemically synthesized
tccagtgatgagcttcctcc

SEQ ID NO: 22151 - DNA, 20 bp, Artificial Sequence
  chemically synthesized
tgatgagcttcctccaagcc

SEQ ID NO: 22152 - DNA, 20 bp, Artificial Sequence
  chemically synthesized
ttcctccaagcctggaaaac

SEQ ID NO: 22153 - DNA, 20 bp, Artificial Sequence
  chemically synthesized
aagcctggaaaaccagtcaa

SEQ ID NO: 22154 - DNA, 20 bp, Artificial Sequence
  chemically synthesized
agcctggaaaaccagtcaat

SEQ ID NO: 22155 - DNA, 20 bp, Artificial Sequence
  chemically synthesized
ctggaaaaccagtcaatagg

SEQ ID NO: 22156 - DNA, 20 bp, Artificial Sequence
  chemically synthesized
tggaaaaccagtcaatagga

SEQ ID NO: 22157 - DNA, 20 bp, Artificial Sequence
  chemically synthesized
ggaaaaccagtcaataggaa

SEQ ID NO: 22158 - DNA, 20 bp, Artificial Sequence
  chemically synthesized
aaccagtcaataggaaggga

SEQ ID NO: 22159 - DNA, 20 bp, Artificial Sequence
  chemically synthesized
accagtcaataggaagggat

SEQ ID NO: 22160 - DNA, 20 bp, Artificial Sequence
  chemically synthesized
cagtcaataggaagggatgg

SEQ ID NO: 22161 - DNA, 20 bp, Artificial Sequence
  chemically synthesized
gaagggatgggagctgccgc

SEQ ID NO: 22162 - DNA, 20 bp, Artificial Sequence
  chemically synthesized
gctgccgctggacgacatcc

SEQ ID NO: 22163 - DNA, 20 bp, Artificial Sequence
  chemically synthesized
ctgccgctggacgacatcct

SEQ ID NO: 22164 - DNA, 20 bp, Artificial Sequence
  chemically synthesized
gacgacatcctgggtttata

SEQ ID NO: 22165 - DNA, 20 bp, Artificial Sequence
  chemically synthesized
gacatcctgggtttatatag

SEQ ID NO: 22166 - DNA, 20 bp, Artificial Sequence
  chemically synthesized
ttctgtttctgttattacca

SEQ ID NO: 22167 - DNA, 20 bp, Artificial Sequence
  chemically synthesized
tctgttattaccacagtgca

SEQ ID NO: 22168 - DNA, 20 bp, Artificial Sequence
  chemically synthesized
cagtgcacagttctaccttc

SEQ ID NO: 22169 - DNA, 20 bp, Artificial Sequence
  chemically synthesized
agtgcacagttctaccttca

SEQ ID NO: 22170 - DNA, 20 bp, Artificial Sequence
  chemically synthesized
cacttcgactatatcattct

SEQ ID NO: 22171 - DNA, 20 bp, Artificial Sequence
  chemically synthesized
attctcagaattttttccta

SEQ ID NO: 22172 - DNA, 20 bp, Artificial Sequence
  chemically synthesized
gataataatgacatcaatat

SEQ ID NO: 22173 - DNA, 20 bp, Artificial Sequence
  chemically synthesized
tgtttctcaaaatacattct

SEQ ID NO: 22174 - DNA, 20 bp, Artificial Sequence
  chemically synthesized
gtttctcaaaatacattctc

SEQ ID NO: 22175 - DNA, 20 bp, Artificial Sequence
  chemically synthesized
tttctcaaaatacattctca

SEQ ID NO: 22176 - DNA, 20 bp, Artificial Sequence
  chemically synthesized
gtattcttaactgcacattc

SEQ ID NO: 22177 - DNA, 20 bp, Artificial Sequence
  chemically synthesized
tattcttaactgcacattcc

SEQ ID NO: 22178 - DNA, 20 bp, Artificial Sequence
  chemically synthesized
tacctacgtaatcaaattct

SEQ ID NO: 22179 - DNA, 20 bp, Artificial Sequence
  chemically synthesized
cctacgtaatcaaattcttg

SEQ ID NO: 22180 - DNA, 20 bp, Artificial Sequence
  chemically synthesized
tcaactgtttatatgcattt

SEQ ID NO: 22181 - DNA, 20 bp, Artificial Sequence
  chemically synthesized
atgcatttaagcattctctt

SEQ ID NO: 22182 - DNA, 20 bp, Artificial Sequence
  chemically synthesized
aactgttacccttaactatg

SEQ ID NO: 22183 - DNA, 20 bp, Artificial Sequence
  chemically synthesized
ccttaactatgcagatttta

SEQ ID NO: 22184 - DNA, 20 bp, Artificial Sequence
  chemically synthesized
tttaaagaattcgtattcta

SEQ ID NO: 22185 - DNA, 20 bp, Artificial Sequence
  chemically synthesized
ttaaagaattcgtattctat

SEQ ID NO: 22186 - DNA, 20 bp, Artificial Sequence
  chemically synthesized
taaagaattcgtattctatg

SEQ ID NO: 22187 - DNA, 20 bp, Artificial Sequence
  chemically synthesized
tcgtattctatggggcattc

SEQ ID NO: 22188 - DNA, 20 bp, Artificial Sequence
  chemically synthesized
cgtattctatggggcattca

SEQ ID NO: 22189 - DNA, 20 bp, Artificial Sequence
  chemically synthesized
gtattctatggggcattcaa

SEQ ID NO: 22190 - DNA, 20 bp, Artificial Sequence
  chemically synthesized
tattctatggggcattcaag

SEQ ID NO: 22191 - DNA, 20 bp, Artificial Sequence
  chemically synthesized
ggggcattcaaggggatttc

SEQ ID NO: 22192 - DNA, 20 bp, Artificial Sequence
  chemically synthesized
cattcaaggggatttccaga

SEQ ID NO: 22193 - DNA, 20 bp, Artificial Sequence
  chemically synthesized
agctaacactaatttttttc

SEQ ID NO: 22194 - DNA, 20 bp, Artificial Sequence
  chemically synthesized
taaacctgtaattgccttca

SEQ ID NO: 22195 - DNA, 20 bp, Artificial Sequence
  chemically synthesized
acctgtaattgccttcacag

SEQ ID NO: 22196 - DNA, 20 bp, Artificial Sequence
  chemically synthesized
tccacattttcctgcatgta

SEQ ID NO: 22197 - DNA, 20 bp, Artificial Sequence
  chemically synthesized
taaagacttacctgaattat

SEQ ID NO: 22198 - DNA, 20 bp, Artificial Sequence
  chemically synthesized
cttacctgaattatcagcta

SEQ ID NO: 22199 - DNA, 20 bp, Artificial Sequence
  chemically synthesized
attatcagctaaagtctcaa

SEQ ID NO: 22200 - DNA, 20 bp, Artificial Sequence
  chemically synthesized
agctaaagtctcaacagcct

SEQ ID NO: 22201 - DNA, 20 bp, Artificial Sequence
  chemically synthesized
aaagtctcaacagcctaaga

SEQ ID NO: 22202 - DNA, 20 bp, Artificial Sequence
  chemically synthesized
ctcaacagcctaagaaagaa

SEQ ID NO: 22203 - DNA, 20 bp, Artificial Sequence
  chemically synthesized
cagcctaagaaagaaaagtg

SEQ ID NO: 22204 - DNA, 20 bp, Artificial Sequence
  chemically synthesized
agcctaagaaagaaaagtgt

SEQ ID NO: 22205 - DNA, 20 bp, Artificial Sequence
  chemically synthesized
ctaagaaagaaaagtgtggg

SEQ ID NO: 22206 - DNA, 20 bp, Artificial Sequence
  chemically synthesized
aagaaagaaaagtgtgggaa

SEQ ID NO: 22207 - DNA, 20 bp, Artificial Sequence
  chemically synthesized
aaactctgccactaccactg

SEQ ID NO: 22208 - DNA, 20 bp, Artificial Sequence
  chemically synthesized
ctgccactaccactgtagct

SEQ ID NO: 22209 - DNA, 20 bp, Artificial Sequence
  chemically synthesized
tgccactaccactgtagcta

SEQ ID NO: 22210 - DNA, 20 bp, Artificial Sequence
  chemically synthesized
ccactaccactgtagctaag

SEQ ID NO: 22211 - DNA, 20 bp, Artificial Sequence
  chemically synthesized
ctaccactgtagctaaggag

SEQ ID NO: 22212 - DNA, 20 bp, Artificial Sequence
  chemically synthesized
cactgtagctaaggagcagt

SEQ ID NO: 22213 - DNA, 20 bp, Artificial Sequence
  chemically synthesized
agctaaggagcagtcagatt

SEQ ID NO: 22214 - DNA, 20 bp, Artificial Sequence
  chemically synthesized
aaggagcagtcagattgaga

SEQ ID NO: 22215 - DNA, 20 bp, Artificial Sequence
  chemically synthesized
ggagcagtcagattgagaaa

SEQ ID NO: 22216 - DNA, 20 bp, Artificial Sequence
  chemically synthesized
cagattgagaaagagacact

SEQ ID NO: 22217 - DNA, 20 bp, Artificial Sequence
  chemically synthesized
agaaagagacacttggcctc

SEQ ID NO: 22218 - DNA, 20 bp, Artificial Sequence
  chemically synthesized
cacttggcctccagatttca

SEQ ID NO: 22219 - DNA, 20 bp, Artificial Sequence
  chemically synthesized
ggcctccagatttcatggac

SEQ ID NO: 22220 - DNA, 20 bp, Artificial Sequence
  chemically synthesized
cagatttcatggactagtga

SEQ ID NO: 22221 - DNA, 20 bp, Artificial Sequence
  chemically synthesized
agatttcatggactagtgat

SEQ ID NO: 22222 - DNA, 20 bp, Artificial Sequence
  chemically synthesized
gatttcatggactagtgatg

SEQ ID NO: 22223 - DNA, 20 bp, Artificial Sequence
  chemically synthesized
catggactagtgatggggaa

SEQ ID NO: 22224 - DNA, 20 bp, Artificial Sequence
  chemically synthesized
ggggaacagacattcacgat

SEQ ID NO: 22225 - DNA, 20 bp, Artificial Sequence
  chemically synthesized
tagtgtgaattaccctcttg

SEQ ID NO: 22226 - DNA, 20 bp, Artificial Sequence
  chemically synthesized
taccctcttgtagaatcctt

SEQ ID NO: 22227 - DNA, 20 bp, Artificial Sequence
  chemically synthesized
ctactcactacttgtgacaa

SEQ ID NO: 22228 - DNA, 20 bp, Artificial Sequence
  chemically synthesized
cactacttgtgacaatagct

SEQ ID NO: 22229 - DNA, 20 bp, Artificial Sequence
  chemically synthesized
caatagctcagtctaattat

SEQ ID NO: 22230 - DNA, 20 bp, Artificial Sequence
  chemically synthesized
agctcagtctaattataagt

SEQ ID NO: 22231 - DNA, 20 bp, Artificial Sequence
  chemically synthesized
tctaattataagttagactt

SEQ ID NO: 22232 - DNA, 20 bp, Artificial Sequence
  chemically synthesized
ctaattataagttagacttt

SEQ ID NO: 22233 - DNA, 20 bp, Artificial Sequence
  chemically synthesized
taattataagttagactttg

SEQ ID NO: 22234 - DNA, 20 bp, Artificial Sequence
  chemically synthesized
tataagttagactttggggc

SEQ ID NO: 22235 - DNA, 20 bp, Artificial Sequence
  chemically synthesized
ttggggctggaataaatgat

SEQ ID NO: 22236 - DNA, 20 bp, Artificial Sequence
  chemically synthesized
tggggctggaataaatgatt

SEQ ID NO: 22237 - DNA, 20 bp, Artificial Sequence
  chemically synthesized
gctggaataaatgattaggc

SEQ ID NO: 22238 - DNA, 20 bp, Artificial Sequence
  chemically synthesized
ataaatgattaggccagcca

SEQ ID NO: 22239 - DNA, 20 bp, Artificial Sequence
  chemically synthesized
gccaaagacatcacttataa

SEQ ID NO: 22240 - DNA, 20 bp, Artificial Sequence
  chemically synthesized
ttataatagtgtatctcctt

SEQ ID NO: 22241 - DNA, 20 bp, Artificial Sequence
  chemically synthesized
tcttactgtttcttatttac

SEQ ID NO: 22242 - DNA, 20 bp, Artificial Sequence
  chemically synthesized
tactgtttcttatttacaag

SEQ ID NO: 22243 - DNA, 20 bp, Artificial Sequence
  chemically synthesized
ctttttaaattatttttcta

SEQ ID NO: 22244 - DNA, 20 bp, Artificial Sequence
  chemically synthesized
tttttaaattatttttctat

SEQ ID NO: 22245 - DNA, 20 bp, Artificial Sequence
  chemically synthesized
atttttctataggcctactg

SEQ ID NO: 22246 - DNA, 20 bp, Artificial Sequence
  chemically synthesized
ggcctactgaagtaattccc

SEQ ID NO: 22247 - DNA, 20 bp, Artificial Sequence
  chemically synthesized
aatctgacctctctcatttc

SEQ ID NO: 22248 - DNA, 20 bp, Artificial Sequence
  chemically synthesized
tatttaaacatccatcttcc

SEQ ID NO: 22249 - DNA, 20 bp, Artificial Sequence
  chemically synthesized
ggtttccttccctttatccc

SEQ ID NO: 22250 - DNA, 20 bp, Artificial Sequence
  chemically synthesized
cttccctttatccccagcca

SEQ ID NO: 22251 - DNA, 20 bp, Artificial Sequence
  chemically synthesized
ttccctttatccccagccat

SEQ ID NO: 22252 - DNA, 20 bp, Artificial Sequence
  chemically synthesized
aatctgttctccccaatact

SEQ ID NO: 22253 - DNA, 20 bp, Artificial Sequence
  chemically synthesized
tgttctccccaatactgagt

SEQ ID NO: 22254 - DNA, 20 bp, Artificial Sequence
  chemically synthesized
ttctccccaatactgagtga

SEQ ID NO: 22255 - DNA, 20 bp, Artificial Sequence
  chemically synthesized
gctatttccctgcttaaacg

SEQ ID NO: 22256 - DNA, 20 bp, Artificial Sequence
  chemically synthesized
cgtggtgctgtcttttactg

SEQ ID NO: 22257 - DNA, 20 bp, Artificial Sequence
  chemically synthesized
tggtgctgtcttttactgaa

SEQ ID NO: 22258 - DNA, 20 bp, Artificial Sequence
  chemically synthesized
tgctgtcttttactgaagag

SEQ ID NO: 22259 - DNA, 20 bp, Artificial Sequence
  chemically synthesized
ctgtcttttactgaagagaa

SEQ ID NO: 22260 - DNA, 20 bp, Artificial Sequence
  chemically synthesized
ttttactgaagagaagagat

SEQ ID NO: 22261 - DNA, 20 bp, Artificial Sequence
  chemically synthesized
agagaagagattagtccttt

SEQ ID NO: 22262 - DNA, 20 bp, Artificial Sequence
  chemically synthesized
gaagagattagtcctttgag

SEQ ID NO: 22263 - DNA, 20 bp, Artificial Sequence
  chemically synthesized
aagagattagtcctttgaga

SEQ ID NO: 22264 - DNA, 20 bp, Artificial Sequence
  chemically synthesized
tttaatattccttctgccac

SEQ ID NO: 22265 - DNA, 20 bp, Artificial Sequence
  chemically synthesized
tattccttctgccactagac

SEQ ID NO: 22266 - DNA, 20 bp, Artificial Sequence
  chemically synthesized
attccttctgccactagact

SEQ ID NO: 22267 - DNA, 20 bp, Artificial Sequence
  chemically synthesized
ttccttctgccactagacta

SEQ ID NO: 22268 - DNA, 20 bp, Artificial Sequence
  chemically synthesized
tccttctgccactagactag

SEQ ID NO: 22269 - DNA, 20 bp, Artificial Sequence
  chemically synthesized
gactaggggcttcttgcata

SEQ ID NO: 22270 - DNA, 20 bp, Artificial Sequence
  chemically synthesized
gggcttcttgcatatagaca

SEQ ID NO: 22271 - DNA, 20 bp, Artificial Sequence
  chemically synthesized
gctttgctcaacaccttgca

SEQ ID NO: 22272 - DNA, 20 bp, Artificial Sequence
  chemically synthesized
tgtgactgataaacatttct

SEQ ID NO: 22273 - DNA, 20 bp, Artificial Sequence
  chemically synthesized
tgtgaacacgcatcatgtga

SEQ ID NO: 22274 - DNA, 20 bp, Artificial Sequence
  chemically synthesized
tgtgacagccatgatattta

SEQ ID NO: 22275 - DNA, 20 bp, Artificial Sequence
  chemically synthesized
ccatgatatttaaagctctc

SEQ ID NO: 22276 - DNA, 20 bp, Artificial Sequence
  chemically synthesized
taaagctctctggaattaaa

SEQ ID NO: 22277 - DNA, 20 bp, Artificial Sequence
  chemically synthesized
ctctggaattaaatggtaat

SEQ ID NO: 22278 - DNA, 20 bp, Artificial Sequence
  chemically synthesized
aattaaatggtaataagaca

SEQ ID NO: 22279 - DNA, 20 bp, Artificial Sequence
  chemically synthesized
aatcttataaaccataaatt

SEQ ID NO: 22280 - DNA, 20 bp, Artificial Sequence
  chemically synthesized
aattaagttgaaaaataaat

SEQ ID NO: 22281 - DNA, 20 bp, Artificial Sequence
  chemically synthesized
ttttaaacaaatataaatgc

SEQ ID NO: 22282 - DNA, 20 bp, Artificial Sequence
  chemically synthesized
aatgcaagtttaacataaaa

SEQ ID NO: 22283 - DNA, 20 bp, Artificial Sequence
  chemically synthesized
taaaacagtactacttgatg

SEQ ID NO: 22284 - DNA, 20 bp, Artificial Sequence
  chemically synthesized
actacttgatgtagattaat

SEQ ID NO: 22285 - DNA, 20 bp, Artificial Sequence
  chemically synthesized
cttgatgtagattaattgga

SEQ ID NO: 22286 - DNA, 20 bp, Artificial Sequence
  chemically synthesized
aattggatggtattgtatac

SEQ ID NO: 22287 - DNA, 20 bp, Artificial Sequence
  chemically synthesized
ggatggtattgtatacaaga

SEQ ID NO: 22288 - DNA, 20 bp, Artificial Sequence
  chemically synthesized
gtattgtatacaagatagta

SEQ ID NO: 22289 - DNA, 20 bp, Artificial Sequence
  chemically synthesized
ttgtatacaagatagtatag

SEQ ID NO: 22290 - DNA, 20 bp, Artificial Sequence
  chemically synthesized
acaagatagtatagcagttt

SEQ ID NO: 22291 - DNA, 20 bp, Artificial Sequence
  chemically synthesized
caagatagtatagcagtttg

SEQ ID NO: 22292 - DNA, 20 bp, Artificial Sequence
  chemically synthesized
aagatagtatagcagtttga

SEQ ID NO: 22293 - DNA, 20 bp, Artificial Sequence
  chemically synthesized
agatagtatagcagtttgag

SEQ ID NO: 22294 - DNA, 20 bp, Artificial Sequence
  chemically synthesized
gtatagcagtttgaggggcc

SEQ ID NO: 22295 - DNA, 20 bp, Artificial Sequence
  chemically synthesized
gggcctagaactgcacctat

SEQ ID NO: 22296 - DNA, 20 bp, Artificial Sequence
  chemically synthesized
ggcctagaactgcacctatg

SEQ ID NO: 22297 - DNA, 20 bp, Artificial Sequence
  chemically synthesized
cctagaactgcacctatgag

SEQ ID NO: 22298 - DNA, 20 bp, Artificial Sequence
  chemically synthesized
ctagaactgcacctatgagg

SEQ ID NO: 22299 - DNA, 20 bp, Artificial Sequence
  chemically synthesized
gaggaggtcccatttgaact

SEQ ID NO: 22300 - DNA, 20 bp, Artificial Sequence
  chemically synthesized
gaactgagacctcaatacaa

SEQ ID NO: 22301 - DNA, 20 bp, Artificial Sequence
  chemically synthesized
aaagaaaacctgaccgtata

SEQ ID NO: 22302 - DNA, 20 bp, Artificial Sequence
  chemically synthesized
aacctgaccgtatacagacc

SEQ ID NO: 22303 - DNA, 20 bp, Artificial Sequence
  chemically synthesized
cctgaccgtatacagaccta

SEQ ID NO: 22304 - DNA, 20 bp, Artificial Sequence
  chemically synthesized
ctgaccgtatacagacctag

SEQ ID NO: 22305 - DNA, 20 bp, Artificial Sequence
  chemically synthesized
gacctagaggaaaactgttc

SEQ ID NO: 22306 - DNA, 20 bp, Artificial Sequence
  chemically synthesized
cctagaggaaaactgttcca

SEQ ID NO: 22307 - DNA, 20 bp, Artificial Sequence
  chemically synthesized
ctagaggaaaactgttccag

SEQ ID NO: 22308 - DNA, 20 bp, Artificial Sequence
  chemically synthesized
tagaggaaaactgttccaga

SEQ ID NO: 22309 - DNA, 20 bp, Artificial Sequence
  chemically synthesized
aactgttccagagggaaaat

SEQ ID NO: 22310 - DNA, 20 bp, Artificial Sequence
  chemically synthesized
agagggaaaatcagcatgac

SEQ ID NO: 22311 - DNA, 20 bp, Artificial Sequence
  chemically synthesized
cagcatgactggcatttgat

SEQ ID NO: 22312 - DNA, 20 bp, Artificial Sequence
  chemically synthesized
actggcatttgataagaaaa

SEQ ID NO: 22313 - DNA, 20 bp, Artificial Sequence
  chemically synthesized
ctggcatttgataagaaaac

SEQ ID NO: 22314 - DNA, 20 bp, Artificial Sequence
  chemically synthesized
ggcatttgataagaaaacag

SEQ ID NO: 22315 - DNA, 20 bp, Artificial Sequence
  chemically synthesized
catttgataagaaaacagga

SEQ ID NO: 22316 - DNA, 20 bp, Artificial Sequence
  chemically synthesized
atttgataagaaaacaggag

SEQ ID NO: 22317 - DNA, 20 bp, Artificial Sequence
  chemically synthesized
tttgataagaaaacaggaga

SEQ ID NO: 22318 - DNA, 20 bp, Artificial Sequence
  chemically synthesized
agaaaacaggagagggacaa

SEQ ID NO: 22319 - DNA, 20 bp, Artificial Sequence
  chemically synthesized
agggacaatagatgatgtca

SEQ ID NO: 22320 - DNA, 20 bp, Artificial Sequence
  chemically synthesized
gacaatagatgatgtcaaag

SEQ ID NO: 22321 - DNA, 20 bp, Artificial Sequence
  chemically synthesized
aatagatgatgtcaaagaag

SEQ ID NO: 22322 - DNA, 20 bp, Artificial Sequence
  chemically synthesized
atagatgatgtcaaagaagc

SEQ ID NO: 22323 - DNA, 20 bp, Artificial Sequence
  chemically synthesized
gatgatgtcaaagaagcagg

SEQ ID NO: 22324 - DNA, 20 bp, Artificial Sequence
  chemically synthesized
caaagaagcaggtagtaatc

SEQ ID NO: 22325 - DNA, 20 bp, Artificial Sequence
  chemically synthesized
caggtagtaatcaagtgtca

SEQ ID NO: 22326 - DNA, 20 bp, Artificial Sequence
  chemically synthesized
aggtagtaatcaagtgtcat

SEQ ID NO: 22327 - DNA, 20 bp, Artificial Sequence
  chemically synthesized
ggtagtaatcaagtgtcata

SEQ ID NO: 22328 - DNA, 20 bp, Artificial Sequence
  chemically synthesized
tcaagtgtcatagggcctta

SEQ ID NO: 22329 - DNA, 20 bp, Artificial Sequence
  chemically synthesized
tagggccttacagaccacca

SEQ ID NO: 22330 - DNA, 20 bp, Artificial Sequence
  chemically synthesized
ttttcttcttactataaatg

SEQ ID NO: 22331 - DNA, 20 bp, Artificial Sequence
  chemically synthesized
ttcttactataaatgtagta

SEQ ID NO: 22332 - DNA, 20 bp, Artificial Sequence
  chemically synthesized
tataaatgtagtaaagacat

SEQ ID NO: 22333 - DNA, 20 bp, Artificial Sequence
  chemically synthesized
ataaatgtagtaaagacatt

SEQ ID NO: 22334 - DNA, 20 bp, Artificial Sequence
  chemically synthesized
ggacactttgaaaatcacaa

SEQ ID NO: 22335 - DNA, 20 bp, Artificial Sequence
  chemically synthesized
ttgaaaatcacaatggaaaa

SEQ ID NO: 22336 - DNA, 20 bp, Artificial Sequence
  chemically synthesized
aatcacaatggaaaatagtg

SEQ ID NO: 22337 - DNA, 20 bp, Artificial Sequence
  chemically synthesized
gtatttttaaattactcact

SEQ ID NO: 22338 - DNA, 20 bp, Artificial Sequence
  chemically synthesized
ctcacttagactgctatgtg

SEQ ID NO: 22339 - DNA, 20 bp, Artificial Sequence
  chemically synthesized
acttagactgctatgtgaag

SEQ ID NO: 22340 - DNA, 20 bp, Artificial Sequence
  chemically synthesized
actgctatgtgaagaagact

SEQ ID NO: 22341 - DNA, 20 bp, Artificial Sequence
  chemically synthesized
ctatgtgaagaagactaagc

SEQ ID NO: 22342 - DNA, 20 bp, Artificial Sequence
  chemically synthesized
atgtgaagaagactaagcaa

SEQ ID NO: 22343 - DNA, 20 bp, Artificial Sequence
  chemically synthesized
aagaagactaagcaagagac

SEQ ID NO: 22344 - DNA, 20 bp, Artificial Sequence
  chemically synthesized
gactaagcaagagacaagaa

SEQ ID NO: 22345 - DNA, 20 bp, Artificial Sequence
  chemically synthesized
ctaagcaagagacaagaaaa

SEQ ID NO: 22346 - DNA, 20 bp, Artificial Sequence
  chemically synthesized
caagagacaagaaaagagat

SEQ ID NO: 22347 - DNA, 20 bp, Artificial Sequence
  chemically synthesized
agacaagaaaagagatgagt

SEQ ID NO: 22348 - DNA, 20 bp, Artificial Sequence
  chemically synthesized
aagaaaagagatgagttaga

SEQ ID NO: 22349 - DNA, 20 bp, Artificial Sequence
  chemically synthesized
ctattttaaaaatccatatg

SEQ ID NO: 22350 - DNA, 20 bp, Artificial Sequence
  chemically synthesized
attttaaaaatccatatgaa

SEQ ID NO: 22351 - DNA, 20 bp, Artificial Sequence
  chemically synthesized
aaaatccatatgaagagtca

SEQ ID NO: 22352 - DNA, 20 bp, Artificial Sequence
  chemically synthesized
agagtcatggtgaccttgac

SEQ ID NO: 22353 - DNA, 20 bp, Artificial Sequence
  chemically synthesized
gagtcatggtgaccttgact

SEQ ID NO: 22354 - DNA, 20 bp, Artificial Sequence
  chemically synthesized
gtcatggtgaccttgactag

SEQ ID NO: 22355 - DNA, 20 bp, Artificial Sequence
  chemically synthesized
catggtgaccttgactagga

SEQ ID NO: 22356 - DNA, 20 bp, Artificial Sequence
  chemically synthesized
ggtgaccttgactaggagag

SEQ ID NO: 22357 - DNA, 20 bp, Artificial Sequence
  chemically synthesized
gaccttgactaggagagaag

SEQ ID NO: 22358 - DNA, 20 bp, Artificial Sequence
  chemically synthesized
accttgactaggagagaagc

SEQ ID NO: 22359 - DNA, 20 bp, Artificial Sequence
  chemically synthesized
ccttgactaggagagaagca

SEQ ID NO: 22360 - DNA, 20 bp, Artificial Sequence
  chemically synthesized
cttgactaggagagaagcag

SEQ ID NO: 22361 - DNA, 20 bp, Artificial Sequence
  chemically synthesized
gaagcaggggaaatgaaaaa

SEQ ID NO: 22362 - DNA, 20 bp, Artificial Sequence
  chemically synthesized
agcaggggaaatgaaaaaaa

SEQ ID NO: 22363 - DNA, 20 bp, Artificial Sequence
  chemically synthesized
aaatgaaaaaaagagaaaaa

SEQ ID NO: 22364 - DNA, 20 bp, Artificial Sequence
  chemically synthesized
gaaaaatagaaaaacttaaa

SEQ ID NO: 22365 - DNA, 20 bp, Artificial Sequence
  chemically synthesized
aaaatagaaaaacttaaaca

SEQ ID NO: 22366 - DNA, 20 bp, Artificial Sequence
  chemically synthesized
tagaaaaacttaaacagaga

SEQ ID NO: 22367 - DNA, 20 bp, Artificial Sequence
  chemically synthesized
cagagacagatgcatttttg

SEQ ID NO: 22368 - DNA, 20 bp, Artificial Sequence
  chemically synthesized
agacagatgcatttttgaag

SEQ ID NO: 22369 - DNA, 20 bp, Artificial Sequence
  chemically synthesized
tgcatttttgaagtagtgcc

SEQ ID NO: 22370 - DNA, 20 bp, Artificial Sequence
  chemically synthesized
atttgctgatatattaaaaa

SEQ ID NO: 22371 - DNA, 20 bp, Artificial Sequence
  chemically synthesized
tttgctgatatattaaaaat

SEQ ID NO: 22372 - DNA, 20 bp, Artificial Sequence
  chemically synthesized
tgctgatatattaaaaatgg

SEQ ID NO: 22373 - DNA, 20 bp, Artificial Sequence
  chemically synthesized
gatatattaaaaatgggagt

SEQ ID NO: 22374 - DNA, 20 bp, Artificial Sequence
  chemically synthesized
atatattaaaaatgggagtg

SEQ ID NO: 22375 - DNA, 20 bp, Artificial Sequence
  chemically synthesized
tatattaaaaatgggagtga

SEQ ID NO: 22376 - DNA, 20 bp, Artificial Sequence
  chemically synthesized
gagtgagggaaaaatcaaat

SEQ ID NO: 22377 - DNA, 20 bp, Artificial Sequence
  chemically synthesized
agtgagggaaaaatcaaatg

SEQ ID NO: 22378 - DNA, 20 bp, Artificial Sequence
  chemically synthesized
aaatcaaatgaggtttcccc

SEQ ID NO: 22379 - DNA, 20 bp, Artificial Sequence
  chemically synthesized
atttctgtttgaacaaatga

SEQ ID NO: 22380 - DNA, 20 bp, Artificial Sequence
  chemically synthesized
tgtttgaacaaatgaaagaa

SEQ ID NO: 22381 - DNA, 20 bp, Artificial Sequence
  chemically synthesized
gaacaaatgaaagaatggtg

SEQ ID NO: 22382 - DNA, 20 bp, Artificial Sequence
  chemically synthesized
gtgaagccatttactcaaaa

SEQ ID NO: 22383 - DNA, 20 bp, Artificial Sequence
  chemically synthesized
aagccatttactcaaaatgg

SEQ ID NO: 22384 - DNA, 20 bp, Artificial Sequence
  chemically synthesized
tttactcaaaatggaagtct

SEQ ID NO: 22385 - DNA, 20 bp, Artificial Sequence
  chemically synthesized
ttactcaaaatggaagtctg

SEQ ID NO: 22386 - DNA, 20 bp, Artificial Sequence
  chemically synthesized
tactcaaaatggaagtctga

SEQ ID NO: 22387 - DNA, 20 bp, Artificial Sequence
  chemically synthesized
actcaaaatggaagtctgag

SEQ ID NO: 22388 - DNA, 20 bp, Artificial Sequence
  chemically synthesized
ctcaaaatggaagtctgagg

SEQ ID NO: 22389 - DNA, 20 bp, Artificial Sequence
  chemically synthesized
ggggatacatattcacttgt

SEQ ID NO: 22390 - DNA, 20 bp, Artificial Sequence
  chemically synthesized
gggatacatattcacttgtg

SEQ ID NO: 22391 - DNA, 20 bp, Artificial Sequence
  chemically synthesized
tattcacttgtgaggaaatc

SEQ ID NO: 22392 - DNA, 20 bp, Artificial Sequence
  chemically synthesized
ttcacttgtgaggaaatcaa

SEQ ID NO: 22393 - DNA, 20 bp, Artificial Sequence
  chemically synthesized
gtgaggaaatcaagagtcat

SEQ ID NO: 22394 - DNA, 20 bp, Artificial Sequence
  chemically synthesized
tcaagagtcattagtaaata

SEQ ID NO: 22395 - DNA, 20 bp, Artificial Sequence
  chemically synthesized
attagtaaatatagctgaat

SEQ ID NO: 22396 - DNA, 20 bp, Artificial Sequence
  chemically synthesized
tagtaaatatagctgaatta

SEQ ID NO: 22397 - DNA, 20 bp, Artificial Sequence
  chemically synthesized
ttttttttcttgtcacatgc

SEQ ID NO: 22398 - DNA, 20 bp, Artificial Sequence
  chemically synthesized
catgccagaacaacttcttg

SEQ ID NO: 22399 - DNA, 20 bp, Artificial Sequence
  chemically synthesized
cttgaagttgtttttatcct

SEQ ID NO: 22400 - DNA, 20 bp, Artificial Sequence
  chemically synthesized
tgtttttatcctaagttaaa

SEQ ID NO: 22401 - DNA, 20 bp, Artificial Sequence
  chemically synthesized
tttatcctaagttaaaaaga

SEQ ID NO: 22402 - DNA, 20 bp, Artificial Sequence
  chemically synthesized
cgtatccaaatatacccctt

SEQ ID NO: 22403 - DNA, 20 bp, Artificial Sequence
  chemically synthesized
tatccaaatataccccttca

SEQ ID NO: 22404 - DNA, 20 bp, Artificial Sequence
  chemically synthesized
ccccttcagagttactttgt

SEQ ID NO: 22405 - DNA, 20 bp, Artificial Sequence
  chemically synthesized
cagagttactttgtcagtgt

SEQ ID NO: 22406 - DNA, 20 bp, Artificial Sequence
  chemically synthesized
agagttactttgtcagtgta

SEQ ID NO: 22407 - DNA, 20 bp, Artificial Sequence
  chemically synthesized
cagtgtaaggcactacccta

SEQ ID NO: 22408 - DNA, 20 bp, Artificial Sequence
  chemically synthesized
ctaccctaaagatgccacca

SEQ ID NO: 22409 - DNA, 20 bp, Artificial Sequence
  chemically synthesized
taccctaaagatgccaccaa

SEQ ID NO: 22410 - DNA, 20 bp, Artificial Sequence
  chemically synthesized
atcctcttaccttccaccca

SEQ ID NO: 22411 - DNA, 20 bp, Artificial Sequence
  chemically synthesized
cctcttaccttccacccata

SEQ ID NO: 22412 - DNA, 20 bp, Artificial Sequence
  chemically synthesized
taccttccacccatagagat

SEQ ID NO: 22413 - DNA, 20 bp, Artificial Sequence
  chemically synthesized
gagatgagatctaactgtaa

SEQ ID NO: 22414 - DNA, 20 bp, Artificial Sequence
  chemically synthesized
agatctaactgtaatagttt

SEQ ID NO: 22415 - DNA, 20 bp, Artificial Sequence
  chemically synthesized
taactgtaatagtttcagtg

SEQ ID NO: 22416 - DNA, 20 bp, Artificial Sequence
  chemically synthesized
actgtaatagtttcagtgaa

SEQ ID NO: 22417 - DNA, 20 bp, Artificial Sequence
  chemically synthesized
tagtttcagtgaagagatgc

SEQ ID NO: 22418 - DNA, 20 bp, Artificial Sequence
  chemically synthesized
gtgaagagatgccagacaac

SEQ ID NO: 22419 - DNA, 20 bp, Artificial Sequence
  chemically synthesized
tgaagagatgccagacaact

SEQ ID NO: 22420 - DNA, 20 bp, Artificial Sequence
  chemically synthesized
gatgccagacaactgggcgt

SEQ ID NO: 22421 - DNA, 20 bp, Artificial Sequence
  chemically synthesized
atgccagacaactgggcgtg

SEQ ID NO: 22422 - DNA, 20 bp, Artificial Sequence
  chemically synthesized
ctgggcgtgaggcaacaact

SEQ ID NO: 22423 - DNA, 20 bp, Artificial Sequence
  chemically synthesized
gcaacaactcagcactttga

SEQ ID NO: 22424 - DNA, 20 bp, Artificial Sequence
  chemically synthesized
actttgaaagaatcattttt

SEQ ID NO: 22425 - DNA, 20 bp, Artificial Sequence
  chemically synthesized
tcagcatccatattctgtcc

SEQ ID NO: 22426 - DNA, 20 bp, Artificial Sequence
  chemically synthesized
cagcatccatattctgtcct

SEQ ID NO: 22427 - DNA, 20 bp, Artificial Sequence
  chemically synthesized
ccatattctgtcctaggact

SEQ ID NO: 22428 - DNA, 20 bp, Artificial Sequence
  chemically synthesized
atattctgtcctaggactga

SEQ ID NO: 22429 - DNA, 20 bp, Artificial Sequence
  chemically synthesized
taggactgagagacataaac

SEQ ID NO: 22430 - DNA, 20 bp, Artificial Sequence
  chemically synthesized
gagagacataaaccagaatt

SEQ ID NO: 22431 - DNA, 20 bp, Artificial Sequence
  chemically synthesized
gtgcctactgaacatacaat

SEQ ID NO: 22432 - DNA, 20 bp, Artificial Sequence
  chemically synthesized
aatgagtgatgtatattctt

SEQ ID NO: 22433 - DNA, 20 bp, Artificial Sequence
  chemically synthesized
gatgtatattcttcagttac

SEQ ID NO: 22434 - DNA, 20 bp, Artificial Sequence
  chemically synthesized
ttcttcagttactagacgca

SEQ ID NO: 22435 - DNA, 20 bp, Artificial Sequence
  chemically synthesized
tactagacgcaaagataatc

SEQ ID NO: 22436 - DNA, 20 bp, Artificial Sequence
  chemically synthesized
gacgcaaagataatccagct

SEQ ID NO: 22437 - DNA, 20 bp, Artificial Sequence
  chemically synthesized
ctcttacttctctgacgttt

SEQ ID NO: 22438 - DNA, 20 bp, Artificial Sequence
  chemically synthesized
tgtgaaaaattccttcttat

SEQ ID NO: 22439 - DNA, 20 bp, Artificial Sequence
  chemically synthesized
tgaaaaattccttcttatca

SEQ ID NO: 22440 - DNA, 20 bp, Artificial Sequence
  chemically synthesized
ccttcttatcagagaatatg

SEQ ID NO: 22441 - DNA, 20 bp, Artificial Sequence
  chemically synthesized
tatcagagaatatgcagcac

SEQ ID NO: 22442 - DNA, 20 bp, Artificial Sequence
  chemically synthesized
gcacaagtgatgaatcacta

SEQ ID NO: 22443 - DNA, 20 bp, Artificial Sequence
  chemically synthesized
cacaagtgatgaatcactac

SEQ ID NO: 22444 - DNA, 20 bp, Artificial Sequence
  chemically synthesized
acaagtgatgaatcactaca

SEQ ID NO: 22445 - DNA, 20 bp, Artificial Sequence
  chemically synthesized
gtgatgaatcactacaggga

SEQ ID NO: 22446 - DNA, 20 bp, Artificial Sequence
  chemically synthesized
gggaaagctaaccaaactgt

SEQ ID NO: 22447 - DNA, 20 bp, Artificial Sequence
  chemically synthesized
ggaaagctaaccaaactgta

SEQ ID NO: 22448 - DNA, 20 bp, Artificial Sequence
  chemically synthesized
caataataacctgcaactta

SEQ ID NO: 22449 - DNA, 20 bp, Artificial Sequence
  chemically synthesized
tttcctccttctccattccc

SEQ ID NO: 22450 - DNA, 20 bp, Artificial Sequence
  chemically synthesized
ccattcccaagaattccatg

SEQ ID NO: 22451 - DNA, 20 bp, Artificial Sequence
  chemically synthesized
gaattccatgcagacatacc

SEQ ID NO: 22452 - DNA, 20 bp, Artificial Sequence
  chemically synthesized
tgcagacatacctggtaatg

SEQ ID NO: 22453 - DNA, 20 bp, Artificial Sequence
  chemically synthesized
acctggtaatgcagctataa

SEQ ID NO: 22454 - DNA, 20 bp, Artificial Sequence
  chemically synthesized
gcagctataatagtgatcta

SEQ ID NO: 22455 - DNA, 20 bp, Artificial Sequence
  chemically synthesized
tgtgaaaattcttgtgtcct

SEQ ID NO: 22456 - DNA, 20 bp, Artificial Sequence
  chemically synthesized
aaaattcttgtgtcctcagc

SEQ ID NO: 22457 - DNA, 20 bp, Artificial Sequence
  chemically synthesized
cttgtgtcctcagctagtcg

SEQ ID NO: 22458 - DNA, 20 bp, Artificial Sequence
  chemically synthesized
cctcagctagtcgtggctct

SEQ ID NO: 22459 - DNA, 20 bp, Artificial Sequence
  chemically synthesized
agtcgtggctcttggtttct

SEQ ID NO: 22460 - DNA, 20 bp, Artificial Sequence
  chemically synthesized
cgtggctcttggtttctgag

SEQ ID NO: 22461 - DNA, 20 bp, Artificial Sequence
  chemically synthesized
gctcttggtttctgagaaga

SEQ ID NO: 22462 - DNA, 20 bp, Artificial Sequence
  chemically synthesized
tttctgagaagaaagacaat

SEQ ID NO: 22463 - DNA, 20 bp, Artificial Sequence
  chemically synthesized
tctgagaagaaagacaatga

SEQ ID NO: 22464 - DNA, 20 bp, Artificial Sequence
  chemically synthesized
gagaagaaagacaatgagag

SEQ ID NO: 22465 - DNA, 20 bp, Artificial Sequence
  chemically synthesized
gaagaaagacaatgagagaa

SEQ ID NO: 22466 - DNA, 20 bp, Artificial Sequence
  chemically synthesized
gacaatgagagaagagataa

SEQ ID NO: 22467 - DNA, 20 bp, Artificial Sequence
  chemically synthesized
tgagagaagagataaaagct

SEQ ID NO: 22468 - DNA, 20 bp, Artificial Sequence
  chemically synthesized
gagagaagagataaaagctg

SEQ ID NO: 22469 - DNA, 20 bp, Artificial Sequence
  chemically synthesized
aaagctgaggaaaaaaaata

SEQ ID NO: 22470 - DNA, 20 bp, Artificial Sequence
  chemically synthesized
aagctgaggaaaaaaaatat

SEQ ID NO: 22471 - DNA, 20 bp, Artificial Sequence
  chemically synthesized
agctgaggaaaaaaaatata

SEQ ID NO: 22472 - DNA, 20 bp, Artificial Sequence
  chemically synthesized
tgaggaaaaaaaatataggg

SEQ ID NO: 22473 - DNA, 20 bp, Artificial Sequence
  chemically synthesized
gaggaaaaaaaatataggga

SEQ ID NO: 22474 - DNA, 20 bp, Artificial Sequence
  chemically synthesized
aaaaaaaatatagggaagga

SEQ ID NO: 22475 - DNA, 20 bp, Artificial Sequence
  chemically synthesized
aaaaaatatagggaaggaaa

SEQ ID NO: 22476 - DNA, 20 bp, Artificial Sequence
  chemically synthesized
agggaaggaaagagatcata

SEQ ID NO: 22477 - DNA, 20 bp, Artificial Sequence
  chemically synthesized
ggaaagagatcataaagact

SEQ ID NO: 22478 - DNA, 20 bp, Artificial Sequence
  chemically synthesized
gaaagagatcataaagactg

SEQ ID NO: 22479 - DNA, 20 bp, Artificial Sequence
  chemically synthesized
gagatcataaagactgagga

SEQ ID NO: 22480 - DNA, 20 bp, Artificial Sequence
  chemically synthesized
atcataaagactgaggatag

SEQ ID NO: 22481 - DNA, 20 bp, Artificial Sequence
  chemically synthesized
taaagactgaggatagaagc

SEQ ID NO: 22482 - DNA, 20 bp, Artificial Sequence
  chemically synthesized
agactgaggatagaagcaag

SEQ ID NO: 22483 - DNA, 20 bp, Artificial Sequence
  chemically synthesized
gaagcaagaagattctataa

SEQ ID NO: 22484 - DNA, 20 bp, Artificial Sequence
  chemically synthesized
agattctataatggaacacc

SEQ ID NO: 22485 - DNA, 20 bp, Artificial Sequence
  chemically synthesized
taatggaacacctagaaaat

SEQ ID NO: 22486 - DNA, 20 bp, Artificial Sequence
  chemically synthesized
agataaacttctaacattta

SEQ ID NO: 22487 - DNA, 20 bp, Artificial Sequence
  chemically synthesized
ttttctctgctttgtttaaa

SEQ ID NO: 22488 - DNA, 20 bp, Artificial Sequence
  chemically synthesized
tttgtttaaaaagtaaaatg

SEQ ID NO: 22489 - DNA, 20 bp, Artificial Sequence
  chemically synthesized
gtttaaaaagtaaaatgtag

SEQ ID NO: 22490 - DNA, 20 bp, Artificial Sequence
  chemically synthesized
aaagtaaaatgtagtagaat

SEQ ID NO: 22491 - DNA, 20 bp, Artificial Sequence
  chemically synthesized
agtaaaatgtagtagaataa

SEQ ID NO: 22492 - DNA, 20 bp, Artificial Sequence
  chemically synthesized
gtaaaatgtagtagaataag

SEQ ID NO: 22493 - DNA, 20 bp, Artificial Sequence
  chemically synthesized
gtgccttcctgttcatcttt

SEQ ID NO: 22494 - DNA, 20 bp, Artificial Sequence
  chemically synthesized
cttcctgttcatcttttaga

SEQ ID NO: 22495 - DNA, 20 bp, Artificial Sequence
  chemically synthesized
ttcctgttcatcttttagaa

SEQ ID NO: 22496 - DNA, 20 bp, Artificial Sequence
  chemically synthesized
tgttcatcttttagaaagga

SEQ ID NO: 22497 - DNA, 20 bp, Artificial Sequence
  chemically synthesized
tcatcttttagaaaggaaag

SEQ ID NO: 22498 - DNA, 20 bp, Artificial Sequence
  chemically synthesized
agaaaggaaagaagacatat

SEQ ID NO: 22499 - DNA, 20 bp, Artificial Sequence
  chemically synthesized
aaaggaaagaagacatatga

SEQ ID NO: 22500 - DNA, 20 bp, Artificial Sequence
  chemically synthesized
aaggaaagaagacatatgag

SEQ ID NO: 22501 - DNA, 20 bp, Artificial Sequence
  chemically synthesized
aggaaagaagacatatgaga

SEQ ID NO: 22502 - DNA, 20 bp, Artificial Sequence
  chemically synthesized
tcaatcatattcacatcact

SEQ ID NO: 22503 - DNA, 20 bp, Artificial Sequence
  chemically synthesized
catattcacatcactgagta

SEQ ID NO: 22504 - DNA, 20 bp, Artificial Sequence
  chemically synthesized
attcacatcactgagtacag

SEQ ID NO: 22505 - DNA, 20 bp, Artificial Sequence
  chemically synthesized
ttcacatcactgagtacaga

SEQ ID NO: 22506 - DNA, 20 bp, Artificial Sequence
  chemically synthesized
tcactgagtacagaaggtct

SEQ ID NO: 22507 - DNA, 20 bp, Artificial Sequence
  chemically synthesized
cactgagtacagaaggtctt

SEQ ID NO: 22508 - DNA, 20 bp, Artificial Sequence
  chemically synthesized
tgagtacagaaggtcttagg

SEQ ID NO: 22509 - DNA, 20 bp, Artificial Sequence
  chemically synthesized
tacagaaggtcttaggtagt

SEQ ID NO: 22510 - DNA, 20 bp, Artificial Sequence
  chemically synthesized
gaaggtcttaggtagttggt

SEQ ID NO: 22511 - DNA, 20 bp, Artificial Sequence
  chemically synthesized
ggtcttaggtagttggttgg

SEQ ID NO: 22512 - DNA, 20 bp, Artificial Sequence
  chemically synthesized
ggtagttggttggtagcact

SEQ ID NO: 22513 - DNA, 20 bp, Artificial Sequence
  chemically synthesized
agcacttggaattgcttttg

SEQ ID NO: 22514 - DNA, 20 bp, Artificial Sequence
  chemically synthesized
ttttgaagttctatcaactt

SEQ ID NO: 22515 - DNA, 20 bp, Artificial Sequence
  chemically synthesized
gaaatctgtgcacacatcca

SEQ ID NO: 22516 - DNA, 20 bp, Artificial Sequence
  chemically synthesized
tgtgcacacatccaaagctg

SEQ ID NO: 22517 - DNA, 20 bp, Artificial Sequence
  chemically synthesized
atccaaagctgtggactatt

SEQ ID NO: 22518 - DNA, 20 bp, Artificial Sequence
  chemically synthesized
ttcttctccgtatctttctc

SEQ ID NO: 22519 - DNA, 20 bp, Artificial Sequence
  chemically synthesized
cttctccgtatctttctctg

SEQ ID NO: 22520 - DNA, 20 bp, Artificial Sequence
  chemically synthesized
tctccgtatctttctctgga

SEQ ID NO: 22521 - DNA, 20 bp, Artificial Sequence
  chemically synthesized
atctttctctggagagctta

SEQ ID NO: 22522 - DNA, 20 bp, Artificial Sequence
  chemically synthesized
ctttctctggagagcttata

SEQ ID NO: 22523 - DNA, 20 bp, Artificial Sequence
  chemically synthesized
tttctctggagagcttatag

SEQ ID NO: 22524 - DNA, 20 bp, Artificial Sequence
  chemically synthesized
tctctggagagcttatagag

SEQ ID NO: 22525 - DNA, 20 bp, Artificial Sequence
  chemically synthesized
gagcttatagaggagtctcc

SEQ ID NO: 22526 - DNA, 20 bp, Artificial Sequence
  chemically synthesized
tagtacactctttatatatc

SEQ ID NO: 22527 - DNA, 20 bp, Artificial Sequence
  chemically synthesized
agtacactctttatatatct

SEQ ID NO: 22528 - DNA, 20 bp, Artificial Sequence
  chemically synthesized
tacactctttatatatctag

SEQ ID NO: 22529 - DNA, 20 bp, Artificial Sequence
  chemically synthesized
ggagtatttcaccatactcc

SEQ ID NO: 22530 - DNA, 20 bp, Artificial Sequence
  chemically synthesized
gagtatttcaccatactccc

SEQ ID NO: 22531 - DNA, 20 bp, Artificial Sequence
  chemically synthesized
aggtaccataacttgtttga

SEQ ID NO: 22532 - DNA, 20 bp, Artificial Sequence
  chemically synthesized
accataacttgtttgatggt

SEQ ID NO: 22533 - DNA, 20 bp, Artificial Sequence
  chemically synthesized
ccataacttgtttgatggtg

SEQ ID NO: 22534 - DNA, 20 bp, Artificial Sequence
  chemically synthesized
taacttgtttgatggtgagg

SEQ ID NO: 22535 - DNA, 20 bp, Artificial Sequence
  chemically synthesized
acttgtttgatggtgaggaa

SEQ ID NO: 22536 - DNA, 20 bp, Artificial Sequence
  chemically synthesized
tgtttgatggtgaggaagag

SEQ ID NO: 22537 - DNA, 20 bp, Artificial Sequence
  chemically synthesized
gtttgatggtgaggaagagc

SEQ ID NO: 22538 - DNA, 20 bp, Artificial Sequence
  chemically synthesized
tttgatggtgaggaagagca

SEQ ID NO: 22539 - DNA, 20 bp, Artificial Sequence
  chemically synthesized
gggttcttgtgtcttaccta

SEQ ID NO: 22540 - DNA, 20 bp, Artificial Sequence
  chemically synthesized
ttgtgtcttacctaaagact

SEQ ID NO: 22541 - DNA, 20 bp, Artificial Sequence
  chemically synthesized
gttccttctcaacatctgtg

SEQ ID NO: 22542 - DNA, 20 bp, Artificial Sequence
  chemically synthesized
tccttctcaacatctgtgaa

SEQ ID NO: 22543 - DNA, 20 bp, Artificial Sequence
  chemically synthesized
ttctcaacatctgtgaagag

SEQ ID NO: 22544 - DNA, 20 bp, Artificial Sequence
  chemically synthesized
tcaacatctgtgaagagaag

SEQ ID NO: 22545 - DNA, 20 bp, Artificial Sequence
  chemically synthesized
gtgaagagaagcagtcactg

SEQ ID NO: 22546 - DNA, 20 bp, Artificial Sequence
  chemically synthesized
agtcactgtggttattaata

SEQ ID NO: 22547 - DNA, 20 bp, Artificial Sequence
  chemically synthesized
actgtggttattaataaaga

SEQ ID NO: 22548 - DNA, 20 bp, Artificial Sequence
  chemically synthesized
taataaagatagcaccttcc

SEQ ID NO: 22549 - DNA, 20 bp, Artificial Sequence
  chemically synthesized
tcccagatgtctccctttta

SEQ ID NO: 22550 - DNA, 20 bp, Artificial Sequence
  chemically synthesized
tctcccttttatagccaact

SEQ ID NO: 22551 - DNA, 20 bp, Artificial Sequence
  chemically synthesized
ttatagccaacttggatctt

SEQ ID NO: 22552 - DNA, 20 bp, Artificial Sequence
  chemically synthesized
actctgtattaactcctcct

SEQ ID NO: 22553 - DNA, 20 bp, Artificial Sequence
  chemically synthesized
tctgtattaactcctcctta

SEQ ID NO: 22554 - DNA, 20 bp, Artificial Sequence
  chemically synthesized
ctgtattaactcctccttag

SEQ ID NO: 22555 - DNA, 20 bp, Artificial Sequence
  chemically synthesized
tgtattaactcctccttaga

SEQ ID NO: 22556 - DNA, 20 bp, Artificial Sequence
  chemically synthesized
tattaactcctccttagagg

SEQ ID NO: 22557 - DNA, 20 bp, Artificial Sequence
  chemically synthesized
aactcctccttagagggagc

SEQ ID NO: 22558 - DNA, 20 bp, Artificial Sequence
  chemically synthesized
agggagctggaacacttaat

SEQ ID NO: 22559 - DNA, 20 bp, Artificial Sequence
  chemically synthesized
aacacttaattagtcccccc

SEQ ID NO: 22560 - DNA, 20 bp, Artificial Sequence
  chemically synthesized
taatctttcttttttcaaat

SEQ ID NO: 22561 - DNA, 20 bp, Artificial Sequence
  chemically synthesized
tcttttttcaaataagttac

SEQ ID NO: 22562 - DNA, 20 bp, Artificial Sequence
  chemically synthesized
aataagttactggctgaatc

SEQ ID NO: 22563 - DNA, 20 bp, Artificial Sequence
  chemically synthesized
tactggctgaatcaagccac

SEQ ID NO: 22564 - DNA, 20 bp, Artificial Sequence
  chemically synthesized
tggctgaatcaagccactgg

SEQ ID NO: 22565 - DNA, 20 bp, Artificial Sequence
  chemically synthesized
ggctgaatcaagccactggt

SEQ ID NO: 22566 - DNA, 20 bp, Artificial Sequence
  chemically synthesized
actggtaggacctttatgtg

SEQ ID NO: 22567 - DNA, 20 bp, Artificial Sequence
  chemically synthesized
ctggtaggacctttatgtgt

SEQ ID NO: 22568 - DNA, 20 bp, Artificial Sequence
  chemically synthesized
tggtaggacctttatgtgtg

SEQ ID NO: 22569 - DNA, 20 bp, Artificial Sequence
  chemically synthesized
gacctttatgtgtggggaat

SEQ ID NO: 22570 - DNA, 20 bp, Artificial Sequence
  chemically synthesized
tttatgtgtggggaatcaga

SEQ ID NO: 22571 - DNA, 20 bp, Artificial Sequence
  chemically synthesized
aatcagacagcctgtcttca

SEQ ID NO: 22572 - DNA, 20 bp, Artificial Sequence
  chemically synthesized
acagcctgtcttcatagccc

SEQ ID NO: 22573 - DNA, 20 bp, Artificial Sequence
  chemically synthesized
gcctgtcttcatagccccag

SEQ ID NO: 22574 - DNA, 20 bp, Artificial Sequence
  chemically synthesized
ttcatagccccagcagactc

SEQ ID NO: 22575 - DNA, 20 bp, Artificial Sequence
  chemically synthesized
gcagactctggtatcacctc

SEQ ID NO: 22576 - DNA, 20 bp, Artificial Sequence
  chemically synthesized
cagactctggtatcacctct

SEQ ID NO: 22577 - DNA, 20 bp, Artificial Sequence
  chemically synthesized
gactctggtatcacctctgg

SEQ ID NO: 22578 - DNA, 20 bp, Artificial Sequence
  chemically synthesized
actctggtatcacctctggg

SEQ ID NO: 22579 - DNA, 20 bp, Artificial Sequence
  chemically synthesized
attccctacatttacttcaa

SEQ ID NO: 22580 - DNA, 20 bp, Artificial Sequence
  chemically synthesized
ttcaacagtcaaatctttcc

SEQ ID NO: 22581 - DNA, 20 bp, Artificial Sequence
  chemically synthesized
aatctttcccagtttatctc

SEQ ID NO: 22582 - DNA, 20 bp, Artificial Sequence
  chemically synthesized
tctttcccagtttatctcaa

SEQ ID NO: 22583 - DNA, 20 bp, Artificial Sequence
  chemically synthesized
tcccagtttatctcaagaga

SEQ ID NO: 22584 - DNA, 20 bp, Artificial Sequence
  chemically synthesized
agaaagcctatatatcttct

SEQ ID NO: 22585 - DNA, 20 bp, Artificial Sequence
  chemically synthesized
tttctactatatttcctgct

SEQ ID NO: 22586 - DNA, 20 bp, Artificial Sequence
  chemically synthesized
actatatttcctgcttggtt

SEQ ID NO: 22587 - DNA, 20 bp, Artificial Sequence
  chemically synthesized
atttcctgcttggtttagat

SEQ ID NO: 22588 - DNA, 20 bp, Artificial Sequence
  chemically synthesized
ttcctgcttggtttagatca

SEQ ID NO: 22589 - DNA, 20 bp, Artificial Sequence
  chemically synthesized
tgcttggtttagatcagaga

SEQ ID NO: 22590 - DNA, 20 bp, Artificial Sequence
  chemically synthesized
ttagatcagagaaagcttga

SEQ ID NO: 22591 - DNA, 20 bp, Artificial Sequence
  chemically synthesized
gatcagagaaagcttgaaag

SEQ ID NO: 22592 - DNA, 20 bp, Artificial Sequence
  chemically synthesized
tcagagaaagcttgaaagca

SEQ ID NO: 22593 - DNA, 20 bp, Artificial Sequence
  chemically synthesized
agagaaagcttgaaagcaga

SEQ ID NO: 22594 - DNA, 20 bp, Artificial Sequence
  chemically synthesized
aaagcttgaaagcagagagc

SEQ ID NO: 22595 - DNA, 20 bp, Artificial Sequence
  chemically synthesized
cttgaaagcagagagctaga

SEQ ID NO: 22596 - DNA, 20 bp, Artificial Sequence
  chemically synthesized
aagcagagagctagatagac

SEQ ID NO: 22597 - DNA, 20 bp, Artificial Sequence
  chemically synthesized
gcagagagctagatagacta

SEQ ID NO: 22598 - DNA, 20 bp, Artificial Sequence
  chemically synthesized
agagtcaatataataaaatt

SEQ ID NO: 22599 - DNA, 20 bp, Artificial Sequence
  chemically synthesized
gagtcaatataataaaattc

SEQ ID NO: 22600 - DNA, 20 bp, Artificial Sequence
  chemically synthesized
tcaatataataaaattcagg

SEQ ID NO: 22601 - DNA, 20 bp, Artificial Sequence
  chemically synthesized
aaaattcaggcagccttctc

SEQ ID NO: 22602 - DNA, 20 bp, Artificial Sequence
  chemically synthesized
caacgtgaacgcacattctg

SEQ ID NO: 22603 - DNA, 20 bp, Artificial Sequence
  chemically synthesized
tcactaactattcccttctt

SEQ ID NO: 22604 - DNA, 20 bp, Artificial Sequence
  chemically synthesized
aactattcccttcttgagtt

SEQ ID NO: 22605 - DNA, 20 bp, Artificial Sequence
  chemically synthesized
ccttcttgagtttagcctac

SEQ ID NO: 22606 - DNA, 20 bp, Artificial Sequence
  chemically synthesized
tcttgagtttagcctaccag

SEQ ID NO: 22607 - DNA, 20 bp, Artificial Sequence
  chemically synthesized
accagaagttttctcttttc

SEQ ID NO: 22608 - DNA, 20 bp, Artificial Sequence
  chemically synthesized
ccagaagttttctcttttcc

SEQ ID NO: 22609 - DNA, 20 bp, Artificial Sequence
  chemically synthesized
cagaagttttctcttttcca

SEQ ID NO: 22610 - DNA, 20 bp, Artificial Sequence
  chemically synthesized
agaagttttctcttttccag

SEQ ID NO: 22611 - DNA, 20 bp, Artificial Sequence
  chemically synthesized
tttctcttttccaggggatg

SEQ ID NO: 22612 - DNA, 20 bp, Artificial Sequence
  chemically synthesized
ctcttttccaggggatgcag

SEQ ID NO: 22613 - DNA, 20 bp, Artificial Sequence
  chemically synthesized
tcttttccaggggatgcagc

SEQ ID NO: 22614 - DNA, 20 bp, Artificial Sequence
  chemically synthesized
cagcaggcatactcatcaca

SEQ ID NO: 22615 - DNA, 20 bp, Artificial Sequence
  chemically synthesized
atactcatcacatggtgctt

SEQ ID NO: 22616 - DNA, 20 bp, Artificial Sequence
  chemically synthesized
catcacatggtgcttcagcc

SEQ ID NO: 22617 - DNA, 20 bp, Artificial Sequence
  chemically synthesized
cacaccacatcactttgtga

SEQ ID NO: 22618 - DNA, 20 bp, Artificial Sequence
  chemically synthesized
caattattatatgcgtttta

SEQ ID NO: 22619 - DNA, 20 bp, Artificial Sequence
  chemically synthesized
tattatatgcgttttacagt

SEQ ID NO: 22620 - DNA, 20 bp, Artificial Sequence
  chemically synthesized
attatatgcgttttacagta

SEQ ID NO: 22621 - DNA, 20 bp, Artificial Sequence
  chemically synthesized
taaggactatgaaatgcaat

SEQ ID NO: 22622 - DNA, 20 bp, Artificial Sequence
  chemically synthesized
aatgagataaaataattcca

SEQ ID NO: 22623 - DNA, 20 bp, Artificial Sequence
  chemically synthesized
gagataaaataattccaaag

SEQ ID NO: 22624 - DNA, 20 bp, Artificial Sequence
  chemically synthesized
aaaataattccaaagtagca

SEQ ID NO: 22625 - DNA, 20 bp, Artificial Sequence
  chemically synthesized
taattccaaagtagcacagc

SEQ ID NO: 22626 - DNA, 20 bp, Artificial Sequence
  chemically synthesized
attccaaagtagcacagcaa

SEQ ID NO: 22627 - DNA, 20 bp, Artificial Sequence
  chemically synthesized
aagtagcacagcaagagcca

SEQ ID NO: 22628 - DNA, 20 bp, Artificial Sequence
  chemically synthesized
caagagccaaagccacaatg

SEQ ID NO: 22629 - DNA, 20 bp, Artificial Sequence
  chemically synthesized
acaaaatattcaacctccaa

SEQ ID NO: 22630 - DNA, 20 bp, Artificial Sequence
  chemically synthesized
aaaatattcaacctccaaca

SEQ ID NO: 22631 - DNA, 20 bp, Artificial Sequence
  chemically synthesized
aaatattcaacctccaacag

SEQ ID NO: 22632 - DNA, 20 bp, Artificial Sequence
  chemically synthesized
ctccaacagaggaaaacctc

SEQ ID NO: 22633 - DNA, 20 bp, Artificial Sequence
  chemically synthesized
cagaggaaaacctccagtaa

SEQ ID NO: 22634 - DNA, 20 bp, Artificial Sequence
  chemically synthesized
ggaaaacctccagtaaaagc

SEQ ID NO: 22635 - DNA, 20 bp, Artificial Sequence
  chemically synthesized
gaaaacctccagtaaaagcc

SEQ ID NO: 22636 - DNA, 20 bp, Artificial Sequence
  chemically synthesized
acctccagtaaaagccagga

SEQ ID NO: 22637 - DNA, 20 bp, Artificial Sequence
  chemically synthesized
ctccagtaaaagccaggaca

SEQ ID NO: 22638 - DNA, 20 bp, Artificial Sequence
  chemically synthesized
agtaaaagccaggacagaga

SEQ ID NO: 22639 - DNA, 20 bp, Artificial Sequence
  chemically synthesized
taaaagccaggacagagaca

SEQ ID NO: 22640 - DNA, 20 bp, Artificial Sequence
  chemically synthesized
aggacagagacagagatctt

SEQ ID NO: 22641 - DNA, 20 bp, Artificial Sequence
  chemically synthesized
atcttgagttgtgctgttca

SEQ ID NO: 22642 - DNA, 20 bp, Artificial Sequence
  chemically synthesized
gttcaaagcccaatacccac

SEQ ID NO: 22643 - DNA, 20 bp, Artificial Sequence
  chemically synthesized
ttcaaagcccaatacccaca

SEQ ID NO: 22644 - DNA, 20 bp, Artificial Sequence
  chemically synthesized
agcccaatacccacaaggct

SEQ ID NO: 22645 - DNA, 20 bp, Artificial Sequence
  chemically synthesized
gcccaatacccacaaggctg

SEQ ID NO: 22646 - DNA, 20 bp, Artificial Sequence
  chemically synthesized
cccaatacccacaaggctga

SEQ ID NO: 22647 - DNA, 20 bp, Artificial Sequence
  chemically synthesized
aaggctgagggcacaaataa

SEQ ID NO: 22648 - DNA, 20 bp, Artificial Sequence
  chemically synthesized
ggctgagggcacaaataata

SEQ ID NO: 22649 - DNA, 20 bp, Artificial Sequence
  chemically synthesized
gggcacaaataatagagaaa

SEQ ID NO: 22650 - DNA, 20 bp, Artificial Sequence
  chemically synthesized
acaaataatagagaaaaaga

SEQ ID NO: 22651 - DNA, 20 bp, Artificial Sequence
  chemically synthesized
aataatagagaaaaagatgg

SEQ ID NO: 22652 - DNA, 20 bp, Artificial Sequence
  chemically synthesized
ataatagagaaaaagatgga

SEQ ID NO: 22653 - DNA, 20 bp, Artificial Sequence
  chemically synthesized
atagagaaaaagatggaagg

SEQ ID NO: 22654 - DNA, 20 bp, Artificial Sequence
  chemically synthesized
tagagaaaaagatggaagga

SEQ ID NO: 22655 - DNA, 20 bp, Artificial Sequence
  chemically synthesized
gagaaaaagatggaaggaag

SEQ ID NO: 22656 - DNA, 20 bp, Artificial Sequence
  chemically synthesized
agaaaaagatggaaggaagg

SEQ ID NO: 22657 - DNA, 20 bp, Artificial Sequence
  chemically synthesized
aaaagatggaaggaaggagg

SEQ ID NO: 22658 - DNA, 20 bp, Artificial Sequence
  chemically synthesized
aaagatggaaggaaggaggt

SEQ ID NO: 22659 - DNA, 20 bp, Artificial Sequence
  chemically synthesized
aagatggaaggaaggaggta

SEQ ID NO: 22660 - DNA, 20 bp, Artificial Sequence
  chemically synthesized
gatggaaggaaggaggtagg

SEQ ID NO: 22661 - DNA, 20 bp, Artificial Sequence
  chemically synthesized
tggaaggaaggaggtaggga

SEQ ID NO: 22662 - DNA, 20 bp, Artificial Sequence
  chemically synthesized
gaaggaaggaggtagggaga

SEQ ID NO: 22663 - DNA, 20 bp, Artificial Sequence
  chemically synthesized
aaggaaggaggtagggagag

SEQ ID NO: 22664 - DNA, 20 bp, Artificial Sequence
  chemically synthesized
aggaaggaggtagggagaga

SEQ ID NO: 22665 - DNA, 20 bp, Artificial Sequence
  chemically synthesized
aaggaggtagggagagaggg

SEQ ID NO: 22666 - DNA, 20 bp, Artificial Sequence
  chemically synthesized
ggaggtagggagagagggaa

SEQ ID NO: 22667 - DNA, 20 bp, Artificial Sequence
  chemically synthesized
aggtagggagagagggaaga

SEQ ID NO: 22668 - DNA, 20 bp, Artificial Sequence
  chemically synthesized
ggtagggagagagggaagag

SEQ ID NO: 22669 - DNA, 20 bp, Artificial Sequence
  chemically synthesized
tagggagagagggaagagag

SEQ ID NO: 22670 - DNA, 20 bp, Artificial Sequence
  chemically synthesized
agggagagagggaagagagg

SEQ ID NO: 22671 - DNA, 20 bp, Artificial Sequence
  chemically synthesized
gggagagagggaagagagga

SEQ ID NO: 22672 - DNA, 20 bp, Artificial Sequence
  chemically synthesized
gagagagggaagagaggagg

SEQ ID NO: 22673 - DNA, 20 bp, Artificial Sequence
  chemically synthesized
agagggaagagaggagggag

SEQ ID NO: 22674 - DNA, 20 bp, Artificial Sequence
  chemically synthesized
gggaagagaggagggagcag

SEQ ID NO: 22675 - DNA, 20 bp, Artificial Sequence
  chemically synthesized
gaagagaggagggagcagaa

SEQ ID NO: 22676 - DNA, 20 bp, Artificial Sequence
  chemically synthesized
aagagaggagggagcagaag

SEQ ID NO: 22677 - DNA, 20 bp, Artificial Sequence
  chemically synthesized
agagaggagggagcagaaga

SEQ ID NO: 22678 - DNA, 20 bp, Artificial Sequence
  chemically synthesized
agaggagggagcagaagagg

SEQ ID NO: 22679 - DNA, 20 bp, Artificial Sequence
  chemically synthesized
gaggagggagcagaagaggg

SEQ ID NO: 22680 - DNA, 20 bp, Artificial Sequence
  chemically synthesized
aggagggagcagaagaggga

SEQ ID NO: 22681 - DNA, 20 bp, Artificial Sequence
  chemically synthesized
gagggagcagaagagggagg

SEQ ID NO: 22682 - DNA, 20 bp, Artificial Sequence
  chemically synthesized
agggagcagaagagggaggg

SEQ ID NO: 22683 - DNA, 20 bp, Artificial Sequence
  chemically synthesized
gggagcagaagagggaggga

SEQ ID NO: 22684 - DNA, 20 bp, Artificial Sequence
  chemically synthesized
agcagaagagggagggaggg

SEQ ID NO: 22685 - DNA, 20 bp, Artificial Sequence
  chemically synthesized
agaacaataattatctaaat

SEQ ID NO: 22686 - DNA, 20 bp, Artificial Sequence
  chemically synthesized
gaacaataattatctaaatc

SEQ ID NO: 22687 - DNA, 20 bp, Artificial Sequence
  chemically synthesized
ataattatctaaatcaggaa

SEQ ID NO: 22688 - DNA, 20 bp, Artificial Sequence
  chemically synthesized
tctaaatcaggaatggtctc

SEQ ID NO: 22689 - DNA, 20 bp, Artificial Sequence
  chemically synthesized
ctaaatcaggaatggtctct

SEQ ID NO: 22690 - DNA, 20 bp, Artificial Sequence
  chemically synthesized
taaatcaggaatggtctctg

SEQ ID NO: 22691 - DNA, 20 bp, Artificial Sequence
  chemically synthesized
aatcaggaatggtctctggg

SEQ ID NO: 22692 - DNA, 20 bp, Artificial Sequence
  chemically synthesized
atcaggaatggtctctgggg

SEQ ID NO: 22693 - DNA, 20 bp, Artificial Sequence
  chemically synthesized
caggaatggtctctggggag

SEQ ID NO: 22694 - DNA, 20 bp, Artificial Sequence
  chemically synthesized
tctaaaataaatgttcctac

SEQ ID NO: 22695 - DNA, 20 bp, Artificial Sequence
  chemically synthesized
aaataaatgttcctaccagc

SEQ ID NO: 22696 - DNA, 20 bp, Artificial Sequence
  chemically synthesized
aataaatgttcctaccagcc

SEQ ID NO: 22697 - DNA, 20 bp, Artificial Sequence
  chemically synthesized
ctaccagccaggctcatgtg

SEQ ID NO: 22698 - DNA, 20 bp, Artificial Sequence
  chemically synthesized
gctcatgtgcagattctgaa

SEQ ID NO: 22699 - DNA, 20 bp, Artificial Sequence
  chemically synthesized
tgatgcccaaatctttcata

SEQ ID NO: 22700 - DNA, 20 bp, Artificial Sequence
  chemically synthesized
ccaaatctttcatacggcta

SEQ ID NO: 22701 - DNA, 20 bp, Artificial Sequence
  chemically synthesized
tttcatacggctaaagatgt

SEQ ID NO: 22702 - DNA, 20 bp, Artificial Sequence
  chemically synthesized
agatgtgagatacatgacta

SEQ ID NO: 22703 - DNA, 20 bp, Artificial Sequence
  chemically synthesized
gatacatgactatggaactg

SEQ ID NO: 22704 - DNA, 20 bp, Artificial Sequence
  chemically synthesized
atgactatggaactgaagaa

SEQ ID NO: 22705 - DNA, 20 bp, Artificial Sequence
  chemically synthesized
actatggaactgaagaatgg

SEQ ID NO: 22706 - DNA, 20 bp, Artificial Sequence
  chemically synthesized
ctatggaactgaagaatgga

SEQ ID NO: 22707 - DNA, 20 bp, Artificial Sequence
  chemically synthesized
tatggaactgaagaatggaa

SEQ ID NO: 22708 - DNA, 20 bp, Artificial Sequence
  chemically synthesized
ctgaagaatggaagggaaca

SEQ ID NO: 22709 - DNA, 20 bp, Artificial Sequence
  chemically synthesized
aatggaagggaacaaagttt

SEQ ID NO: 22710 - DNA, 20 bp, Artificial Sequence
  chemically synthesized
atggaagggaacaaagtttc

SEQ ID NO: 22711 - DNA, 20 bp, Artificial Sequence
  chemically synthesized
aagggaacaaagtttcaggt

SEQ ID NO: 22712 - DNA, 20 bp, Artificial Sequence
  chemically synthesized
gaacaaagtttcaggtcagt

SEQ ID NO: 22713 - DNA, 20 bp, Artificial Sequence
  chemically synthesized
aacaaagtttcaggtcagtg

SEQ ID NO: 22714 - DNA, 20 bp, Artificial Sequence
  chemically synthesized
acaaagtttcaggtcagtga

SEQ ID NO: 22715 - DNA, 20 bp, Artificial Sequence
  chemically synthesized
atttaatgaatctcctctgt

SEQ ID NO: 22716 - DNA, 20 bp, Artificial Sequence
  chemically synthesized
tcctctgtaagatctcattg

SEQ ID NO: 22717 - DNA, 20 bp, Artificial Sequence
  chemically synthesized
cctctgtaagatctcattgc

SEQ ID NO: 22718 - DNA, 20 bp, Artificial Sequence
  chemically synthesized
aagatctcattgcaggaacc

SEQ ID NO: 22719 - DNA, 20 bp, Artificial Sequence
  chemically synthesized
agatctcattgcaggaacca

SEQ ID NO: 22720 - DNA, 20 bp, Artificial Sequence
  chemically synthesized
gaaccaaggcaaaaaaaaaa

SEQ ID NO: 22721 - DNA, 20 bp, Artificial Sequence
  chemically synthesized
accaaggcaaaaaaaaaaca

SEQ ID NO: 22722 - DNA, 20 bp, Artificial Sequence
  chemically synthesized
caaggcaaaaaaaaaacaga

SEQ ID NO: 22723 - DNA, 20 bp, Artificial Sequence
  chemically synthesized
aaaaaaaaacagagagatcg

SEQ ID NO: 22724 - DNA, 20 bp, Artificial Sequence
  chemically synthesized
agagatcgaagctgatttct

SEQ ID NO: 22725 - DNA, 20 bp, Artificial Sequence
  chemically synthesized
atcgaagctgatttcttagc

SEQ ID NO: 22726 - DNA, 20 bp, Artificial Sequence
  chemically synthesized
cgaagctgatttcttagcaa

SEQ ID NO: 22727 - DNA, 20 bp, Artificial Sequence
  chemically synthesized
ctgatttcttagcaagagaa

SEQ ID NO: 22728 - DNA, 20 bp, Artificial Sequence
  chemically synthesized
tcttagcaagagaaaagtaa

SEQ ID NO: 22729 - DNA, 20 bp, Artificial Sequence
  chemically synthesized
aagtaatagtgttgtctgct

SEQ ID NO: 22730 - DNA, 20 bp, Artificial Sequence
  chemically synthesized
gtaatagtgttgtctgctaa

SEQ ID NO: 22731 - DNA, 20 bp, Artificial Sequence
  chemically synthesized
atagtgttgtctgctaagag

SEQ ID NO: 22732 - DNA, 20 bp, Artificial Sequence
  chemically synthesized
ctgctaagagtagatatatg

SEQ ID NO: 22733 - DNA, 20 bp, Artificial Sequence
  chemically synthesized
ctaagagtagatatatgtag

SEQ ID NO: 22734 - DNA, 20 bp, Artificial Sequence
  chemically synthesized
taagagtagatatatgtagt

SEQ ID NO: 22735 - DNA, 20 bp, Artificial Sequence
  chemically synthesized
gtagatatatgtagtaggca

SEQ ID NO: 22736 - DNA, 20 bp, Artificial Sequence
  chemically synthesized
tagatatatgtagtaggcat

SEQ ID NO: 22737 - DNA, 20 bp, Artificial Sequence
  chemically synthesized
tgtagtaggcatgggtccta

SEQ ID NO: 22738 - DNA, 20 bp, Artificial Sequence
  chemically synthesized
tccctgacatctctaaaact

SEQ ID NO: 22739 - DNA, 20 bp, Artificial Sequence
  chemically synthesized
ctctaaaacttggtttcttt

SEQ ID NO: 22740 - DNA, 20 bp, Artificial Sequence
  chemically synthesized
ctaaaacttggtttctttga

SEQ ID NO: 22741 - DNA, 20 bp, Artificial Sequence
  chemically synthesized
ttacctcttcaaatataaaa

SEQ ID NO: 22742 - DNA, 20 bp, Artificial Sequence
  chemically synthesized
tcttcaaatataaaaaagtg

SEQ ID NO: 22743 - DNA, 20 bp, Artificial Sequence
  chemically synthesized
cttcaaatataaaaaagtga

SEQ ID NO: 22744 - DNA, 20 bp, Artificial Sequence
  chemically synthesized
aaatataaaaaagtgaagga

SEQ ID NO: 22745 - DNA, 20 bp, Artificial Sequence
  chemically synthesized
aaaaagtgaaggatagattc

SEQ ID NO: 22746 - DNA, 20 bp, Artificial Sequence
  chemically synthesized
ggatagattctggaacacat

SEQ ID NO: 22747 - DNA, 20 bp, Artificial Sequence
  chemically synthesized
gatagattctggaacacata

SEQ ID NO: 22748 - DNA, 20 bp, Artificial Sequence
  chemically synthesized
aaacaattctacgaacaaac

SEQ ID NO: 22749 - DNA, 20 bp, Artificial Sequence
  chemically synthesized
acaattctacgaacaaacca

SEQ ID NO: 22750 - DNA, 20 bp, Artificial Sequence
  chemically synthesized
tctacgaacaaaccagagca

SEQ ID NO: 22751 - DNA, 20 bp, Artificial Sequence
  chemically synthesized
ctacgaacaaaccagagcat

SEQ ID NO: 22752 - DNA, 20 bp, Artificial Sequence
  chemically synthesized
ccagagcatgggtgttgact

SEQ ID NO: 22753 - DNA, 20 bp, Artificial Sequence
  chemically synthesized
cagagcatgggtgttgactc

SEQ ID NO: 22754 - DNA, 20 bp, Artificial Sequence
  chemically synthesized
gttgactcaggcatgaatta

SEQ ID NO: 22755 - DNA, 20 bp, Artificial Sequence
  chemically synthesized
ttgactcaggcatgaattat

SEQ ID NO: 22756 - DNA, 20 bp, Artificial Sequence
  chemically synthesized
tgactcaggcatgaattatg

SEQ ID NO: 22757 - DNA, 20 bp, Artificial Sequence
  chemically synthesized
aggcatgaattatggggttg

SEQ ID NO: 22758 - DNA, 20 bp, Artificial Sequence
  chemically synthesized
gactgattctttaatctctc

SEQ ID NO: 22759 - DNA, 20 bp, Artificial Sequence
  chemically synthesized
ctggcttccattctaaccct

SEQ ID NO: 22760 - DNA, 20 bp, Artificial Sequence
  chemically synthesized
ggcttccattctaaccctga

SEQ ID NO: 22761 - DNA, 20 bp, Artificial Sequence
  chemically synthesized
caaccccatgtcttttacct

SEQ ID NO: 22762 - DNA, 20 bp, Artificial Sequence
  chemically synthesized
ccccatgtcttttaccttag

SEQ ID NO: 22763 - DNA, 20 bp, Artificial Sequence
  chemically synthesized
tgtcttttaccttagaagtc

SEQ ID NO: 22764 - DNA, 20 bp, Artificial Sequence
  chemically synthesized
tttaccttagaagtccagat

SEQ ID NO: 22765 - DNA, 20 bp, Artificial Sequence
  chemically synthesized
gtccagataagtgccaaata

SEQ ID NO: 22766 - DNA, 20 bp, Artificial Sequence
  chemically synthesized
atcaactcttccaaattctt

SEQ ID NO: 22767 - DNA, 20 bp, Artificial Sequence
  chemically synthesized
tcaactcttccaaattcttg

SEQ ID NO: 22768 - DNA, 20 bp, Artificial Sequence
  chemically synthesized
aactcttccaaattcttgag

SEQ ID NO: 22769 - DNA, 20 bp, Artificial Sequence
  chemically synthesized
actcttccaaattcttgagg

SEQ ID NO: 22770 - DNA, 20 bp, Artificial Sequence
  chemically synthesized
aggtatacctctgtaatcat

SEQ ID NO: 22771 - DNA, 20 bp, Artificial Sequence
  chemically synthesized
gtatacctctgtaatcatca

SEQ ID NO: 22772 - DNA, 20 bp, Artificial Sequence
  chemically synthesized
tatacctctgtaatcatcag

SEQ ID NO: 22773 - DNA, 20 bp, Artificial Sequence
  chemically synthesized
tcagaggttcaaatactttc

SEQ ID NO: 22774 - DNA, 20 bp, Artificial Sequence
  chemically synthesized
tcaaatactttctagaaaaa

SEQ ID NO: 22775 - DNA, 20 bp, Artificial Sequence
  chemically synthesized
taataaaccaattcaaaatt

SEQ ID NO: 22776 - DNA, 20 bp, Artificial Sequence
  chemically synthesized
aaccaattcaaaattaagct

SEQ ID NO: 22777 - DNA, 20 bp, Artificial Sequence
  chemically synthesized
aattcaaaattaagcttgga

SEQ ID NO: 22778 - DNA, 20 bp, Artificial Sequence
  chemically synthesized
ttcaaaattaagcttggacg

SEQ ID NO: 22779 - DNA, 20 bp, Artificial Sequence
  chemically synthesized
aattaagcttggacggagct

SEQ ID NO: 22780 - DNA, 20 bp, Artificial Sequence
  chemically synthesized
attaagcttggacggagctt

SEQ ID NO: 22781 - DNA, 20 bp, Artificial Sequence
  chemically synthesized
gcttgggttatgtgtgcctc

SEQ ID NO: 22782 - DNA, 20 bp, Artificial Sequence
  chemically synthesized
ggttatgtgtgcctctggat

SEQ ID NO: 22783 - DNA, 20 bp, Artificial Sequence
  chemically synthesized
gttatgtgtgcctctggatc

SEQ ID NO: 22784 - DNA, 20 bp, Artificial Sequence
  chemically synthesized
ttatgtgtgcctctggatca

SEQ ID NO: 22785 - DNA, 20 bp, Artificial Sequence
  chemically synthesized
tatgtgtgcctctggatcag

SEQ ID NO: 22786 - DNA, 20 bp, Artificial Sequence
  chemically synthesized
gtgcctctggatcaggggta

SEQ ID NO: 22787 - DNA, 20 bp, Artificial Sequence
  chemically synthesized
atcaggggtacagattcaca

SEQ ID NO: 22788 - DNA, 20 bp, Artificial Sequence
  chemically synthesized
tcacatagcctgtgtgactt

SEQ ID NO: 22789 - DNA, 20 bp, Artificial Sequence
  chemically synthesized
gcctgtgtgactttagcacc

SEQ ID NO: 22790 - DNA, 20 bp, Artificial Sequence
  chemically synthesized
gtgtgactttagcacctgga

SEQ ID NO: 22791 - DNA, 20 bp, Artificial Sequence
  chemically synthesized
tgtgactttagcacctggaa

SEQ ID NO: 22792 - DNA, 20 bp, Artificial Sequence
  chemically synthesized
gaaaggtttatattgtgtaa

SEQ ID NO: 22793 - DNA, 20 bp, Artificial Sequence
  chemically synthesized
aaaggtttatattgtgtaac

SEQ ID NO: 22794 - DNA, 20 bp, Artificial Sequence
  chemically synthesized
ttcttttgcctgctttcttc

SEQ ID NO: 22795 - DNA, 20 bp, Artificial Sequence
  chemically synthesized
ctgctttcttctagccgccc

SEQ ID NO: 22796 - DNA, 20 bp, Artificial Sequence
  chemically synthesized
ctttcttctagccgccctgg

SEQ ID NO: 22797 - DNA, 20 bp, Artificial Sequence
  chemically synthesized
tagccgccctggcagctgat

SEQ ID NO: 22798 - DNA, 20 bp, Artificial Sequence
  chemically synthesized
cgccctggcagctgattaga

SEQ ID NO: 22799 - DNA, 20 bp, Artificial Sequence
  chemically synthesized
ctgattagatagtacccacc

SEQ ID NO: 22800 - DNA, 20 bp, Artificial Sequence
  chemically synthesized
ttagatagtacccacccaga

SEQ ID NO: 22801 - DNA, 20 bp, Artificial Sequence
  chemically synthesized
agatagtacccacccagacg

SEQ ID NO: 22802 - DNA, 20 bp, Artificial Sequence
  chemically synthesized
gatagtacccacccagacgg

SEQ ID NO: 22803 - DNA, 20 bp, Artificial Sequence
  chemically synthesized
atagtacccacccagacgga

SEQ ID NO: 22804 - DNA, 20 bp, Artificial Sequence
  chemically synthesized
gtacccacccagacggaggg

SEQ ID NO: 22805 - DNA, 20 bp, Artificial Sequence
  chemically synthesized
tacccacccagacggagggt

SEQ ID NO: 22806 - DNA, 20 bp, Artificial Sequence
  chemically synthesized
ccacccagacggagggtggg

SEQ ID NO: 22807 - DNA, 20 bp, Artificial Sequence
  chemically synthesized
cacccagacggagggtgggt

SEQ ID NO: 22808 - DNA, 20 bp, Artificial Sequence
  chemically synthesized
gtgggtgggtctgcctctcc

SEQ ID NO: 22809 - DNA, 20 bp, Artificial Sequence
  chemically synthesized
actcaaatgttaatctcctt

SEQ ID NO: 22810 - DNA, 20 bp, Artificial Sequence
  chemically synthesized
ctcctttggcaacaccctta

SEQ ID NO: 22811 - DNA, 20 bp, Artificial Sequence
  chemically synthesized
caacacccttacagcacacc

SEQ ID NO: 22812 - DNA, 20 bp, Artificial Sequence
  chemically synthesized
aacacccttacagcacaccc

SEQ ID NO: 22813 - DNA, 20 bp, Artificial Sequence
  chemically synthesized
ttgcatccttcaatccaatc

SEQ ID NO: 22814 - DNA, 20 bp, Artificial Sequence
  chemically synthesized
gcactcaatattaaccatca

SEQ ID NO: 22815 - DNA, 20 bp, Artificial Sequence
  chemically synthesized
tcaatattaaccatcacaga

SEQ ID NO: 22816 - DNA, 20 bp, Artificial Sequence
  chemically synthesized
caatattaaccatcacagaa

SEQ ID NO: 22817 - DNA, 20 bp, Artificial Sequence
  chemically synthesized
aaccatcacagaaaggataa

SEQ ID NO: 22818 - DNA, 20 bp, Artificial Sequence
  chemically synthesized
cacagaaaggataatagcca

SEQ ID NO: 22819 - DNA, 20 bp, Artificial Sequence
  chemically synthesized
acagaaaggataatagccaa

SEQ ID NO: 22820 - DNA, 20 bp, Artificial Sequence
  chemically synthesized
aaaggataatagccaaaggt

SEQ ID NO: 22821 - DNA, 20 bp, Artificial Sequence
  chemically synthesized
aaggataatagccaaaggta

SEQ ID NO: 22822 - DNA, 20 bp, Artificial Sequence
  chemically synthesized
aggataatagccaaaggtaa

SEQ ID NO: 22823 - DNA, 20 bp, Artificial Sequence
  chemically synthesized
ggataatagccaaaggtaag

SEQ ID NO: 22824 - DNA, 20 bp, Artificial Sequence
  chemically synthesized
gataatagccaaaggtaagg

SEQ ID NO: 22825 - DNA, 20 bp, Artificial Sequence
  chemically synthesized
caaaggtaagggggtaaaaa

SEQ ID NO: 22826 - DNA, 20 bp, Artificial Sequence
  chemically synthesized
aaaggtaagggggtaaaaaa

SEQ ID NO: 22827 - DNA, 20 bp, Artificial Sequence
  chemically synthesized
gtaagggggtaaaaaaagga

SEQ ID NO: 22828 - DNA, 20 bp, Artificial Sequence
  chemically synthesized
aagggggtaaaaaaaggatg

SEQ ID NO: 22829 - DNA, 20 bp, Artificial Sequence
  chemically synthesized
aaaaaaaggatggagatact

SEQ ID NO: 22830 - DNA, 20 bp, Artificial Sequence
  chemically synthesized
gatggagatactaagtgctt

SEQ ID NO: 22831 - DNA, 20 bp, Artificial Sequence
  chemically synthesized
gagatactaagtgcttgaga

SEQ ID NO: 22832 - DNA, 20 bp, Artificial Sequence
  chemically synthesized
actaagtgcttgagacagaa

SEQ ID NO: 22833 - DNA, 20 bp, Artificial Sequence
  chemically synthesized
taagtgcttgagacagaaaa

SEQ ID NO: 22834 - DNA, 20 bp, Artificial Sequence
  chemically synthesized
cttgagacagaaaagagtgt

SEQ ID NO: 22835 - DNA, 20 bp, Artificial Sequence
  chemically synthesized
ttgagacagaaaagagtgtc

SEQ ID NO: 22836 - DNA, 20 bp, Artificial Sequence
  chemically synthesized
acagaaaagagtgtcaggaa

SEQ ID NO: 22837 - DNA, 20 bp, Artificial Sequence
  chemically synthesized
aaagagtgtcaggaaaagtg

SEQ ID NO: 22838 - DNA, 20 bp, Artificial Sequence
  chemically synthesized
aagagtgtcaggaaaagtga

SEQ ID NO: 22839 - DNA, 20 bp, Artificial Sequence
  chemically synthesized
tcaggaaaagtgaaggaaaa

SEQ ID NO: 22840 - DNA, 20 bp, Artificial Sequence
  chemically synthesized
aaagtgaaggaaaaaagcca

SEQ ID NO: 22841 - DNA, 20 bp, Artificial Sequence
  chemically synthesized
aagtgaaggaaaaaagccaa

SEQ ID NO: 22842 - DNA, 20 bp, Artificial Sequence
  chemically synthesized
agtgaaggaaaaaagccaaa

SEQ ID NO: 22843 - DNA, 20 bp, Artificial Sequence
  chemically synthesized
gaaggaaaaaagccaaaggg

SEQ ID NO: 22844 - DNA, 20 bp, Artificial Sequence
  chemically synthesized
aaggaaaaaagccaaaggga

SEQ ID NO: 22845 - DNA, 20 bp, Artificial Sequence
  chemically synthesized
aaaaaagccaaagggaaggt

SEQ ID NO: 22846 - DNA, 20 bp, Artificial Sequence
  chemically synthesized
aaaagccaaagggaaggtga

SEQ ID NO: 22847 - DNA, 20 bp, Artificial Sequence
  chemically synthesized
gaaggtgagagaatatatga

SEQ ID NO: 22848 - DNA, 20 bp, Artificial Sequence
  chemically synthesized
tatgaaagttaacatctgaa

SEQ ID NO: 22849 - DNA, 20 bp, Artificial Sequence
  chemically synthesized
atgaaagttaacatctgaat

SEQ ID NO: 22850 - DNA, 20 bp, Artificial Sequence
  chemically synthesized
catctgaatgggctcctgct

SEQ ID NO: 22851 - DNA, 20 bp, Artificial Sequence
  chemically synthesized
atctgaatgggctcctgctg

SEQ ID NO: 22852 - DNA, 20 bp, Artificial Sequence
  chemically synthesized
ctcctgctgaggtgtctgca

SEQ ID NO: 22853 - DNA, 20 bp, Artificial Sequence
  chemically synthesized
cctgctgaggtgtctgcata

SEQ ID NO: 22854 - DNA, 20 bp, Artificial Sequence
  chemically synthesized
aggtgtctgcatagagccat

SEQ ID NO: 22855 - DNA, 20 bp, Artificial Sequence
  chemically synthesized
catagagccatcagtttatg

SEQ ID NO: 22856 - DNA, 20 bp, Artificial Sequence
  chemically synthesized
agagccatcagtttatgcgg

SEQ ID NO: 22857 - DNA, 20 bp, Artificial Sequence
  chemically synthesized
agccatcagtttatgcggca

SEQ ID NO: 22858 - DNA, 20 bp, Artificial Sequence
  chemically synthesized
cagtttatgcggcagagttt

SEQ ID NO: 22859 - DNA, 20 bp, Artificial Sequence
  chemically synthesized
gcggcagagtttgagacttt

SEQ ID NO: 22860 - DNA, 20 bp, Artificial Sequence
  chemically synthesized
gagtttgagactttgagaat

SEQ ID NO: 22861 - DNA, 20 bp, Artificial Sequence
  chemically synthesized
tttctcattaataaaaactc

SEQ ID NO: 22862 - DNA, 20 bp, Artificial Sequence
  chemically synthesized
aactcaagtctattctatga

SEQ ID NO: 22863 - DNA, 20 bp, Artificial Sequence
  chemically synthesized
ctcaagtctattctatgaca

SEQ ID NO: 22864 - DNA, 20 bp, Artificial Sequence
  chemically synthesized
ctattctatgacagagaccc

SEQ ID NO: 22865 - DNA, 20 bp, Artificial Sequence
  chemically synthesized
ttctatgacagagaccctgg

SEQ ID NO: 22866 - DNA, 20 bp, Artificial Sequence
  chemically synthesized
ctatgacagagaccctggaa

SEQ ID NO: 22867 - DNA, 20 bp, Artificial Sequence
  chemically synthesized
tatgacagagaccctggaag

SEQ ID NO: 22868 - DNA, 20 bp, Artificial Sequence
  chemically synthesized
atgacagagaccctggaaga

SEQ ID NO: 22869 - DNA, 20 bp, Artificial Sequence
  chemically synthesized
agaccctggaagagggtgaa

SEQ ID NO: 22870 - DNA, 20 bp, Artificial Sequence
  chemically synthesized
tggaagagggtgaatggctg

SEQ ID NO: 22871 - DNA, 20 bp, Artificial Sequence
  chemically synthesized
ggaagagggtgaatggctgc

SEQ ID NO: 22872 - DNA, 20 bp, Artificial Sequence
  chemically synthesized
gaagagggtgaatggctgca

SEQ ID NO: 22873 - DNA, 20 bp, Artificial Sequence
  chemically synthesized
gggtgaatggctgcagggat

SEQ ID NO: 22874 - DNA, 20 bp, Artificial Sequence
  chemically synthesized
ggtgaatggctgcagggatg

SEQ ID NO: 22875 - DNA, 20 bp, Artificial Sequence
  chemically synthesized
atggctgcagggatgaggca

SEQ ID NO: 22876 - DNA, 20 bp, Artificial Sequence
  chemically synthesized
tggctgcagggatgaggcaa

SEQ ID NO: 22877 - DNA, 20 bp, Artificial Sequence
  chemically synthesized
cagggatgaggcaaaggttt

SEQ ID NO: 22878 - DNA, 20 bp, Artificial Sequence
  chemically synthesized
tttatcccctctgaaactca

SEQ ID NO: 22879 - DNA, 20 bp, Artificial Sequence
  chemically synthesized
gatcatctcatataccacaa

SEQ ID NO: 22880 - DNA, 20 bp, Artificial Sequence
  chemically synthesized
catataccacaaaagcaact

SEQ ID NO: 22881 - DNA, 20 bp, Artificial Sequence
  chemically synthesized
caaaagcaactgagtgaatc

SEQ ID NO: 22882 - DNA, 20 bp, Artificial Sequence
  chemically synthesized
caactgagtgaatcaagtga

SEQ ID NO: 22883 - DNA, 20 bp, Artificial Sequence
  chemically synthesized
gtgaatcaagtgaaagcact

SEQ ID NO: 22884 - DNA, 20 bp, Artificial Sequence
  chemically synthesized
ctcagttttcaatatgaaaa

SEQ ID NO: 22885 - DNA, 20 bp, Artificial Sequence
  chemically synthesized
ttttcaatatgaaaacagac

SEQ ID NO: 22886 - DNA, 20 bp, Artificial Sequence
  chemically synthesized
atgaaaacagacaagacaaa

SEQ ID NO: 22887 - DNA, 20 bp, Artificial Sequence
  chemically synthesized
acaagacaaacagctatttt

SEQ ID NO: 22888 - DNA, 20 bp, Artificial Sequence
  chemically synthesized
caagacaaacagctatttta

SEQ ID NO: 22889 - DNA, 20 bp, Artificial Sequence
  chemically synthesized
aaggattcttcccaaaaaat

SEQ ID NO: 22890 - DNA, 20 bp, Artificial Sequence
  chemically synthesized
aggattcttcccaaaaaatg

SEQ ID NO: 22891 - DNA, 20 bp, Artificial Sequence
  chemically synthesized
atgaggtgtatataatgccc

SEQ ID NO: 22892 - DNA, 20 bp, Artificial Sequence
  chemically synthesized
ccagtccaatacttgacaca

SEQ ID NO: 22893 - DNA, 20 bp, Artificial Sequence
  chemically synthesized
gtccaatacttgacacacgg

SEQ ID NO: 22894 - DNA, 20 bp, Artificial Sequence
  chemically synthesized
tgttccatacatttgtttct

SEQ ID NO: 22895 - DNA, 20 bp, Artificial Sequence
  chemically synthesized
tcagctttattttccctatc

SEQ ID NO: 22896 - DNA, 20 bp, Artificial Sequence
  chemically synthesized
ttatcaattatatgtttatt

SEQ ID NO: 22897 - DNA, 20 bp, Artificial Sequence
  chemically synthesized
tcaattatatgtttatttag

SEQ ID NO: 22898 - DNA, 20 bp, Artificial Sequence
  chemically synthesized
agtaatataacacaattaac

SEQ ID NO: 22899 - DNA, 20 bp, Artificial Sequence
  chemically synthesized
ctgtattatcttttccctcc

SEQ ID NO: 22900 - DNA, 20 bp, Artificial Sequence
  chemically synthesized
ttttccctcccagctttatt

SEQ ID NO: 22901 - DNA, 20 bp, Artificial Sequence
  chemically synthesized
tttccctcccagctttattt

SEQ ID NO: 22902 - DNA, 20 bp, Artificial Sequence
  chemically synthesized
aggtatatttaaaatttgct

SEQ ID NO: 22903 - DNA, 20 bp, Artificial Sequence
  chemically synthesized
atatttaaaatttgctaaga

SEQ ID NO: 22904 - DNA, 20 bp, Artificial Sequence
  chemically synthesized
tttaaaatttgctaagaaag

SEQ ID NO: 22905 - DNA, 20 bp, Artificial Sequence
  chemically synthesized
ttttactaccaaaaaaatta

SEQ ID NO: 22906 - DNA, 20 bp, Artificial Sequence
  chemically synthesized
aaaaattaaagttattatgt

SEQ ID NO: 22907 - DNA, 20 bp, Artificial Sequence
  chemically synthesized
aaaattaaagttattatgtg

SEQ ID NO: 22908 - DNA, 20 bp, Artificial Sequence
  chemically synthesized
aaagttattatgtgaggtga

SEQ ID NO: 22909 - DNA, 20 bp, Artificial Sequence
  chemically synthesized
gaggtgatagatatattaat

SEQ ID NO: 22910 - DNA, 20 bp, Artificial Sequence
  chemically synthesized
tatattaattagtttgatta

SEQ ID NO: 22911 - DNA, 20 bp, Artificial Sequence
  chemically synthesized
aatacctataataaaacaat

SEQ ID NO: 22912 - DNA, 20 bp, Artificial Sequence
  chemically synthesized
ctgcttctttaatcctgcat

SEQ ID NO: 22913 - DNA, 20 bp, Artificial Sequence
  chemically synthesized
tctttaatcctgcataagct

SEQ ID NO: 22914 - DNA, 20 bp, Artificial Sequence
  chemically synthesized
gtattgtctgaacctctcac

SEQ ID NO: 22915 - DNA, 20 bp, Artificial Sequence
  chemically synthesized
ttgtctgaacctctcactgg

SEQ ID NO: 22916 - DNA, 20 bp, Artificial Sequence
  chemically synthesized
tgtctgaacctctcactggc

SEQ ID NO: 22917 - DNA, 20 bp, Artificial Sequence
  chemically synthesized
ctgaacctctcactggcagg

SEQ ID NO: 22918 - DNA, 20 bp, Artificial Sequence
  chemically synthesized
ctctcactggcaggcagatt

SEQ ID NO: 22919 - DNA, 20 bp, Artificial Sequence
  chemically synthesized
acctccttttctcacttttt

SEQ ID NO: 22920 - DNA, 20 bp, Artificial Sequence
  chemically synthesized
cctccttttctcactttttg

SEQ ID NO: 22921 - DNA, 20 bp, Artificial Sequence
  chemically synthesized
cttttctcactttttgagga

SEQ ID NO: 22922 - DNA, 20 bp, Artificial Sequence
  chemically synthesized
tttctcactttttgaggaca

SEQ ID NO: 22923 - DNA, 20 bp, Artificial Sequence
  chemically synthesized
gctttcccctctacttccct

SEQ ID NO: 22924 - DNA, 20 bp, Artificial Sequence
  chemically synthesized
ttccctcagtcccaatgccc

SEQ ID NO: 22925 - DNA, 20 bp, Artificial Sequence
  chemically synthesized
tccctcagtcccaatgcccc

SEQ ID NO: 22926 - DNA, 20 bp, Artificial Sequence
  chemically synthesized
cccaggctcaacgttacttt

SEQ ID NO: 22927 - DNA, 20 bp, Artificial Sequence
  chemically synthesized
aacgttacttttagctatgt

SEQ ID NO: 22928 - DNA, 20 bp, Artificial Sequence
  chemically synthesized
gttacttttagctatgtcag

SEQ ID NO: 22929 - DNA, 20 bp, Artificial Sequence
  chemically synthesized
tatgtcagaagttcccacat

SEQ ID NO: 22930 - DNA, 20 bp, Artificial Sequence
  chemically synthesized
tctcctttccctttcccacc

SEQ ID NO: 22931 - DNA, 20 bp, Artificial Sequence
  chemically synthesized
atcacattttatctgctgat

SEQ ID NO: 22932 - DNA, 20 bp, Artificial Sequence
  chemically synthesized
cacattttatctgctgatta

SEQ ID NO: 22933 - DNA, 20 bp, Artificial Sequence
  chemically synthesized
tctgctgattagagaaacta

SEQ ID NO: 22934 - DNA, 20 bp, Artificial Sequence
  chemically synthesized
tagtttaatatctttattta

SEQ ID NO: 22935 - DNA, 20 bp, Artificial Sequence
  chemically synthesized
tctttatttaaagtcaaaca

SEQ ID NO: 22936 - DNA, 20 bp, Artificial Sequence
  chemically synthesized
ctttatttaaagtcaaacac

SEQ ID NO: 22937 - DNA, 20 bp, Artificial Sequence
  chemically synthesized
atcatcttatatctgttccc

SEQ ID NO: 22938 - DNA, 20 bp, Artificial Sequence
  chemically synthesized
tcatcttatatctgttccca

SEQ ID NO: 22939 - DNA, 20 bp, Artificial Sequence
  chemically synthesized
atctgttcccaaggcttcca

SEQ ID NO: 22940 - DNA, 20 bp, Artificial Sequence
  chemically synthesized
ccaaggcttccacagaaaaa

SEQ ID NO: 22941 - DNA, 20 bp, Artificial Sequence
  chemically synthesized
caaggcttccacagaaaaaa

SEQ ID NO: 22942 - DNA, 20 bp, Artificial Sequence
  chemically synthesized
gaaatcatttgacacacctc

SEQ ID NO: 22943 - DNA, 20 bp, Artificial Sequence
  chemically synthesized
aaatcatttgacacacctct

SEQ ID NO: 22944 - DNA, 20 bp, Artificial Sequence
  chemically synthesized
taatcctgacatgtactcac

SEQ ID NO: 22945 - DNA, 20 bp, Artificial Sequence
  chemically synthesized
atcctgacatgtactcacta

SEQ ID NO: 22946 - DNA, 20 bp, Artificial Sequence
  chemically synthesized
tgacatgtactcactagaga

SEQ ID NO: 22947 - DNA, 20 bp, Artificial Sequence
  chemically synthesized
acatgtactcactagagaaa

SEQ ID NO: 22948 - DNA, 20 bp, Artificial Sequence
  chemically synthesized
gtactcactagagaaagaga

SEQ ID NO: 22949 - DNA, 20 bp, Artificial Sequence
  chemically synthesized
tactcactagagaaagagaa

SEQ ID NO: 22950 - DNA, 20 bp, Artificial Sequence
  chemically synthesized
ctcactagagaaagagaaag

SEQ ID NO: 22951 - DNA, 20 bp, Artificial Sequence
  chemically synthesized
tcactagagaaagagaaagg

SEQ ID NO: 22952 - DNA, 20 bp, Artificial Sequence
  chemically synthesized
atttccccttactttgtgtc

SEQ ID NO: 22953 - DNA, 20 bp, Artificial Sequence
  chemically synthesized
ttccccttactttgtgtcaa

SEQ ID NO: 22954 - DNA, 20 bp, Artificial Sequence
  chemically synthesized
tttgtgtcaagagaatgact

SEQ ID NO: 22955 - DNA, 20 bp, Artificial Sequence
  chemically synthesized
gtgtcaagagaatgactgag

SEQ ID NO: 22956 - DNA, 20 bp, Artificial Sequence
  chemically synthesized
caagagaatgactgagaaga

SEQ ID NO: 22957 - DNA, 20 bp, Artificial Sequence
  chemically synthesized
actgagaagacagaaatcac

SEQ ID NO: 22958 - DNA, 20 bp, Artificial Sequence
  chemically synthesized
gagaagacagaaatcactag

SEQ ID NO: 22959 - DNA, 20 bp, Artificial Sequence
  chemically synthesized
gaaatcactagtagtcttta

SEQ ID NO: 22960 - DNA, 20 bp, Artificial Sequence
  chemically synthesized
aaatcactagtagtctttac

SEQ ID NO: 22961 - DNA, 20 bp, Artificial Sequence
  chemically synthesized
aggttatgtaaccaaatctc

SEQ ID NO: 22962 - DNA, 20 bp, Artificial Sequence
  chemically synthesized
caagattaaattactttccc

SEQ ID NO: 22963 - DNA, 20 bp, Artificial Sequence
  chemically synthesized
tttcccaagatcattattgt

SEQ ID NO: 22964 - DNA, 20 bp, Artificial Sequence
  chemically synthesized
ccaagatcattattgttaga

SEQ ID NO: 22965 - DNA, 20 bp, Artificial Sequence
  chemically synthesized
aagatcattattgttagaaa

SEQ ID NO: 22966 - DNA, 20 bp, Artificial Sequence
  chemically synthesized
atcattattgttagaaagag

SEQ ID NO: 22967 - DNA, 20 bp, Artificial Sequence
  chemically synthesized
cattattgttagaaagagca

SEQ ID NO: 22968 - DNA, 20 bp, Artificial Sequence
  chemically synthesized
acaaattcttctgaaaatga

SEQ ID NO: 22969 - DNA, 20 bp, Artificial Sequence
  chemically synthesized
ttcttctgaaaatgaaagtc

SEQ ID NO: 22970 - DNA, 20 bp, Artificial Sequence
  chemically synthesized
aaatgaaagtccagtaatct

SEQ ID NO: 22971 - DNA, 20 bp, Artificial Sequence
  chemically synthesized
tcttggatgcattcttttca

SEQ ID NO: 22972 - DNA, 20 bp, Artificial Sequence
  chemically synthesized
ggatgcattcttttcatgga

SEQ ID NO: 22973 - DNA, 20 bp, Artificial Sequence
  chemically synthesized
gcattcttttcatggacaga

SEQ ID NO: 22974 - DNA, 20 bp, Artificial Sequence
  chemically synthesized
attcttttcatggacagaaa

SEQ ID NO: 22975 - DNA, 20 bp, Artificial Sequence
  chemically synthesized
ttcttttcatggacagaaag

SEQ ID NO: 22976 - DNA, 20 bp, Artificial Sequence
  chemically synthesized
acatcaatatgctctttcaa

SEQ ID NO: 22977 - DNA, 20 bp, Artificial Sequence
  chemically synthesized
atgctctttcaatagtatat

SEQ ID NO: 22978 - DNA, 20 bp, Artificial Sequence
  chemically synthesized
tcaatagtatatgagatgta

SEQ ID NO: 22979 - DNA, 20 bp, Artificial Sequence
  chemically synthesized
gtatagtccaaaccaaccat

SEQ ID NO: 22980 - DNA, 20 bp, Artificial Sequence
  chemically synthesized
atagtccaaaccaaccataa

SEQ ID NO: 22981 - DNA, 20 bp, Artificial Sequence
  chemically synthesized
gtccaaaccaaccataagag

SEQ ID NO: 22982 - DNA, 20 bp, Artificial Sequence
  chemically synthesized
tccaaaccaaccataagaga

SEQ ID NO: 22983 - DNA, 20 bp, Artificial Sequence
  chemically synthesized
aaaccaaccataagagaagg

SEQ ID NO: 22984 - DNA, 20 bp, Artificial Sequence
  chemically synthesized
aaccaaccataagagaaggt

SEQ ID NO: 22985 - DNA, 20 bp, Artificial Sequence
  chemically synthesized
gaaggtgggcctattttctc

SEQ ID NO: 22986 - DNA, 20 bp, Artificial Sequence
  chemically synthesized
acacacaatttatgtattct

SEQ ID NO: 22987 - DNA, 20 bp, Artificial Sequence
  chemically synthesized
acacaatttatgtattctca

SEQ ID NO: 22988 - DNA, 20 bp, Artificial Sequence
  chemically synthesized
cacaatttatgtattctcag

SEQ ID NO: 22989 - DNA, 20 bp, Artificial Sequence
  chemically synthesized
atttatgtattctcagaggt

SEQ ID NO: 22990 - DNA, 20 bp, Artificial Sequence
  chemically synthesized
cagaggttggctgcctgcac

SEQ ID NO: 22991 - DNA, 20 bp, Artificial Sequence
  chemically synthesized
gcctgcaccagctgaaatct

SEQ ID NO: 22992 - DNA, 20 bp, Artificial Sequence
  chemically synthesized
tgaaatcttagaattctaat

SEQ ID NO: 22993 - DNA, 20 bp, Artificial Sequence
  chemically synthesized
cttagaattctaatgagtca

SEQ ID NO: 22994 - DNA, 20 bp, Artificial Sequence
  chemically synthesized
tagaattctaatgagtcaca

SEQ ID NO: 22995 - DNA, 20 bp, Artificial Sequence
  chemically synthesized
tcacttttgtcaaatcccat

SEQ ID NO: 22996 - DNA, 20 bp, Artificial Sequence
  chemically synthesized
tcaaatcccatcagattcca

SEQ ID NO: 22997 - DNA, 20 bp, Artificial Sequence
  chemically synthesized
atttttatttttgcatcacc

SEQ ID NO: 22998 - DNA, 20 bp, Artificial Sequence
  chemically synthesized
tttatttttgcatcaccaag

SEQ ID NO: 22999 - DNA, 20 bp, Artificial Sequence
  chemically synthesized
ttatttttgcatcaccaagt

SEQ ID NO: 23000 - DNA, 20 bp, Artificial Sequence
  chemically synthesized
accaagtaggtgatatgcaa

SEQ ID NO: 23001 - DNA, 20 bp, Artificial Sequence
  chemically synthesized
aagtaggtgatatgcaacag

SEQ ID NO: 23002 - DNA, 20 bp, Artificial Sequence
  chemically synthesized
ggtgatatgcaacagtagtt

SEQ ID NO: 23003 - DNA, 20 bp, Artificial Sequence
  chemically synthesized
agtttggtgctattatcaat

SEQ ID NO: 23004 - DNA, 20 bp, Artificial Sequence
  chemically synthesized
ttatcaattagtgccttcaa

SEQ ID NO: 23005 - DNA, 20 bp, Artificial Sequence
  chemically synthesized
atgaaaatttgaattctttg

SEQ ID NO: 23006 - DNA, 20 bp, Artificial Sequence
  chemically synthesized
aaaatttgaattctttgaag

SEQ ID NO: 23007 - DNA, 20 bp, Artificial Sequence
  chemically synthesized
tgaagcagtgtatcaataac

SEQ ID NO: 23008 - DNA, 20 bp, Artificial Sequence
  chemically synthesized
gaagcagtgtatcaataact

SEQ ID NO: 23009 - DNA, 20 bp, Artificial Sequence
  chemically synthesized
aagcagtgtatcaataacta

SEQ ID NO: 23010 - DNA, 20 bp, Artificial Sequence
  chemically synthesized
tatcaataactagggttata

SEQ ID NO: 23011 - DNA, 20 bp, Artificial Sequence
  chemically synthesized
aataactagggttataaagc

SEQ ID NO: 23012 - DNA, 20 bp, Artificial Sequence
  chemically synthesized
ataactagggttataaagct

SEQ ID NO: 23013 - DNA, 20 bp, Artificial Sequence
  chemically synthesized
ggttataaagctgggcaact

SEQ ID NO: 23014 - DNA, 20 bp, Artificial Sequence
  chemically synthesized
ttataaagctgggcaactta

SEQ ID NO: 23015 - DNA, 20 bp, Artificial Sequence
  chemically synthesized
acttagagttctatgtgctt

SEQ ID NO: 23016 - DNA, 20 bp, Artificial Sequence
  chemically synthesized
atgtgctttggaaacacaca

SEQ ID NO: 23017 - DNA, 20 bp, Artificial Sequence
  chemically synthesized
tgtgctttggaaacacacac

SEQ ID NO: 23018 - DNA, 20 bp, Artificial Sequence
  chemically synthesized
ctttggaaacacacacaggt

SEQ ID NO: 23019 - DNA, 20 bp, Artificial Sequence
  chemically synthesized
gtcattttctaactacccaa

SEQ ID NO: 23020 - DNA, 20 bp, Artificial Sequence
  chemically synthesized
tctaactacccaaaagtctc

SEQ ID NO: 23021 - DNA, 20 bp, Artificial Sequence
  chemically synthesized
taactacccaaaagtctctg

SEQ ID NO: 23022 - DNA, 20 bp, Artificial Sequence
  chemically synthesized
catcaattgaattttccctc

SEQ ID NO: 23023 - DNA, 20 bp, Artificial Sequence
  chemically synthesized
atcaattgaattttccctcc

SEQ ID NO: 23024 - DNA, 20 bp, Artificial Sequence
  chemically synthesized
ttttccctccaggaatattg

SEQ ID NO: 23025 - DNA, 20 bp, Artificial Sequence
  chemically synthesized
cctccaggaatattgaagaa

SEQ ID NO: 23026 - DNA, 20 bp, Artificial Sequence
  chemically synthesized
ctttatatctgcttttccaa

SEQ ID NO: 23027 - DNA, 20 bp, Artificial Sequence
  chemically synthesized
tctgcttttccaatagtgct

SEQ ID NO: 23028 - DNA, 20 bp, Artificial Sequence
  chemically synthesized
ccatttttctactgatcttt

SEQ ID NO: 23029 - DNA, 20 bp, Artificial Sequence
  chemically synthesized
catttttctactgatctttt

SEQ ID NO: 23030 - DNA, 20 bp, Artificial Sequence
  chemically synthesized
ctgatcttttaggtctcaca

SEQ ID NO: 23031 - DNA, 20 bp, Artificial Sequence
  chemically synthesized
cttttaggtctcacatagcc

SEQ ID NO: 23032 - DNA, 20 bp, Artificial Sequence
  chemically synthesized
ttttaggtctcacatagcct

SEQ ID NO: 23033 - DNA, 20 bp, Artificial Sequence
  chemically synthesized
catccaccctataataccac

SEQ ID NO: 23034 - DNA, 20 bp, Artificial Sequence
  chemically synthesized
caccctataataccaccagt

SEQ ID NO: 23035 - DNA, 20 bp, Artificial Sequence
  chemically synthesized
accctataataccaccagtc

SEQ ID NO: 23036 - DNA, 20 bp, Artificial Sequence
  chemically synthesized
taataccaccagtcaggatg

SEQ ID NO: 23037 - DNA, 20 bp, Artificial Sequence
  chemically synthesized
ataccaccagtcaggatgaa

SEQ ID NO: 23038 - DNA, 20 bp, Artificial Sequence
  chemically synthesized
aggatgaagagcaccatgaa

SEQ ID NO: 23039 - DNA, 20 bp, Artificial Sequence
  chemically synthesized
caccatgaaaagtgacctat

SEQ ID NO: 23040 - DNA, 20 bp, Artificial Sequence
  chemically synthesized
gaaaagtgacctataagttt

SEQ ID NO: 23041 - DNA, 20 bp, Artificial Sequence
  chemically synthesized
aaaagtgacctataagtttc

SEQ ID NO: 23042 - DNA, 20 bp, Artificial Sequence
  chemically synthesized
ctataagtttcaggccatta

SEQ ID NO: 23043 - DNA, 20 bp, Artificial Sequence
  chemically synthesized
attacagcactattcaaata

SEQ ID NO: 23044 - DNA, 20 bp, Artificial Sequence
  chemically synthesized
ttcattttgtttttattttc

SEQ ID NO: 23045 - DNA, 20 bp, Artificial Sequence
  chemically synthesized
tcattttgtttttattttct

SEQ ID NO: 23046 - DNA, 20 bp, Artificial Sequence
  chemically synthesized
caatgtttattctgcatgaa

SEQ ID NO: 23047 - DNA, 20 bp, Artificial Sequence
  chemically synthesized
gaatagctgtatccccaacg

SEQ ID NO: 23048 - DNA, 20 bp, Artificial Sequence
  chemically synthesized
tagtatccaataatcttaca

SEQ ID NO: 23049 - DNA, 20 bp, Artificial Sequence
  chemically synthesized
gtatccaataatcttacata

SEQ ID NO: 23050 - DNA, 20 bp, Artificial Sequence
  chemically synthesized
acattctattttcccatacc

SEQ ID NO: 23051 - DNA, 20 bp, Artificial Sequence
  chemically synthesized
cattctattttcccatacct

SEQ ID NO: 23052 - DNA, 20 bp, Artificial Sequence
  chemically synthesized
ttcccatacctaggatctcc

SEQ ID NO: 23053 - DNA, 20 bp, Artificial Sequence
  chemically synthesized
tcccatacctaggatctccc

SEQ ID NO: 23054 - DNA, 20 bp, Artificial Sequence
  chemically synthesized
atcatccttgctgtcactga

SEQ ID NO: 23055 - DNA, 20 bp, Artificial Sequence
  chemically synthesized
tccttgctgtcactgaaagt

SEQ ID NO: 23056 - DNA, 20 bp, Artificial Sequence
  chemically synthesized
ccttgctgtcactgaaagtc

SEQ ID NO: 23057 - DNA, 20 bp, Artificial Sequence
  chemically synthesized
ctgtcactgaaagtcaggac

SEQ ID NO: 23058 - DNA, 20 bp, Artificial Sequence
  chemically synthesized
actggtgaacatcttatgaa

SEQ ID NO: 23059 - DNA, 20 bp, Artificial Sequence
  chemically synthesized
ctggtgaacatcttatgaac

SEQ ID NO: 23060 - DNA, 20 bp, Artificial Sequence
  chemically synthesized
gtgaacatcttatgaacagg

SEQ ID NO: 23061 - DNA, 20 bp, Artificial Sequence
  chemically synthesized
tatgaacaggtagaattctc

SEQ ID NO: 23062 - DNA, 20 bp, Artificial Sequence
  chemically synthesized
atgaacaggtagaattctca

SEQ ID NO: 23063 - DNA, 20 bp, Artificial Sequence
  chemically synthesized
gaacaggtagaattctcaag

SEQ ID NO: 23064 - DNA, 20 bp, Artificial Sequence
  chemically synthesized
ctgattactattgctttacc

SEQ ID NO: 23065 - DNA, 20 bp, Artificial Sequence
  chemically synthesized
gattactattgctttacctg

SEQ ID NO: 23066 - DNA, 20 bp, Artificial Sequence
  chemically synthesized
taaatatttgcctctttgca

SEQ ID NO: 23067 - DNA, 20 bp, Artificial Sequence
  chemically synthesized
tatttgcctctttgcaaagc

SEQ ID NO: 23068 - DNA, 20 bp, Artificial Sequence
  chemically synthesized
cctctttgcaaagctggcaa

SEQ ID NO: 23069 - DNA, 20 bp, Artificial Sequence
  chemically synthesized
ctctttgcaaagctggcaat

SEQ ID NO: 23070 - DNA, 20 bp, Artificial Sequence
  chemically synthesized
tctttgcaaagctggcaatg

SEQ ID NO: 23071 - DNA, 20 bp, Artificial Sequence
  chemically synthesized
agctggcaatggggctcaat

SEQ ID NO: 23072 - DNA, 20 bp, Artificial Sequence
  chemically synthesized
ataagtctgcttccaccttc

SEQ ID NO: 23073 - DNA, 20 bp, Artificial Sequence
  chemically synthesized
gcttccaccttccagcttac

SEQ ID NO: 23074 - DNA, 20 bp, Artificial Sequence
  chemically synthesized
cttccagcttactggcttcc

SEQ ID NO: 23075 - DNA, 20 bp, Artificial Sequence
  chemically synthesized
ttccagcttactggcttccc

SEQ ID NO: 23076 - DNA, 20 bp, Artificial Sequence
  chemically synthesized
gcttactggcttcccaggca

SEQ ID NO: 23077 - DNA, 20 bp, Artificial Sequence
  chemically synthesized
ttactggcttcccaggcatg

SEQ ID NO: 23078 - DNA, 20 bp, Artificial Sequence
  chemically synthesized
ctggcttcccaggcatggag

SEQ ID NO: 23079 - DNA, 20 bp, Artificial Sequence
  chemically synthesized
tggcttcccaggcatggaga

SEQ ID NO: 23080 - DNA, 20 bp, Artificial Sequence
  chemically synthesized
gcatggagaaggcacatcac

SEQ ID NO: 23081 - DNA, 20 bp, Artificial Sequence
  chemically synthesized
ctggatattcatcccattat

SEQ ID NO: 23082 - DNA, 20 bp, Artificial Sequence
  chemically synthesized
gatattcatcccattattgg

SEQ ID NO: 23083 - DNA, 20 bp, Artificial Sequence
  chemically synthesized
gcctacatctccatacttct

SEQ ID NO: 23084 - DNA, 20 bp, Artificial Sequence
  chemically synthesized
atctccatacttcttggcaa

SEQ ID NO: 23085 - DNA, 20 bp, Artificial Sequence
  chemically synthesized
ggcactcttctctttctcat

SEQ ID NO: 23086 - DNA, 20 bp, Artificial Sequence
  chemically synthesized
gcactcttctctttctcatc

SEQ ID NO: 23087 - DNA, 20 bp, Artificial Sequence
  chemically synthesized
ggaatgatcataacctccat

SEQ ID NO: 23088 - DNA, 20 bp, Artificial Sequence
  chemically synthesized
tgagcccatgtactatttct

SEQ ID NO: 23089 - DNA, 20 bp, Artificial Sequence
  chemically synthesized
gtactatttcttagctatgt

SEQ ID NO: 23090 - DNA, 20 bp, Artificial Sequence
  chemically synthesized
ctatttcttagctatgttgg

SEQ ID NO: 23091 - DNA, 20 bp, Artificial Sequence
  chemically synthesized
cttagctatgttggcagcta

SEQ ID NO: 23092 - DNA, 20 bp, Artificial Sequence
  chemically synthesized
atgttggcagctacagacct

SEQ ID NO: 23093 - DNA, 20 bp, Artificial Sequence
  chemically synthesized
gttggcagctacagacctcg

SEQ ID NO: 23094 - DNA, 20 bp, Artificial Sequence
  chemically synthesized
gacattgaccacaatgccca

SEQ ID NO: 23095 - DNA, 20 bp, Artificial Sequence
  chemically synthesized
gaccacaatgcccacagtgc

SEQ ID NO: 23096 - DNA, 20 bp, Artificial Sequence
  chemically synthesized
accacaatgcccacagtgct

SEQ ID NO: 23097 - DNA, 20 bp, Artificial Sequence
  chemically synthesized
ccacagtgctaggtgttctg

SEQ ID NO: 23098 - DNA, 20 bp, Artificial Sequence
  chemically synthesized
agtgctaggtgttctgtggt

SEQ ID NO: 23099 - DNA, 20 bp, Artificial Sequence
  chemically synthesized
ggtgttctgtggttagatca

SEQ ID NO: 23100 - DNA, 20 bp, Artificial Sequence
  chemically synthesized
gtgttctgtggttagatcac

SEQ ID NO: 23101 - DNA, 20 bp, Artificial Sequence
  chemically synthesized
tgttctgtggttagatcaca

SEQ ID NO: 23102 - DNA, 20 bp, Artificial Sequence
  chemically synthesized
ttctgtggttagatcacagg

SEQ ID NO: 23103 - DNA, 20 bp, Artificial Sequence
  chemically synthesized
tggttagatcacagggagat

SEQ ID NO: 23104 - DNA, 20 bp, Artificial Sequence
  chemically synthesized
gatcacagggagattggcca

SEQ ID NO: 23105 - DNA, 20 bp, Artificial Sequence
  chemically synthesized
tcacagggagattggccatg

SEQ ID NO: 23106 - DNA, 20 bp, Artificial Sequence
  chemically synthesized
gccatggagcctgcttctct

SEQ ID NO: 23107 - DNA, 20 bp, Artificial Sequence
  chemically synthesized
ccatggagcctgcttctctc

SEQ ID NO: 23108 - DNA, 20 bp, Artificial Sequence
  chemically synthesized
tatccatactctttctgtca

SEQ ID NO: 23109 - DNA, 20 bp, Artificial Sequence
  chemically synthesized
tccatactctttctgtcatg

SEQ ID NO: 23110 - DNA, 20 bp, Artificial Sequence
  chemically synthesized
tactctttctgtcatggagt

SEQ ID NO: 23111 - DNA, 20 bp, Artificial Sequence
  chemically synthesized
actctttctgtcatggagtc

SEQ ID NO: 23112 - DNA, 20 bp, Artificial Sequence
  chemically synthesized
gtcaggtgtcttgcttgcca

SEQ ID NO: 23113 - DNA, 20 bp, Artificial Sequence
  chemically synthesized
gactgtttcattaccatccg

SEQ ID NO: 23114 - DNA, 20 bp, Artificial Sequence
  chemically synthesized
attaccatccgcagcccctt

SEQ ID NO: 23115 - DNA, 20 bp, Artificial Sequence
  chemically synthesized
cctctatcctgaccaacacc

SEQ ID NO: 23116 - DNA, 20 bp, Artificial Sequence
  chemically synthesized
ctctatcctgaccaacaccc

SEQ ID NO: 23117 - DNA, 20 bp, Artificial Sequence
  chemically synthesized
tgaccaacacccaggtaatg

SEQ ID NO: 23118 - DNA, 20 bp, Artificial Sequence
  chemically synthesized
aacacccaggtaatgaagat

SEQ ID NO: 23119 - DNA, 20 bp, Artificial Sequence
  chemically synthesized
aggtaatgaagattggtgtg

SEQ ID NO: 23120 - DNA, 20 bp, Artificial Sequence
  chemically synthesized
ggtaatgaagattggtgtgc

SEQ ID NO: 23121 - DNA, 20 bp, Artificial Sequence
  chemically synthesized
attggtgtgcgggtattgac

SEQ ID NO: 23122 - DNA, 20 bp, Artificial Sequence
  chemically synthesized
ttggtgtgcgggtattgaca

SEQ ID NO: 23123 - DNA, 20 bp, Artificial Sequence
  chemically synthesized
tggtgtgcgggtattgacaa

SEQ ID NO: 23124 - DNA, 20 bp, Artificial Sequence
  chemically synthesized
gtgcgggtattgacaagggc

SEQ ID NO: 23125 - DNA, 20 bp, Artificial Sequence
  chemically synthesized
tggtctgtccattatgccaa

SEQ ID NO: 23126 - DNA, 20 bp, Artificial Sequence
  chemically synthesized
caatagttgttcgcctacac

SEQ ID NO: 23127 - DNA, 20 bp, Artificial Sequence
  chemically synthesized
ccatgctttctgtctacacc

SEQ ID NO: 23128 - DNA, 20 bp, Artificial Sequence
  chemically synthesized
gtctacaccaagatgtcatc

SEQ ID NO: 23129 - DNA, 20 bp, Artificial Sequence
  chemically synthesized
acaccaagatgtcatcaagc

SEQ ID NO: 23130 - DNA, 20 bp, Artificial Sequence
  chemically synthesized
caccttcaaccgtctctatc

SEQ ID NO: 23131 - DNA, 20 bp, Artificial Sequence
  chemically synthesized
caaccgtctctatccagttg

SEQ ID NO: 23132 - DNA, 20 bp, Artificial Sequence
  chemically synthesized
agttgtagttttatttgcaa

SEQ ID NO: 23133 - DNA, 20 bp, Artificial Sequence
  chemically synthesized
tttatttgcaatggtcttgt

SEQ ID NO: 23134 - DNA, 20 bp, Artificial Sequence
  chemically synthesized
tctcctacattttgattctc

SEQ ID NO: 23135 - DNA, 20 bp, Artificial Sequence
  chemically synthesized
tttgattctcaagactgtca

SEQ ID NO: 23136 - DNA, 20 bp, Artificial Sequence
  chemically synthesized
ttgattctcaagactgtcat

SEQ ID NO: 23137 - DNA, 20 bp, Artificial Sequence
  chemically synthesized
ctcaagactgtcatgggcat

SEQ ID NO: 23138 - DNA, 20 bp, Artificial Sequence
  chemically synthesized
actgtcatgggcattggttc

SEQ ID NO: 23139 - DNA, 20 bp, Artificial Sequence
  chemically synthesized
tgtcatgggcattggttctg

SEQ ID NO: 23140 - DNA, 20 bp, Artificial Sequence
  chemically synthesized
gtcatgggcattggttctgg

SEQ ID NO: 23141 - DNA, 20 bp, Artificial Sequence
  chemically synthesized
catgggcattggttctggag

SEQ ID NO: 23142 - DNA, 20 bp, Artificial Sequence
  chemically synthesized
ggcattggttctggaggaga

SEQ ID NO: 23143 - DNA, 20 bp, Artificial Sequence
  chemically synthesized
gcattggttctggaggagaa

SEQ ID NO: 23144 - DNA, 20 bp, Artificial Sequence
  chemically synthesized
cattggttctggaggagaaa

SEQ ID NO: 23145 - DNA, 20 bp, Artificial Sequence
  chemically synthesized
gttctggaggagaaagggcc

SEQ ID NO: 23146 - DNA, 20 bp, Artificial Sequence
  chemically synthesized
ttctggaggagaaagggcca

SEQ ID NO: 23147 - DNA, 20 bp, Artificial Sequence
  chemically synthesized
ctctcatatctgctgcatcc

SEQ ID NO: 23148 - DNA, 20 bp, Artificial Sequence
  chemically synthesized
cctggtcttctatgtcactg

SEQ ID NO: 23149 - DNA, 20 bp, Artificial Sequence
  chemically synthesized
gtttgtctgacatttattca

SEQ ID NO: 23150 - DNA, 20 bp, Artificial Sequence
  chemically synthesized
tttgtctgacatttattcat

SEQ ID NO: 23151 - DNA, 20 bp, Artificial Sequence
  chemically synthesized
ctgacatttattcataggtt

SEQ ID NO: 23152 - DNA, 20 bp, Artificial Sequence
  chemically synthesized
catttattcataggtttgga

SEQ ID NO: 23153 - DNA, 20 bp, Artificial Sequence
  chemically synthesized
catgtcgttcacatcacaat

SEQ ID NO: 23154 - DNA, 20 bp, Artificial Sequence
  chemically synthesized
tttatgaacccatttatcta

SEQ ID NO: 23155 - DNA, 20 bp, Artificial Sequence
  chemically synthesized
ttatctatagcattaaaact

SEQ ID NO: 23156 - DNA, 20 bp, Artificial Sequence
  chemically synthesized
tctatagcattaaaactaag

SEQ ID NO: 23157 - DNA, 20 bp, Artificial Sequence
  chemically synthesized
gcattaaaactaagcagatt

SEQ ID NO: 23158 - DNA, 20 bp, Artificial Sequence
  chemically synthesized
attaaaactaagcagattca

SEQ ID NO: 23159 - DNA, 20 bp, Artificial Sequence
  chemically synthesized
aaaactaagcagattcagag

SEQ ID NO: 23160 - DNA, 20 bp, Artificial Sequence
  chemically synthesized
ttattctctctgcctcactc

SEQ ID NO: 23161 - DNA, 20 bp, Artificial Sequence
  chemically synthesized
attctctctgcctcactcta

SEQ ID NO: 23162 - DNA, 20 bp, Artificial Sequence
  chemically synthesized
agagcatgacattgtttcac

SEQ ID NO: 23163 - DNA, 20 bp, Artificial Sequence
  chemically synthesized
acattgtttcactggtctct

SEQ ID NO: 23164 - DNA, 20 bp, Artificial Sequence
  chemically synthesized
cattgtttcactggtctctg

SEQ ID NO: 23165 - DNA, 20 bp, Artificial Sequence
  chemically synthesized
ctggtctctgaggaataatt

SEQ ID NO: 23166 - DNA, 20 bp, Artificial Sequence
  chemically synthesized
tggtctctgaggaataattc

SEQ ID NO: 23167 - DNA, 20 bp, Artificial Sequence
  chemically synthesized
ggtctctgaggaataattca

SEQ ID NO: 23168 - DNA, 20 bp, Artificial Sequence
  chemically synthesized
gtctctgaggaataattcag

SEQ ID NO: 23169 - DNA, 20 bp, Artificial Sequence
  chemically synthesized
gaggaataattcaggggacc

SEQ ID NO: 23170 - DNA, 20 bp, Artificial Sequence
  chemically synthesized
aataattcaggggacctgga

SEQ ID NO: 23171 - DNA, 20 bp, Artificial Sequence
  chemically synthesized
ataattcaggggacctggac

SEQ ID NO: 23172 - DNA, 20 bp, Artificial Sequence
  chemically synthesized
ggacaggatgacaatgttgc

SEQ ID NO: 23173 - DNA, 20 bp, Artificial Sequence
  chemically synthesized
gatgacaatgttgccagcat

SEQ ID NO: 23174 - DNA, 20 bp, Artificial Sequence
  chemically synthesized
atgttgccagcataagtaac

SEQ ID NO: 23175 - DNA, 20 bp, Artificial Sequence
  chemically synthesized
tgttgccagcataagtaact

SEQ ID NO: 23176 - DNA, 20 bp, Artificial Sequence
  chemically synthesized
gttgccagcataagtaacta

SEQ ID NO: 23177 - DNA, 20 bp, Artificial Sequence
  chemically synthesized
ccagcataagtaactaggga

SEQ ID NO: 23178 - DNA, 20 bp, Artificial Sequence
  chemically synthesized
ctagggaaagtcatttcaat

SEQ ID NO: 23179 - DNA, 20 bp, Artificial Sequence
  chemically synthesized
atgagaactaatcaatccct

SEQ ID NO: 23180 - DNA, 20 bp, Artificial Sequence
  chemically synthesized
taatcaatccctgagcattt

SEQ ID NO: 23181 - DNA, 20 bp, Artificial Sequence
  chemically synthesized
tcaatccctgagcatttcag

SEQ ID NO: 23182 - DNA, 20 bp, Artificial Sequence
  chemically synthesized
ctgagcatttcagtggaaat

SEQ ID NO: 23183 - DNA, 20 bp, Artificial Sequence
  chemically synthesized
cagtcaatccctctgctact

SEQ ID NO: 23184 - DNA, 20 bp, Artificial Sequence
  chemically synthesized
tgtctattgctgatttgtat

SEQ ID NO: 23185 - DNA, 20 bp, Artificial Sequence
  chemically synthesized
taagatatatgtacaacact

SEQ ID NO: 23186 - DNA, 20 bp, Artificial Sequence
  chemically synthesized
acaacactaagtacatatct

SEQ ID NO: 23187 - DNA, 20 bp, Artificial Sequence
  chemically synthesized
ctcaactgatattgttttct

SEQ ID NO: 23188 - DNA, 20 bp, Artificial Sequence
  chemically synthesized
tcaactgatattgttttctc

SEQ ID NO: 23189 - DNA, 20 bp, Artificial Sequence
  chemically synthesized
tttaactcacattgtttgat

SEQ ID NO: 23190 - DNA, 20 bp, Artificial Sequence
  chemically synthesized
cacattgtttgattagctta

SEQ ID NO: 23191 - DNA, 20 bp, Artificial Sequence
  chemically synthesized
ttgtttgattagcttatggc

SEQ ID NO: 23192 - DNA, 20 bp, Artificial Sequence
  chemically synthesized
cacacatacatatacacaca

SEQ ID NO: 23193 - DNA, 20 bp, Artificial Sequence
  chemically synthesized
tatatatacttaatatataa

SEQ ID NO: 23194 - DNA, 20 bp, Artificial Sequence
  chemically synthesized
ccaattatatatataattct

SEQ ID NO: 23195 - DNA, 20 bp, Artificial Sequence
  chemically synthesized
caattatatatataattctt

SEQ ID NO: 23196 - DNA, 20 bp, Artificial Sequence
  chemically synthesized
taattcttgggtctatgatt

SEQ ID NO: 23197 - DNA, 20 bp, Artificial Sequence
  chemically synthesized
aattcttgggtctatgattt

SEQ ID NO: 23198 - DNA, 20 bp, Artificial Sequence
  chemically synthesized
gggtctatgatttgggtcac

SEQ ID NO: 23199 - DNA, 20 bp, Artificial Sequence
  chemically synthesized
gatttgggtcaccggcattt

SEQ ID NO: 23200 - DNA, 20 bp, Artificial Sequence
  chemically synthesized
aatgcccattgctctccata

SEQ ID NO: 23201 - DNA, 20 bp, Artificial Sequence
  chemically synthesized
tccatatggcttgcatatat

SEQ ID NO: 23202 - DNA, 20 bp, Artificial Sequence
  chemically synthesized
tatattagtcctgttataca

SEQ ID NO: 23203 - DNA, 20 bp, Artificial Sequence
  chemically synthesized
atattagtcctgttatacat

SEQ ID NO: 23204 - DNA, 20 bp, Artificial Sequence
  chemically synthesized
gtcctgttatacataggaat

SEQ ID NO: 23205 - DNA, 20 bp, Artificial Sequence
  chemically synthesized
tcctgttatacataggaata

SEQ ID NO: 23206 - DNA, 20 bp, Artificial Sequence
  chemically synthesized
acataggaataaggcatttt

SEQ ID NO: 23207 - DNA, 20 bp, Artificial Sequence
  chemically synthesized
gaataaggcatttttggctt

SEQ ID NO: 23208 - DNA, 20 bp, Artificial Sequence
  chemically synthesized
tttggcttcagacatacatc

SEQ ID NO: 23209 - DNA, 20 bp, Artificial Sequence
  chemically synthesized
atccagttctcttgcatata

SEQ ID NO: 23210 - DNA, 20 bp, Artificial Sequence
  chemically synthesized
ccagttctcttgcatatatg

SEQ ID NO: 23211 - DNA, 20 bp, Artificial Sequence
  chemically synthesized
ttctcttgcatatatggagc

SEQ ID NO: 23212 - DNA, 20 bp, Artificial Sequence
  chemically synthesized
atggagctggctgctgtttc

SEQ ID NO: 23213 - DNA, 20 bp, Artificial Sequence
  chemically synthesized
tttctagaaaattgcacgtg

SEQ ID NO: 23214 - DNA, 20 bp, Artificial Sequence
  chemically synthesized
aaaattgcacgtgaagaaat

SEQ ID NO: 23215 - DNA, 20 bp, Artificial Sequence
  chemically synthesized
gaaatgagactttcttcaat

SEQ ID NO: 23216 - DNA, 20 bp, Artificial Sequence
  chemically synthesized
aatgagactttcttcaatga

SEQ ID NO: 23217 - DNA, 20 bp, Artificial Sequence
  chemically synthesized
agactttcttcaatgagagt

SEQ ID NO: 23218 - DNA, 20 bp, Artificial Sequence
  chemically synthesized
cctcaattactttcttcaat

SEQ ID NO: 23219 - DNA, 20 bp, Artificial Sequence
  chemically synthesized
ctcaattactttcttcaatg

SEQ ID NO: 23220 - DNA, 20 bp, Artificial Sequence
  chemically synthesized
tcaattactttcttcaatga

SEQ ID NO: 23221 - DNA, 20 bp, Artificial Sequence
  chemically synthesized
ttccctcaattcaaaatgat

SEQ ID NO: 23222 - DNA, 20 bp, Artificial Sequence
  chemically synthesized
tcaattcaaaatgatgagtc

SEQ ID NO: 23223 - DNA, 20 bp, Artificial Sequence
  chemically synthesized
caattcaaaatgatgagtct

SEQ ID NO: 23224 - DNA, 20 bp, Artificial Sequence
  chemically synthesized
aattcaaaatgatgagtcta

SEQ ID NO: 23225 - DNA, 20 bp, Artificial Sequence
  chemically synthesized
caaaatgatgagtctaggga

SEQ ID NO: 23226 - DNA, 20 bp, Artificial Sequence
  chemically synthesized
tctagggaaagtatctctat

SEQ ID NO: 23227 - DNA, 20 bp, Artificial Sequence
  chemically synthesized
atctctatgagaaatgtgtt

SEQ ID NO: 23228 - DNA, 20 bp, Artificial Sequence
  chemically synthesized
aatgtgttcagttaaaactt

SEQ ID NO: 23229 - DNA, 20 bp, Artificial Sequence
  chemically synthesized
tattgataataatttgaaaa

SEQ ID NO: 23230 - DNA, 20 bp, Artificial Sequence
  chemically synthesized
ttgataataatttgaaaaca

SEQ ID NO: 23231 - DNA, 20 bp, Artificial Sequence
  chemically synthesized
cagagatataatttctaatt

SEQ ID NO: 23232 - DNA, 20 bp, Artificial Sequence
  chemically synthesized
tcagatgaccattgtcttga

SEQ ID NO: 23233 - DNA, 20 bp, Artificial Sequence
  chemically synthesized
attgtcttgatagttaattc

SEQ ID NO: 23234 - DNA, 20 bp, Artificial Sequence
  chemically synthesized
taattccagttactactgaa

SEQ ID NO: 23235 - DNA, 20 bp, Artificial Sequence
  chemically synthesized
attccagttactactgaaca

SEQ ID NO: 23236 - DNA, 20 bp, Artificial Sequence
  chemically synthesized
tccagttactactgaacaga

SEQ ID NO: 23237 - DNA, 20 bp, Artificial Sequence
  chemically synthesized
cagagagatgcattttcata

SEQ ID NO: 23238 - DNA, 20 bp, Artificial Sequence
  chemically synthesized
agagatgcattttcataaag

SEQ ID NO: 23239 - DNA, 20 bp, Artificial Sequence
  chemically synthesized
gcattttcataaagtggtat

SEQ ID NO: 23240 - DNA, 20 bp, Artificial Sequence
  chemically synthesized
attttcataaagtggtatga

SEQ ID NO: 23241 - DNA, 20 bp, Artificial Sequence
  chemically synthesized
ttttcataaagtggtatgag

SEQ ID NO: 23242 - DNA, 20 bp, Artificial Sequence
  chemically synthesized
ataaagtggtatgagaggtc

SEQ ID NO: 23243 - DNA, 20 bp, Artificial Sequence
  chemically synthesized
gtggtatgagaggtctggtt

SEQ ID NO: 23244 - DNA, 20 bp, Artificial Sequence
  chemically synthesized
tggtatgagaggtctggttt

SEQ ID NO: 23245 - DNA, 20 bp, Artificial Sequence
  chemically synthesized
ggtatgagaggtctggttta

SEQ ID NO: 23246 - DNA, 20 bp, Artificial Sequence
  chemically synthesized
gtatgagaggtctggtttag

SEQ ID NO: 23247 - DNA, 20 bp, Artificial Sequence
  chemically synthesized
ggtctggtttaggggaacat

SEQ ID NO: 23248 - DNA, 20 bp, Artificial Sequence
  chemically synthesized
tctggtttaggggaacatca

SEQ ID NO: 23249 - DNA, 20 bp, Artificial Sequence
  chemically synthesized
tttaggggaacatcagagat

SEQ ID NO: 23250 - DNA, 20 bp, Artificial Sequence
  chemically synthesized
gggaacatcagagataagac

SEQ ID NO: 23251 - DNA, 20 bp, Artificial Sequence
  chemically synthesized
acatcagagataagactaga

SEQ ID NO: 23252 - DNA, 20 bp, Artificial Sequence
  chemically synthesized
catcagagataagactagat

SEQ ID NO: 23253 - DNA, 20 bp, Artificial Sequence
  chemically synthesized
atcagagataagactagata

SEQ ID NO: 23254 - DNA, 20 bp, Artificial Sequence
  chemically synthesized
tcagagataagactagatag

SEQ ID NO: 23255 - DNA, 20 bp, Artificial Sequence
  chemically synthesized
taagactagataggggtgtc

SEQ ID NO: 23256 - DNA, 20 bp, Artificial Sequence
  chemically synthesized
ggtgtctggcatgtgcaaaa

SEQ ID NO: 23257 - DNA, 20 bp, Artificial Sequence
  chemically synthesized
gtctggcatgtgcaaaatag

SEQ ID NO: 23258 - DNA, 20 bp, Artificial Sequence
  chemically synthesized
ctggcatgtgcaaaatagca

SEQ ID NO: 23259 - DNA, 20 bp, Artificial Sequence
  chemically synthesized
tagcagagttgaaaaacaaa

SEQ ID NO: 23260 - DNA, 20 bp, Artificial Sequence
  chemically synthesized
agagttgaaaaacaaacagt

SEQ ID NO: 23261 - DNA, 20 bp, Artificial Sequence
  chemically synthesized
aacaaacagttggtcatatg

SEQ ID NO: 23262 - DNA, 20 bp, Artificial Sequence
  chemically synthesized
caaacagttggtcatatgtg

SEQ ID NO: 23263 - DNA, 20 bp, Artificial Sequence
  chemically synthesized
aacagttggtcatatgtgga

SEQ ID NO: 23264 - DNA, 20 bp, Artificial Sequence
  chemically synthesized
agttggtcatatgtggagag

SEQ ID NO: 23265 - DNA, 20 bp, Artificial Sequence
  chemically synthesized
gttggtcatatgtggagagt

SEQ ID NO: 23266 - DNA, 20 bp, Artificial Sequence
  chemically synthesized
ttggtcatatgtggagagtg

SEQ ID NO: 23267 - DNA, 20 bp, Artificial Sequence
  chemically synthesized
ggtcatatgtggagagtggg

SEQ ID NO: 23268 - DNA, 20 bp, Artificial Sequence
  chemically synthesized
gtcatatgtggagagtgggg

SEQ ID NO: 23269 - DNA, 20 bp, Artificial Sequence
  chemically synthesized
atatgtggagagtggggagg

SEQ ID NO: 23270 - DNA, 20 bp, Artificial Sequence
  chemically synthesized
tatgtggagagtggggagga

SEQ ID NO: 23271 - DNA, 20 bp, Artificial Sequence
  chemically synthesized
atgtggagagtggggaggaa

SEQ ID NO: 23272 - DNA, 20 bp, Artificial Sequence
  chemically synthesized
gtggagagtggggaggaagg

SEQ ID NO: 23273 - DNA, 20 bp, Artificial Sequence
  chemically synthesized
ggagagtggggaggaaggga

SEQ ID NO: 23274 - DNA, 20 bp, Artificial Sequence
  chemically synthesized
gagagtggggaggaagggag

SEQ ID NO: 23275 - DNA, 20 bp, Artificial Sequence
  chemically synthesized
gtggggaggaagggagagga

SEQ ID NO: 23276 - DNA, 20 bp, Artificial Sequence
  chemically synthesized
ggggaggaagggagaggatg

SEQ ID NO: 23277 - DNA, 20 bp, Artificial Sequence
  chemically synthesized
gggaggaagggagaggatgg

SEQ ID NO: 23278 - DNA, 20 bp, Artificial Sequence
  chemically synthesized
atggaggcaatgctcataac

SEQ ID NO: 23279 - DNA, 20 bp, Artificial Sequence
  chemically synthesized
gaggcaatgctcataactag

SEQ ID NO: 23280 - DNA, 20 bp, Artificial Sequence
  chemically synthesized
ctcataactagaagataaaa

SEQ ID NO: 23281 - DNA, 20 bp, Artificial Sequence
  chemically synthesized
gaagataaaatggccttttc

SEQ ID NO: 23282 - DNA, 20 bp, Artificial Sequence
  chemically synthesized
caaatacttttgattctttt

SEQ ID NO: 23283 - DNA, 20 bp, Artificial Sequence
  chemically synthesized
aatacttttgattcttttca

SEQ ID NO: 23284 - DNA, 20 bp, Artificial Sequence
  chemically synthesized
ttttgattcttttcagagtc

SEQ ID NO: 23285 - DNA, 20 bp, Artificial Sequence
  chemically synthesized
tttgattcttttcagagtct

SEQ ID NO: 23286 - DNA, 20 bp, Artificial Sequence
  chemically synthesized
tcttttcagagtctaggcat

SEQ ID NO: 23287 - DNA, 20 bp, Artificial Sequence
  chemically synthesized
tttcagagtctaggcatgag

SEQ ID NO: 23288 - DNA, 20 bp, Artificial Sequence
  chemically synthesized
tcagagtctaggcatgagaa

SEQ ID NO: 23289 - DNA, 20 bp, Artificial Sequence
  chemically synthesized
cagagtctaggcatgagaag

SEQ ID NO: 23290 - DNA, 20 bp, Artificial Sequence
  chemically synthesized
agagtctaggcatgagaaga

SEQ ID NO: 23291 - DNA, 20 bp, Artificial Sequence
  chemically synthesized
gagtctaggcatgagaagag

SEQ ID NO: 23292 - DNA, 20 bp, Artificial Sequence
  chemically synthesized
agtctaggcatgagaagagg

SEQ ID NO: 23293 - DNA, 20 bp, Artificial Sequence
  chemically synthesized
gcatgagaagagggggtttg

SEQ ID NO: 23294 - DNA, 20 bp, Artificial Sequence
  chemically synthesized
agagggggtttgtggtccta

SEQ ID NO: 23295 - DNA, 20 bp, Artificial Sequence
  chemically synthesized
ggggtttgtggtcctatggc

SEQ ID NO: 23296 - DNA, 20 bp, Artificial Sequence
  chemically synthesized
gggtttgtggtcctatggcc

SEQ ID NO: 23297 - DNA, 20 bp, Artificial Sequence
  chemically synthesized
tgtggtcctatggccaggtg

SEQ ID NO: 23298 - DNA, 20 bp, Artificial Sequence
  chemically synthesized
tggtcctatggccaggtgaa

SEQ ID NO: 23299 - DNA, 20 bp, Artificial Sequence
  chemically synthesized
cctatggccaggtgaagagc

SEQ ID NO: 23300 - DNA, 20 bp, Artificial Sequence
  chemically synthesized
gtatccatgactcaaatgat

SEQ ID NO: 23301 - DNA, 20 bp, Artificial Sequence
  chemically synthesized
aagttttaaattaattttaa

SEQ ID NO: 23302 - DNA, 20 bp, Artificial Sequence
  chemically synthesized
tttaaattaattttaaaaga

SEQ ID NO: 23303 - DNA, 20 bp, Artificial Sequence
  chemically synthesized
atattcttttgaccaaaata

SEQ ID NO: 23304 - DNA, 20 bp, Artificial Sequence
  chemically synthesized
tattcttttgaccaaaatac

SEQ ID NO: 23305 - DNA, 20 bp, Artificial Sequence
  chemically synthesized
attcttttgaccaaaataca

SEQ ID NO: 23306 - DNA, 20 bp, Artificial Sequence
  chemically synthesized
aatacagggtatgatgtgct

SEQ ID NO: 23307 - DNA, 20 bp, Artificial Sequence
  chemically synthesized
atgatgtgcttggactacac

SEQ ID NO: 23308 - DNA, 20 bp, Artificial Sequence
  chemically synthesized
tgatgtgcttggactacaca

SEQ ID NO: 23309 - DNA, 20 bp, Artificial Sequence
  chemically synthesized
gatgtgcttggactacacaa

SEQ ID NO: 23310 - DNA, 20 bp, Artificial Sequence
  chemically synthesized
atgtgcttggactacacaag

SEQ ID NO: 23311 - DNA, 20 bp, Artificial Sequence
  chemically synthesized
ggactacacaaggggccacc

SEQ ID NO: 23312 - DNA, 20 bp, Artificial Sequence
  chemically synthesized
acaaggggccacccagtgac

SEQ ID NO: 23313 - DNA, 20 bp, Artificial Sequence
  chemically synthesized
ggggccacccagtgaccagt

SEQ ID NO: 23314 - DNA, 20 bp, Artificial Sequence
  chemically synthesized
ccacccagtgaccagtcagc

SEQ ID NO: 23315 - DNA, 20 bp, Artificial Sequence
  chemically synthesized
agctggatgcccctcatctc

SEQ ID NO: 23316 - DNA, 20 bp, Artificial Sequence
  chemically synthesized
gcctctgtcatactgacact

SEQ ID NO: 23317 - DNA, 20 bp, Artificial Sequence
  chemically synthesized
tactgacactcagtgatcta

SEQ ID NO: 23318 - DNA, 20 bp, Artificial Sequence
  chemically synthesized
tgcccacctactcttcatca

SEQ ID NO: 23319 - DNA, 20 bp, Artificial Sequence
  chemically synthesized
cacctactcttcatcacaga

SEQ ID NO: 23320 - DNA, 20 bp, Artificial Sequence
  chemically synthesized
acctactcttcatcacagaa

SEQ ID NO: 23321 - DNA, 20 bp, Artificial Sequence
  chemically synthesized
tactcttcatcacagaaagg

SEQ ID NO: 23322 - DNA, 20 bp, Artificial Sequence
  chemically synthesized
actcttcatcacagaaaggt

SEQ ID NO: 23323 - DNA, 20 bp, Artificial Sequence
  chemically synthesized
ctcttcatcacagaaaggtg

SEQ ID NO: 23324 - DNA, 20 bp, Artificial Sequence
  chemically synthesized
acagaaaggtggggattttt

SEQ ID NO: 23325 - DNA, 20 bp, Artificial Sequence
  chemically synthesized
cagaaaggtggggatttttt

SEQ ID NO: 23326 - DNA, 20 bp, Artificial Sequence
  chemically synthesized
tggggattttttaggattct

SEQ ID NO: 23327 - DNA, 20 bp, Artificial Sequence
  chemically synthesized
ggggattttttaggattctt

SEQ ID NO: 23328 - DNA, 20 bp, Artificial Sequence
  chemically synthesized
cttgggatgtataaataaca

SEQ ID NO: 23329 - DNA, 20 bp, Artificial Sequence
  chemically synthesized
tgggatgtataaataacaca

SEQ ID NO: 23330 - DNA, 20 bp, Artificial Sequence
  chemically synthesized
ataaaataataccttcacaa

SEQ ID NO: 23331 - DNA, 20 bp, Artificial Sequence
  chemically synthesized
aataccttcacaatagtttc

SEQ ID NO: 23332 - DNA, 20 bp, Artificial Sequence
  chemically synthesized
ataccttcacaatagtttcc

SEQ ID NO: 23333 - DNA, 20 bp, Artificial Sequence
  chemically synthesized
cttcacaatagtttccaggc

SEQ ID NO: 23334 - DNA, 20 bp, Artificial Sequence
  chemically synthesized
gtaaatgatctttatctgat

SEQ ID NO: 23335 - DNA, 20 bp, Artificial Sequence
  chemically synthesized
tctttatctgattagaccaa

SEQ ID NO: 23336 - DNA, 20 bp, Artificial Sequence
  chemically synthesized
tttgtttgttttactcaact

SEQ ID NO: 23337 - DNA, 20 bp, Artificial Sequence
  chemically synthesized
aaatttgcctttctcttttg

SEQ ID NO: 23338 - DNA, 20 bp, Artificial Sequence
  chemically synthesized
agcttcttgactgtgtgctc

SEQ ID NO: 23339 - DNA, 20 bp, Artificial Sequence
  chemically synthesized
gcttcttgactgtgtgctcg

SEQ ID NO: 23340 - DNA, 20 bp, Artificial Sequence
  chemically synthesized
cttgactgtgtgctcgagga

SEQ ID NO: 23341 - DNA, 20 bp, Artificial Sequence
  chemically synthesized
cgaggatggtaaatataaca

SEQ ID NO: 23342 - DNA, 20 bp, Artificial Sequence
  chemically synthesized
tcttattccctactgtatta

SEQ ID NO: 23343 - DNA, 20 bp, Artificial Sequence
  chemically synthesized
gtattacagaacttctcaca

SEQ ID NO: 23344 - DNA, 20 bp, Artificial Sequence
  chemically synthesized
aaatgaataaataaaattta

SEQ ID NO: 23345 - DNA, 20 bp, Artificial Sequence
  chemically synthesized
atgtctttctgtgtgtctgc

SEQ ID NO: 23346 - DNA, 20 bp, Artificial Sequence
  chemically synthesized
tgctctctgtattgtcttcc

SEQ ID NO: 23347 - DNA, 20 bp, Artificial Sequence
  chemically synthesized
ctgtattgtcttccaagata

SEQ ID NO: 23348 - DNA, 20 bp, Artificial Sequence
  chemically synthesized
tgtattgtcttccaagatat

SEQ ID NO: 23349 - DNA, 20 bp, Artificial Sequence
  chemically synthesized
aatcctgttctttcttccct

SEQ ID NO: 23350 - DNA, 20 bp, Artificial Sequence
  chemically synthesized
atcctgttctttcttccctt

SEQ ID NO: 23351 - DNA, 20 bp, Artificial Sequence
  chemically synthesized
tctttcttcccttgggcttt

SEQ ID NO: 23352 - DNA, 20 bp, Artificial Sequence
  chemically synthesized
ctttcttcccttgggctttt

SEQ ID NO: 23353 - DNA, 20 bp, Artificial Sequence
  chemically synthesized
tgggcttttgggaatgaatt

SEQ ID NO: 23354 - DNA, 20 bp, Artificial Sequence
  chemically synthesized
gggcttttgggaatgaattc

SEQ ID NO: 23355 - DNA, 20 bp, Artificial Sequence
  chemically synthesized
ggcttttgggaatgaattca

SEQ ID NO: 23356 - DNA, 20 bp, Artificial Sequence
  chemically synthesized
gcttttgggaatgaattcag

SEQ ID NO: 23357 - DNA, 20 bp, Artificial Sequence
  chemically synthesized
cttttgggaatgaattcagg

SEQ ID NO: 23358 - DNA, 20 bp, Artificial Sequence
  chemically synthesized
gaatgaattcagggggatct

SEQ ID NO: 23359 - DNA, 20 bp, Artificial Sequence
  chemically synthesized
gggggatctaagccacatca

SEQ ID NO: 23360 - DNA, 20 bp, Artificial Sequence
  chemically synthesized
atctttcttgactcaccctc

SEQ ID NO: 23361 - DNA, 20 bp, Artificial Sequence
  chemically synthesized
tctttcttgactcaccctct

SEQ ID NO: 23362 - DNA, 20 bp, Artificial Sequence
  chemically synthesized
cttgactcaccctctaggtc

SEQ ID NO: 23363 - DNA, 20 bp, Artificial Sequence
  chemically synthesized
agtgatcctgaaacctgcca

SEQ ID NO: 23364 - DNA, 20 bp, Artificial Sequence
  chemically synthesized
gatcctgaaacctgccatag

SEQ ID NO: 23365 - DNA, 20 bp, Artificial Sequence
  chemically synthesized
atcctgaaacctgccatagc

SEQ ID NO: 23366 - DNA, 20 bp, Artificial Sequence
  chemically synthesized
tgaaacctgccatagcaggc

SEQ ID NO: 23367 - DNA, 20 bp, Artificial Sequence
  chemically synthesized
tgccatagcaggctagtata

SEQ ID NO: 23368 - DNA, 20 bp, Artificial Sequence
  chemically synthesized
caggctagtataaagataac

SEQ ID NO: 23369 - DNA, 20 bp, Artificial Sequence
  chemically synthesized
aggctagtataaagataact

SEQ ID NO: 23370 - DNA, 20 bp, Artificial Sequence
  chemically synthesized
cattttataaattctgtaaa

SEQ ID NO: 23371 - DNA, 20 bp, Artificial Sequence
  chemically synthesized
cacatttgactgacaaccct

SEQ ID NO: 23372 - DNA, 20 bp, Artificial Sequence
  chemically synthesized
ttctgttcttccttatactg

SEQ ID NO: 23373 - DNA, 20 bp, Artificial Sequence
  chemically synthesized
ctgttcttccttatactgaa

SEQ ID NO: 23374 - DNA, 20 bp, Artificial Sequence
  chemically synthesized
tatactgaagagatgtgatg

SEQ ID NO: 23375 - DNA, 20 bp, Artificial Sequence
  chemically synthesized
tactgaagagatgtgatgaa

SEQ ID NO: 23376 - DNA, 20 bp, Artificial Sequence
  chemically synthesized
aagagatgtgatgaagagac

SEQ ID NO: 23377 - DNA, 20 bp, Artificial Sequence
  chemically synthesized
tgatgaagagacaagataaa

SEQ ID NO: 23378 - DNA, 20 bp, Artificial Sequence
  chemically synthesized
agagacaagataaaaagtcc

SEQ ID NO: 23379 - DNA, 20 bp, Artificial Sequence
  chemically synthesized
agacaagataaaaagtccaa

SEQ ID NO: 23380 - DNA, 20 bp, Artificial Sequence
  chemically synthesized
acaagataaaaagtccaaga

SEQ ID NO: 23381 - DNA, 20 bp, Artificial Sequence
  chemically synthesized
caagataaaaagtccaagag

SEQ ID NO: 23382 - DNA, 20 bp, Artificial Sequence
  chemically synthesized
aaaaagtccaagagaggtga

SEQ ID NO: 23383 - DNA, 20 bp, Artificial Sequence
  chemically synthesized
gtccaagagaggtgaaagac

SEQ ID NO: 23384 - DNA, 20 bp, Artificial Sequence
  chemically synthesized
tccaagagaggtgaaagact

SEQ ID NO: 23385 - DNA, 20 bp, Artificial Sequence
  chemically synthesized
aggtgaaagactgggacttg

SEQ ID NO: 23386 - DNA, 20 bp, Artificial Sequence
  chemically synthesized
gggacttgcagttctctttg

SEQ ID NO: 23387 - DNA, 20 bp, Artificial Sequence
  chemically synthesized
gacttgcagttctctttgtg

SEQ ID NO: 23388 - DNA, 20 bp, Artificial Sequence
  chemically synthesized
ctttgtggagtcccgtgaaa

SEQ ID NO: 23389 - DNA, 20 bp, Artificial Sequence
  chemically synthesized
ttgtggagtcccgtgaaaca

SEQ ID NO: 23390 - DNA, 20 bp, Artificial Sequence
  chemically synthesized
tggagtcccgtgaaacagag

SEQ ID NO: 23391 - DNA, 20 bp, Artificial Sequence
  chemically synthesized
gagtcccgtgaaacagagca

SEQ ID NO: 23392 - DNA, 20 bp, Artificial Sequence
  chemically synthesized
cgtgaaacagagcagagctc

SEQ ID NO: 23393 - DNA, 20 bp, Artificial Sequence
  chemically synthesized
gtgaaacagagcagagctct

SEQ ID NO: 23394 - DNA, 20 bp, Artificial Sequence
  chemically synthesized
gcagagctctgggctcccga

SEQ ID NO: 23395 - DNA, 20 bp, Artificial Sequence
  chemically synthesized
gtccctgaacaacatatcaa

SEQ ID NO: 23396 - DNA, 20 bp, Artificial Sequence
  chemically synthesized
cctgaacaacatatcaacag

SEQ ID NO: 23397 - DNA, 20 bp, Artificial Sequence
  chemically synthesized
ctgaacaacatatcaacagt

SEQ ID NO: 23398 - DNA, 20 bp, Artificial Sequence
  chemically synthesized
tgaacaacatatcaacagta

SEQ ID NO: 23399 - DNA, 20 bp, Artificial Sequence
  chemically synthesized
acatatcaacagtagggtcg

SEQ ID NO: 23400 - DNA, 20 bp, Artificial Sequence
  chemically synthesized
ctcccgcccctccacgccac

SEQ ID NO: 23401 - DNA, 20 bp, Artificial Sequence
  chemically synthesized
tccacgccaccagccacact

SEQ ID NO: 23402 - DNA, 20 bp, Artificial Sequence
  chemically synthesized
caccagccacactgagcgct

SEQ ID NO: 23403 - DNA, 20 bp, Artificial Sequence
  chemically synthesized
actgagcgctcagctcctcc

SEQ ID NO: 23404 - DNA, 20 bp, Artificial Sequence
  chemically synthesized
ctgagcgctcagctcctccc

SEQ ID NO: 23405 - DNA, 20 bp, Artificial Sequence
  chemically synthesized
gctcagctcctcccaggtcc

SEQ ID NO: 23406 - DNA, 20 bp, Artificial Sequence
  chemically synthesized
cctcccaggtcctggacctg

SEQ ID NO: 23407 - DNA, 20 bp, Artificial Sequence
  chemically synthesized
aggtcctggacctgcagccc

SEQ ID NO: 23408 - DNA, 20 bp, Artificial Sequence
  chemically synthesized
ctgcagccctggccaacatc

SEQ ID NO: 23409 - DNA, 20 bp, Artificial Sequence
  chemically synthesized
gcagccctggccaacatcaa

SEQ ID NO: 23410 - DNA, 20 bp, Artificial Sequence
  chemically synthesized
cagccctggccaacatcaag

SEQ ID NO: 23411 - DNA, 20 bp, Artificial Sequence
  chemically synthesized
agccctggccaacatcaaga

SEQ ID NO: 23412 - DNA, 20 bp, Artificial Sequence
  chemically synthesized
atcaagagggcatctttgcc

SEQ ID NO: 23413 - DNA, 20 bp, Artificial Sequence
  chemically synthesized
gcatctttgccaagaatgcc

SEQ ID NO: 23414 - DNA, 20 bp, Artificial Sequence
  chemically synthesized
tctttgccaagaatgcctgg

SEQ ID NO: 23415 - DNA, 20 bp, Artificial Sequence
  chemically synthesized
tttgccaagaatgcctggaa

SEQ ID NO: 23416 - DNA, 20 bp, Artificial Sequence
  chemically synthesized
aagaatgcctggaagagact

SEQ ID NO: 23417 - DNA, 20 bp, Artificial Sequence
  chemically synthesized
ggaagagactcagccactca

SEQ ID NO: 23418 - DNA, 20 bp, Artificial Sequence
  chemically synthesized
gaagagactcagccactcac

SEQ ID NO: 23419 - DNA, 20 bp, Artificial Sequence
  chemically synthesized
actcacaggaaaacgtcctc

SEQ ID NO: 23420 - DNA, 20 bp, Artificial Sequence
  chemically synthesized
cacaggaaaacgtcctccag

SEQ ID NO: 23421 - DNA, 20 bp, Artificial Sequence
  chemically synthesized
ggaaaacgtcctccagaagc

SEQ ID NO: 23422 - DNA, 20 bp, Artificial Sequence
  chemically synthesized
gaaaacgtcctccagaagcc

SEQ ID NO: 23423 - DNA, 20 bp, Artificial Sequence
  chemically synthesized
aaaacgtcctccagaagcca

SEQ ID NO: 23424 - DNA, 20 bp, Artificial Sequence
  chemically synthesized
cgtcctccagaagccaggga

SEQ ID NO: 23425 - DNA, 20 bp, Artificial Sequence
  chemically synthesized
agaagccagggaaagctgct

SEQ ID NO: 23426 - DNA, 20 bp, Artificial Sequence
  chemically synthesized
agggaaagctgctgagacaa

SEQ ID NO: 23427 - DNA, 20 bp, Artificial Sequence
  chemically synthesized
ctgctgagacaaaagacaaa

SEQ ID NO: 23428 - DNA, 20 bp, Artificial Sequence
  chemically synthesized
gacaaaagacaaacagtttg

SEQ ID NO: 23429 - DNA, 20 bp, Artificial Sequence
  chemically synthesized
aacagtttgaagaatatgtc

SEQ ID NO: 23430 - DNA, 20 bp, Artificial Sequence
  chemically synthesized
aagaatatgtccagaacttc

SEQ ID NO: 23431 - DNA, 20 bp, Artificial Sequence
  chemically synthesized
tgtccagaacttcaagccac

SEQ ID NO: 23432 - DNA, 20 bp, Artificial Sequence
  chemically synthesized
ccagaacttcaagccacaag

SEQ ID NO: 23433 - DNA, 20 bp, Artificial Sequence
  chemically synthesized
gaacttcaagccacaagaag

SEQ ID NO: 23434 - DNA, 20 bp, Artificial Sequence
  chemically synthesized
acttcaagccacaagaagca

SEQ ID NO: 23435 - DNA, 20 bp, Artificial Sequence
  chemically synthesized
cttcaagccacaagaagcag

SEQ ID NO: 23436 - DNA, 20 bp, Artificial Sequence
  chemically synthesized
ttcaagccacaagaagcaga

SEQ ID NO: 23437 - DNA, 20 bp, Artificial Sequence
  chemically synthesized
ccacaagaagcagagggtac

SEQ ID NO: 23438 - DNA, 20 bp, Artificial Sequence
  chemically synthesized
aagcagagggtaccagacct

SEQ ID NO: 23439 - DNA, 20 bp, Artificial Sequence
  chemically synthesized
gcagagggtaccagacctga

SEQ ID NO: 23440 - DNA, 20 bp, Artificial Sequence
  chemically synthesized
accagacctgagagaactct

SEQ ID NO: 23441 - DNA, 20 bp, Artificial Sequence
  chemically synthesized
ccagacctgagagaactctg

SEQ ID NO: 23442 - DNA, 20 bp, Artificial Sequence
  chemically synthesized
gagagaactctgaggatgtt

SEQ ID NO: 23443 - DNA, 20 bp, Artificial Sequence
  chemically synthesized
agaactctgaggatgtttag

SEQ ID NO: 23444 - DNA, 20 bp, Artificial Sequence
  chemically synthesized
aggatgtttagaagcaatca

SEQ ID NO: 23445 - DNA, 20 bp, Artificial Sequence
  chemically synthesized
ggatgtttagaagcaatcaa

SEQ ID NO: 23446 - DNA, 20 bp, Artificial Sequence
  chemically synthesized
agaagcaatcaaaggcattc

SEQ ID NO: 23447 - DNA, 20 bp, Artificial Sequence
  chemically synthesized
aagcaatcaaaggcattcaa

SEQ ID NO: 23448 - DNA, 20 bp, Artificial Sequence
  chemically synthesized
gcattcaagagaccttgacg

SEQ ID NO: 23449 - DNA, 20 bp, Artificial Sequence
  chemically synthesized
caagagaccttgacgaagct

SEQ ID NO: 23450 - DNA, 20 bp, Artificial Sequence
  chemically synthesized
cgaagctgagtcactgtgtg

SEQ ID NO: 23451 - DNA, 20 bp, Artificial Sequence
  chemically synthesized
actgtgtgaagtctgtgcgc

SEQ ID NO: 23452 - DNA, 20 bp, Artificial Sequence
  chemically synthesized
gtgaagtctgtgcgctggat

SEQ ID NO: 23453 - DNA, 20 bp, Artificial Sequence
  chemically synthesized
gtctgtgcgctggattggtc

SEQ ID NO: 23454 - DNA, 20 bp, Artificial Sequence
  chemically synthesized
tctgtgcgctggattggtct

SEQ ID NO: 23455 - DNA, 20 bp, Artificial Sequence
  chemically synthesized
gtgcgctggattggtctggg

SEQ ID NO: 23456 - DNA, 20 bp, Artificial Sequence
  chemically synthesized
tgcgctggattggtctgggc

SEQ ID NO: 23457 - DNA, 20 bp, Artificial Sequence
  chemically synthesized
gctggattggtctgggcagg

SEQ ID NO: 23458 - DNA, 20 bp, Artificial Sequence
  chemically synthesized
ctggattggtctgggcagga

SEQ ID NO: 23459 - DNA, 20 bp, Artificial Sequence
  chemically synthesized
tgggcaggaaggtgtgaaaa

SEQ ID NO: 23460 - DNA, 20 bp, Artificial Sequence
  chemically synthesized
caggaaggtgtgaaaatggt

SEQ ID NO: 23461 - DNA, 20 bp, Artificial Sequence
  chemically synthesized
aaggtgtgaaaatggttggt

SEQ ID NO: 23462 - DNA, 20 bp, Artificial Sequence
  chemically synthesized
tgtgaaaatggttggtgaga

SEQ ID NO: 23463 - DNA, 20 bp, Artificial Sequence
  chemically synthesized
gtgaaaatggttggtgagaa

SEQ ID NO: 23464 - DNA, 20 bp, Artificial Sequence
  chemically synthesized
gtgagaaaggtgatgtgctc

SEQ ID NO: 23465 - DNA, 20 bp, Artificial Sequence
  chemically synthesized
tgagaaaggtgatgtgctct

SEQ ID NO: 23466 - DNA, 20 bp, Artificial Sequence
  chemically synthesized
agaaaggtgatgtgctctgg

SEQ ID NO: 23467 - DNA, 20 bp, Artificial Sequence
  chemically synthesized
gaaaggtgatgtgctctggg

SEQ ID NO: 23468 - DNA, 20 bp, Artificial Sequence
  chemically synthesized
ggatatccacaaaaaactca

SEQ ID NO: 23469 - DNA, 20 bp, Artificial Sequence
  chemically synthesized
ggatgcatccttgctaacac

SEQ ID NO: 23470 - DNA, 20 bp, Artificial Sequence
  chemically synthesized
gctaacactggaaaactacc

SEQ ID NO: 23471 - DNA, 20 bp, Artificial Sequence
  chemically synthesized
tggaccaatttcctgacttg

SEQ ID NO: 23472 - DNA, 20 bp, Artificial Sequence
  chemically synthesized
acttgaagaatcacatcacc

SEQ ID NO: 23473 - DNA, 20 bp, Artificial Sequence
  chemically synthesized
aagaatcacatcaccaagtg

SEQ ID NO: 23474 - DNA, 20 bp, Artificial Sequence
  chemically synthesized
aatcacatcaccaagtgcag

SEQ ID NO: 23475 - DNA, 20 bp, Artificial Sequence
  chemically synthesized
atcacatcaccaagtgcagc

SEQ ID NO: 23476 - DNA, 20 bp, Artificial Sequence
  chemically synthesized
acatcaccaagtgcagcagg

SEQ ID NO: 23477 - DNA, 20 bp, Artificial Sequence
  chemically synthesized
caagtgcagcaggaagctta

SEQ ID NO: 23478 - DNA, 20 bp, Artificial Sequence
  chemically synthesized
aggaagcttacggactatga

SEQ ID NO: 23479 - DNA, 20 bp, Artificial Sequence
  chemically synthesized
cagtgcctgcccacctccat

SEQ ID NO: 23480 - DNA, 20 bp, Artificial Sequence
  chemically synthesized
agtgcctgcccacctccatc

SEQ ID NO: 23481 - DNA, 20 bp, Artificial Sequence
  chemically synthesized
cccacctccatcgggctcaa

SEQ ID NO: 23482 - DNA, 20 bp, Artificial Sequence
  chemically synthesized
cacctccatcgggctcaaca

SEQ ID NO: 23483 - DNA, 20 bp, Artificial Sequence
  chemically synthesized
catcgggctcaacagagctt

SEQ ID NO: 23484 - DNA, 20 bp, Artificial Sequence
  chemically synthesized
atcgggctcaacagagcttc

SEQ ID NO: 23485 - DNA, 20 bp, Artificial Sequence
  chemically synthesized
cgggctcaacagagcttcag

SEQ ID NO: 23486 - DNA, 20 bp, Artificial Sequence
  chemically synthesized
gggctcaacagagcttcagg

SEQ ID NO: 23487 - DNA, 20 bp, Artificial Sequence
  chemically synthesized
ctcaacagagcttcaggagg

SEQ ID NO: 23488 - DNA, 20 bp, Artificial Sequence
  chemically synthesized
tcaacagagcttcaggagga

SEQ ID NO: 23489 - DNA, 20 bp, Artificial Sequence
  chemically synthesized
cagagcttcaggaggaagga

SEQ ID NO: 23490 - DNA, 20 bp, Artificial Sequence
  chemically synthesized
agagcttcaggaggaaggat

SEQ ID NO: 23491 - DNA, 20 bp, Artificial Sequence
  chemically synthesized
agcttcaggaggaaggatag

SEQ ID NO: 23492 - DNA, 20 bp, Artificial Sequence
  chemically synthesized
aaggataggagcctctgtct

SEQ ID NO: 23493 - DNA, 20 bp, Artificial Sequence
  chemically synthesized
aggataggagcctctgtcta

SEQ ID NO: 23494 - DNA, 20 bp, Artificial Sequence
  chemically synthesized
ataggagcctctgtctaagg

SEQ ID NO: 23495 - DNA, 20 bp, Artificial Sequence
  chemically synthesized
ggagcctctgtctaaggcag

SEQ ID NO: 23496 - DNA, 20 bp, Artificial Sequence
  chemically synthesized
gcctctgtctaaggcagaag

SEQ ID NO: 23497 - DNA, 20 bp, Artificial Sequence
  chemically synthesized
ctaaggcagaagtagaattt

SEQ ID NO: 23498 - DNA, 20 bp, Artificial Sequence
  chemically synthesized
ggcagaagtagaatttcaga

SEQ ID NO: 23499 - DNA, 20 bp, Artificial Sequence
  chemically synthesized
aagtagaatttcagaaagca

SEQ ID NO: 23500 - DNA, 20 bp, Artificial Sequence
  chemically synthesized
gtagaatttcagaaagcata

SEQ ID NO: 23501 - DNA, 20 bp, Artificial Sequence
  chemically synthesized
aatttcagaaagcatagaga

SEQ ID NO: 23502 - DNA, 20 bp, Artificial Sequence
  chemically synthesized
gaaagcatagagaaagtttg

SEQ ID NO: 23503 - DNA, 20 bp, Artificial Sequence
  chemically synthesized
aagcatagagaaagtttgaa

SEQ ID NO: 23504 - DNA, 20 bp, Artificial Sequence
  chemically synthesized
agaaagtttgaagagtttaa

SEQ ID NO: 23505 - DNA, 20 bp, Artificial Sequence
  chemically synthesized
agagtttaatggtgacttac

SEQ ID NO: 23506 - DNA, 20 bp, Artificial Sequence
  chemically synthesized
ttaatggtgacttacaagaa

SEQ ID NO: 23507 - DNA, 20 bp, Artificial Sequence
  chemically synthesized
aagaaaagttaccattatta

SEQ ID NO: 23508 - DNA, 20 bp, Artificial Sequence
  chemically synthesized
aagttaccattattatagtc

SEQ ID NO: 23509 - DNA, 20 bp, Artificial Sequence
  chemically synthesized
ttattatagtcaagacgaat

SEQ ID NO: 23510 - DNA, 20 bp, Artificial Sequence
  chemically synthesized
aatactttcaaaaacatctc

SEQ ID NO: 23511 - DNA, 20 bp, Artificial Sequence
  chemically synthesized
caaaaacatctccagccttg

SEQ ID NO: 23512 - DNA, 20 bp, Artificial Sequence
  chemically synthesized
acatctccagccttgaagct

SEQ ID NO: 23513 - DNA, 20 bp, Artificial Sequence
  chemically synthesized
gccttgaagctaagtttcat

SEQ ID NO: 23514 - DNA, 20 bp, Artificial Sequence
  chemically synthesized
ccttgaagctaagtttcata

SEQ ID NO: 23515 - DNA, 20 bp, Artificial Sequence
  chemically synthesized
taagtttcataaggaaactg

SEQ ID NO: 23516 - DNA, 20 bp, Artificial Sequence
  chemically synthesized
ataaggaaactgtggtgctt

SEQ ID NO: 23517 - DNA, 20 bp, Artificial Sequence
  chemically synthesized
ctgtggtgctttggtacaaa

SEQ ID NO: 23518 - DNA, 20 bp, Artificial Sequence
  chemically synthesized
gctttggtacaaacagtatg

SEQ ID NO: 23519 - DNA, 20 bp, Artificial Sequence
  chemically synthesized
gtatgaagtgatgatgaaac

SEQ ID NO: 23520 - DNA, 20 bp, Artificial Sequence
  chemically synthesized
tatgaagtgatgatgaaact

SEQ ID NO: 23521 - DNA, 20 bp, Artificial Sequence
  chemically synthesized
tgatgatgaaactgggtgac

SEQ ID NO: 23522 - DNA, 20 bp, Artificial Sequence
  chemically synthesized
tgggtgaccagtatgctgac

SEQ ID NO: 23523 - DNA, 20 bp, Artificial Sequence
  chemically synthesized
gggtgaccagtatgctgaca

SEQ ID NO: 23524 - DNA, 20 bp, Artificial Sequence
  chemically synthesized
gacaaggccttcaacattca

SEQ ID NO: 23525 - DNA, 20 bp, Artificial Sequence
  chemically synthesized
caaggccttcaacattcaaa

SEQ ID NO: 23526 - DNA, 20 bp, Artificial Sequence
  chemically synthesized
aagagcaacacccactgatt

SEQ ID NO: 23527 - DNA, 20 bp, Artificial Sequence
  chemically synthesized
agagcaacacccactgattt

SEQ ID NO: 23528 - DNA, 20 bp, Artificial Sequence
  chemically synthesized
tgggtcctctccacattgca

SEQ ID NO: 23529 - DNA, 20 bp, Artificial Sequence
  chemically synthesized
acattgcaaagatgtcctca

SEQ ID NO: 23530 - DNA, 20 bp, Artificial Sequence
  chemically synthesized
gcaaagatgtcctcatggcc

SEQ ID NO: 23531 - DNA, 20 bp, Artificial Sequence
  chemically synthesized
caaagatgtcctcatggcct

SEQ ID NO: 23532 - DNA, 20 bp, Artificial Sequence
  chemically synthesized
aaagatgtcctcatggccta

SEQ ID NO: 23533 - DNA, 20 bp, Artificial Sequence
  chemically synthesized
agatgtcctcatggcctagg

SEQ ID NO: 23534 - DNA, 20 bp, Artificial Sequence
  chemically synthesized
agggagctttcattccaccc

SEQ ID NO: 23535 - DNA, 20 bp, Artificial Sequence
  chemically synthesized
ttccaccccagcccaacaac

SEQ ID NO: 23536 - DNA, 20 bp, Artificial Sequence
  chemically synthesized
cccagcccaacaactagttc

SEQ ID NO: 23537 - DNA, 20 bp, Artificial Sequence
  chemically synthesized
aactagttcaagtgaaacac

SEQ ID NO: 23538 - DNA, 20 bp, Artificial Sequence
  chemically synthesized
agcacctgcttctcctatgc

SEQ ID NO: 23539 - DNA, 20 bp, Artificial Sequence
  chemically synthesized
ctcctatgccagcatgacct

SEQ ID NO: 23540 - DNA, 20 bp, Artificial Sequence
  chemically synthesized
catgacctgagtcactcttg

SEQ ID NO: 23541 - DNA, 20 bp, Artificial Sequence
  chemically synthesized
tgcagtcctgtatctgtcta

SEQ ID NO: 23542 - DNA, 20 bp, Artificial Sequence
  chemically synthesized
ctgtctaaagtcacttgaca

SEQ ID NO: 23543 - DNA, 20 bp, Artificial Sequence
  chemically synthesized
tgtctaaagtcacttgacaa

SEQ ID NO: 23544 - DNA, 20 bp, Artificial Sequence
  chemically synthesized
gtcacttgacaaaggaactg

SEQ ID NO: 23545 - DNA, 20 bp, Artificial Sequence
  chemically synthesized
acttgacaaaggaactgcag

SEQ ID NO: 23546 - DNA, 20 bp, Artificial Sequence
  chemically synthesized
cttgacaaaggaactgcagc

SEQ ID NO: 23547 - DNA, 20 bp, Artificial Sequence
  chemically synthesized
caggaaaaatatcatcttca

SEQ ID NO: 23548 - DNA, 20 bp, Artificial Sequence
  chemically synthesized
catcttcacagactgtccta

SEQ ID NO: 23549 - DNA, 20 bp, Artificial Sequence
  chemically synthesized
ttcacagactgtcctaaagt

SEQ ID NO: 23550 - DNA, 20 bp, Artificial Sequence
  chemically synthesized
cagactgtcctaaagtaaga

SEQ ID NO: 23551 - DNA, 20 bp, Artificial Sequence
  chemically synthesized
agactgtcctaaagtaagat

SEQ ID NO: 23552 - DNA, 20 bp, Artificial Sequence
  chemically synthesized
tatccacaaatcatctgtaa

SEQ ID NO: 23553 - DNA, 20 bp, Artificial Sequence
  chemically synthesized
atctgtaaaagttatgtttt

SEQ ID NO: 23554 - DNA, 20 bp, Artificial Sequence
  chemically synthesized
tgtaaaagttatgttttcag

SEQ ID NO: 23555 - DNA, 20 bp, Artificial Sequence
  chemically synthesized
gtgtcatttcaaataaacct

SEQ ID NO: 23556 - DNA, 20 bp, Artificial Sequence
  chemically synthesized
tgtcatttcaaataaacctt

SEQ ID NO: 23557 - DNA, 20 bp, Artificial Sequence
  chemically synthesized
taaaaattaaaaaaaaaaaa

SEQ ID NO: 23558 - DNA, 20 bp, Artificial Sequence
  chemically synthesized
aaaattaaaaaaaaaaaaaa

SEQ ID NO: 23559 - DNA, 20 bp, Artificial Sequence
  chemically synthesized
attaaaaaaaaaaaaaagag

SEQ ID NO: 23560 - DNA, 20 bp, Artificial Sequence
  chemically synthesized
ttaaaaaaaaaaaaaagagt

SEQ ID NO: 23561 - DNA, 20 bp, Artificial Sequence
  chemically synthesized
taaaaaaaaaaaaaagagta

SEQ ID NO: 23562 - DNA, 20 bp, Artificial Sequence
  chemically synthesized
aaaaaaaaaagagtagggtc

SEQ ID NO: 23563 - DNA, 20 bp, Artificial Sequence
  chemically synthesized
aaaaaaaaagagtagggtca

SEQ ID NO: 23564 - DNA, 20 bp, Artificial Sequence
  chemically synthesized
aaaaaaaagagtagggtcaa

SEQ ID NO: 23565 - DNA, 20 bp, Artificial Sequence
  chemically synthesized
aaaaaaagagtagggtcaag

SEQ ID NO: 23566 - DNA, 20 bp, Artificial Sequence
  chemically synthesized
aagagtagggtcaaggggta

SEQ ID NO: 23567 - DNA, 20 bp, Artificial Sequence
  chemically synthesized
agagtagggtcaaggggtat

SEQ ID NO: 23568 - DNA, 20 bp, Artificial Sequence
  chemically synthesized
gagtagggtcaaggggtata

SEQ ID NO: 23569 - DNA, 20 bp, Artificial Sequence
  chemically synthesized
tagggtcaaggggtataggg

SEQ ID NO: 23570 - DNA, 20 bp, Artificial Sequence
  chemically synthesized
agggtagcaaaattttctta

SEQ ID NO: 23571 - DNA, 20 bp, Artificial Sequence
  chemically synthesized
gggtagcaaaattttcttaa

SEQ ID NO: 23572 - DNA, 20 bp, Artificial Sequence
  chemically synthesized
atgccctgctctgattcctg

SEQ ID NO: 23573 - DNA, 20 bp, Artificial Sequence
  chemically synthesized
ctctgattcctgtagtgaca

SEQ ID NO: 23574 - DNA, 20 bp, Artificial Sequence
  chemically synthesized
tctgattcctgtagtgacat

SEQ ID NO: 23575 - DNA, 20 bp, Artificial Sequence
  chemically synthesized
gtgacataggcgtcaatata

SEQ ID NO: 23576 - DNA, 20 bp, Artificial Sequence
  chemically synthesized
ataggcgtcaatatacagac

SEQ ID NO: 23577 - DNA, 20 bp, Artificial Sequence
  chemically synthesized
taggcgtcaatatacagaca

SEQ ID NO: 23578 - DNA, 20 bp, Artificial Sequence
  chemically synthesized
tcaatatacagacaaggtcc

SEQ ID NO: 23579 - DNA, 20 bp, Artificial Sequence
  chemically synthesized
atatacagacaaggtcctgg

SEQ ID NO: 23580 - DNA, 20 bp, Artificial Sequence
  chemically synthesized
ttcttttaaaaatctgctgc

SEQ ID NO: 23581 - DNA, 20 bp, Artificial Sequence
  chemically synthesized
ttaaaaatctgctgcaagct

SEQ ID NO: 23582 - DNA, 20 bp, Artificial Sequence
  chemically synthesized
taaaaatctgctgcaagctg

SEQ ID NO: 23583 - DNA, 20 bp, Artificial Sequence
  chemically synthesized
aaaaatctgctgcaagctga

SEQ ID NO: 23584 - DNA, 20 bp, Artificial Sequence
  chemically synthesized
ctgcaagctgagggtcctgt

SEQ ID NO: 23585 - DNA, 20 bp, Artificial Sequence
  chemically synthesized
caagctgagggtcctgttag

SEQ ID NO: 23586 - DNA, 20 bp, Artificial Sequence
  chemically synthesized
aagctgagggtcctgttaga

SEQ ID NO: 23587 - DNA, 20 bp, Artificial Sequence
  chemically synthesized
ttagaaggaaaactaacaaa

SEQ ID NO: 23588 - DNA, 20 bp, Artificial Sequence
  chemically synthesized
aaggaaaactaacaaacaga

SEQ ID NO: 23589 - DNA, 20 bp, Artificial Sequence
  chemically synthesized
aggaaaactaacaaacagaa

SEQ ID NO: 23590 - DNA, 20 bp, Artificial Sequence
  chemically synthesized
tctgtacgtcaccatcatca

SEQ ID NO: 23591 - DNA, 20 bp, Artificial Sequence
  chemically synthesized
gtcaccatcatcaaagacca

SEQ ID NO: 23592 - DNA, 20 bp, Artificial Sequence
  chemically synthesized
tcaccatcatcaaagaccaa

SEQ ID NO: 23593 - DNA, 20 bp, Artificial Sequence
  chemically synthesized
ccatcatcaaagaccaaagg

SEQ ID NO: 23594 - DNA, 20 bp, Artificial Sequence
  chemically synthesized
caaaggtagataaaaccaca

SEQ ID NO: 23595 - DNA, 20 bp, Artificial Sequence
  chemically synthesized
ggtagataaaaccacaaaga

SEQ ID NO: 23596 - DNA, 20 bp, Artificial Sequence
  chemically synthesized
gtagataaaaccacaaagat

SEQ ID NO: 23597 - DNA, 20 bp, Artificial Sequence
  chemically synthesized
tagataaaaccacaaagatg

SEQ ID NO: 23598 - DNA, 20 bp, Artificial Sequence
  chemically synthesized
accacaaagatggggaaaaa

SEQ ID NO: 23599 - DNA, 20 bp, Artificial Sequence
  chemically synthesized
cacaaagatggggaaaaaca

SEQ ID NO: 23600 - DNA, 20 bp, Artificial Sequence
  chemically synthesized
aaagatggggaaaaacagag

SEQ ID NO: 23601 - DNA, 20 bp, Artificial Sequence
  chemically synthesized
gaaaaacagagcagaaaaac

SEQ ID NO: 23602 - DNA, 20 bp, Artificial Sequence
  chemically synthesized
aaactggaaactctaaaaat

SEQ ID NO: 23603 - DNA, 20 bp, Artificial Sequence
  chemically synthesized
actggaaactctaaaaatca

SEQ ID NO: 23604 - DNA, 20 bp, Artificial Sequence
  chemically synthesized
agagtgcctctcctcctcca

SEQ ID NO: 23605 - DNA, 20 bp, Artificial Sequence
  chemically synthesized
gagtgcctctcctcctccaa

SEQ ID NO: 23606 - DNA, 20 bp, Artificial Sequence
  chemically synthesized
tctcctcctccaaaggaatg

SEQ ID NO: 23607 - DNA, 20 bp, Artificial Sequence
  chemically synthesized
aaaggaatgcagctcctcac

SEQ ID NO: 23608 - DNA, 20 bp, Artificial Sequence
  chemically synthesized
atgcagctcctcaccagcaa

SEQ ID NO: 23609 - DNA, 20 bp, Artificial Sequence
  chemically synthesized
tcctcaccagcaacggtaca

SEQ ID NO: 23610 - DNA, 20 bp, Artificial Sequence
  chemically synthesized
caccagcaacggtacaaagc

SEQ ID NO: 23611 - DNA, 20 bp, Artificial Sequence
  chemically synthesized
agcaacggtacaaagctgga

SEQ ID NO: 23612 - DNA, 20 bp, Artificial Sequence
  chemically synthesized
caacggtacaaagctggaca

SEQ ID NO: 23613 - DNA, 20 bp, Artificial Sequence
  chemically synthesized
ggacagagaatgactttgac

SEQ ID NO: 23614 - DNA, 20 bp, Artificial Sequence
  chemically synthesized
gagaatgactttgacaagtt

SEQ ID NO: 23615 - DNA, 20 bp, Artificial Sequence
  chemically synthesized
gaatgactttgacaagttga

SEQ ID NO: 23616 - DNA, 20 bp, Artificial Sequence
  chemically synthesized
tgactttgacaagttgagag

SEQ ID NO: 23617 - DNA, 20 bp, Artificial Sequence
  chemically synthesized
ctttgacaagttgagagaag

SEQ ID NO: 23618 - DNA, 20 bp, Artificial Sequence
  chemically synthesized
tttgacaagttgagagaaga

SEQ ID NO: 23619 - DNA, 20 bp, Artificial Sequence
  chemically synthesized
aagttgagagaagaaggctt

SEQ ID NO: 23620 - DNA, 20 bp, Artificial Sequence
  chemically synthesized
tcagacgatcaaactactcc

SEQ ID NO: 23621 - DNA, 20 bp, Artificial Sequence
  chemically synthesized
gatcaaactactccgagcta

SEQ ID NO: 23622 - DNA, 20 bp, Artificial Sequence
  chemically synthesized
atcaaactactccgagctaa

SEQ ID NO: 23623 - DNA, 20 bp, Artificial Sequence
  chemically synthesized
caaactactccgagctaaag

SEQ ID NO: 23624 - DNA, 20 bp, Artificial Sequence
  chemically synthesized
aaactactccgagctaaagg

SEQ ID NO: 23625 - DNA, 20 bp, Artificial Sequence
  chemically synthesized
ctactccgagctaaaggagg

SEQ ID NO: 23626 - DNA, 20 bp, Artificial Sequence
  chemically synthesized
aaggaggaagctcgaaccca

SEQ ID NO: 23627 - DNA, 20 bp, Artificial Sequence
  chemically synthesized
agctcgaacccatggcaaaa

SEQ ID NO: 23628 - DNA, 20 bp, Artificial Sequence
  chemically synthesized
taaaaaccttgaaaataaat

SEQ ID NO: 23629 - DNA, 20 bp, Artificial Sequence
  chemically synthesized
ttgaaaataaattagactaa

SEQ ID NO: 23630 - DNA, 20 bp, Artificial Sequence
  chemically synthesized
aaattagactaatggctaac

SEQ ID NO: 23631 - DNA, 20 bp, Artificial Sequence
  chemically synthesized
gctaactagaataaccaata

SEQ ID NO: 23632 - DNA, 20 bp, Artificial Sequence
  chemically synthesized
taactagaataaccaataca

SEQ ID NO: 23633 - DNA, 20 bp, Artificial Sequence
  chemically synthesized
ctagaataaccaatacagag

SEQ ID NO: 23634 - DNA, 20 bp, Artificial Sequence
  chemically synthesized
ccaatacagagaagtcctta

SEQ ID NO: 23635 - DNA, 20 bp, Artificial Sequence
  chemically synthesized
caatacagagaagtccttaa

SEQ ID NO: 23636 - DNA, 20 bp, Artificial Sequence
  chemically synthesized
gaagtccttaaaggacctga

SEQ ID NO: 23637 - DNA, 20 bp, Artificial Sequence
  chemically synthesized
agtccttaaaggacctgatg

SEQ ID NO: 23638 - DNA, 20 bp, Artificial Sequence
  chemically synthesized
acctgatggagctgaaaacc

SEQ ID NO: 23639 - DNA, 20 bp, Artificial Sequence
  chemically synthesized
cctgatggagctgaaaacca

SEQ ID NO: 23640 - DNA, 20 bp, Artificial Sequence
  chemically synthesized
ggagctgaaaaccaaggcat

SEQ ID NO: 23641 - DNA, 20 bp, Artificial Sequence
  chemically synthesized
gaactacatgatgaatgcac

SEQ ID NO: 23642 - DNA, 20 bp, Artificial Sequence
  chemically synthesized
catgatgaatgcacaagact

SEQ ID NO: 23643 - DNA, 20 bp, Artificial Sequence
  chemically synthesized
gatgaatgcacaagactcag

SEQ ID NO: 23644 - DNA, 20 bp, Artificial Sequence
  chemically synthesized
cagtagctgattcgatcaac

SEQ ID NO: 23645 - DNA, 20 bp, Artificial Sequence
  chemically synthesized
tagctgattcgatcaactgg

SEQ ID NO: 23646 - DNA, 20 bp, Artificial Sequence
  chemically synthesized
tgattcgatcaactggaaga

SEQ ID NO: 23647 - DNA, 20 bp, Artificial Sequence
  chemically synthesized
gattcgatcaactggaagaa

SEQ ID NO: 23648 - DNA, 20 bp, Artificial Sequence
  chemically synthesized
attcgatcaactggaagaaa

SEQ ID NO: 23649 - DNA, 20 bp, Artificial Sequence
  chemically synthesized
tcaactggaagaaagggtat

SEQ ID NO: 23650 - DNA, 20 bp, Artificial Sequence
  chemically synthesized
ggaagaaagggtatcagtga

SEQ ID NO: 23651 - DNA, 20 bp, Artificial Sequence
  chemically synthesized
agaaagggtatcagtgatgg

SEQ ID NO: 23652 - DNA, 20 bp, Artificial Sequence
  chemically synthesized
aagatcaaatgaatgaaatg

SEQ ID NO: 23653 - DNA, 20 bp, Artificial Sequence
  chemically synthesized
tcaaatgaatgaaatgaagc

SEQ ID NO: 23654 - DNA, 20 bp, Artificial Sequence
  chemically synthesized
aatgaatgaaatgaagcaag

SEQ ID NO: 23655 - DNA, 20 bp, Artificial Sequence
  chemically synthesized
tgaatgaaatgaagcaagaa

SEQ ID NO: 23656 - DNA, 20 bp, Artificial Sequence
  chemically synthesized
atgaaatgaagcaagaagag

SEQ ID NO: 23657 - DNA, 20 bp, Artificial Sequence
  chemically synthesized
atgaagcaagaagagaagtt

SEQ ID NO: 23658 - DNA, 20 bp, Artificial Sequence
  chemically synthesized
gaagcaagaagagaagttta

SEQ ID NO: 23659 - DNA, 20 bp, Artificial Sequence
  chemically synthesized
gaagagaagtttagagaaaa

SEQ ID NO: 23660 - DNA, 20 bp, Artificial Sequence
  chemically synthesized
tttagagaaaaaagaataaa

SEQ ID NO: 23661 - DNA, 20 bp, Artificial Sequence
  chemically synthesized
agaataaaaagaaatgaaca

SEQ ID NO: 23662 - DNA, 20 bp, Artificial Sequence
  chemically synthesized
aagaaatgaacaaagcctcc

SEQ ID NO: 23663 - DNA, 20 bp, Artificial Sequence
  chemically synthesized
aacaaagcctccaagaaata

SEQ ID NO: 23664 - DNA, 20 bp, Artificial Sequence
  chemically synthesized
acaaagcctccaagaaatat

SEQ ID NO: 23665 - DNA, 20 bp, Artificial Sequence
  chemically synthesized
gaaatatgggactatgtgaa

SEQ ID NO: 23666 - DNA, 20 bp, Artificial Sequence
  chemically synthesized
agaccaaatctatatctgat

SEQ ID NO: 23667 - DNA, 20 bp, Artificial Sequence
  chemically synthesized
tatctgattggtgtacctga

SEQ ID NO: 23668 - DNA, 20 bp, Artificial Sequence
  chemically synthesized
attggtgtacctgaaagtga

SEQ ID NO: 23669 - DNA, 20 bp, Artificial Sequence
  chemically synthesized
ttggtgtacctgaaagtgac

SEQ ID NO: 23670 - DNA, 20 bp, Artificial Sequence
  chemically synthesized
gtgtacctgaaagtgacggg

SEQ ID NO: 23671 - DNA, 20 bp, Artificial Sequence
  chemically synthesized
cctgaaagtgacgggcagaa

SEQ ID NO: 23672 - DNA, 20 bp, Artificial Sequence
  chemically synthesized
gtgacgggcagaatggaacc

SEQ ID NO: 23673 - DNA, 20 bp, Artificial Sequence
  chemically synthesized
cgggcagaatggaaccaagt

SEQ ID NO: 23674 - DNA, 20 bp, Artificial Sequence
  chemically synthesized
ccaagttggaaaacactctg

SEQ ID NO: 23675 - DNA, 20 bp, Artificial Sequence
  chemically synthesized
caagttggaaaacactctgc

SEQ ID NO: 23676 - DNA, 20 bp, Artificial Sequence
  chemically synthesized
acactctgcaggatattatc

SEQ ID NO: 23677 - DNA, 20 bp, Artificial Sequence
  chemically synthesized
cactctgcaggatattatcc

SEQ ID NO: 23678 - DNA, 20 bp, Artificial Sequence
  chemically synthesized
ctctgcaggatattatccag

SEQ ID NO: 23679 - DNA, 20 bp, Artificial Sequence
  chemically synthesized
ccaggagaacttccccaatc

SEQ ID NO: 23680 - DNA, 20 bp, Artificial Sequence
  chemically synthesized
gagaacttccccaatctagc

SEQ ID NO: 23681 - DNA, 20 bp, Artificial Sequence
  chemically synthesized
agaacttccccaatctagca

SEQ ID NO: 23682 - DNA, 20 bp, Artificial Sequence
  chemically synthesized
acttccccaatctagcaagg

SEQ ID NO: 23683 - DNA, 20 bp, Artificial Sequence
  chemically synthesized
cttccccaatctagcaaggc

SEQ ID NO: 23684 - DNA, 20 bp, Artificial Sequence
  chemically synthesized
ggcaggtcaacattcaaatt

SEQ ID NO: 23685 - DNA, 20 bp, Artificial Sequence
  chemically synthesized
gcaggtcaacattcaaattc

SEQ ID NO: 23686 - DNA, 20 bp, Artificial Sequence
  chemically synthesized
acattcaaattcaggaaata

SEQ ID NO: 23687 - DNA, 20 bp, Artificial Sequence
  chemically synthesized
attcaaattcaggaaataca

SEQ ID NO: 23688 - DNA, 20 bp, Artificial Sequence
  chemically synthesized
gaaatacagagaacgccaca

SEQ ID NO: 23689 - DNA, 20 bp, Artificial Sequence
  chemically synthesized
acgccacaaagatactcctt

SEQ ID NO: 23690 - DNA, 20 bp, Artificial Sequence
  chemically synthesized
ccacaaagatactccttgag

SEQ ID NO: 23691 - DNA, 20 bp, Artificial Sequence
  chemically synthesized
acaaagatactccttgagaa

SEQ ID NO: 23692 - DNA, 20 bp, Artificial Sequence
  chemically synthesized
tccttgagaagagcaactac

SEQ ID NO: 23693 - DNA, 20 bp, Artificial Sequence
  chemically synthesized
ccttgagaagagcaactaca

SEQ ID NO: 23694 - DNA, 20 bp, Artificial Sequence
  chemically synthesized
actacaaggcacataattgt

SEQ ID NO: 23695 - DNA, 20 bp, Artificial Sequence
  chemically synthesized
cataattgtcagattcacca

SEQ ID NO: 23696 - DNA, 20 bp, Artificial Sequence
  chemically synthesized
gattcaccaaagttgaaatg

SEQ ID NO: 23697 - DNA, 20 bp, Artificial Sequence
  chemically synthesized
attcaccaaagttgaaatga

SEQ ID NO: 23698 - DNA, 20 bp, Artificial Sequence
  chemically synthesized
ttcaccaaagttgaaatgaa

SEQ ID NO: 23699 - DNA, 20 bp, Artificial Sequence
  chemically synthesized
gaaatgaagggaaaaatgtt

SEQ ID NO: 23700 - DNA, 20 bp, Artificial Sequence
  chemically synthesized
aaatgaagggaaaaatgtta

SEQ ID NO: 23701 - DNA, 20 bp, Artificial Sequence
  chemically synthesized
aatgaagggaaaaatgttaa

SEQ ID NO: 23702 - DNA, 20 bp, Artificial Sequence
  chemically synthesized
gaagggaaaaatgttaaggg

SEQ ID NO: 23703 - DNA, 20 bp, Artificial Sequence
  chemically synthesized
ggaaaaatgttaagggtagc

SEQ ID NO: 23704 - DNA, 20 bp, Artificial Sequence
  chemically synthesized
aaaaatgttaagggtagcca

SEQ ID NO: 23705 - DNA, 20 bp, Artificial Sequence
  chemically synthesized
aaatgttaagggtagccaga

SEQ ID NO: 23706 - DNA, 20 bp, Artificial Sequence
  chemically synthesized
gttaagggtagccagagaga

SEQ ID NO: 23707 - DNA, 20 bp, Artificial Sequence
  chemically synthesized
ttaagggtagccagagagaa

SEQ ID NO: 23708 - DNA, 20 bp, Artificial Sequence
  chemically synthesized
gggtagccagagagaaaggt

SEQ ID NO: 23709 - DNA, 20 bp, Artificial Sequence
  chemically synthesized
ggtagccagagagaaaggtc

SEQ ID NO: 23710 - DNA, 20 bp, Artificial Sequence
  chemically synthesized
gaaaggtcgggttacccaca

SEQ ID NO: 23711 - DNA, 20 bp, Artificial Sequence
  chemically synthesized
aaaggtcgggttacccacaa

SEQ ID NO: 23712 - DNA, 20 bp, Artificial Sequence
  chemically synthesized
aaggtcgggttacccacaaa

SEQ ID NO: 23713 - DNA, 20 bp, Artificial Sequence
  chemically synthesized
gtcgggttacccacaaaggg

SEQ ID NO: 23714 - DNA, 20 bp, Artificial Sequence
  chemically synthesized
acccacaaagggaagcccat

SEQ ID NO: 23715 - DNA, 20 bp, Artificial Sequence
  chemically synthesized
agggaagcccatcagaataa

SEQ ID NO: 23716 - DNA, 20 bp, Artificial Sequence
  chemically synthesized
gaagcccatcagaataacag

SEQ ID NO: 23717 - DNA, 20 bp, Artificial Sequence
  chemically synthesized
cagaataacagcagatctct

SEQ ID NO: 23718 - DNA, 20 bp, Artificial Sequence
  chemically synthesized
aataacagcagatctctcag

SEQ ID NO: 23719 - DNA, 20 bp, Artificial Sequence
  chemically synthesized
tctctcagcagaaactctac

SEQ ID NO: 23720 - DNA, 20 bp, Artificial Sequence
  chemically synthesized
tcagcagaaactctacaagc

SEQ ID NO: 23721 - DNA, 20 bp, Artificial Sequence
  chemically synthesized
gcagaaactctacaagccag

SEQ ID NO: 23722 - DNA, 20 bp, Artificial Sequence
  chemically synthesized
agaaactctacaagccagaa

SEQ ID NO: 23723 - DNA, 20 bp, Artificial Sequence
  chemically synthesized
aaactctacaagccagaaga

SEQ ID NO: 23724 - DNA, 20 bp, Artificial Sequence
  chemically synthesized
ctctacaagccagaagagag

SEQ ID NO: 23725 - DNA, 20 bp, Artificial Sequence
  chemically synthesized
tctacaagccagaagagagt

SEQ ID NO: 23726 - DNA, 20 bp, Artificial Sequence
  chemically synthesized
ctacaagccagaagagagtg

SEQ ID NO: 23727 - DNA, 20 bp, Artificial Sequence
  chemically synthesized
tacaagccagaagagagtgg

SEQ ID NO: 23728 - DNA, 20 bp, Artificial Sequence
  chemically synthesized
gccaatattcaacatcctta

SEQ ID NO: 23729 - DNA, 20 bp, Artificial Sequence
  chemically synthesized
ccaatattcaacatccttaa

SEQ ID NO: 23730 - DNA, 20 bp, Artificial Sequence
  chemically synthesized
tattcaacatccttaaagga

SEQ ID NO: 23731 - DNA, 20 bp, Artificial Sequence
  chemically synthesized
aaaggaaagaattttcaaca

SEQ ID NO: 23732 - DNA, 20 bp, Artificial Sequence
  chemically synthesized
tcaacacagaatttcatatc

SEQ ID NO: 23733 - DNA, 20 bp, Artificial Sequence
  chemically synthesized
atttcatatccagccaaact

SEQ ID NO: 23734 - DNA, 20 bp, Artificial Sequence
  chemically synthesized
ccagccaaactaagcttcat

SEQ ID NO: 23735 - DNA, 20 bp, Artificial Sequence
  chemically synthesized
caaactaagcttcataagtg

SEQ ID NO: 23736 - DNA, 20 bp, Artificial Sequence
  chemically synthesized
aaactaagcttcataagtga

SEQ ID NO: 23737 - DNA, 20 bp, Artificial Sequence
  chemically synthesized
actaagcttcataagtgaag

SEQ ID NO: 23738 - DNA, 20 bp, Artificial Sequence
  chemically synthesized
aggagaaataaaatacttta

SEQ ID NO: 23739 - DNA, 20 bp, Artificial Sequence
  chemically synthesized
aaataaaatactttacagac

SEQ ID NO: 23740 - DNA, 20 bp, Artificial Sequence
  chemically synthesized
tttacagacaagcaaatgct

SEQ ID NO: 23741 - DNA, 20 bp, Artificial Sequence
  chemically synthesized
tacagacaagcaaatgctga

SEQ ID NO: 23742 - DNA, 20 bp, Artificial Sequence
  chemically synthesized
ctgagagattttgtcatcac

SEQ ID NO: 23743 - DNA, 20 bp, Artificial Sequence
  chemically synthesized
tgagagattttgtcatcacc

SEQ ID NO: 23744 - DNA, 20 bp, Artificial Sequence
  chemically synthesized
catcaccaggcctgacctaa

SEQ ID NO: 23745 - DNA, 20 bp, Artificial Sequence
  chemically synthesized
tcaccaggcctgacctaaaa

SEQ ID NO: 23746 - DNA, 20 bp, Artificial Sequence
  chemically synthesized
ctgacctaaaagagctcctg

SEQ ID NO: 23747 - DNA, 20 bp, Artificial Sequence
  chemically synthesized
tgacctaaaagagctcctga

SEQ ID NO: 23748 - DNA, 20 bp, Artificial Sequence
  chemically synthesized
cctaaaagagctcctgaagg

SEQ ID NO: 23749 - DNA, 20 bp, Artificial Sequence
  chemically synthesized
cctgaaggaagcactaaata

SEQ ID NO: 23750 - DNA, 20 bp, Artificial Sequence
  chemically synthesized
aaggaagcactaaatatgga

SEQ ID NO: 23751 - DNA, 20 bp, Artificial Sequence
  chemically synthesized
aggaagcactaaatatggaa

SEQ ID NO: 23752 - DNA, 20 bp, Artificial Sequence
  chemically synthesized
taaatatggaaaggcacaac

SEQ ID NO: 23753 - DNA, 20 bp, Artificial Sequence
  chemically synthesized
tggaaaggcacaaccggtac

SEQ ID NO: 23754 - DNA, 20 bp, Artificial Sequence
  chemically synthesized
caaaaacatgccaaattgta

SEQ ID NO: 23755 - DNA, 20 bp, Artificial Sequence
  chemically synthesized
gccaaattgtaaagaccatt

SEQ ID NO: 23756 - DNA, 20 bp, Artificial Sequence
  chemically synthesized
ccaaattgtaaagaccattg

SEQ ID NO: 23757 - DNA, 20 bp, Artificial Sequence
  chemically synthesized
attgtaaagaccattgaggc

SEQ ID NO: 23758 - DNA, 20 bp, Artificial Sequence
  chemically synthesized
ttgtaaagaccattgaggct

SEQ ID NO: 23759 - DNA, 20 bp, Artificial Sequence
  chemically synthesized
taaagaccattgaggctagg

SEQ ID NO: 23760 - DNA, 20 bp, Artificial Sequence
  chemically synthesized
aagaaactgcatcaactaat

SEQ ID NO: 23761 - DNA, 20 bp, Artificial Sequence
  chemically synthesized
caactaatgagcaaaataac

SEQ ID NO: 23762 - DNA, 20 bp, Artificial Sequence
  chemically synthesized
accagctaacatcataatga

SEQ ID NO: 23763 - DNA, 20 bp, Artificial Sequence
  chemically synthesized
ccagctaacatcataatgac

SEQ ID NO: 23764 - DNA, 20 bp, Artificial Sequence
  chemically synthesized
aatattaaccttaatgtaaa

SEQ ID NO: 23765 - DNA, 20 bp, Artificial Sequence
  chemically synthesized
atattaaccttaatgtaaat

SEQ ID NO: 23766 - DNA, 20 bp, Artificial Sequence
  chemically synthesized
tgtaaatgggctaaatgctc

SEQ ID NO: 23767 - DNA, 20 bp, Artificial Sequence
  chemically synthesized
gggctaaatgctccagtaaa

SEQ ID NO: 23768 - DNA, 20 bp, Artificial Sequence
  chemically synthesized
aatgctccagtaaaaagaca

SEQ ID NO: 23769 - DNA, 20 bp, Artificial Sequence
  chemically synthesized
ctccagtaaaaagacacaga

SEQ ID NO: 23770 - DNA, 20 bp, Artificial Sequence
  chemically synthesized
tccagtaaaaagacacagac

SEQ ID NO: 23771 - DNA, 20 bp, Artificial Sequence
  chemically synthesized
aaagacacagacgggcaaat

SEQ ID NO: 23772 - DNA, 20 bp, Artificial Sequence
  chemically synthesized
acagacgggcaaattagata

SEQ ID NO: 23773 - DNA, 20 bp, Artificial Sequence
  chemically synthesized
agacgggcaaattagataaa

SEQ ID NO: 23774 - DNA, 20 bp, Artificial Sequence
  chemically synthesized
ggcaaattagataaagagtc

SEQ ID NO: 23775 - DNA, 20 bp, Artificial Sequence
  chemically synthesized
gataaagagtcaagacccat

SEQ ID NO: 23776 - DNA, 20 bp, Artificial Sequence
  chemically synthesized
acccatcagtgtgctgtatt

SEQ ID NO: 23777 - DNA, 20 bp, Artificial Sequence
  chemically synthesized
cccatcagtgtgctgtattc

SEQ ID NO: 23778 - DNA, 20 bp, Artificial Sequence
  chemically synthesized
ctcatgtgcacacacacaca

SEQ ID NO: 23779 - DNA, 20 bp, Artificial Sequence
  chemically synthesized
tcatgtgcacacacacacat

SEQ ID NO: 23780 - DNA, 20 bp, Artificial Sequence
  chemically synthesized
acacacataggctcaaaata

SEQ ID NO: 23781 - DNA, 20 bp, Artificial Sequence
  chemically synthesized
cacacataggctcaaaataa

SEQ ID NO: 23782 - DNA, 20 bp, Artificial Sequence
  chemically synthesized
acacataggctcaaaataaa

SEQ ID NO: 23783 - DNA, 20 bp, Artificial Sequence
  chemically synthesized
ataggctcaaaataaaggga

SEQ ID NO: 23784 - DNA, 20 bp, Artificial Sequence
  chemically synthesized
aggctcaaaataaagggatg

SEQ ID NO: 23785 - DNA, 20 bp, Artificial Sequence
  chemically synthesized
ggctcaaaataaagggatgg

SEQ ID NO: 23786 - DNA, 20 bp, Artificial Sequence
  chemically synthesized
tcaaaataaagggatggagg

SEQ ID NO: 23787 - DNA, 20 bp, Artificial Sequence
  chemically synthesized
gggatggaggaagatctacc

SEQ ID NO: 23788 - DNA, 20 bp, Artificial Sequence
  chemically synthesized
aggaagatctaccaagaaaa

SEQ ID NO: 23789 - DNA, 20 bp, Artificial Sequence
  chemically synthesized
aagaaaatggaaaacaaaaa

SEQ ID NO: 23790 - DNA, 20 bp, Artificial Sequence
  chemically synthesized
agaaaatggaaaacaaaaaa

SEQ ID NO: 23791 - DNA, 20 bp, Artificial Sequence
  chemically synthesized
aaatggaaaacaaaaaaagg

SEQ ID NO: 23792 - DNA, 20 bp, Artificial Sequence
  chemically synthesized
aatggaaaacaaaaaaaggc

SEQ ID NO: 23793 - DNA, 20 bp, Artificial Sequence
  chemically synthesized
atggaaaacaaaaaaaggca

SEQ ID NO: 23794 - DNA, 20 bp, Artificial Sequence
  chemically synthesized
tggaaaacaaaaaaaggcag

SEQ ID NO: 23795 - DNA, 20 bp, Artificial Sequence
  chemically synthesized
aatcctcatctctgataaaa

SEQ ID NO: 23796 - DNA, 20 bp, Artificial Sequence
  chemically synthesized
atcctcatctctgataaaac

SEQ ID NO: 23797 - DNA, 20 bp, Artificial Sequence
  chemically synthesized
aaacaggctttaaaccaaca

SEQ ID NO: 23798 - DNA, 20 bp, Artificial Sequence
  chemically synthesized
tttaaaccaacaaagatcaa

SEQ ID NO: 23799 - DNA, 20 bp, Artificial Sequence
  chemically synthesized
taaaccaacaaagatcaaaa

SEQ ID NO: 23800 - DNA, 20 bp, Artificial Sequence
  chemically synthesized
aacaaagatcaaaagagaca

SEQ ID NO: 23801 - DNA, 20 bp, Artificial Sequence
  chemically synthesized
aaagatcaaaagagacaaag

SEQ ID NO: 23802 - DNA, 20 bp, Artificial Sequence
  chemically synthesized
aagatcaaaagagacaaaga

SEQ ID NO: 23803 - DNA, 20 bp, Artificial Sequence
  chemically synthesized
caaagaaggccattacataa

SEQ ID NO: 23804 - DNA, 20 bp, Artificial Sequence
  chemically synthesized
aaggccattacataatggta

SEQ ID NO: 23805 - DNA, 20 bp, Artificial Sequence
  chemically synthesized
aggccattacataatggtaa

SEQ ID NO: 23806 - DNA, 20 bp, Artificial Sequence
  chemically synthesized
ggccattacataatggtaaa

SEQ ID NO: 23807 - DNA, 20 bp, Artificial Sequence
  chemically synthesized
ggtaaagggatcaattcaac

SEQ ID NO: 23808 - DNA, 20 bp, Artificial Sequence
  chemically synthesized
aaagggatcaattcaacaag

SEQ ID NO: 23809 - DNA, 20 bp, Artificial Sequence
  chemically synthesized
agggatcaattcaacaagaa

SEQ ID NO: 23810 - DNA, 20 bp, Artificial Sequence
  chemically synthesized
aaacatatatgcacccaata

SEQ ID NO: 23811 - DNA, 20 bp, Artificial Sequence
  chemically synthesized
aacatatatgcacccaatac

SEQ ID NO: 23812 - DNA, 20 bp, Artificial Sequence
  chemically synthesized
gcacccaatacaggaacacc

SEQ ID NO: 23813 - DNA, 20 bp, Artificial Sequence
  chemically synthesized
cacccaatacaggaacaccc

SEQ ID NO: 23814 - DNA, 20 bp, Artificial Sequence
  chemically synthesized
caggaacacccaggttcata

SEQ ID NO: 23815 - DNA, 20 bp, Artificial Sequence
  chemically synthesized
aacacccaggttcataaagc

SEQ ID NO: 23816 - DNA, 20 bp, Artificial Sequence
  chemically synthesized
aggttcataaagcaagtcct

SEQ ID NO: 23817 - DNA, 20 bp, Artificial Sequence
  chemically synthesized
gttcataaagcaagtcctta

SEQ ID NO: 23818 - DNA, 20 bp, Artificial Sequence
  chemically synthesized
caagtccttagagacctaca

SEQ ID NO: 23819 - DNA, 20 bp, Artificial Sequence
  chemically synthesized
agtccttagagacctacaaa

SEQ ID NO: 23820 - DNA, 20 bp, Artificial Sequence
  chemically synthesized
tagagacctacaaagagact

SEQ ID NO: 23821 - DNA, 20 bp, Artificial Sequence
  chemically synthesized
agactctcacacaataacaa

SEQ ID NO: 23822 - DNA, 20 bp, Artificial Sequence
  chemically synthesized
gactctcacacaataacaat

SEQ ID NO: 23823 - DNA, 20 bp, Artificial Sequence
  chemically synthesized
ctctcacacaataacaatgg

SEQ ID NO: 23824 - DNA, 20 bp, Artificial Sequence
  chemically synthesized
taacaccccactgtcaacat

SEQ ID NO: 23825 - DNA, 20 bp, Artificial Sequence
  chemically synthesized
accccactgtcaacattaga

SEQ ID NO: 23826 - DNA, 20 bp, Artificial Sequence
  chemically synthesized
aacattagacagatcaacat

SEQ ID NO: 23827 - DNA, 20 bp, Artificial Sequence
  chemically synthesized
ttagacagatcaacattaga

SEQ ID NO: 23828 - DNA, 20 bp, Artificial Sequence
  chemically synthesized
tcaacattagacagatcaac

SEQ ID NO: 23829 - DNA, 20 bp, Artificial Sequence
  chemically synthesized
cattagacagatcaacgaga

SEQ ID NO: 23830 - DNA, 20 bp, Artificial Sequence
  chemically synthesized
agacagatcaacgagacaga

SEQ ID NO: 23831 - DNA, 20 bp, Artificial Sequence
  chemically synthesized
caacgagacagaaagttaac

SEQ ID NO: 23832 - DNA, 20 bp, Artificial Sequence
  chemically synthesized
aacgagacagaaagttaaca

SEQ ID NO: 23833 - DNA, 20 bp, Artificial Sequence
  chemically synthesized
agaaagttaacaaggatatc

SEQ ID NO: 23834 - DNA, 20 bp, Artificial Sequence
  chemically synthesized
gaaagttaacaaggatatcc

SEQ ID NO: 23835 - DNA, 20 bp, Artificial Sequence
  chemically synthesized
ggatatccaggaattgaact

SEQ ID NO: 23836 - DNA, 20 bp, Artificial Sequence
  chemically synthesized
attgaactcagctctgcacc

SEQ ID NO: 23837 - DNA, 20 bp, Artificial Sequence
  chemically synthesized
gaactcagctctgcaccaag

SEQ ID NO: 23838 - DNA, 20 bp, Artificial Sequence
  chemically synthesized
tctgcaccaagcggacctaa

SEQ ID NO: 23839 - DNA, 20 bp, Artificial Sequence
  chemically synthesized
gcggacctaatagacatcta

SEQ ID NO: 23840 - DNA, 20 bp, Artificial Sequence
  chemically synthesized
aactctccaccccaaatcaa

SEQ ID NO: 23841 - DNA, 20 bp, Artificial Sequence
  chemically synthesized
aacagaatatacattctttt

SEQ ID NO: 23842 - DNA, 20 bp, Artificial Sequence
  chemically synthesized
ctattccaaaattgaccaca

SEQ ID NO: 23843 - DNA, 20 bp, Artificial Sequence
  chemically synthesized
tccaaaattgaccacatagt

SEQ ID NO: 23844 - DNA, 20 bp, Artificial Sequence
  chemically synthesized
aaaattgaccacatagttgg

SEQ ID NO: 23845 - DNA, 20 bp, Artificial Sequence
  chemically synthesized
tgaccacatagttggaagta

SEQ ID NO: 23846 - DNA, 20 bp, Artificial Sequence
  chemically synthesized
gttggaagtaaagcactcct

SEQ ID NO: 23847 - DNA, 20 bp, Artificial Sequence
  chemically synthesized
gcactcctcagcaaatgtaa

SEQ ID NO: 23848 - DNA, 20 bp, Artificial Sequence
  chemically synthesized
cctcagcaaatgtaaaagaa

SEQ ID NO: 23849 - DNA, 20 bp, Artificial Sequence
  chemically synthesized
aattataacaaactgtctct

SEQ ID NO: 23850 - DNA, 20 bp, Artificial Sequence
  chemically synthesized
acaaactgtctctcagacca

SEQ ID NO: 23851 - DNA, 20 bp, Artificial Sequence
  chemically synthesized
agaccacagtgcaatcaaac

SEQ ID NO: 23852 - DNA, 20 bp, Artificial Sequence
  chemically synthesized
agtgcaatcaaactagaact

SEQ ID NO: 23853 - DNA, 20 bp, Artificial Sequence
  chemically synthesized
gtgcaatcaaactagaactc

SEQ ID NO: 23854 - DNA, 20 bp, Artificial Sequence
  chemically synthesized
tcaaactagaactcaggatt

SEQ ID NO: 23855 - DNA, 20 bp, Artificial Sequence
  chemically synthesized
ctcaaaaccgctcaactaca

SEQ ID NO: 23856 - DNA, 20 bp, Artificial Sequence
  chemically synthesized
aattgctcctgaatgactac

SEQ ID NO: 23857 - DNA, 20 bp, Artificial Sequence
  chemically synthesized
attgctcctgaatgactact

SEQ ID NO: 23858 - DNA, 20 bp, Artificial Sequence
  chemically synthesized
actgggttcataacaaaatg

SEQ ID NO: 23859 - DNA, 20 bp, Artificial Sequence
  chemically synthesized
ctgggttcataacaaaatga

SEQ ID NO: 23860 - DNA, 20 bp, Artificial Sequence
  chemically synthesized
ggttcataacaaaatgaagg

SEQ ID NO: 23861 - DNA, 20 bp, Artificial Sequence
  chemically synthesized
gcagaaataaaaatgttctt

SEQ ID NO: 23862 - DNA, 20 bp, Artificial Sequence
  chemically synthesized
aaaaatgttctttggaacca

SEQ ID NO: 23863 - DNA, 20 bp, Artificial Sequence
  chemically synthesized
aaatgttctttggaaccaaa

SEQ ID NO: 23864 - DNA, 20 bp, Artificial Sequence
  chemically synthesized
ctttggaaccaaagagaaca

SEQ ID NO: 23865 - DNA, 20 bp, Artificial Sequence
  chemically synthesized
agaacaaagacacaacatac

SEQ ID NO: 23866 - DNA, 20 bp, Artificial Sequence
  chemically synthesized
acacaacataccagaatctc

SEQ ID NO: 23867 - DNA, 20 bp, Artificial Sequence
  chemically synthesized
cacaacataccagaatctct

SEQ ID NO: 23868 - DNA, 20 bp, Artificial Sequence
  chemically synthesized
gaatctctgggacacattca

SEQ ID NO: 23869 - DNA, 20 bp, Artificial Sequence
  chemically synthesized
tctctgggacacattcaaag

SEQ ID NO: 23870 - DNA, 20 bp, Artificial Sequence
  chemically synthesized
gacacattcaaagcagtgtg

SEQ ID NO: 23871 - DNA, 20 bp, Artificial Sequence
  chemically synthesized
cacattcaaagcagtgtgta

SEQ ID NO: 23872 - DNA, 20 bp, Artificial Sequence
  chemically synthesized
acattcaaagcagtgtgtag

SEQ ID NO: 23873 - DNA, 20 bp, Artificial Sequence
  chemically synthesized
cattcaaagcagtgtgtaga

SEQ ID NO: 23874 - DNA, 20 bp, Artificial Sequence
  chemically synthesized
agtgtgtagagggaaattta

SEQ ID NO: 23875 - DNA, 20 bp, Artificial Sequence
  chemically synthesized
aatttatagcactaaacgcc

SEQ ID NO: 23876 - DNA, 20 bp, Artificial Sequence
  chemically synthesized
ttatagcactaaacgcccag

SEQ ID NO: 23877 - DNA, 20 bp, Artificial Sequence
  chemically synthesized
atagcactaaacgcccagaa

SEQ ID NO: 23878 - DNA, 20 bp, Artificial Sequence
  chemically synthesized
cactaaacgcccagaagaga

SEQ ID NO: 23879 - DNA, 20 bp, Artificial Sequence
  chemically synthesized
taaacgcccagaagagaaag

SEQ ID NO: 23880 - DNA, 20 bp, Artificial Sequence
  chemically synthesized
aaacgcccagaagagaaagc

SEQ ID NO: 23881 - DNA, 20 bp, Artificial Sequence
  chemically synthesized
gcccagaagagaaagcagga

SEQ ID NO: 23882 - DNA, 20 bp, Artificial Sequence
  chemically synthesized
caccctaacatcacaattaa

SEQ ID NO: 23883 - DNA, 20 bp, Artificial Sequence
  chemically synthesized
aacatcacaattaaaagaac

SEQ ID NO: 23884 - DNA, 20 bp, Artificial Sequence
  chemically synthesized
catcacaattaaaagaacta

SEQ ID NO: 23885 - DNA, 20 bp, Artificial Sequence
  chemically synthesized
cacaattaaaagaactagag

SEQ ID NO: 23886 - DNA, 20 bp, Artificial Sequence
  chemically synthesized
attaaaagaactagagaagc

SEQ ID NO: 23887 - DNA, 20 bp, Artificial Sequence
  chemically synthesized
taaaagaactagagaagcaa

SEQ ID NO: 23888 - DNA, 20 bp, Artificial Sequence
  chemically synthesized
gagcaaacacattcaaatgc

SEQ ID NO: 23889 - DNA, 20 bp, Artificial Sequence
  chemically synthesized
caaacacattcaaatgctag

SEQ ID NO: 23890 - DNA, 20 bp, Artificial Sequence
  chemically synthesized
acacattcaaatgctagcag

SEQ ID NO: 23891 - DNA, 20 bp, Artificial Sequence
  chemically synthesized
cacattcaaatgctagcaga

SEQ ID NO: 23892 - DNA, 20 bp, Artificial Sequence
  chemically synthesized
ttcaaatgctagcagaaggc

SEQ ID NO: 23893 - DNA, 20 bp, Artificial Sequence
  chemically synthesized
aggcaagaaataactaaaat

SEQ ID NO: 23894 - DNA, 20 bp, Artificial Sequence
  chemically synthesized
gcaagaaataactaaaatca

SEQ ID NO: 23895 - DNA, 20 bp, Artificial Sequence
  chemically synthesized
agaaataactaaaatcagag

SEQ ID NO: 23896 - DNA, 20 bp, Artificial Sequence
  chemically synthesized
ctaaaatcagagcagaactg

SEQ ID NO: 23897 - DNA, 20 bp, Artificial Sequence
  chemically synthesized
taaaatcagagcagaactga

SEQ ID NO: 23898 - DNA, 20 bp, Artificial Sequence
  chemically synthesized
cagagcagaactgaaggaaa

SEQ ID NO: 23899 - DNA, 20 bp, Artificial Sequence
  chemically synthesized
gagcagaactgaaggaaata

SEQ ID NO: 23900 - DNA, 20 bp, Artificial Sequence
  chemically synthesized
cttcaaaaaatcaatgaatc

SEQ ID NO: 23901 - DNA, 20 bp, Artificial Sequence
  chemically synthesized
caaaaaatcaatgaatccag

SEQ ID NO: 23902 - DNA, 20 bp, Artificial Sequence
  chemically synthesized
aaatcaatgaatccagaagc

SEQ ID NO: 23903 - DNA, 20 bp, Artificial Sequence
  chemically synthesized
ccagaagctggtttttcaaa

SEQ ID NO: 23904 - DNA, 20 bp, Artificial Sequence
  chemically synthesized
aaaaagatcaacaaaattga

SEQ ID NO: 23905 - DNA, 20 bp, Artificial Sequence
  chemically synthesized
caacaaaattgatagactgc

SEQ ID NO: 23906 - DNA, 20 bp, Artificial Sequence
  chemically synthesized
aaaattgatagactgctagc

SEQ ID NO: 23907 - DNA, 20 bp, Artificial Sequence
  chemically synthesized
gactgctagcaagactaata

SEQ ID NO: 23908 - DNA, 20 bp, Artificial Sequence
  chemically synthesized
tgctagcaagactaataaag

SEQ ID NO: 23909 - DNA, 20 bp, Artificial Sequence
  chemically synthesized
gcaagactaataaagaagaa

SEQ ID NO: 23910 - DNA, 20 bp, Artificial Sequence
  chemically synthesized
aagactaataaagaagaaaa

SEQ ID NO: 23911 - DNA, 20 bp, Artificial Sequence
  chemically synthesized
gactaataaagaagaaaaga

SEQ ID NO: 23912 - DNA, 20 bp, Artificial Sequence
  chemically synthesized
taataaagaagaaaagagag

SEQ ID NO: 23913 - DNA, 20 bp, Artificial Sequence
  chemically synthesized
gaaaagagagaagaatcaaa

SEQ ID NO: 23914 - DNA, 20 bp, Artificial Sequence
  chemically synthesized
agatgcaataaaaaatgata

SEQ ID NO: 23915 - DNA, 20 bp, Artificial Sequence
  chemically synthesized
gatgcaataaaaaatgataa

SEQ ID NO: 23916 - DNA, 20 bp, Artificial Sequence
  chemically synthesized
atgcaataaaaaatgataaa

SEQ ID NO: 23917 - DNA, 20 bp, Artificial Sequence
  chemically synthesized
gtatatcaccaccgatccca

SEQ ID NO: 23918 - DNA, 20 bp, Artificial Sequence
  chemically synthesized
acagaaatacaaaccaccat

SEQ ID NO: 23919 - DNA, 20 bp, Artificial Sequence
  chemically synthesized
agaaatacaaaccaccatca

SEQ ID NO: 23920 - DNA, 20 bp, Artificial Sequence
  chemically synthesized
acacctctacacaaataaac

SEQ ID NO: 23921 - DNA, 20 bp, Artificial Sequence
  chemically synthesized
cacaaataaactagaaaatc

SEQ ID NO: 23922 - DNA, 20 bp, Artificial Sequence
  chemically synthesized
aaataaactagaaaatctag

SEQ ID NO: 23923 - DNA, 20 bp, Artificial Sequence
  chemically synthesized
actagaaaatctagaagaaa

SEQ ID NO: 23924 - DNA, 20 bp, Artificial Sequence
  chemically synthesized
cttgacacatacaccctccc

SEQ ID NO: 23925 - DNA, 20 bp, Artificial Sequence
  chemically synthesized
acaccctcccaagactaaac

SEQ ID NO: 23926 - DNA, 20 bp, Artificial Sequence
  chemically synthesized
caccctcccaagactaaacc

SEQ ID NO: 23927 - DNA, 20 bp, Artificial Sequence
  chemically synthesized
cctcccaagactaaaccagg

SEQ ID NO: 23928 - DNA, 20 bp, Artificial Sequence
  chemically synthesized
cccaagactaaaccaggaag

SEQ ID NO: 23929 - DNA, 20 bp, Artificial Sequence
  chemically synthesized
gaagaagttgaatctctgaa

SEQ ID NO: 23930 - DNA, 20 bp, Artificial Sequence
  chemically synthesized
atctctgaatagaccaataa

SEQ ID NO: 23931 - DNA, 20 bp, Artificial Sequence
  chemically synthesized
tctctgaatagaccaataac

SEQ ID NO: 23932 - DNA, 20 bp, Artificial Sequence
  chemically synthesized
caataacaggatctgaaatt

SEQ ID NO: 23933 - DNA, 20 bp, Artificial Sequence
  chemically synthesized
aataacaggatctgaaattg

SEQ ID NO: 23934 - DNA, 20 bp, Artificial Sequence
  chemically synthesized
gaaattgaggcaataattaa

SEQ ID NO: 23935 - DNA, 20 bp, Artificial Sequence
  chemically synthesized
aatagcttaccaaccaaaaa

SEQ ID NO: 23936 - DNA, 20 bp, Artificial Sequence
  chemically synthesized
cttaccaaccaaaaacagtc

SEQ ID NO: 23937 - DNA, 20 bp, Artificial Sequence
  chemically synthesized
ttaccaaccaaaaacagtcc

SEQ ID NO: 23938 - DNA, 20 bp, Artificial Sequence
  chemically synthesized
aaccaaaaacagtccaggac

SEQ ID NO: 23939 - DNA, 20 bp, Artificial Sequence
  chemically synthesized
aaaaacagtccaggaccaga

SEQ ID NO: 23940 - DNA, 20 bp, Artificial Sequence
  chemically synthesized
aaacagtccaggaccagatg

SEQ ID NO: 23941 - DNA, 20 bp, Artificial Sequence
  chemically synthesized
tccaggaccagatggagtca

SEQ ID NO: 23942 - DNA, 20 bp, Artificial Sequence
  chemically synthesized
gagtcacagccaaattctac

SEQ ID NO: 23943 - DNA, 20 bp, Artificial Sequence
  chemically synthesized
gtcacagccaaattctacca

SEQ ID NO: 23944 - DNA, 20 bp, Artificial Sequence
  chemically synthesized
tcacagccaaattctaccag

SEQ ID NO: 23945 - DNA, 20 bp, Artificial Sequence
  chemically synthesized
ccaaattctaccagaggtac

SEQ ID NO: 23946 - DNA, 20 bp, Artificial Sequence
  chemically synthesized
caaattctaccagaggtaca

SEQ ID NO: 23947 - DNA, 20 bp, Artificial Sequence
  chemically synthesized
aattctaccagaggtacaag

SEQ ID NO: 23948 - DNA, 20 bp, Artificial Sequence
  chemically synthesized
attctaccagaggtacaagg

SEQ ID NO: 23949 - DNA, 20 bp, Artificial Sequence
  chemically synthesized
tctaccagaggtacaaggag

SEQ ID NO: 23950 - DNA, 20 bp, Artificial Sequence
  chemically synthesized
ccagaggtacaaggaggagc

SEQ ID NO: 23951 - DNA, 20 bp, Artificial Sequence
  chemically synthesized
tctgaaactattcgaatcaa

SEQ ID NO: 23952 - DNA, 20 bp, Artificial Sequence
  chemically synthesized
actattcgaatcaatagtaa

SEQ ID NO: 23953 - DNA, 20 bp, Artificial Sequence
  chemically synthesized
tattcgaatcaatagtaaaa

SEQ ID NO: 23954 - DNA, 20 bp, Artificial Sequence
  chemically synthesized
attcgaatcaatagtaaaag

SEQ ID NO: 23955 - DNA, 20 bp, Artificial Sequence
  chemically synthesized
ttcgaatcaatagtaaaaga

SEQ ID NO: 23956 - DNA, 20 bp, Artificial Sequence
  chemically synthesized
tcctccctaactcattttat

SEQ ID NO: 23957 - DNA, 20 bp, Artificial Sequence
  chemically synthesized
cctccctaactcattttatg

SEQ ID NO: 23958 - DNA, 20 bp, Artificial Sequence
  chemically synthesized
cctaactcattttatgaggc

SEQ ID NO: 23959 - DNA, 20 bp, Artificial Sequence
  chemically synthesized
ccagcatcatcctgatacca

SEQ ID NO: 23960 - DNA, 20 bp, Artificial Sequence
  chemically synthesized
catcatcctgataccaaagc

SEQ ID NO: 23961 - DNA, 20 bp, Artificial Sequence
  chemically synthesized
atcatcctgataccaaagcc

SEQ ID NO: 23962 - DNA, 20 bp, Artificial Sequence
  chemically synthesized
atcctgataccaaagccggg

SEQ ID NO: 23963 - DNA, 20 bp, Artificial Sequence
  chemically synthesized
cctgataccaaagccgggca

SEQ ID NO: 23964 - DNA, 20 bp, Artificial Sequence
  chemically synthesized
gggcagagacacaacaaaaa

SEQ ID NO: 23965 - DNA, 20 bp, Artificial Sequence
  chemically synthesized
gcagagacacaacaaaaaaa

SEQ ID NO: 23966 - DNA, 20 bp, Artificial Sequence
  chemically synthesized
acaacaaaaaaagagaattt

SEQ ID NO: 23967 - DNA, 20 bp, Artificial Sequence
  chemically synthesized
ttttagaccaatatccctga

SEQ ID NO: 23968 - DNA, 20 bp, Artificial Sequence
  chemically synthesized
aaaaaacctcaataaaatac

SEQ ID NO: 23969 - DNA, 20 bp, Artificial Sequence
  chemically synthesized
acctcaataaaatactggca

SEQ ID NO: 23970 - DNA, 20 bp, Artificial Sequence
  chemically synthesized
aaatactggcaaagcaaatc

SEQ ID NO: 23971 - DNA, 20 bp, Artificial Sequence
  chemically synthesized
tactggcaaagcaaatccag

SEQ ID NO: 23972 - DNA, 20 bp, Artificial Sequence
  chemically synthesized
aaatccagcagcacatccaa

SEQ ID NO: 23973 - DNA, 20 bp, Artificial Sequence
  chemically synthesized
aaagcttatccaccatgatc

SEQ ID NO: 23974 - DNA, 20 bp, Artificial Sequence
  chemically synthesized
gcttatccaccatgatcaag

SEQ ID NO: 23975 - DNA, 20 bp, Artificial Sequence
  chemically synthesized
cttatccaccatgatcaagt

SEQ ID NO: 23976 - DNA, 20 bp, Artificial Sequence
  chemically synthesized
gatcaagtgggcttcatccc

SEQ ID NO: 23977 - DNA, 20 bp, Artificial Sequence
  chemically synthesized
atcaagtgggcttcatccct

SEQ ID NO: 23978 - DNA, 20 bp, Artificial Sequence
  chemically synthesized
gggcttcatccctgggatgc

SEQ ID NO: 23979 - DNA, 20 bp, Artificial Sequence
  chemically synthesized
ggcttcatccctgggatgca

SEQ ID NO: 23980 - DNA, 20 bp, Artificial Sequence
  chemically synthesized
tcatccctgggatgcaaggc

SEQ ID NO: 23981 - DNA, 20 bp, Artificial Sequence
  chemically synthesized
gcaaatcaataaatgtaatc

SEQ ID NO: 23982 - DNA, 20 bp, Artificial Sequence
  chemically synthesized
aatgtaatccagcatataaa

SEQ ID NO: 23983 - DNA, 20 bp, Artificial Sequence
  chemically synthesized
ccagcatataaacagaacca

SEQ ID NO: 23984 - DNA, 20 bp, Artificial Sequence
  chemically synthesized
aaaccacatgattatctcaa

SEQ ID NO: 23985 - DNA, 20 bp, Artificial Sequence
  chemically synthesized
catgattatctcaatagatg

SEQ ID NO: 23986 - DNA, 20 bp, Artificial Sequence
  chemically synthesized
ttatctcaatagatgcagaa

SEQ ID NO: 23987 - DNA, 20 bp, Artificial Sequence
  chemically synthesized
tatctcaatagatgcagaaa

SEQ ID NO: 23988 - DNA, 20 bp, Artificial Sequence
  chemically synthesized
gctaaaaactctcaataaat

SEQ ID NO: 23989 - DNA, 20 bp, Artificial Sequence
  chemically synthesized
ctaaaaactctcaataaatt

SEQ ID NO: 23990 - DNA, 20 bp, Artificial Sequence
  chemically synthesized
ctcaataaattaggtattga

SEQ ID NO: 23991 - DNA, 20 bp, Artificial Sequence
  chemically synthesized
tcaataaattaggtattgat

SEQ ID NO: 23992 - DNA, 20 bp, Artificial Sequence
  chemically synthesized
gggacgtatctcaaaataat

SEQ ID NO: 23993 - DNA, 20 bp, Artificial Sequence
  chemically synthesized
gacgtatctcaaaataataa

SEQ ID NO: 23994 - DNA, 20 bp, Artificial Sequence
  chemically synthesized
agccatctatgacaaaccca

SEQ ID NO: 23995 - DNA, 20 bp, Artificial Sequence
  chemically synthesized
acagccaatatcatactgaa

SEQ ID NO: 23996 - DNA, 20 bp, Artificial Sequence
  chemically synthesized
catactgaatggacaaaaac

SEQ ID NO: 23997 - DNA, 20 bp, Artificial Sequence
  chemically synthesized
actgaatggacaaaaactgg

SEQ ID NO: 23998 - DNA, 20 bp, Artificial Sequence
  chemically synthesized
gaagcattccctttgaaaac

SEQ ID NO: 23999 - DNA, 20 bp, Artificial Sequence
  chemically synthesized
ttccctttgaaaactggcac

SEQ ID NO: 24000 - DNA, 20 bp, Artificial Sequence
  chemically synthesized
ctttgaaaactggcacaaga

SEQ ID NO: 24001 - DNA, 20 bp, Artificial Sequence
  chemically synthesized
tttgaaaactggcacaagac

SEQ ID NO: 24002 - DNA, 20 bp, Artificial Sequence
  chemically synthesized
ttgaaaactggcacaagaca

SEQ ID NO: 24003 - DNA, 20 bp, Artificial Sequence
  chemically synthesized
ctcactactcctattcaaca

SEQ ID NO: 24004 - DNA, 20 bp, Artificial Sequence
  chemically synthesized
actcctattcaacatagtgt

SEQ ID NO: 24005 - DNA, 20 bp, Artificial Sequence
  chemically synthesized
caacatagtgttggaatttc

SEQ ID NO: 24006 - DNA, 20 bp, Artificial Sequence
  chemically synthesized
atagtgttggaatttctggc

SEQ ID NO: 24007 - DNA, 20 bp, Artificial Sequence
  chemically synthesized
tagtgttggaatttctggcc

SEQ ID NO: 24008 - DNA, 20 bp, Artificial Sequence
  chemically synthesized
agtgttggaatttctggcca

SEQ ID NO: 24009 - DNA, 20 bp, Artificial Sequence
  chemically synthesized
gaatttctggccagggcaat

SEQ ID NO: 24010 - DNA, 20 bp, Artificial Sequence
  chemically synthesized
aatttctggccagggcaatt

SEQ ID NO: 24011 - DNA, 20 bp, Artificial Sequence
  chemically synthesized
ttctggccagggcaattagg

SEQ ID NO: 24012 - DNA, 20 bp, Artificial Sequence
  chemically synthesized
tctggccagggcaattaggc

SEQ ID NO: 24013 - DNA, 20 bp, Artificial Sequence
  chemically synthesized
tggccagggcaattaggcag

SEQ ID NO: 24014 - DNA, 20 bp, Artificial Sequence
  chemically synthesized
ccagggcaattaggcaggag

SEQ ID NO: 24015 - DNA, 20 bp, Artificial Sequence
  chemically synthesized
cagggcaattaggcaggaga

SEQ ID NO: 24016 - DNA, 20 bp, Artificial Sequence
  chemically synthesized
ttaggcaggagaaggaaaaa

SEQ ID NO: 24017 - DNA, 20 bp, Artificial Sequence
  chemically synthesized
taggcaggagaaggaaaaaa

SEQ ID NO: 24018 - DNA, 20 bp, Artificial Sequence
  chemically synthesized
aggaaaaaaaggtattcaat

SEQ ID NO: 24019 - DNA, 20 bp, Artificial Sequence
  chemically synthesized
ggaaaaaaaggtattcaatt

SEQ ID NO: 24020 - DNA, 20 bp, Artificial Sequence
  chemically synthesized
aaaaggtattcaattaggaa

SEQ ID NO: 24021 - DNA, 20 bp, Artificial Sequence
  chemically synthesized
aaggtattcaattaggaaaa

SEQ ID NO: 24022 - DNA, 20 bp, Artificial Sequence
  chemically synthesized
aggtattcaattaggaaaag

SEQ ID NO: 24023 - DNA, 20 bp, Artificial Sequence
  chemically synthesized
tattcaattaggaaaagagg

SEQ ID NO: 24024 - DNA, 20 bp, Artificial Sequence
  chemically synthesized
agtcaaattgtccctgtttg

SEQ ID NO: 24025 - DNA, 20 bp, Artificial Sequence
  chemically synthesized
agatgacacgattgtatatc

SEQ ID NO: 24026 - DNA, 20 bp, Artificial Sequence
  chemically synthesized
tctagaaaaccccactgtct

SEQ ID NO: 24027 - DNA, 20 bp, Artificial Sequence
  chemically synthesized
ccaaaatgtccttaaactga

SEQ ID NO: 24028 - DNA, 20 bp, Artificial Sequence
  chemically synthesized
caaaatgtccttaaactgat

SEQ ID NO: 24029 - DNA, 20 bp, Artificial Sequence
  chemically synthesized
cttaaactgataggcaactt

SEQ ID NO: 24030 - DNA, 20 bp, Artificial Sequence
  chemically synthesized
actgataggcaacttcagca

SEQ ID NO: 24031 - DNA, 20 bp, Artificial Sequence
  chemically synthesized
aggcaacttcagcaaagtct

SEQ ID NO: 24032 - DNA, 20 bp, Artificial Sequence
  chemically synthesized
ggcaacttcagcaaagtctc

SEQ ID NO: 24033 - DNA, 20 bp, Artificial Sequence
  chemically synthesized
aatcaatgtgcaaaaatcac

SEQ ID NO: 24034 - DNA, 20 bp, Artificial Sequence
  chemically synthesized
gcattcttatacaccaataa

SEQ ID NO: 24035 - DNA, 20 bp, Artificial Sequence
  chemically synthesized
atacaccaataacagacaaa

SEQ ID NO: 24036 - DNA, 20 bp, Artificial Sequence
  chemically synthesized
acaccaataacagacaaaca

SEQ ID NO: 24037 - DNA, 20 bp, Artificial Sequence
  chemically synthesized
accaataacagacaaacaga

SEQ ID NO: 24038 - DNA, 20 bp, Artificial Sequence
  chemically synthesized
caaacagagagccaaatcat

SEQ ID NO: 24039 - DNA, 20 bp, Artificial Sequence
  chemically synthesized
aaacagagagccaaatcatg

SEQ ID NO: 24040 - DNA, 20 bp, Artificial Sequence
  chemically synthesized
aacagagagccaaatcatga

SEQ ID NO: 24041 - DNA, 20 bp, Artificial Sequence
  chemically synthesized
tcccattcacaattgcttca

SEQ ID NO: 24042 - DNA, 20 bp, Artificial Sequence
  chemically synthesized
ccattcacaattgcttcaaa

SEQ ID NO: 24043 - DNA, 20 bp, Artificial Sequence
  chemically synthesized
ttcaaagagaataaaatacc

SEQ ID NO: 24044 - DNA, 20 bp, Artificial Sequence
  chemically synthesized
tcaaagagaataaaatacct

SEQ ID NO: 24045 - DNA, 20 bp, Artificial Sequence
  chemically synthesized
tacctaggaatccaacttac

SEQ ID NO: 24046 - DNA, 20 bp, Artificial Sequence
  chemically synthesized
cctaggaatccaacttacaa

SEQ ID NO: 24047 - DNA, 20 bp, Artificial Sequence
  chemically synthesized
taggaatccaacttacaaga

SEQ ID NO: 24048 - DNA, 20 bp, Artificial Sequence
  chemically synthesized
aggaatccaacttacaagag

SEQ ID NO: 24049 - DNA, 20 bp, Artificial Sequence
  chemically synthesized
tccaacttacaagagaggtg

SEQ ID NO: 24050 - DNA, 20 bp, Artificial Sequence
  chemically synthesized
ccaacttacaagagaggtga

SEQ ID NO: 24051 - DNA, 20 bp, Artificial Sequence
  chemically synthesized
gagaggtgaaggacctcttc

SEQ ID NO: 24052 - DNA, 20 bp, Artificial Sequence
  chemically synthesized
agaggtgaaggacctcttca

SEQ ID NO: 24053 - DNA, 20 bp, Artificial Sequence
  chemically synthesized
aggtgaaggacctcttcaag

SEQ ID NO: 24054 - DNA, 20 bp, Artificial Sequence
  chemically synthesized
accactgctgaatgaaataa

SEQ ID NO: 24055 - DNA, 20 bp, Artificial Sequence
  chemically synthesized
actgctgaatgaaataaaag

SEQ ID NO: 24056 - DNA, 20 bp, Artificial Sequence
  chemically synthesized
taaaagaagatacaaacaaa

SEQ ID NO: 24057 - DNA, 20 bp, Artificial Sequence
  chemically synthesized
aagaagatacaaacaaatgg

SEQ ID NO: 24058 - DNA, 20 bp, Artificial Sequence
  chemically synthesized
ggaagaacattccatgctca

SEQ ID NO: 24059 - DNA, 20 bp, Artificial Sequence
  chemically synthesized
gaagaacattccatgctcat

SEQ ID NO: 24060 - DNA, 20 bp, Artificial Sequence
  chemically synthesized
gaacattccatgctcatggg

SEQ ID NO: 24061 - DNA, 20 bp, Artificial Sequence
  chemically synthesized
aacattccatgctcatgggt

SEQ ID NO: 24062 - DNA, 20 bp, Artificial Sequence
  chemically synthesized
attccatgctcatgggtagg

SEQ ID NO: 24063 - DNA, 20 bp, Artificial Sequence
  chemically synthesized
aagaatcaatatcatgaaaa

SEQ ID NO: 24064 - DNA, 20 bp, Artificial Sequence
  chemically synthesized
atatcatgaaaatggccata

SEQ ID NO: 24065 - DNA, 20 bp, Artificial Sequence
  chemically synthesized
tgaaaatggccatacagccc

SEQ ID NO: 24066 - DNA, 20 bp, Artificial Sequence
  chemically synthesized
gaaaatggccatacagccca

SEQ ID NO: 24067 - DNA, 20 bp, Artificial Sequence
  chemically synthesized
atacagcccaaggtaattta

SEQ ID NO: 24068 - DNA, 20 bp, Artificial Sequence
  chemically synthesized
gattcaatgccatccccatc

SEQ ID NO: 24069 - DNA, 20 bp, Artificial Sequence
  chemically synthesized
gctaccaatgactttcttca

SEQ ID NO: 24070 - DNA, 20 bp, Artificial Sequence
  chemically synthesized
aatgactttcttcacagaat

SEQ ID NO: 24071 - DNA, 20 bp, Artificial Sequence
  chemically synthesized
aattggaaaaaactacttta

SEQ ID NO: 24072 - DNA, 20 bp, Artificial Sequence
  chemically synthesized
aaactactttaaagttcata

SEQ ID NO: 24073 - DNA, 20 bp, Artificial Sequence
  chemically synthesized
aagttcatatggaaccaaaa

SEQ ID NO: 24074 - DNA, 20 bp, Artificial Sequence
  chemically synthesized
gttcatatggaaccaaaaaa

SEQ ID NO: 24075 - DNA, 20 bp, Artificial Sequence
  chemically synthesized
cacattgacatgccaatcct

SEQ ID NO: 24076 - DNA, 20 bp, Artificial Sequence
  chemically synthesized
acatgccaatcctaagccaa

SEQ ID NO: 24077 - DNA, 20 bp, Artificial Sequence
  chemically synthesized
aatcctaagccaaaagaaca

SEQ ID NO: 24078 - DNA, 20 bp, Artificial Sequence
  chemically synthesized
ctaagccaaaagaacaaagc

SEQ ID NO: 24079 - DNA, 20 bp, Artificial Sequence
  chemically synthesized
aagccaaaagaacaaagctg

SEQ ID NO: 24080 - DNA, 20 bp, Artificial Sequence
  chemically synthesized
agccaaaagaacaaagctgg

SEQ ID NO: 24081 - DNA, 20 bp, Artificial Sequence
  chemically synthesized
ctgacttcaaactatactac

SEQ ID NO: 24082 - DNA, 20 bp, Artificial Sequence
  chemically synthesized
tgacttcaaactatactaca

SEQ ID NO: 24083 - DNA, 20 bp, Artificial Sequence
  chemically synthesized
caaactatactacaaggcta

SEQ ID NO: 24084 - DNA, 20 bp, Artificial Sequence
  chemically synthesized
caaggctacagtaaccaaaa

SEQ ID NO: 24085 - DNA, 20 bp, Artificial Sequence
  chemically synthesized
ctacagtaaccaaaacagca

SEQ ID NO: 24086 - DNA, 20 bp, Artificial Sequence
  chemically synthesized
taaccaaaacagcatggtac

SEQ ID NO: 24087 - DNA, 20 bp, Artificial Sequence
  chemically synthesized
gcatggtactggtaccaaaa

SEQ ID NO: 24088 - DNA, 20 bp, Artificial Sequence
  chemically synthesized
atggtactggtaccaaaaca

SEQ ID NO: 24089 - DNA, 20 bp, Artificial Sequence
  chemically synthesized
ctggtaccaaaacagagata

SEQ ID NO: 24090 - DNA, 20 bp, Artificial Sequence
  chemically synthesized
aaaacagagatatagaccaa

SEQ ID NO: 24091 - DNA, 20 bp, Artificial Sequence
  chemically synthesized
agagatatagaccaatggaa

SEQ ID NO: 24092 - DNA, 20 bp, Artificial Sequence
  chemically synthesized
tatagaccaatggaacagaa

SEQ ID NO: 24093 - DNA, 20 bp, Artificial Sequence
  chemically synthesized
tagaccaatggaacagaaca

SEQ ID NO: 24094 - DNA, 20 bp, Artificial Sequence
  chemically synthesized
agaccaatggaacagaacag

SEQ ID NO: 24095 - DNA, 20 bp, Artificial Sequence
  chemically synthesized
atggaacagaacagaggcct

SEQ ID NO: 24096 - DNA, 20 bp, Artificial Sequence
  chemically synthesized
aacctgacaaaaaaaacaaa

SEQ ID NO: 24097 - DNA, 20 bp, Artificial Sequence
  chemically synthesized
acctgacaaaaaaaacaaat

SEQ ID NO: 24098 - DNA, 20 bp, Artificial Sequence
  chemically synthesized
cctgacaaaaaaaacaaatg

SEQ ID NO: 24099 - DNA, 20 bp, Artificial Sequence
  chemically synthesized
acaaaaaaaacaaatgggga

SEQ ID NO: 24100 - DNA, 20 bp, Artificial Sequence
  chemically synthesized
caaaaaaaacaaatggggaa

SEQ ID NO: 24101 - DNA, 20 bp, Artificial Sequence
  chemically synthesized
aggattccctatttaataaa

SEQ ID NO: 24102 - DNA, 20 bp, Artificial Sequence
  chemically synthesized
ccctatttaataaatggtgc

SEQ ID NO: 24103 - DNA, 20 bp, Artificial Sequence
  chemically synthesized
cctatttaataaatggtgct

SEQ ID NO: 24104 - DNA, 20 bp, Artificial Sequence
  chemically synthesized
ataaatggtgctgggaaaac

SEQ ID NO: 24105 - DNA, 20 bp, Artificial Sequence
  chemically synthesized
gaaaactggctaaccatacg

SEQ ID NO: 24106 - DNA, 20 bp, Artificial Sequence
  chemically synthesized
actggctaaccatacgcaga

SEQ ID NO: 24107 - DNA, 20 bp, Artificial Sequence
  chemically synthesized
catacgcagaaagctgaaac

SEQ ID NO: 24108 - DNA, 20 bp, Artificial Sequence
  chemically synthesized
ccttatacaaaaattaattc

SEQ ID NO: 24109 - DNA, 20 bp, Artificial Sequence
  chemically synthesized
atacaaaaattaattcaaga

SEQ ID NO: 24110 - DNA, 20 bp, Artificial Sequence
  chemically synthesized
aattaattcaagatggatta

SEQ ID NO: 24111 - DNA, 20 bp, Artificial Sequence
  chemically synthesized
tggattacagacttaaatgt

SEQ ID NO: 24112 - DNA, 20 bp, Artificial Sequence
  chemically synthesized
actgaaaaccataaaaactc

SEQ ID NO: 24113 - DNA, 20 bp, Artificial Sequence
  chemically synthesized
gaaaaccataaaaactctgg

SEQ ID NO: 24114 - DNA, 20 bp, Artificial Sequence
  chemically synthesized
aaaaactctggaagaaaacc

SEQ ID NO: 24115 - DNA, 20 bp, Artificial Sequence
  chemically synthesized
aaaactctggaagaaaacct

SEQ ID NO: 24116 - DNA, 20 bp, Artificial Sequence
  chemically synthesized
aaaacctaggcaataccatt

SEQ ID NO: 24117 - DNA, 20 bp, Artificial Sequence
  chemically synthesized
aaacctaggcaataccattc

SEQ ID NO: 24118 - DNA, 20 bp, Artificial Sequence
  chemically synthesized
aggcaataccattcaggaca

SEQ ID NO: 24119 - DNA, 20 bp, Artificial Sequence
  chemically synthesized
ggcaataccattcaggacat

SEQ ID NO: 24120 - DNA, 20 bp, Artificial Sequence
  chemically synthesized
taccattcaggacataggca

SEQ ID NO: 24121 - DNA, 20 bp, Artificial Sequence
  chemically synthesized
accattcaggacataggcat

SEQ ID NO: 24122 - DNA, 20 bp, Artificial Sequence
  chemically synthesized
ttcaggacataggcatgggc

SEQ ID NO: 24123 - DNA, 20 bp, Artificial Sequence
  chemically synthesized
tcaggacataggcatgggca

SEQ ID NO: 24124 - DNA, 20 bp, Artificial Sequence
  chemically synthesized
cttcatgtctaaaacaccaa

SEQ ID NO: 24125 - DNA, 20 bp, Artificial Sequence
  chemically synthesized
gtctaaaacaccaaaagcaa

SEQ ID NO: 24126 - DNA, 20 bp, Artificial Sequence
  chemically synthesized
accaaaagcaatggcaacaa

SEQ ID NO: 24127 - DNA, 20 bp, Artificial Sequence
  chemically synthesized
aatggcaacaaaagccaaaa

SEQ ID NO: 24128 - DNA, 20 bp, Artificial Sequence
  chemically synthesized
caaaagccaaaatggacaaa

SEQ ID NO: 24129 - DNA, 20 bp, Artificial Sequence
  chemically synthesized
aaaagccaaaatggacaaat

SEQ ID NO: 24130 - DNA, 20 bp, Artificial Sequence
  chemically synthesized
aatgggatctaattaaacta

SEQ ID NO: 24131 - DNA, 20 bp, Artificial Sequence
  chemically synthesized
tgggatctaattaaactaaa

SEQ ID NO: 24132 - DNA, 20 bp, Artificial Sequence
  chemically synthesized
taaactaaagagcttctgca

SEQ ID NO: 24133 - DNA, 20 bp, Artificial Sequence
  chemically synthesized
aaagagcttctgcacagcaa

SEQ ID NO: 24134 - DNA, 20 bp, Artificial Sequence
  chemically synthesized
acagcaaaagaaactaccat

SEQ ID NO: 24135 - DNA, 20 bp, Artificial Sequence
  chemically synthesized
agcaaaagaaactaccatca

SEQ ID NO: 24136 - DNA, 20 bp, Artificial Sequence
  chemically synthesized
gaaactaccatcagagtgaa

SEQ ID NO: 24137 - DNA, 20 bp, Artificial Sequence
  chemically synthesized
aaactaccatcagagtgaac

SEQ ID NO: 24138 - DNA, 20 bp, Artificial Sequence
  chemically synthesized
cagagtgaacaggcaacata

SEQ ID NO: 24139 - DNA, 20 bp, Artificial Sequence
  chemically synthesized
tgaacaggcaacatacagaa

SEQ ID NO: 24140 - DNA, 20 bp, Artificial Sequence
  chemically synthesized
gaacaggcaacatacagaat

SEQ ID NO: 24141 - DNA, 20 bp, Artificial Sequence
  chemically synthesized
acaggcaacatacagaatgg

SEQ ID NO: 24142 - DNA, 20 bp, Artificial Sequence
  chemically synthesized
tgcaatctactcatccgaca

SEQ ID NO: 24143 - DNA, 20 bp, Artificial Sequence
  chemically synthesized
gcaatctactcatccgacaa

SEQ ID NO: 24144 - DNA, 20 bp, Artificial Sequence
  chemically synthesized
caatctactcatccgacaaa

SEQ ID NO: 24145 - DNA, 20 bp, Artificial Sequence
  chemically synthesized
tccgacaaagggctaatatc

SEQ ID NO: 24146 - DNA, 20 bp, Artificial Sequence
  chemically synthesized
atgaactcaaacaaatttac

SEQ ID NO: 24147 - DNA, 20 bp, Artificial Sequence
  chemically synthesized
aaaaaaacaaccccatcaaa

SEQ ID NO: 24148 - DNA, 20 bp, Artificial Sequence
  chemically synthesized
aaaacaaccccatcaaaaag

SEQ ID NO: 24149 - DNA, 20 bp, Artificial Sequence
  chemically synthesized
aaacaaccccatcaaaaagt

SEQ ID NO: 24150 - DNA, 20 bp, Artificial Sequence
  chemically synthesized
accccatcaaaaagtgggca

SEQ ID NO: 24151 - DNA, 20 bp, Artificial Sequence
  chemically synthesized
ccccatcaaaaagtgggcaa

SEQ ID NO: 24152 - DNA, 20 bp, Artificial Sequence
  chemically synthesized
aagtgggcaaaggatatgaa

SEQ ID NO: 24153 - DNA, 20 bp, Artificial Sequence
  chemically synthesized
tatgaacagacacttctcaa

SEQ ID NO: 24154 - DNA, 20 bp, Artificial Sequence
  chemically synthesized
gaacagacacttctcaaaag

SEQ ID NO: 24155 - DNA, 20 bp, Artificial Sequence
  chemically synthesized
ctcaaaagaagacatttatg

SEQ ID NO: 24156 - DNA, 20 bp, Artificial Sequence
  chemically synthesized
gaagacatttatgcagtcaa

SEQ ID NO: 24157 - DNA, 20 bp, Artificial Sequence
  chemically synthesized
gaaaaaatgctcatcatcac

SEQ ID NO: 24158 - DNA, 20 bp, Artificial Sequence
  chemically synthesized
tgctcatcatcactggccat

SEQ ID NO: 24159 - DNA, 20 bp, Artificial Sequence
  chemically synthesized
ctcatcatcactggccatca

SEQ ID NO: 24160 - DNA, 20 bp, Artificial Sequence
  chemically synthesized
agaaatacaaatcaaaacca

SEQ ID NO: 24161 - DNA, 20 bp, Artificial Sequence
  chemically synthesized
atacaaatcaaaaccacagt

SEQ ID NO: 24162 - DNA, 20 bp, Artificial Sequence
  chemically synthesized
agtgagataccatctcacac

SEQ ID NO: 24163 - DNA, 20 bp, Artificial Sequence
  chemically synthesized
agataccatctcacaccagt

SEQ ID NO: 24164 - DNA, 20 bp, Artificial Sequence
  chemically synthesized
ccatctcacaccagttagaa

SEQ ID NO: 24165 - DNA, 20 bp, Artificial Sequence
  chemically synthesized
ttagaatggcgatcattaaa

SEQ ID NO: 24166 - DNA, 20 bp, Artificial Sequence
  chemically synthesized
aatggcgatcattaaaaagt

SEQ ID NO: 24167 - DNA, 20 bp, Artificial Sequence
  chemically synthesized
atggcgatcattaaaaagtc

SEQ ID NO: 24168 - DNA, 20 bp, Artificial Sequence
  chemically synthesized
attaaaaagtcaggaaacaa

SEQ ID NO: 24169 - DNA, 20 bp, Artificial Sequence
  chemically synthesized
ttaaaaagtcaggaaacaac

SEQ ID NO: 24170 - DNA, 20 bp, Artificial Sequence
  chemically synthesized
agtcaggaaacaacaggtgc

SEQ ID NO: 24171 - DNA, 20 bp, Artificial Sequence
  chemically synthesized
tcaggaaacaacaggtgctg

SEQ ID NO: 24172 - DNA, 20 bp, Artificial Sequence
  chemically synthesized
aggaaacaacaggtgctgga

SEQ ID NO: 24173 - DNA, 20 bp, Artificial Sequence
  chemically synthesized
ggaaacaacaggtgctggag

SEQ ID NO: 24174 - DNA, 20 bp, Artificial Sequence
  chemically synthesized
caggtgctggagaggatgtg

SEQ ID NO: 24175 - DNA, 20 bp, Artificial Sequence
  chemically synthesized
gtgctggagaggatgtgaag

SEQ ID NO: 24176 - DNA, 20 bp, Artificial Sequence
  chemically synthesized
ctggagaggatgtgaagaag

SEQ ID NO: 24177 - DNA, 20 bp, Artificial Sequence
  chemically synthesized
tggagaggatgtgaagaagt

SEQ ID NO: 24178 - DNA, 20 bp, Artificial Sequence
  chemically synthesized
taggaacacttttacactgt

SEQ ID NO: 24179 - DNA, 20 bp, Artificial Sequence
  chemically synthesized
aacacttttacactgttggt

SEQ ID NO: 24180 - DNA, 20 bp, Artificial Sequence
  chemically synthesized
ctgttggtgagactgtaaac

SEQ ID NO: 24181 - DNA, 20 bp, Artificial Sequence
  chemically synthesized
gtaaactagttcaaccattg

SEQ ID NO: 24182 - DNA, 20 bp, Artificial Sequence
  chemically synthesized
aactagttcaaccattgtgg

SEQ ID NO: 24183 - DNA, 20 bp, Artificial Sequence
  chemically synthesized
agttcaaccattgtggaagt

SEQ ID NO: 24184 - DNA, 20 bp, Artificial Sequence
  chemically synthesized
aaccattgtggaagtcagtg

SEQ ID NO: 24185 - DNA, 20 bp, Artificial Sequence
  chemically synthesized
aagtcagtgtggcgattcct

SEQ ID NO: 24186 - DNA, 20 bp, Artificial Sequence
  chemically synthesized
agtcagtgtggcgattcctc

SEQ ID NO: 24187 - DNA, 20 bp, Artificial Sequence
  chemically synthesized
gtcagtgtggcgattcctca

SEQ ID NO: 24188 - DNA, 20 bp, Artificial Sequence
  chemically synthesized
gtggcgattcctcagggatc

SEQ ID NO: 24189 - DNA, 20 bp, Artificial Sequence
  chemically synthesized
attcctcagggatctagaac

SEQ ID NO: 24190 - DNA, 20 bp, Artificial Sequence
  chemically synthesized
actagaaataccatttgacc

SEQ ID NO: 24191 - DNA, 20 bp, Artificial Sequence
  chemically synthesized
tgacccagccatcccattac

SEQ ID NO: 24192 - DNA, 20 bp, Artificial Sequence
  chemically synthesized
gacccagccatcccattact

SEQ ID NO: 24193 - DNA, 20 bp, Artificial Sequence
  chemically synthesized
cattactgggtacatactca

SEQ ID NO: 24194 - DNA, 20 bp, Artificial Sequence
  chemically synthesized
attactgggtacatactcaa

SEQ ID NO: 24195 - DNA, 20 bp, Artificial Sequence
  chemically synthesized
ttataaatcatgctgctata

SEQ ID NO: 24196 - DNA, 20 bp, Artificial Sequence
  chemically synthesized
atgcacatgtatgtttattg

SEQ ID NO: 24197 - DNA, 20 bp, Artificial Sequence
  chemically synthesized
tattgtggcactattcacaa

SEQ ID NO: 24198 - DNA, 20 bp, Artificial Sequence
  chemically synthesized
tggcactattcacaatagca

SEQ ID NO: 24199 - DNA, 20 bp, Artificial Sequence
  chemically synthesized
tattcacaatagcaaagact

SEQ ID NO: 24200 - DNA, 20 bp, Artificial Sequence
  chemically synthesized
acccaaatgtccaacaatga

SEQ ID NO: 24201 - DNA, 20 bp, Artificial Sequence
  chemically synthesized
aatgtccaacaatgatagac

SEQ ID NO: 24202 - DNA, 20 bp, Artificial Sequence
  chemically synthesized
caacaatgatagactggatt

SEQ ID NO: 24203 - DNA, 20 bp, Artificial Sequence
  chemically synthesized
tagactggattaagaaaacg

SEQ ID NO: 24204 - DNA, 20 bp, Artificial Sequence
  chemically synthesized
aacgtggcacatatacacca

SEQ ID NO: 24205 - DNA, 20 bp, Artificial Sequence
  chemically synthesized
atacaccatggaatactatg

SEQ ID NO: 24206 - DNA, 20 bp, Artificial Sequence
  chemically synthesized
ctatgcagccataaaaaatg

SEQ ID NO: 24207 - DNA, 20 bp, Artificial Sequence
  chemically synthesized
atgcagccataaaaaatgaa

SEQ ID NO: 24208 - DNA, 20 bp, Artificial Sequence
  chemically synthesized
tgaagagttcatgtcctttg

SEQ ID NO: 24209 - DNA, 20 bp, Artificial Sequence
  chemically synthesized
gaagagttcatgtcctttgt

SEQ ID NO: 24210 - DNA, 20 bp, Artificial Sequence
  chemically synthesized
aagagttcatgtcctttgta

SEQ ID NO: 24211 - DNA, 20 bp, Artificial Sequence
  chemically synthesized
tcatgtcctttgtagggaca

SEQ ID NO: 24212 - DNA, 20 bp, Artificial Sequence
  chemically synthesized
cctttgtagggacatggatg

SEQ ID NO: 24213 - DNA, 20 bp, Artificial Sequence
  chemically synthesized
tgtagggacatggatgaagc

SEQ ID NO: 24214 - DNA, 20 bp, Artificial Sequence
  chemically synthesized
aagctggaaaccatcattct

SEQ ID NO: 24215 - DNA, 20 bp, Artificial Sequence
  chemically synthesized
cattctcagcaaactatcgc

SEQ ID NO: 24216 - DNA, 20 bp, Artificial Sequence
  chemically synthesized
attctcagcaaactatcgca

SEQ ID NO: 24217 - DNA, 20 bp, Artificial Sequence
  chemically synthesized
acactgcatgttctcactca

SEQ ID NO: 24218 - DNA, 20 bp, Artificial Sequence
  chemically synthesized
cactgcatgttctcactcat

SEQ ID NO: 24219 - DNA, 20 bp, Artificial Sequence
  chemically synthesized
tgcatgttctcactcatagg

SEQ ID NO: 24220 - DNA, 20 bp, Artificial Sequence
  chemically synthesized
gcatgttctcactcataggt

SEQ ID NO: 24221 - DNA, 20 bp, Artificial Sequence
  chemically synthesized
ataggtgggaattgaacaat

SEQ ID NO: 24222 - DNA, 20 bp, Artificial Sequence
  chemically synthesized
aattgaacaatgagaacaca

SEQ ID NO: 24223 - DNA, 20 bp, Artificial Sequence
  chemically synthesized
acaatgagaacacatggaca

SEQ ID NO: 24224 - DNA, 20 bp, Artificial Sequence
  chemically synthesized
caatgagaacacatggacac

SEQ ID NO: 24225 - DNA, 20 bp, Artificial Sequence
  chemically synthesized
tgagaacacatggacacagg

SEQ ID NO: 24226 - DNA, 20 bp, Artificial Sequence
  chemically synthesized
gagaacacatggacacagga

SEQ ID NO: 24227 - DNA, 20 bp, Artificial Sequence
  chemically synthesized
agaacacatggacacaggaa

SEQ ID NO: 24228 - DNA, 20 bp, Artificial Sequence
  chemically synthesized
gaacacatggacacaggaag

SEQ ID NO: 24229 - DNA, 20 bp, Artificial Sequence
  chemically synthesized
ggaaggggaacatcacacac

SEQ ID NO: 24230 - DNA, 20 bp, Artificial Sequence
  chemically synthesized
gaaggggaacatcacacacc

SEQ ID NO: 24231 - DNA, 20 bp, Artificial Sequence
  chemically synthesized
aaggggaacatcacacacca

SEQ ID NO: 24232 - DNA, 20 bp, Artificial Sequence
  chemically synthesized
acatcacacaccagggcctg

SEQ ID NO: 24233 - DNA, 20 bp, Artificial Sequence
  chemically synthesized
tcacacaccagggcctgcag

SEQ ID NO: 24234 - DNA, 20 bp, Artificial Sequence
  chemically synthesized
cacacaccagggcctgcagt

SEQ ID NO: 24235 - DNA, 20 bp, Artificial Sequence
  chemically synthesized
acacaccagggcctgcagtg

SEQ ID NO: 24236 - DNA, 20 bp, Artificial Sequence
  chemically synthesized
caccagggcctgcagtgggg

SEQ ID NO: 24237 - DNA, 20 bp, Artificial Sequence
  chemically synthesized
accagggcctgcagtggggt

SEQ ID NO: 24238 - DNA, 20 bp, Artificial Sequence
  chemically synthesized
ccagggcctgcagtggggtg

SEQ ID NO: 24239 - DNA, 20 bp, Artificial Sequence
  chemically synthesized
cagggcctgcagtggggtgg

SEQ ID NO: 24240 - DNA, 20 bp, Artificial Sequence
  chemically synthesized
gcctgcagtggggtgggggt

SEQ ID NO: 24241 - DNA, 20 bp, Artificial Sequence
  chemically synthesized
cctgcagtggggtgggggtc

SEQ ID NO: 24242 - DNA, 20 bp, Artificial Sequence
  chemically synthesized
ctgcagtggggtgggggtcg

SEQ ID NO: 24243 - DNA, 20 bp, Artificial Sequence
  chemically synthesized
tgcagtggggtgggggtcgg

SEQ ID NO: 24244 - DNA, 20 bp, Artificial Sequence
  chemically synthesized
gcagtggggtgggggtcggg

SEQ ID NO: 24245 - DNA, 20 bp, Artificial Sequence
  chemically synthesized
agtggggtgggggtcggggg

SEQ ID NO: 24246 - DNA, 20 bp, Artificial Sequence
  chemically synthesized
gtggggtgggggtcgggggg

SEQ ID NO: 24247 - DNA, 20 bp, Artificial Sequence
  chemically synthesized
tggggtgggggtcgggggga

SEQ ID NO: 24248 - DNA, 20 bp, Artificial Sequence
  chemically synthesized
gtgggggtcggggggaggga

SEQ ID NO: 24249 - DNA, 20 bp, Artificial Sequence
  chemically synthesized
gtcggggggagggatagcat

SEQ ID NO: 24250 - DNA, 20 bp, Artificial Sequence
  chemically synthesized
tcggggggagggatagcatt

SEQ ID NO: 24251 - DNA, 20 bp, Artificial Sequence
  chemically synthesized
ggggggagggatagcattag

SEQ ID NO: 24252 - DNA, 20 bp, Artificial Sequence
  chemically synthesized
taggagatatacctaatgct

SEQ ID NO: 24253 - DNA, 20 bp, Artificial Sequence
  chemically synthesized
tatacctaatgctaagtgac

SEQ ID NO: 24254 - DNA, 20 bp, Artificial Sequence
  chemically synthesized
aatgctaagtgacgagttaa

SEQ ID NO: 24255 - DNA, 20 bp, Artificial Sequence
  chemically synthesized
atgctaagtgacgagttaat

SEQ ID NO: 24256 - DNA, 20 bp, Artificial Sequence
  chemically synthesized
aagtgacgagttaatgggtg

SEQ ID NO: 24257 - DNA, 20 bp, Artificial Sequence
  chemically synthesized
atgggtgcagcacaccaaca

SEQ ID NO: 24258 - DNA, 20 bp, Artificial Sequence
  chemically synthesized
caaatgtaccctaaaactta

SEQ ID NO: 24259 - DNA, 20 bp, Artificial Sequence
  chemically synthesized
aacttaaagtataataataa

SEQ ID NO: 24260 - DNA, 20 bp, Artificial Sequence
  chemically synthesized
taaagtataataataaaaga

SEQ ID NO: 24261 - DNA, 20 bp, Artificial Sequence
  chemically synthesized
gtataataataaaagaaaga

SEQ ID NO: 24262 - DNA, 20 bp, Artificial Sequence
  chemically synthesized
aataataaaagaaagaaaga

SEQ ID NO: 24263 - DNA, 20 bp, Artificial Sequence
  chemically synthesized
agaaagaaatctgctgcaaa

SEQ ID NO: 24264 - DNA, 20 bp, Artificial Sequence
  chemically synthesized
gaaagaaatctgctgcaaaa

SEQ ID NO: 24265 - DNA, 20 bp, Artificial Sequence
  chemically synthesized
cttaaaataaatcttatttc

SEQ ID NO: 24266 - DNA, 20 bp, Artificial Sequence
  chemically synthesized
taaaataaatcttatttctg

SEQ ID NO: 24267 - DNA, 20 bp, Artificial Sequence
  chemically synthesized
aaatcttatttctggagatg

SEQ ID NO: 24268 - DNA, 20 bp, Artificial Sequence
  chemically synthesized
atgtggctaattccctaacc

SEQ ID NO: 24269 - DNA, 20 bp, Artificial Sequence
  chemically synthesized
ctaattccctaacctagatg

SEQ ID NO: 24270 - DNA, 20 bp, Artificial Sequence
  chemically synthesized
taattccctaacctagatgc

SEQ ID NO: 24271 - DNA, 20 bp, Artificial Sequence
  chemically synthesized
ttccctaacctagatgcagg

SEQ ID NO: 24272 - DNA, 20 bp, Artificial Sequence
  chemically synthesized
ctagatgcaggaagaaacct

SEQ ID NO: 24273 - DNA, 20 bp, Artificial Sequence
  chemically synthesized
ccttagcgactcctgttcca

SEQ ID NO: 24274 - DNA, 20 bp, Artificial Sequence
  chemically synthesized
ttccaaagttctaaatccct

SEQ ID NO: 24275 - DNA, 20 bp, Artificial Sequence
  chemically synthesized
tccaaagttctaaatccctc

SEQ ID NO: 24276 - DNA, 20 bp, Artificial Sequence
  chemically synthesized
aagttctaaatccctcaggc

SEQ ID NO: 24277 - DNA, 20 bp, Artificial Sequence
  chemically synthesized
agttctaaatccctcaggct

SEQ ID NO: 24278 - DNA, 20 bp, Artificial Sequence
  chemically synthesized
ttctaaatccctcaggctgg

SEQ ID NO: 24279 - DNA, 20 bp, Artificial Sequence
  chemically synthesized
tccctcaggctgggagaata

SEQ ID NO: 24280 - DNA, 20 bp, Artificial Sequence
  chemically synthesized
ctcaggctgggagaataaag

SEQ ID NO: 24281 - DNA, 20 bp, Artificial Sequence
  chemically synthesized
tcaggctgggagaataaaga

SEQ ID NO: 24282 - DNA, 20 bp, Artificial Sequence
  chemically synthesized
aggctgggagaataaagaag

SEQ ID NO: 24283 - DNA, 20 bp, Artificial Sequence
  chemically synthesized
ggctgggagaataaagaagg

SEQ ID NO: 24284 - DNA, 20 bp, Artificial Sequence
  chemically synthesized
gctgggagaataaagaagga

SEQ ID NO: 24285 - DNA, 20 bp, Artificial Sequence
  chemically synthesized
tgggagaataaagaaggagg

SEQ ID NO: 24286 - DNA, 20 bp, Artificial Sequence
  chemically synthesized
gggagaataaagaaggaggg

SEQ ID NO: 24287 - DNA, 20 bp, Artificial Sequence
  chemically synthesized
gagaataaagaaggagggag

SEQ ID NO: 24288 - DNA, 20 bp, Artificial Sequence
  chemically synthesized
gaataaagaaggagggagga

SEQ ID NO: 24289 - DNA, 20 bp, Artificial Sequence
  chemically synthesized
ataaagaaggagggaggaga

SEQ ID NO: 24290 - DNA, 20 bp, Artificial Sequence
  chemically synthesized
taaagaaggagggaggagag

SEQ ID NO: 24291 - DNA, 20 bp, Artificial Sequence
  chemically synthesized
aagaaggagggaggagagag

SEQ ID NO: 24292 - DNA, 20 bp, Artificial Sequence
  chemically synthesized
aaggagggaggagagaggag

SEQ ID NO: 24293 - DNA, 20 bp, Artificial Sequence
  chemically synthesized
aggagggaggagagaggagt

SEQ ID NO: 24294 - DNA, 20 bp, Artificial Sequence
  chemically synthesized
gaggagagaggagtgggccg

SEQ ID NO: 24295 - DNA, 20 bp, Artificial Sequence
  chemically synthesized
aggagagaggagtgggccgt

SEQ ID NO: 24296 - DNA, 20 bp, Artificial Sequence
  chemically synthesized
ggagagaggagtgggccgta

SEQ ID NO: 24297 - DNA, 20 bp, Artificial Sequence
  chemically synthesized
agagaggagtgggccgtagg

SEQ ID NO: 24298 - DNA, 20 bp, Artificial Sequence
  chemically synthesized
gagaggagtgggccgtaggg

SEQ ID NO: 24299 - DNA, 20 bp, Artificial Sequence
  chemically synthesized
gaggagtgggccgtagggag

SEQ ID NO: 24300 - DNA, 20 bp, Artificial Sequence
  chemically synthesized
tctgaaactaattttctttg

SEQ ID NO: 24301 - DNA, 20 bp, Artificial Sequence
  chemically synthesized
aactaattttctttgcagct

SEQ ID NO: 24302 - DNA, 20 bp, Artificial Sequence
  chemically synthesized
ttctttgcagcttggcttct

SEQ ID NO: 24303 - DNA, 20 bp, Artificial Sequence
  chemically synthesized
tgcagcttggcttctgagta

SEQ ID NO: 24304 - DNA, 20 bp, Artificial Sequence
  chemically synthesized
gcttctgagtatagtctaaa

SEQ ID NO: 24305 - DNA, 20 bp, Artificial Sequence
  chemically synthesized
ctgagtatagtctaaaaagt

SEQ ID NO: 24306 - DNA, 20 bp, Artificial Sequence
  chemically synthesized
atagtctaaaaagttggtgt

SEQ ID NO: 24307 - DNA, 20 bp, Artificial Sequence
  chemically synthesized
gttggatccaatatcttgac

SEQ ID NO: 24308 - DNA, 20 bp, Artificial Sequence
  chemically synthesized
ttggatccaatatcttgacc

SEQ ID NO: 24309 - DNA, 20 bp, Artificial Sequence
  chemically synthesized
tccaatatcttgaccaggct

SEQ ID NO: 24310 - DNA, 20 bp, Artificial Sequence
  chemically synthesized
ccaatatcttgaccaggctt

SEQ ID NO: 24311 - DNA, 20 bp, Artificial Sequence
  chemically synthesized
caatatcttgaccaggctta

SEQ ID NO: 24312 - DNA, 20 bp, Artificial Sequence
  chemically synthesized
aatatcttgaccaggcttag

SEQ ID NO: 24313 - DNA, 20 bp, Artificial Sequence
  chemically synthesized
tgaccaggcttaggggttca

SEQ ID NO: 24314 - DNA, 20 bp, Artificial Sequence
  chemically synthesized
ggggttcatagtcacatctg

SEQ ID NO: 24315 - DNA, 20 bp, Artificial Sequence
  chemically synthesized
acatctgtggcaacaatgaa

SEQ ID NO: 24316 - DNA, 20 bp, Artificial Sequence
  chemically synthesized
acaatgaacagacttatgaa

SEQ ID NO: 24317 - DNA, 20 bp, Artificial Sequence
  chemically synthesized
caatgaacagacttatgaac

SEQ ID NO: 24318 - DNA, 20 bp, Artificial Sequence
  chemically synthesized
gaacagacttatgaacaggt

SEQ ID NO: 24319 - DNA, 20 bp, Artificial Sequence
  chemically synthesized
gacttatgaacaggtcggta

SEQ ID NO: 24320 - DNA, 20 bp, Artificial Sequence
  chemically synthesized
aacaggtcggtaaagaactc

SEQ ID NO: 24321 - DNA, 20 bp, Artificial Sequence
  chemically synthesized
taaagaactccagtgtgtct

SEQ ID NO: 24322 - DNA, 20 bp, Artificial Sequence
  chemically synthesized
aactccagtgtgtcttggcc

SEQ ID NO: 24323 - DNA, 20 bp, Artificial Sequence
  chemically synthesized
ctccagtgtgtcttggccta

SEQ ID NO: 24324 - DNA, 20 bp, Artificial Sequence
  chemically synthesized
tccagtgtgtcttggcctag

SEQ ID NO: 24325 - DNA, 20 bp, Artificial Sequence
  chemically synthesized
cttggcctagaggctccgca

SEQ ID NO: 24326 - DNA, 20 bp, Artificial Sequence
  chemically synthesized
ttggcctagaggctccgcat

SEQ ID NO: 24327 - DNA, 20 bp, Artificial Sequence
  chemically synthesized
tagaggctccgcataggaat

SEQ ID NO: 24328 - DNA, 20 bp, Artificial Sequence
  chemically synthesized
aggctccgcataggaatgag

SEQ ID NO: 24329 - DNA, 20 bp, Artificial Sequence
  chemically synthesized
ctccgcataggaatgagcag

SEQ ID NO: 24330 - DNA, 20 bp, Artificial Sequence
  chemically synthesized
gcataggaatgagcagtaga

SEQ ID NO: 24331 - DNA, 20 bp, Artificial Sequence
  chemically synthesized
aggaatgagcagtagacggt

SEQ ID NO: 24332 - DNA, 20 bp, Artificial Sequence
  chemically synthesized
gcagtagacggttggcttat

SEQ ID NO: 24333 - DNA, 20 bp, Artificial Sequence
  chemically synthesized
agtagacggttggcttatca

SEQ ID NO: 24334 - DNA, 20 bp, Artificial Sequence
  chemically synthesized
ggttggcttatcagagattg

SEQ ID NO: 24335 - DNA, 20 bp, Artificial Sequence
  chemically synthesized
ttggcttatcagagattgca

SEQ ID NO: 24336 - DNA, 20 bp, Artificial Sequence
  chemically synthesized
ggcttatcagagattgcaga

SEQ ID NO: 24337 - DNA, 20 bp, Artificial Sequence
  chemically synthesized
gcttatcagagattgcagag

SEQ ID NO: 24338 - DNA, 20 bp, Artificial Sequence
  chemically synthesized
cttatcagagattgcagaga

SEQ ID NO: 24339 - DNA, 20 bp, Artificial Sequence
  chemically synthesized
agattgcagagagggaaatg

SEQ ID NO: 24340 - DNA, 20 bp, Artificial Sequence
  chemically synthesized
agggaaatgcagtaatgtat

SEQ ID NO: 24341 - DNA, 20 bp, Artificial Sequence
  chemically synthesized
aatgcagtaatgtatcagtc

SEQ ID NO: 24342 - DNA, 20 bp, Artificial Sequence
  chemically synthesized
atgtatcagtcaagatgtga

SEQ ID NO: 24343 - DNA, 20 bp, Artificial Sequence
  chemically synthesized
tgtatcagtcaagatgtgat

SEQ ID NO: 24344 - DNA, 20 bp, Artificial Sequence
  chemically synthesized
gtatcagtcaagatgtgatg

SEQ ID NO: 24345 - DNA, 20 bp, Artificial Sequence
  chemically synthesized
gtcaagatgtgatggggtat

SEQ ID NO: 24346 - DNA, 20 bp, Artificial Sequence
  chemically synthesized
tataagaatctatcatccca

SEQ ID NO: 24347 - DNA, 20 bp, Artificial Sequence
  chemically synthesized
caaagactccctaaaatctt

SEQ ID NO: 24348 - DNA, 20 bp, Artificial Sequence
  chemically synthesized
tccctaaaatctttagaact

SEQ ID NO: 24349 - DNA, 20 bp, Artificial Sequence
  chemically synthesized
taatctcttttgcaaattcc

SEQ ID NO: 24350 - DNA, 20 bp, Artificial Sequence
  chemically synthesized
tctcttttgcaaattcctag

SEQ ID NO: 24351 - DNA, 20 bp, Artificial Sequence
  chemically synthesized
tcttttgcaaattcctagaa

SEQ ID NO: 24352 - DNA, 20 bp, Artificial Sequence
  chemically synthesized
cttttgcaaattcctagaag

SEQ ID NO: 24353 - DNA, 20 bp, Artificial Sequence
  chemically synthesized
ttttgcaaattcctagaaga

SEQ ID NO: 24354 - DNA, 20 bp, Artificial Sequence
  chemically synthesized
tcctagaagagggaaaatcc

SEQ ID NO: 24355 - DNA, 20 bp, Artificial Sequence
  chemically synthesized
agatctcctttttcattccc

SEQ ID NO: 24356 - DNA, 20 bp, Artificial Sequence
  chemically synthesized
tctcctttttcattccctag

SEQ ID NO: 24357 - DNA, 20 bp, Artificial Sequence
  chemically synthesized
tcctttttcattccctagca

SEQ ID NO: 24358 - DNA, 20 bp, Artificial Sequence
  chemically synthesized
cattccctagcagagtgatc

SEQ ID NO: 24359 - DNA, 20 bp, Artificial Sequence
  chemically synthesized
ccctagcagagtgatctagt

SEQ ID NO: 24360 - DNA, 20 bp, Artificial Sequence
  chemically synthesized
cctagcagagtgatctagtt

SEQ ID NO: 24361 - DNA, 20 bp, Artificial Sequence
  chemically synthesized
gatctagttaggaaaaaatc

SEQ ID NO: 24362 - DNA, 20 bp, Artificial Sequence
  chemically synthesized
aaaatcaagttgaaaatcca

SEQ ID NO: 24363 - DNA, 20 bp, Artificial Sequence
  chemically synthesized
aaatcaagttgaaaatccac

SEQ ID NO: 24364 - DNA, 20 bp, Artificial Sequence
  chemically synthesized
gttgaaaatccacgggaata

SEQ ID NO: 24365 - DNA, 20 bp, Artificial Sequence
  chemically synthesized
ggaatacagaatgatatctc

SEQ ID NO: 24366 - DNA, 20 bp, Artificial Sequence
  chemically synthesized
acagaatgatatctctggtg

SEQ ID NO: 24367 - DNA, 20 bp, Artificial Sequence
  chemically synthesized
tgatatctctggtgtagttc

SEQ ID NO: 24368 - DNA, 20 bp, Artificial Sequence
  chemically synthesized
tctggtgtagttccagactc

SEQ ID NO: 24369 - DNA, 20 bp, Artificial Sequence
  chemically synthesized
tgtagttccagactctggtt

SEQ ID NO: 24370 - DNA, 20 bp, Artificial Sequence
  chemically synthesized
atttcctttgttgctctctt

SEQ ID NO: 24371 - DNA, 20 bp, Artificial Sequence
  chemically synthesized
tttcctttgttgctctcttc

SEQ ID NO: 24372 - DNA, 20 bp, Artificial Sequence
  chemically synthesized
tctcttcgggctgcataaac

SEQ ID NO: 24373 - DNA, 20 bp, Artificial Sequence
  chemically synthesized
ttgcctctatgtgttctacc

SEQ ID NO: 24374 - DNA, 20 bp, Artificial Sequence
  chemically synthesized
ccaagtacttactcccaaaa

SEQ ID NO: 24375 - DNA, 20 bp, Artificial Sequence
  chemically synthesized
acttactcccaaaaaagatg

SEQ ID NO: 24376 - DNA, 20 bp, Artificial Sequence
  chemically synthesized
actcccaaaaaagatgaagt

SEQ ID NO: 24377 - DNA, 20 bp, Artificial Sequence
  chemically synthesized
tcccaaaaaagatgaagtta

SEQ ID NO: 24378 - DNA, 20 bp, Artificial Sequence
  chemically synthesized
aaaaaagatgaagttagagt

SEQ ID NO: 24379 - DNA, 20 bp, Artificial Sequence
  chemically synthesized
aaaaagatgaagttagagtg

SEQ ID NO: 24380 - DNA, 20 bp, Artificial Sequence
  chemically synthesized
agatgaagttagagtgagga

SEQ ID NO: 24381 - DNA, 20 bp, Artificial Sequence
  chemically synthesized
gatgaagttagagtgaggat

SEQ ID NO: 24382 - DNA, 20 bp, Artificial Sequence
  chemically synthesized
atgaagttagagtgaggata

SEQ ID NO: 24383 - DNA, 20 bp, Artificial Sequence
  chemically synthesized
tgaagttagagtgaggatag

SEQ ID NO: 24384 - DNA, 20 bp, Artificial Sequence
  chemically synthesized
ataggggacactgtaatgac

SEQ ID NO: 24385 - DNA, 20 bp, Artificial Sequence
  chemically synthesized
taggggacactgtaatgaca

SEQ ID NO: 24386 - DNA, 20 bp, Artificial Sequence
  chemically synthesized
aggggacactgtaatgacaa

SEQ ID NO: 24387 - DNA, 20 bp, Artificial Sequence
  chemically synthesized
acactgtaatgacaagggta

SEQ ID NO: 24388 - DNA, 20 bp, Artificial Sequence
  chemically synthesized
atgacaagggtatagactaa

SEQ ID NO: 24389 - DNA, 20 bp, Artificial Sequence
  chemically synthesized
caagggtatagactaacaga

SEQ ID NO: 24390 - DNA, 20 bp, Artificial Sequence
  chemically synthesized
agaaagaaaaacttaccaaa

SEQ ID NO: 24391 - DNA, 20 bp, Artificial Sequence
  chemically synthesized
gaaaaacttaccaaatagat

SEQ ID NO: 24392 - DNA, 20 bp, Artificial Sequence
  chemically synthesized
cttaccaaatagattagtgt

SEQ ID NO: 24393 - DNA, 20 bp, Artificial Sequence
  chemically synthesized
aaatagattagtgtcagatt

SEQ ID NO: 24394 - DNA, 20 bp, Artificial Sequence
  chemically synthesized
gattagtgtcagattgagta

SEQ ID NO: 24395 - DNA, 20 bp, Artificial Sequence
  chemically synthesized
agtaaagcaaactttgacat

SEQ ID NO: 24396 - DNA, 20 bp, Artificial Sequence
  chemically synthesized
gtaaagcaaactttgacatg

SEQ ID NO: 24397 - DNA, 20 bp, Artificial Sequence
  chemically synthesized
tttaaattgctgcatattcc

SEQ ID NO: 24398 - DNA, 20 bp, Artificial Sequence
  chemically synthesized
tgctgcatattcccagaaat

SEQ ID NO: 24399 - DNA, 20 bp, Artificial Sequence
  chemically synthesized
catattcccagaaatgagcc

SEQ ID NO: 24400 - DNA, 20 bp, Artificial Sequence
  chemically synthesized
gaaatgagcctagtatccat

SEQ ID NO: 24401 - DNA, 20 bp, Artificial Sequence
  chemically synthesized
atgcaaatccttataaacca

SEQ ID NO: 24402 - DNA, 20 bp, Artificial Sequence
  chemically synthesized
aaatccttataaaccaaagt

SEQ ID NO: 24403 - DNA, 20 bp, Artificial Sequence
  chemically synthesized
atccttataaaccaaagtca

SEQ ID NO: 24404 - DNA, 20 bp, Artificial Sequence
  chemically synthesized
ccttataaaccaaagtcaga

SEQ ID NO: 24405 - DNA, 20 bp, Artificial Sequence
  chemically synthesized
ttataaaccaaagtcagaga

SEQ ID NO: 24406 - DNA, 20 bp, Artificial Sequence
  chemically synthesized
caaagtcagagagagcttgt

SEQ ID NO: 24407 - DNA, 20 bp, Artificial Sequence
  chemically synthesized
ggttcacttcattccatgct

SEQ ID NO: 24408 - DNA, 20 bp, Artificial Sequence
  chemically synthesized
ttcattccatgctgagctat

SEQ ID NO: 24409 - DNA, 20 bp, Artificial Sequence
  chemically synthesized
atgctgagctatcagcactg

SEQ ID NO: 24410 - DNA, 20 bp, Artificial Sequence
  chemically synthesized
tatcagcactgcagattttg

SEQ ID NO: 24411 - DNA, 20 bp, Artificial Sequence
  chemically synthesized
ttgaagatctcaaccacacc

SEQ ID NO: 24412 - DNA, 20 bp, Artificial Sequence
  chemically synthesized
agatctcaaccacacccaga

SEQ ID NO: 24413 - DNA, 20 bp, Artificial Sequence
  chemically synthesized
atctcaaccacacccagata

SEQ ID NO: 24414 - DNA, 20 bp, Artificial Sequence
  chemically synthesized
ctcaaccacacccagataga

SEQ ID NO: 24415 - DNA, 20 bp, Artificial Sequence
  chemically synthesized
cacacccagatagagagtga

SEQ ID NO: 24416 - DNA, 20 bp, Artificial Sequence
  chemically synthesized
acccagatagagagtgatag

SEQ ID NO: 24417 - DNA, 20 bp, Artificial Sequence
  chemically synthesized
agtggatcccgtgtttctgt

SEQ ID NO: 24418 - DNA, 20 bp, Artificial Sequence
  chemically synthesized
gtggatcccgtgtttctgtc

SEQ ID NO: 24419 - DNA, 20 bp, Artificial Sequence
  chemically synthesized
tggatcccgtgtttctgtcg

SEQ ID NO: 24420 - DNA, 20 bp, Artificial Sequence
  chemically synthesized
ggatcccgtgtttctgtcgg

SEQ ID NO: 24421 - DNA, 20 bp, Artificial Sequence
  chemically synthesized
cccgtgtttctgtcggggga

SEQ ID NO: 24422 - DNA, 20 bp, Artificial Sequence
  chemically synthesized
ccgtgtttctgtcgggggat

SEQ ID NO: 24423 - DNA, 20 bp, Artificial Sequence
  chemically synthesized
gtgtttctgtcgggggatgg

SEQ ID NO: 24424 - DNA, 20 bp, Artificial Sequence
  chemically synthesized
tttctgtcgggggatgggag

SEQ ID NO: 24425 - DNA, 20 bp, Artificial Sequence
  chemically synthesized
gtcgggggatgggagtagat

SEQ ID NO: 24426 - DNA, 20 bp, Artificial Sequence
  chemically synthesized
tcgggggatgggagtagata

SEQ ID NO: 24427 - DNA, 20 bp, Artificial Sequence
  chemically synthesized
ggatgggagtagataaggaa

SEQ ID NO: 24428 - DNA, 20 bp, Artificial Sequence
  chemically synthesized
aaagtgtttactatttttac

SEQ ID NO: 24429 - DNA, 20 bp, Artificial Sequence
  chemically synthesized
gtgtttactatttttaccag

SEQ ID NO: 24430 - DNA, 20 bp, Artificial Sequence
  chemically synthesized
tgtttactatttttaccagc

SEQ ID NO: 24431 - DNA, 20 bp, Artificial Sequence
  chemically synthesized
gtttactatttttaccagca

SEQ ID NO: 24432 - DNA, 20 bp, Artificial Sequence
  chemically synthesized
tttactatttttaccagcag

SEQ ID NO: 24433 - DNA, 20 bp, Artificial Sequence
  chemically synthesized
taccagcaggggaaactacc

SEQ ID NO: 24434 - DNA, 20 bp, Artificial Sequence
  chemically synthesized
ggaaactacccagatgaaaa

SEQ ID NO: 24435 - DNA, 20 bp, Artificial Sequence
  chemically synthesized
tacccagatgaaaatggtgc

SEQ ID NO: 24436 - DNA, 20 bp, Artificial Sequence
  chemically synthesized
gaaaatggtgctggatgctt

SEQ ID NO: 24437 - DNA, 20 bp, Artificial Sequence
  chemically synthesized
aaaatggtgctggatgcttt

SEQ ID NO: 24438 - DNA, 20 bp, Artificial Sequence
  chemically synthesized
tgctggatgctttgggcaaa

SEQ ID NO: 24439 - DNA, 20 bp, Artificial Sequence
  chemically synthesized
gctttgggcaaaaagccatt

SEQ ID NO: 24440 - DNA, 20 bp, Artificial Sequence
  chemically synthesized
tttgggcaaaaagccattca

SEQ ID NO: 24441 - DNA, 20 bp, Artificial Sequence
  chemically synthesized
cagagccataatcaactacg

SEQ ID NO: 24442 - DNA, 20 bp, Artificial Sequence
  chemically synthesized
gccataatcaactacgaaga

SEQ ID NO: 24443 - DNA, 20 bp, Artificial Sequence
  chemically synthesized
taatcaactacgaagatggt

SEQ ID NO: 24444 - DNA, 20 bp, Artificial Sequence
  chemically synthesized
aatcaactacgaagatggtc

SEQ ID NO: 24445 - DNA, 20 bp, Artificial Sequence
  chemically synthesized
tacgaagatggtcaggaatt

SEQ ID NO: 24446 - DNA, 20 bp, Artificial Sequence
  chemically synthesized
tcaggaatttagtgtatttg

SEQ ID NO: 24447 - DNA, 20 bp, Artificial Sequence
  chemically synthesized
aatttagtgtatttgtagat

SEQ ID NO: 24448 - DNA, 20 bp, Artificial Sequence
  chemically synthesized
gtatttgtagatcagatgat

SEQ ID NO: 24449 - DNA, 20 bp, Artificial Sequence
  chemically synthesized
tagatcagatgatcagtcta

SEQ ID NO: 24450 - DNA, 20 bp, Artificial Sequence
  chemically synthesized
agatgatcagtctatggctt

SEQ ID NO: 24451 - DNA, 20 bp, Artificial Sequence
  chemically synthesized
ctttggaaaattgtgaacat

SEQ ID NO: 24452 - DNA, 20 bp, Artificial Sequence
  chemically synthesized
aattgtgaacattagttgtt

SEQ ID NO: 24453 - DNA, 20 bp, Artificial Sequence
  chemically synthesized
tagttgttgagccttataat

SEQ ID NO: 24454 - DNA, 20 bp, Artificial Sequence
  chemically synthesized
tgagaatgtgatgattaaat

SEQ ID NO: 24455 - DNA, 20 bp, Artificial Sequence
  chemically synthesized
gagaatgtgatgattaaatc

SEQ ID NO: 24456 - DNA, 20 bp, Artificial Sequence
  chemically synthesized
gatgattaaatcaggtctac

SEQ ID NO: 24457 - DNA, 20 bp, Artificial Sequence
  chemically synthesized
gtctactggatactatgaat

SEQ ID NO: 24458 - DNA, 20 bp, Artificial Sequence
  chemically synthesized
ctggatactatgaatcagaa

SEQ ID NO: 24459 - DNA, 20 bp, Artificial Sequence
  chemically synthesized
atcagaatagataacattgt

SEQ ID NO: 24460 - DNA, 20 bp, Artificial Sequence
  chemically synthesized
cattgttagatataattacc

SEQ ID NO: 24461 - DNA, 20 bp, Artificial Sequence
  chemically synthesized
gttagatataattacctagt

SEQ ID NO: 24462 - DNA, 20 bp, Artificial Sequence
  chemically synthesized
tagatataattacctagtca

SEQ ID NO: 24463 - DNA, 20 bp, Artificial Sequence
  chemically synthesized
gatataattacctagtcaga

SEQ ID NO: 24464 - DNA, 20 bp, Artificial Sequence
  chemically synthesized
ataattacctagtcagagag

SEQ ID NO: 24465 - DNA, 20 bp, Artificial Sequence
  chemically synthesized
aattacctagtcagagagca

SEQ ID NO: 24466 - DNA, 20 bp, Artificial Sequence
  chemically synthesized
ctagtcagagagcagagatg

SEQ ID NO: 24467 - DNA, 20 bp, Artificial Sequence
  chemically synthesized
tcagagagcagagatgaagt

SEQ ID NO: 24468 - DNA, 20 bp, Artificial Sequence
  chemically synthesized
cagagagcagagatgaagtc

SEQ ID NO: 24469 - DNA, 20 bp, Artificial Sequence
  chemically synthesized
gagcagagatgaagtcagga

SEQ ID NO: 24470 - DNA, 20 bp, Artificial Sequence
  chemically synthesized
agatgaagtcaggaaagcaa

SEQ ID NO: 24471 - DNA, 20 bp, Artificial Sequence
  chemically synthesized
aagtcaggaaagcaaaagat

SEQ ID NO: 24472 - DNA, 20 bp, Artificial Sequence
  chemically synthesized
aagcaaaagataagaaataa

SEQ ID NO: 24473 - DNA, 20 bp, Artificial Sequence
  chemically synthesized
caaaagataagaaataacag

SEQ ID NO: 24474 - DNA, 20 bp, Artificial Sequence
  chemically synthesized
aagaaataacagaagtcttc

SEQ ID NO: 24475 - DNA, 20 bp, Artificial Sequence
  chemically synthesized
aaataacagaagtcttctgg

SEQ ID NO: 24476 - DNA, 20 bp, Artificial Sequence
  chemically synthesized
taacagaagtcttctggtgg

SEQ ID NO: 24477 - DNA, 20 bp, Artificial Sequence
  chemically synthesized
acagaagtcttctggtggca

SEQ ID NO: 24478 - DNA, 20 bp, Artificial Sequence
  chemically synthesized
gaagtcttctggtggcagag

SEQ ID NO: 24479 - DNA, 20 bp, Artificial Sequence
  chemically synthesized
gtcttctggtggcagagtgg

SEQ ID NO: 24480 - DNA, 20 bp, Artificial Sequence
  chemically synthesized
ctggtggcagagtggtggct

SEQ ID NO: 24481 - DNA, 20 bp, Artificial Sequence
  chemically synthesized
agagtggtggcttagcctgc

SEQ ID NO: 24482 - DNA, 20 bp, Artificial Sequence
  chemically synthesized
gagtggtggcttagcctgct

SEQ ID NO: 24483 - DNA, 20 bp, Artificial Sequence
  chemically synthesized
agtggtggcttagcctgctg

SEQ ID NO: 24484 - DNA, 20 bp, Artificial Sequence
  chemically synthesized
cttagcctgctggggcaaaa

SEQ ID NO: 24485 - DNA, 20 bp, Artificial Sequence
  chemically synthesized
tagcctgctggggcaaaatg

SEQ ID NO: 24486 - DNA, 20 bp, Artificial Sequence
  chemically synthesized
gctggggcaaaatggagctc

SEQ ID NO: 24487 - DNA, 20 bp, Artificial Sequence
  chemically synthesized
ctggggcaaaatggagctca

SEQ ID NO: 24488 - DNA, 20 bp, Artificial Sequence
  chemically synthesized
aaaatggagctcaaggccat

SEQ ID NO: 24489 - DNA, 20 bp, Artificial Sequence
  chemically synthesized
atggagctcaaggccatgag

SEQ ID NO: 24490 - DNA, 20 bp, Artificial Sequence
  chemically synthesized
aaggccatgagcagatacaa

SEQ ID NO: 24491 - DNA, 20 bp, Artificial Sequence
  chemically synthesized
catgagcagatacaacagcc

SEQ ID NO: 24492 - DNA, 20 bp, Artificial Sequence
  chemically synthesized
atacaacagcccggtcaacc

SEQ ID NO: 24493 - DNA, 20 bp, Artificial Sequence
  chemically synthesized
tgtcttcccccatctgattg

SEQ ID NO: 24494 - DNA, 20 bp, Artificial Sequence
  chemically synthesized
tcttcccccatctgattgta

SEQ ID NO: 24495 - DNA, 20 bp, Artificial Sequence
  chemically synthesized
ccatctgattgtagagcttt

SEQ ID NO: 24496 - DNA, 20 bp, Artificial Sequence
  chemically synthesized
tcgacatgttcttcaccacc

SEQ ID NO: 24497 - DNA, 20 bp, Artificial Sequence
  chemically synthesized
ccacctggttctttgtttac

SEQ ID NO: 24498 - DNA, 20 bp, Artificial Sequence
  chemically synthesized
cacctggttctttgtttacg

SEQ ID NO: 24499 - DNA, 20 bp, Artificial Sequence
  chemically synthesized
tttacgaggtcacctctacc

SEQ ID NO: 24500 - DNA, 20 bp, Artificial Sequence
  chemically synthesized
gtacacttgtgatatctata

SEQ ID NO: 24501 - DNA, 20 bp, Artificial Sequence
  chemically synthesized
acacttgtgatatctataaa

SEQ ID NO: 24502 - DNA, 20 bp, Artificial Sequence
  chemically synthesized
atctataaagagtatctcct

SEQ ID NO: 24503 - DNA, 20 bp, Artificial Sequence
  chemically synthesized
tataaagagtatctccttgg

SEQ ID NO: 24504 - DNA, 20 bp, Artificial Sequence
  chemically synthesized
cttggtggcctcactcttca

SEQ ID NO: 24505 - DNA, 20 bp, Artificial Sequence
  chemically synthesized
ttggtggcctcactcttcat

SEQ ID NO: 24506 - DNA, 20 bp, Artificial Sequence
  chemically synthesized
ctcactcttcatgggctttg

SEQ ID NO: 24507 - DNA, 20 bp, Artificial Sequence
  chemically synthesized
aagtcctcttcctgatgctc

SEQ ID NO: 24508 - DNA, 20 bp, Artificial Sequence
  chemically synthesized
agtcctcttcctgatgctct

SEQ ID NO: 24509 - DNA, 20 bp, Artificial Sequence
  chemically synthesized
ctcttcctgatgctctgggt

SEQ ID NO: 24510 - DNA, 20 bp, Artificial Sequence
  chemically synthesized
ctgggttggcatctacatgt

SEQ ID NO: 24511 - DNA, 20 bp, Artificial Sequence
  chemically synthesized
gcatctacatgtgagtgccc

SEQ ID NO: 24512 - DNA, 20 bp, Artificial Sequence
  chemically synthesized
atctacatgtgagtgcccaa

SEQ ID NO: 24513 - DNA, 20 bp, Artificial Sequence
  chemically synthesized
gagtgcccaagagtaacaac

SEQ ID NO: 24514 - DNA, 20 bp, Artificial Sequence
  chemically synthesized
agtgcccaagagtaacaacc

SEQ ID NO: 24515 - DNA, 20 bp, Artificial Sequence
  chemically synthesized
gcccaagagtaacaaccagg

SEQ ID NO: 24516 - DNA, 20 bp, Artificial Sequence
  chemically synthesized
aatccctgcttttgtaaatt

SEQ ID NO: 24517 - DNA, 20 bp, Artificial Sequence
  chemically synthesized
ttaagttttctttctattgc

SEQ ID NO: 24518 - DNA, 20 bp, Artificial Sequence
  chemically synthesized
agttttctttctattgctgg

SEQ ID NO: 24519 - DNA, 20 bp, Artificial Sequence
  chemically synthesized
cctgttgcttataataaatg

SEQ ID NO: 24520 - DNA, 20 bp, Artificial Sequence
  chemically synthesized
ttataataaatgcagatgta

SEQ ID NO: 24521 - DNA, 20 bp, Artificial Sequence
  chemically synthesized
gtatggcattaaaaaaaaaa

SEQ ID NO: 24522 - DNA, 20 bp, Artificial Sequence
  chemically synthesized
taaaaaaaaaaaagaaataa

SEQ ID NO: 24523 - DNA, 20 bp, Artificial Sequence
  chemically synthesized
aaaaaaaaaagaaataatag

SEQ ID NO: 24524 - DNA, 20 bp, Artificial Sequence
  chemically synthesized
aaaaaagaaataatagaagt

SEQ ID NO: 24525 - DNA, 20 bp, Artificial Sequence
  chemically synthesized
aaaaagaaataatagaagtt

SEQ ID NO: 24526 - DNA, 20 bp, Artificial Sequence
  chemically synthesized
aagaaataatagaagttagg

SEQ ID NO: 24527 - DNA, 20 bp, Artificial Sequence
  chemically synthesized
agaaataatagaagttaggc

SEQ ID NO: 24528 - DNA, 20 bp, Artificial Sequence
  chemically synthesized
gaaataatagaagttaggca

SEQ ID NO: 24529 - DNA, 20 bp, Artificial Sequence
  chemically synthesized
aatagaagttaggcagggat

SEQ ID NO: 24530 - DNA, 20 bp, Artificial Sequence
  chemically synthesized
atagaagttaggcagggatt

SEQ ID NO: 24531 - DNA, 20 bp, Artificial Sequence
  chemically synthesized
tagaagttaggcagggattg

SEQ ID NO: 24532 - DNA, 20 bp, Artificial Sequence
  chemically synthesized
taggcagggattggggcatg

SEQ ID NO: 24533 - DNA, 20 bp, Artificial Sequence
  chemically synthesized
aggcagggattggggcatga

SEQ ID NO: 24534 - DNA, 20 bp, Artificial Sequence
  chemically synthesized
ggggcatgaaggttgaaaac

SEQ ID NO: 24535 - DNA, 20 bp, Artificial Sequence
  chemically synthesized
gggcatgaaggttgaaaaca

SEQ ID NO: 24536 - DNA, 20 bp, Artificial Sequence
  chemically synthesized
tgaaggttgaaaacaaggaa

SEQ ID NO: 24537 - DNA, 20 bp, Artificial Sequence
  chemically synthesized
gaaggttgaaaacaaggaaa

SEQ ID NO: 24538 - DNA, 20 bp, Artificial Sequence
  chemically synthesized
aggttgaaaacaaggaaaag

SEQ ID NO: 24539 - DNA, 20 bp, Artificial Sequence
  chemically synthesized
aaaacaaggaaaaggagccc

SEQ ID NO: 24540 - DNA, 20 bp, Artificial Sequence
  chemically synthesized
aaacaaggaaaaggagccca

SEQ ID NO: 24541 - DNA, 20 bp, Artificial Sequence
  chemically synthesized
aaaggagcccaaggaaatgc

SEQ ID NO: 24542 - DNA, 20 bp, Artificial Sequence
  chemically synthesized
caagtgttgtaaaatgtgct

SEQ ID NO: 24543 - DNA, 20 bp, Artificial Sequence
  chemically synthesized
gtgttgtaaaatgtgctaag

SEQ ID NO: 24544 - DNA, 20 bp, Artificial Sequence
  chemically synthesized
aatgtgctaagtagatgtct

SEQ ID NO: 24545 - DNA, 20 bp, Artificial Sequence
  chemically synthesized
gtgctaagtagatgtctgag

SEQ ID NO: 24546 - DNA, 20 bp, Artificial Sequence
  chemically synthesized
tctgagtggcattcctccat

SEQ ID NO: 24547 - DNA, 20 bp, Artificial Sequence
  chemically synthesized
tgagtggcattcctccatga

SEQ ID NO: 24548 - DNA, 20 bp, Artificial Sequence
  chemically synthesized
tggcattcctccatgagaga

SEQ ID NO: 24549 - DNA, 20 bp, Artificial Sequence
  chemically synthesized
tcctccatgagagaaagctt

SEQ ID NO: 24550 - DNA, 20 bp, Artificial Sequence
  chemically synthesized
cctccatgagagaaagctta

SEQ ID NO: 24551 - DNA, 20 bp, Artificial Sequence
  chemically synthesized
ctccatgagagaaagcttaa

SEQ ID NO: 24552 - DNA, 20 bp, Artificial Sequence
  chemically synthesized
catgagagaaagcttaaggg

SEQ ID NO: 24553 - DNA, 20 bp, Artificial Sequence
  chemically synthesized
agagaaagcttaagggaaga

SEQ ID NO: 24554 - DNA, 20 bp, Artificial Sequence
  chemically synthesized
agaaagcttaagggaagaaa

SEQ ID NO: 24555 - DNA, 20 bp, Artificial Sequence
  chemically synthesized
taagggaagaaagagaccct

SEQ ID NO: 24556 - DNA, 20 bp, Artificial Sequence
  chemically synthesized
ctgagtgtcttcaaaactca

SEQ ID NO: 24557 - DNA, 20 bp, Artificial Sequence
  chemically synthesized
aaaactcaaagttttacgaa

SEQ ID NO: 24558 - DNA, 20 bp, Artificial Sequence
  chemically synthesized
agttttacgaacagaatgat

SEQ ID NO: 24559 - DNA, 20 bp, Artificial Sequence
  chemically synthesized
tacgaacagaatgattagtc

SEQ ID NO: 24560 - DNA, 20 bp, Artificial Sequence
  chemically synthesized
cgaacagaatgattagtctg

SEQ ID NO: 24561 - DNA, 20 bp, Artificial Sequence
  chemically synthesized
gaaatcatttttcatcaata

SEQ ID NO: 24562 - DNA, 20 bp, Artificial Sequence
  chemically synthesized
aaatcatttttcatcaatac

SEQ ID NO: 24563 - DNA, 20 bp, Artificial Sequence
  chemically synthesized
tttcatcaatacaggatctc

SEQ ID NO: 24564 - DNA, 20 bp, Artificial Sequence
  chemically synthesized
acacacacacacacacacac

SEQ ID NO: 24565 - DNA, 20 bp, Artificial Sequence
  chemically synthesized
acacacacacacacaccggt

SEQ ID NO: 24566 - DNA, 20 bp, Artificial Sequence
  chemically synthesized
cacacacacacaccggtgag

SEQ ID NO: 24567 - DNA, 20 bp, Artificial Sequence
  chemically synthesized
cacacacaccggtgagtgga

SEQ ID NO: 24568 - DNA, 20 bp, Artificial Sequence
  chemically synthesized
gtggacagacatcgtttttc

SEQ ID NO: 24569 - DNA, 20 bp, Artificial Sequence
  chemically synthesized
tcgtttttcaagtcatgatg

SEQ ID NO: 24570 - DNA, 20 bp, Artificial Sequence
  chemically synthesized
tttttcaagtcatgatgcag

SEQ ID NO: 24571 - DNA, 20 bp, Artificial Sequence
  chemically synthesized
aagtcatgatgcagcagtat

SEQ ID NO: 24572 - DNA, 20 bp, Artificial Sequence
  chemically synthesized
atgcagcagtattggaatta

SEQ ID NO: 24573 - DNA, 20 bp, Artificial Sequence
  chemically synthesized
attggaattacagttttttt

SEQ ID NO: 24574 - DNA, 20 bp, Artificial Sequence
  chemically synthesized
tttttgtttttttttacttc

SEQ ID NO: 24575 - DNA, 20 bp, Artificial Sequence
  chemically synthesized
tttttttttacttcaagcta

SEQ ID NO: 24576 - DNA, 20 bp, Artificial Sequence
  chemically synthesized
ttacttcaagctatggtgtt

SEQ ID NO: 24577 - DNA, 20 bp, Artificial Sequence
  chemically synthesized
caccaattaattgttccttt

SEQ ID NO: 24578 - DNA, 20 bp, Artificial Sequence
  chemically synthesized
acactctctctctcacacaa

SEQ ID NO: 24579 - DNA, 20 bp, Artificial Sequence
  chemically synthesized
aaacacacatcaccaccact

SEQ ID NO: 24580 - DNA, 20 bp, Artificial Sequence
  chemically synthesized
tcaccaccactcagctccat

SEQ ID NO: 24581 - DNA, 20 bp, Artificial Sequence
  chemically synthesized
caccaccactcagctccatg

SEQ ID NO: 24582 - DNA, 20 bp, Artificial Sequence
  chemically synthesized
ctcactacttttattaaacc

SEQ ID NO: 24583 - DNA, 20 bp, Artificial Sequence
  chemically synthesized
tacttttattaaaccaagca

SEQ ID NO: 24584 - DNA, 20 bp, Artificial Sequence
  chemically synthesized
ttaaaccaagcacagatacc

SEQ ID NO: 24585 - DNA, 20 bp, Artificial Sequence
  chemically synthesized
agcacagataccaagttttt

SEQ ID NO: 24586 - DNA, 20 bp, Artificial Sequence
  chemically synthesized
caagtttttgagtgtgaatg

SEQ ID NO: 24587 - DNA, 20 bp, Artificial Sequence
  chemically synthesized
tttttgagtgtgaatgcaga

SEQ ID NO: 24588 - DNA, 20 bp, Artificial Sequence
  chemically synthesized
ttgagtgtgaatgcagaaag

SEQ ID NO: 24589 - DNA, 20 bp, Artificial Sequence
  chemically synthesized
atgcagaaagaagatatatt

SEQ ID NO: 24590 - DNA, 20 bp, Artificial Sequence
  chemically synthesized
tgcagaaagaagatatattg

SEQ ID NO: 24591 - DNA, 20 bp, Artificial Sequence
  chemically synthesized
agaaagaagatatattgagg

SEQ ID NO: 24592 - DNA, 20 bp, Artificial Sequence
  chemically synthesized
attgaggtagatttttctca

SEQ ID NO: 24593 - DNA, 20 bp, Artificial Sequence
  chemically synthesized
tttttctcatagatactact

SEQ ID NO: 24594 - DNA, 20 bp, Artificial Sequence
  chemically synthesized
actactaagattatattgtc

SEQ ID NO: 24595 - DNA, 20 bp, Artificial Sequence
  chemically synthesized
gtctggaatcttatgtgaca

SEQ ID NO: 24596 - DNA, 20 bp, Artificial Sequence
  chemically synthesized
aatcttatgtgacacagaaa

SEQ ID NO: 24597 - DNA, 20 bp, Artificial Sequence
  chemically synthesized
aaaagaacaactctgccatt

SEQ ID NO: 24598 - DNA, 20 bp, Artificial Sequence
  chemically synthesized
tttggccatttgcttgtgtt

SEQ ID NO: 24599 - DNA, 20 bp, Artificial Sequence
  chemically synthesized
tgcttgtgtttggacttgtg

SEQ ID NO: 24600 - DNA, 20 bp, Artificial Sequence
  chemically synthesized
gcttgtgtttggacttgtga

SEQ ID NO: 24601 - DNA, 20 bp, Artificial Sequence
  chemically synthesized
tctttccatcattctgttat

SEQ ID NO: 24602 - DNA, 20 bp, Artificial Sequence
  chemically synthesized
tccatcattctgttattgga

SEQ ID NO: 24603 - DNA, 20 bp, Artificial Sequence
  chemically synthesized
atcattctgttattggaaag

SEQ ID NO: 24604 - DNA, 20 bp, Artificial Sequence
  chemically synthesized
tcattctgttattggaaagc

SEQ ID NO: 24605 - DNA, 20 bp, Artificial Sequence
  chemically synthesized
tctgttattggaaagcggga

SEQ ID NO: 24606 - DNA, 20 bp, Artificial Sequence
  chemically synthesized
gttattggaaagcgggaaag

SEQ ID NO: 24607 - DNA, 20 bp, Artificial Sequence
  chemically synthesized
cgggaaagtagcattttcat

SEQ ID NO: 24608 - DNA, 20 bp, Artificial Sequence
  chemically synthesized
gggaaagtagcattttcatg

SEQ ID NO: 24609 - DNA, 20 bp, Artificial Sequence
  chemically synthesized
atgaggattctattaaaaac

SEQ ID NO: 24610 - DNA, 20 bp, Artificial Sequence
  chemically synthesized
tgaggattctattaaaaact

SEQ ID NO: 24611 - DNA, 20 bp, Artificial Sequence
  chemically synthesized
gaggattctattaaaaacta

SEQ ID NO: 24612 - DNA, 20 bp, Artificial Sequence
  chemically synthesized
gggaccatatgcaatacatc

SEQ ID NO: 24613 - DNA, 20 bp, Artificial Sequence
  chemically synthesized
caatacatccagactatatt

SEQ ID NO: 24614 - DNA, 20 bp, Artificial Sequence
  chemically synthesized
agactatatttagtgtacaa

SEQ ID NO: 24615 - DNA, 20 bp, Artificial Sequence
  chemically synthesized
tatatttagtgtacaataga

SEQ ID NO: 24616 - DNA, 20 bp, Artificial Sequence
  chemically synthesized
acaatagaaagcaattacca

SEQ ID NO: 24617 - DNA, 20 bp, Artificial Sequence
  chemically synthesized
accatagcaattatgttccc

SEQ ID NO: 24618 - DNA, 20 bp, Artificial Sequence
  chemically synthesized
tcttctctctttgcaaaccc

SEQ ID NO: 24619 - DNA, 20 bp, Artificial Sequence
  chemically synthesized
tgcaaaccccagcccccact

SEQ ID NO: 24620 - DNA, 20 bp, Artificial Sequence
  chemically synthesized
agcccccactcagcatgaca

SEQ ID NO: 24621 - DNA, 20 bp, Artificial Sequence
  chemically synthesized
ccccactcagcatgacatgg

SEQ ID NO: 24622 - DNA, 20 bp, Artificial Sequence
  chemically synthesized
cccactcagcatgacatggc

SEQ ID NO: 24623 - DNA, 20 bp, Artificial Sequence
  chemically synthesized
tgacatggcaggtataaaaa

SEQ ID NO: 24624 - DNA, 20 bp, Artificial Sequence
  chemically synthesized
gacatggcaggtataaaaat

SEQ ID NO: 24625 - DNA, 20 bp, Artificial Sequence
  chemically synthesized
aggtataaaaataggcaact

SEQ ID NO: 24626 - DNA, 20 bp, Artificial Sequence
  chemically synthesized
aactcagacccatttctgta

SEQ ID NO: 24627 - DNA, 20 bp, Artificial Sequence
  chemically synthesized
actcagacccatttctgtaa

SEQ ID NO: 24628 - DNA, 20 bp, Artificial Sequence
  chemically synthesized
tcagacccatttctgtaaag

SEQ ID NO: 24629 - DNA, 20 bp, Artificial Sequence
  chemically synthesized
cagacccatttctgtaaagg

SEQ ID NO: 24630 - DNA, 20 bp, Artificial Sequence
  chemically synthesized
gacccatttctgtaaaggag

SEQ ID NO: 24631 - DNA, 20 bp, Artificial Sequence
  chemically synthesized
ccatttctgtaaaggaggag

SEQ ID NO: 24632 - DNA, 20 bp, Artificial Sequence
  chemically synthesized
aaaggaggagaagcttgtgt

SEQ ID NO: 24633 - DNA, 20 bp, Artificial Sequence
  chemically synthesized
aaggaggagaagcttgtgtt

SEQ ID NO: 24634 - DNA, 20 bp, Artificial Sequence
  chemically synthesized
ggagaagcttgtgttaggaa

SEQ ID NO: 24635 - DNA, 20 bp, Artificial Sequence
  chemically synthesized
gaagcttgtgttaggaatgg

SEQ ID NO: 24636 - DNA, 20 bp, Artificial Sequence
  chemically synthesized
gttaggaatggaagaatgcc

SEQ ID NO: 24637 - DNA, 20 bp, Artificial Sequence
  chemically synthesized
ttaggaatggaagaatgcct

SEQ ID NO: 24638 - DNA, 20 bp, Artificial Sequence
  chemically synthesized
gaatggaagaatgcctgggc

SEQ ID NO: 24639 - DNA, 20 bp, Artificial Sequence
  chemically synthesized
atggaagaatgcctgggctg

SEQ ID NO: 24640 - DNA, 20 bp, Artificial Sequence
  chemically synthesized
agaatgcctgggctggagaa

SEQ ID NO: 24641 - DNA, 20 bp, Artificial Sequence
  chemically synthesized
gaatgcctgggctggagaac

SEQ ID NO: 24642 - DNA, 20 bp, Artificial Sequence
  chemically synthesized
aatgcctgggctggagaaca

SEQ ID NO: 24643 - DNA, 20 bp, Artificial Sequence
  chemically synthesized
tggagaacagggcttcacaa

SEQ ID NO: 24644 - DNA, 20 bp, Artificial Sequence
  chemically synthesized
aacagggcttcacaacagtg

SEQ ID NO: 24645 - DNA, 20 bp, Artificial Sequence
  chemically synthesized
gcttcacaacagtgtagtga

SEQ ID NO: 24646 - DNA, 20 bp, Artificial Sequence
  chemically synthesized
cacccacatattatgtgatg

SEQ ID NO: 24647 - DNA, 20 bp, Artificial Sequence
  chemically synthesized
attatgtgatgtggacctct

SEQ ID NO: 24648 - DNA, 20 bp, Artificial Sequence
  chemically synthesized
tgtgatgtggacctctgagc

SEQ ID NO: 24649 - DNA, 20 bp, Artificial Sequence
  chemically synthesized
gtgatgtggacctctgagcc

SEQ ID NO: 24650 - DNA, 20 bp, Artificial Sequence
  chemically synthesized
aggtactatctcattctcca

SEQ ID NO: 24651 - DNA, 20 bp, Artificial Sequence
  chemically synthesized
tcattctccatggttgcaat

SEQ ID NO: 24652 - DNA, 20 bp, Artificial Sequence
  chemically synthesized
cattctccatggttgcaata

SEQ ID NO: 24653 - DNA, 20 bp, Artificial Sequence
  chemically synthesized
ggttgcaataaggtcgatta

SEQ ID NO: 24654 - DNA, 20 bp, Artificial Sequence
  chemically synthesized
ggtcgattatagattcaata

SEQ ID NO: 24655 - DNA, 20 bp, Artificial Sequence
  chemically synthesized
gtcgattatagattcaataa

SEQ ID NO: 24656 - DNA, 20 bp, Artificial Sequence
  chemically synthesized
gattatagattcaataaagg

SEQ ID NO: 24657 - DNA, 20 bp, Artificial Sequence
  chemically synthesized
ttatagattcaataaaggaa

SEQ ID NO: 24658 - DNA, 20 bp, Artificial Sequence
  chemically synthesized
tatagattcaataaaggaag

SEQ ID NO: 24659 - DNA, 20 bp, Artificial Sequence
  chemically synthesized
gaagaggtatctcaacacta

SEQ ID NO: 24660 - DNA, 20 bp, Artificial Sequence
  chemically synthesized
aggtatctcaacactaaaga

SEQ ID NO: 24661 - DNA, 20 bp, Artificial Sequence
  chemically synthesized
gtatctcaacactaaagaaa

SEQ ID NO: 24662 - DNA, 20 bp, Artificial Sequence
  chemically synthesized
taaagaaagagtaaaatttt

SEQ ID NO: 24663 - DNA, 20 bp, Artificial Sequence
  chemically synthesized
aaagaaagagtaaaattttc

SEQ ID NO: 24664 - DNA, 20 bp, Artificial Sequence
  chemically synthesized
aagaaagagtaaaattttca

SEQ ID NO: 24665 - DNA, 20 bp, Artificial Sequence
  chemically synthesized
taaaattttcagggttcaac

SEQ ID NO: 24666 - DNA, 20 bp, Artificial Sequence
  chemically synthesized
ggttcaacaagcgaccacct

SEQ ID NO: 24667 - DNA, 20 bp, Artificial Sequence
  chemically synthesized
gttcaacaagcgaccaccta

SEQ ID NO: 24668 - DNA, 20 bp, Artificial Sequence
  chemically synthesized
ttcaacaagcgaccacctaa

SEQ ID NO: 24669 - DNA, 20 bp, Artificial Sequence
  chemically synthesized
cctaaattttgacaaacttt

SEQ ID NO: 24670 - DNA, 20 bp, Artificial Sequence
  chemically synthesized
tgacaaactttaagttcaaa

SEQ ID NO: 24671 - DNA, 20 bp, Artificial Sequence
  chemically synthesized
ttaagttcaaaaagctcatc

SEQ ID NO: 24672 - DNA, 20 bp, Artificial Sequence
  chemically synthesized
aagctcatctagctatgaca

SEQ ID NO: 24673 - DNA, 20 bp, Artificial Sequence
  chemically synthesized
agctatgacaaagtttgaca

SEQ ID NO: 24674 - DNA, 20 bp, Artificial Sequence
  chemically synthesized
atgacaaagtttgacatagt

SEQ ID NO: 24675 - DNA, 20 bp, Artificial Sequence
  chemically synthesized
aaagtttgacatagttagat

SEQ ID NO: 24676 - DNA, 20 bp, Artificial Sequence
  chemically synthesized
tcttgacttcacaaaaccat

SEQ ID NO: 24677 - DNA, 20 bp, Artificial Sequence
  chemically synthesized
ttcacaaaaccattggaatt

SEQ ID NO: 24678 - DNA, 20 bp, Artificial Sequence
  chemically synthesized
tcacaaaaccattggaattt

SEQ ID NO: 24679 - DNA, 20 bp, Artificial Sequence
  chemically synthesized
cacaaaaccattggaatttg

SEQ ID NO: 24680 - DNA, 20 bp, Artificial Sequence
  chemically synthesized
cattggaatttggggtgata

SEQ ID NO: 24681 - DNA, 20 bp, Artificial Sequence
  chemically synthesized
ttggaatttggggtgatatg

SEQ ID NO: 24682 - DNA, 20 bp, Artificial Sequence
  chemically synthesized
tggaatttggggtgatatgg

SEQ ID NO: 24683 - DNA, 20 bp, Artificial Sequence
  chemically synthesized
atttggggtgatatggaggc

SEQ ID NO: 24684 - DNA, 20 bp, Artificial Sequence
  chemically synthesized
atatggaggcaagccaaatg

SEQ ID NO: 24685 - DNA, 20 bp, Artificial Sequence
  chemically synthesized
aggcaagccaaatgcagaaa

SEQ ID NO: 24686 - DNA, 20 bp, Artificial Sequence
  chemically synthesized
ggcaagccaaatgcagaaac

SEQ ID NO: 24687 - DNA, 20 bp, Artificial Sequence
  chemically synthesized
caagccaaatgcagaaacag

SEQ ID NO: 24688 - DNA, 20 bp, Artificial Sequence
  chemically synthesized
aagccaaatgcagaaacagg

SEQ ID NO: 24689 - DNA, 20 bp, Artificial Sequence
  chemically synthesized
aatgcagaaacaggaggtca

SEQ ID NO: 24690 - DNA, 20 bp, Artificial Sequence
  chemically synthesized
cagaaacaggaggtcatggt

SEQ ID NO: 24691 - DNA, 20 bp, Artificial Sequence
  chemically synthesized
agaaacaggaggtcatggta

SEQ ID NO: 24692 - DNA, 20 bp, Artificial Sequence
  chemically synthesized
gtcatggtaaggctatgatg

SEQ ID NO: 24693 - DNA, 20 bp, Artificial Sequence
  chemically synthesized
ggtaaggctatgatgcagtt

SEQ ID NO: 24694 - DNA, 20 bp, Artificial Sequence
  chemically synthesized
gtaaggctatgatgcagttt

SEQ ID NO: 24695 - DNA, 20 bp, Artificial Sequence
  chemically synthesized
aaggctatgatgcagtttag

SEQ ID NO: 24696 - DNA, 20 bp, Artificial Sequence
  chemically synthesized
gtgatgtgtcatttctgtga

SEQ ID NO: 24697 - DNA, 20 bp, Artificial Sequence
  chemically synthesized
tgatgtgtcatttctgtgac

SEQ ID NO: 24698 - DNA, 20 bp, Artificial Sequence
  chemically synthesized
tcatttctgtgacaggatat

SEQ ID NO: 24699 - DNA, 20 bp, Artificial Sequence
  chemically synthesized
atttctgtgacaggatatga

SEQ ID NO: 24700 - DNA, 20 bp, Artificial Sequence
  chemically synthesized
gagctgcacatctttctgtt

SEQ ID NO: 24701 - DNA, 20 bp, Artificial Sequence
  chemically synthesized
gccatatttgtaattctcaa

SEQ ID NO: 24702 - DNA, 20 bp, Artificial Sequence
  chemically synthesized
tatttgtaattctcaatggt

SEQ ID NO: 24703 - DNA, 20 bp, Artificial Sequence
  chemically synthesized
tcaatggtcagtctccttgc

SEQ ID NO: 24704 - DNA, 20 bp, Artificial Sequence
  chemically synthesized
ctataaattcaactacatgc

SEQ ID NO: 24705 - DNA, 20 bp, Artificial Sequence
  chemically synthesized
ttcaactacatgccagcttt

SEQ ID NO: 24706 - DNA, 20 bp, Artificial Sequence
  chemically synthesized
ctacatgccagctttaagca

SEQ ID NO: 24707 - DNA, 20 bp, Artificial Sequence
  chemically synthesized
gctttaagcacagtgctttg

SEQ ID NO: 24708 - DNA, 20 bp, Artificial Sequence
  chemically synthesized
tttaagcacagtgctttgaa

SEQ ID NO: 24709 - DNA, 20 bp, Artificial Sequence
  chemically synthesized
taagcacagtgctttgaaga

SEQ ID NO: 24710 - DNA, 20 bp, Artificial Sequence
  chemically synthesized
gcacagtgctttgaagagag

SEQ ID NO: 24711 - DNA, 20 bp, Artificial Sequence
  chemically synthesized
cacagtgctttgaagagagt

SEQ ID NO: 24712 - DNA, 20 bp, Artificial Sequence
  chemically synthesized
cagtgctttgaagagagtag

SEQ ID NO: 24713 - DNA, 20 bp, Artificial Sequence
  chemically synthesized
attaaatgaaaaaataaact

SEQ ID NO: 24714 - DNA, 20 bp, Artificial Sequence
  chemically synthesized
tgaaaaaataaactaagcgt

SEQ ID NO: 24715 - DNA, 20 bp, Artificial Sequence
  chemically synthesized
aaaaaataaactaagcgtga

SEQ ID NO: 24716 - DNA, 20 bp, Artificial Sequence
  chemically synthesized
aaaaataaactaagcgtgag

SEQ ID NO: 24717 - DNA, 20 bp, Artificial Sequence
  chemically synthesized
tctctgattttgtgcactct

SEQ ID NO: 24718 - DNA, 20 bp, Artificial Sequence
  chemically synthesized
ctctgattttgtgcactcta

SEQ ID NO: 24719 - DNA, 20 bp, Artificial Sequence
  chemically synthesized
tgattttgtgcactctaagg

SEQ ID NO: 24720 - DNA, 20 bp, Artificial Sequence
  chemically synthesized
gcactctaaggcagccctct

SEQ ID NO: 24721 - DNA, 20 bp, Artificial Sequence
  chemically synthesized
ctctaagctgtttgcccatc

SEQ ID NO: 24722 - DNA, 20 bp, Artificial Sequence
  chemically synthesized
tttgcccatccagcatatga

SEQ ID NO: 24723 - DNA, 20 bp, Artificial Sequence
  chemically synthesized
gcccatccagcatatgacag

SEQ ID NO: 24724 - DNA, 20 bp, Artificial Sequence
  chemically synthesized
atatgacagaagactcttca

SEQ ID NO: 24725 - DNA, 20 bp, Artificial Sequence
  chemically synthesized
ctcttcaaagtgaatgatca

SEQ ID NO: 24726 - DNA, 20 bp, Artificial Sequence
  chemically synthesized
tgatcaaagtcccttgttta

SEQ ID NO: 24727 - DNA, 20 bp, Artificial Sequence
  chemically synthesized
gatcaaagtcccttgtttac

SEQ ID NO: 24728 - DNA, 20 bp, Artificial Sequence
  chemically synthesized
atcaaagtcccttgtttaca

SEQ ID NO: 24729 - DNA, 20 bp, Artificial Sequence
  chemically synthesized
cccccaccctcttccttcct

SEQ ID NO: 24730 - DNA, 20 bp, Artificial Sequence
  chemically synthesized
tccttcctgagcatgtgttc

SEQ ID NO: 24731 - DNA, 20 bp, Artificial Sequence
  chemically synthesized
catgtgttctggatatgctg

SEQ ID NO: 24732 - DNA, 20 bp, Artificial Sequence
  chemically synthesized
atatgctgaagccaacctca

SEQ ID NO: 24733 - DNA, 20 bp, Artificial Sequence
  chemically synthesized
tatgctgaagccaacctcac

SEQ ID NO: 24734 - DNA, 20 bp, Artificial Sequence
  chemically synthesized
aggactttgttacctttcct

SEQ ID NO: 24735 - DNA, 20 bp, Artificial Sequence
  chemically synthesized
tacctttcctaagtttctat

SEQ ID NO: 24736 - DNA, 20 bp, Artificial Sequence
  chemically synthesized
tggtgaatttccatttaata

SEQ ID NO: 24737 - DNA, 20 bp, Artificial Sequence
  chemically synthesized
atagttttattaaatgattt

SEQ ID NO: 24738 - DNA, 20 bp, Artificial Sequence
  chemically synthesized
taaataatttttaatcattg

SEQ ID NO: 24739 - DNA, 20 bp, Artificial Sequence
  chemically synthesized
tttaatcattgtagcttcta

SEQ ID NO: 24740 - DNA, 20 bp, Artificial Sequence
  chemically synthesized
aatcattgtagcttctatgg

SEQ ID NO: 24741 - DNA, 20 bp, Artificial Sequence
  chemically synthesized
agcttctatggtggatacac

SEQ ID NO: 24742 - DNA, 20 bp, Artificial Sequence
  chemically synthesized
gcttctatggtggatacaca

SEQ ID NO: 24743 - DNA, 20 bp, Artificial Sequence
  chemically synthesized
ttctatggtggatacacaag

SEQ ID NO: 24744 - DNA, 20 bp, Artificial Sequence
  chemically synthesized
tatggtggatacacaaggag

SEQ ID NO: 24745 - DNA, 20 bp, Artificial Sequence
  chemically synthesized
ggtggatacacaaggagaag

SEQ ID NO: 24746 - DNA, 20 bp, Artificial Sequence
  chemically synthesized
tggatacacaaggagaagca

SEQ ID NO: 24747 - DNA, 20 bp, Artificial Sequence
  chemically synthesized
gatacacaaggagaagcaga

SEQ ID NO: 24748 - DNA, 20 bp, Artificial Sequence
  chemically synthesized
tacacaaggagaagcagaga

SEQ ID NO: 24749 - DNA, 20 bp, Artificial Sequence
  chemically synthesized
cacaaggagaagcagagaga

SEQ ID NO: 24750 - DNA, 20 bp, Artificial Sequence
  chemically synthesized
acaaggagaagcagagagag

SEQ ID NO: 24751 - DNA, 20 bp, Artificial Sequence
  chemically synthesized
caaggagaagcagagagaga

SEQ ID NO: 24752 - DNA, 20 bp, Artificial Sequence
  chemically synthesized
gagagagagggaaaaaaatg

SEQ ID NO: 24753 - DNA, 20 bp, Artificial Sequence
  chemically synthesized
gagggaaaaaaatgaagtaa

SEQ ID NO: 24754 - DNA, 20 bp, Artificial Sequence
  chemically synthesized
ggaaaaaaatgaagtaacag

SEQ ID NO: 24755 - DNA, 20 bp, Artificial Sequence
  chemically synthesized
gaaaaaaatgaagtaacaga

SEQ ID NO: 24756 - DNA, 20 bp, Artificial Sequence
  chemically synthesized
atgaagtaacagaaggctac

SEQ ID NO: 24757 - DNA, 20 bp, Artificial Sequence
  chemically synthesized
tgaagtaacagaaggctaca

SEQ ID NO: 24758 - DNA, 20 bp, Artificial Sequence
  chemically synthesized
gaagtaacagaaggctacaa

SEQ ID NO: 24759 - DNA, 20 bp, Artificial Sequence
  chemically synthesized
aagtaacagaaggctacaag

SEQ ID NO: 24760 - DNA, 20 bp, Artificial Sequence
  chemically synthesized
aggctacaaggggatttctc

SEQ ID NO: 24761 - DNA, 20 bp, Artificial Sequence
  chemically synthesized
tcttcttgtcattcttgtca

SEQ ID NO: 24762 - DNA, 20 bp, Artificial Sequence
  chemically synthesized
cttgtcacagcaatgaatct

SEQ ID NO: 24763 - DNA, 20 bp, Artificial Sequence
  chemically synthesized
ttgtcacagcaatgaatctt

SEQ ID NO: 24764 - DNA, 20 bp, Artificial Sequence
  chemically synthesized
gcaatgaatcttgggcaaat

SEQ ID NO: 24765 - DNA, 20 bp, Artificial Sequence
  chemically synthesized
caatgaatcttgggcaaata

SEQ ID NO: 24766 - DNA, 20 bp, Artificial Sequence
  chemically synthesized
aatgaatcttgggcaaataa

SEQ ID NO: 24767 - DNA, 20 bp, Artificial Sequence
  chemically synthesized
cttgtaataaccttgaattc

SEQ ID NO: 24768 - DNA, 20 bp, Artificial Sequence
  chemically synthesized
gtaataaccttgaattcaag

SEQ ID NO: 24769 - DNA, 20 bp, Artificial Sequence
  chemically synthesized
ataaccttgaattcaagtgg

SEQ ID NO: 24770 - DNA, 20 bp, Artificial Sequence
  chemically synthesized
aataacttttcttctttgtc

SEQ ID NO: 24771 - DNA, 20 bp, Artificial Sequence
  chemically synthesized
acttttcttctttgtctggt

SEQ ID NO: 24772 - DNA, 20 bp, Artificial Sequence
  chemically synthesized
tctttgtctggtgagttctg

SEQ ID NO: 24773 - DNA, 20 bp, Artificial Sequence
  chemically synthesized
tggtgagttctgtagacatt

SEQ ID NO: 24774 - DNA, 20 bp, Artificial Sequence
  chemically synthesized
gtgagttctgtagacattta

SEQ ID NO: 24775 - DNA, 20 bp, Artificial Sequence
  chemically synthesized
ttctgtagacatttagagtg

SEQ ID NO: 24776 - DNA, 20 bp, Artificial Sequence
  chemically synthesized
tctgtagacatttagagtgt

SEQ ID NO: 24777 - DNA, 20 bp, Artificial Sequence
  chemically synthesized
ctgtagacatttagagtgta

SEQ ID NO: 24778 - DNA, 20 bp, Artificial Sequence
  chemically synthesized
agacatttagagtgtagggc

SEQ ID NO: 24779 - DNA, 20 bp, Artificial Sequence
  chemically synthesized
ctggcaactgtgtttaaaat

SEQ ID NO: 24780 - DNA, 20 bp, Artificial Sequence
  chemically synthesized
aaataagttgtctattatat

SEQ ID NO: 24781 - DNA, 20 bp, Artificial Sequence
  chemically synthesized
aataagttgtctattatatc

SEQ ID NO: 24782 - DNA, 20 bp, Artificial Sequence
  chemically synthesized
tctattatatcaggactcca

SEQ ID NO: 24783 - DNA, 20 bp, Artificial Sequence
  chemically synthesized
caggactccatggaaacatc

SEQ ID NO: 24784 - DNA, 20 bp, Artificial Sequence
  chemically synthesized
catggaaacatctagtgaac

SEQ ID NO: 24785 - DNA, 20 bp, Artificial Sequence
  chemically synthesized
ggaaacatctagtgaaccag

SEQ ID NO: 24786 - DNA, 20 bp, Artificial Sequence
  chemically synthesized
gaaacatctagtgaaccaga

SEQ ID NO: 24787 - DNA, 20 bp, Artificial Sequence
  chemically synthesized
aaacatctagtgaaccagaa

SEQ ID NO: 24788 - DNA, 20 bp, Artificial Sequence
  chemically synthesized
atctagtgaaccagaagggc

SEQ ID NO: 24789 - DNA, 20 bp, Artificial Sequence
  chemically synthesized
tagtgaaccagaagggctgg

SEQ ID NO: 24790 - DNA, 20 bp, Artificial Sequence
  chemically synthesized
gaaccagaagggctggtggt

SEQ ID NO: 24791 - DNA, 20 bp, Artificial Sequence
  chemically synthesized
agaagggctggtggtgagaa

SEQ ID NO: 24792 - DNA, 20 bp, Artificial Sequence
  chemically synthesized
ggtggtgagaacagtgttat

SEQ ID NO: 24793 - DNA, 20 bp, Artificial Sequence
  chemically synthesized
cagtgttattagaataccac

SEQ ID NO: 24794 - DNA, 20 bp, Artificial Sequence
  chemically synthesized
agaataccactggtgtttgc

SEQ ID NO: 24795 - DNA, 20 bp, Artificial Sequence
  chemically synthesized
ccactggtgtttgccagctg

SEQ ID NO: 24796 - DNA, 20 bp, Artificial Sequence
  chemically synthesized
tttgccagctgtggaaaaca

SEQ ID NO: 24797 - DNA, 20 bp, Artificial Sequence
  chemically synthesized
ttgccagctgtggaaaacat

SEQ ID NO: 24798 - DNA, 20 bp, Artificial Sequence
  chemically synthesized
agctgtggaaaacatgggta

SEQ ID NO: 24799 - DNA, 20 bp, Artificial Sequence
  chemically synthesized
ctgtggaaaacatgggtata

SEQ ID NO: 24800 - DNA, 20 bp, Artificial Sequence
  chemically synthesized
tagagcatacactgatgcca

SEQ ID NO: 24801 - DNA, 20 bp, Artificial Sequence
  chemically synthesized
agagcatacactgatgccaa

SEQ ID NO: 24802 - DNA, 20 bp, Artificial Sequence
  chemically synthesized
gccaaaggcaaaccaatgca

SEQ ID NO: 24803 - DNA, 20 bp, Artificial Sequence
  chemically synthesized
aaggcaaaccaatgcatggc

SEQ ID NO: 24804 - DNA, 20 bp, Artificial Sequence
  chemically synthesized
aaccaatgcatggctggtcc

SEQ ID NO: 24805 - DNA, 20 bp, Artificial Sequence
  chemically synthesized
atgcatggctggtcccggca

SEQ ID NO: 24806 - DNA, 20 bp, Artificial Sequence
  chemically synthesized
gctggtcccggcatggcaac

SEQ ID NO: 24807 - DNA, 20 bp, Artificial Sequence
  chemically synthesized
tggcaacaagtaaccaaata

SEQ ID NO: 24808 - DNA, 20 bp, Artificial Sequence
  chemically synthesized
ggcaacaagtaaccaaatat

SEQ ID NO: 24809 - DNA, 20 bp, Artificial Sequence
  chemically synthesized
caagtaaccaaatatgggat

SEQ ID NO: 24810 - DNA, 20 bp, Artificial Sequence
  chemically synthesized
agtaaccaaatatgggatga

SEQ ID NO: 24811 - DNA, 20 bp, Artificial Sequence
  chemically synthesized
ccaaatatgggatgagagac

SEQ ID NO: 24812 - DNA, 20 bp, Artificial Sequence
  chemically synthesized
atgggatgagagacaagatc

SEQ ID NO: 24813 - DNA, 20 bp, Artificial Sequence
  chemically synthesized
agacaagatcaagcatactg

SEQ ID NO: 24814 - DNA, 20 bp, Artificial Sequence
  chemically synthesized
gcatactgtagaaatcgctg

SEQ ID NO: 24815 - DNA, 20 bp, Artificial Sequence
  chemically synthesized
atactgtagaaatcgctgtg

SEQ ID NO: 24816 - DNA, 20 bp, Artificial Sequence
  chemically synthesized
actgtagaaatcgctgtgga

SEQ ID NO: 24817 - DNA, 20 bp, Artificial Sequence
  chemically synthesized
tcgctgtggagagatgcatt

SEQ ID NO: 24818 - DNA, 20 bp, Artificial Sequence
  chemically synthesized
gagagatgcatttagatgaa

SEQ ID NO: 24819 - DNA, 20 bp, Artificial Sequence
  chemically synthesized
agagatgcatttagatgaaa

SEQ ID NO: 24820 - DNA, 20 bp, Artificial Sequence
  chemically synthesized
atgaaaaggtaacccaattc

SEQ ID NO: 24821 - DNA, 20 bp, Artificial Sequence
  chemically synthesized
gtaacccaattctggtctgc

SEQ ID NO: 24822 - DNA, 20 bp, Artificial Sequence
  chemically synthesized
cccaattctggtctgccagt

SEQ ID NO: 24823 - DNA, 20 bp, Artificial Sequence
  chemically synthesized
accattttcctgtctatgca

SEQ ID NO: 24824 - DNA, 20 bp, Artificial Sequence
  chemically synthesized
ccattttcctgtctatgcac

SEQ ID NO: 24825 - DNA, 20 bp, Artificial Sequence
  chemically synthesized
tttcctgtctatgcacagga

SEQ ID NO: 24826 - DNA, 20 bp, Artificial Sequence
  chemically synthesized
ttcctgtctatgcacaggat

SEQ ID NO: 24827 - DNA, 20 bp, Artificial Sequence
  chemically synthesized
tctatgcacaggataggata

SEQ ID NO: 24828 - DNA, 20 bp, Artificial Sequence
  chemically synthesized
gatatggctgtactacctcg

SEQ ID NO: 24829 - DNA, 20 bp, Artificial Sequence
  chemically synthesized
tacctcgaagttttttcaca

SEQ ID NO: 24830 - DNA, 20 bp, Artificial Sequence
  chemically synthesized
tgatacacaaaaacattatc

SEQ ID NO: 24831 - DNA, 20 bp, Artificial Sequence
  chemically synthesized
tatcgagatgcacatgacat

SEQ ID NO: 24832 - DNA, 20 bp, Artificial Sequence
  chemically synthesized
atgacatcggtttgccatga

SEQ ID NO: 24833 - DNA, 20 bp, Artificial Sequence
  chemically synthesized
tgacatcggtttgccatgac

SEQ ID NO: 24834 - DNA, 20 bp, Artificial Sequence
  chemically synthesized
gacatcggtttgccatgaca

SEQ ID NO: 24835 - DNA, 20 bp, Artificial Sequence
  chemically synthesized
gtttgccatgacagggctct

SEQ ID NO: 24836 - DNA, 20 bp, Artificial Sequence
  chemically synthesized
aacacacctccaaatgtgtt

SEQ ID NO: 24837 - DNA, 20 bp, Artificial Sequence
  chemically synthesized
acacacctccaaatgtgttg

SEQ ID NO: 24838 - DNA, 20 bp, Artificial Sequence
  chemically synthesized
aaatgtgttgaggccctaat

SEQ ID NO: 24839 - DNA, 20 bp, Artificial Sequence
  chemically synthesized
tcctgtaattatttaaaaaa

SEQ ID NO: 24840 - DNA, 20 bp, Artificial Sequence
  chemically synthesized
attatttaaaaaatagatat

SEQ ID NO: 24841 - DNA, 20 bp, Artificial Sequence
  chemically synthesized
aaaaatagatataagctttt

SEQ ID NO: 24842 - DNA, 20 bp, Artificial Sequence
  chemically synthesized
aaaatagatataagcttttg

SEQ ID NO: 24843 - DNA, 20 bp, Artificial Sequence
  chemically synthesized
aaatagatataagcttttga

SEQ ID NO: 24844 - DNA, 20 bp, Artificial Sequence
  chemically synthesized
tagatataagcttttgaggg

SEQ ID NO: 24845 - DNA, 20 bp, Artificial Sequence
  chemically synthesized
tgagggcagatattataatc

SEQ ID NO: 24846 - DNA, 20 bp, Artificial Sequence
  chemically synthesized
gagggcagatattataatcc

SEQ ID NO: 24847 - DNA, 20 bp, Artificial Sequence
  chemically synthesized
cctccattacccacattgtc

SEQ ID NO: 24848 - DNA, 20 bp, Artificial Sequence
  chemically synthesized
ccacattgtctagcacatta

SEQ ID NO: 24849 - DNA, 20 bp, Artificial Sequence
  chemically synthesized
tctagcacattatagatgct

SEQ ID NO: 24850 - DNA, 20 bp, Artificial Sequence
  chemically synthesized
tatagatgcttagtatgtgc

SEQ ID NO: 24851 - DNA, 20 bp, Artificial Sequence
  chemically synthesized
agtatgtgctggcttgatga

SEQ ID NO: 24852 - DNA, 20 bp, Artificial Sequence
  chemically synthesized
gtatgtgctggcttgatgac

SEQ ID NO: 24853 - DNA, 20 bp, Artificial Sequence
  chemically synthesized
gctggcttgatgacaggatg

SEQ ID NO: 24854 - DNA, 20 bp, Artificial Sequence
  chemically synthesized
ttgatgacaggatgaagttt

SEQ ID NO: 24855 - DNA, 20 bp, Artificial Sequence
  chemically synthesized
tttaagttgctaaccattct

SEQ ID NO: 24856 - DNA, 20 bp, Artificial Sequence
  chemically synthesized
taagttgctaaccattctta

SEQ ID NO: 24857 - DNA, 20 bp, Artificial Sequence
  chemically synthesized
aagttgctaaccattcttag

SEQ ID NO: 24858 - DNA, 20 bp, Artificial Sequence
  chemically synthesized
gaggaactctgcttacctct

SEQ ID NO: 24859 - DNA, 20 bp, Artificial Sequence
  chemically synthesized
aggaactctgcttacctctt

SEQ ID NO: 24860 - DNA, 20 bp, Artificial Sequence
  chemically synthesized
tgcttacctcttgggttctg

SEQ ID NO: 24861 - DNA, 20 bp, Artificial Sequence
  chemically synthesized
gcttacctcttgggttctga

SEQ ID NO: 24862 - DNA, 20 bp, Artificial Sequence
  chemically synthesized
cttacctcttgggttctgaa

SEQ ID NO: 24863 - DNA, 20 bp, Artificial Sequence
  chemically synthesized
ttctgaagggtctgactgac

SEQ ID NO: 24864 - DNA, 20 bp, Artificial Sequence
  chemically synthesized
ctgaagggtctgactgacca

SEQ ID NO: 24865 - DNA, 20 bp, Artificial Sequence
  chemically synthesized
gaagggtctgactgaccaga

SEQ ID NO: 24866 - DNA, 20 bp, Artificial Sequence
  chemically synthesized
aagggtctgactgaccagag

SEQ ID NO: 24867 - DNA, 20 bp, Artificial Sequence
  chemically synthesized
tgactgaccagagaggcatg

SEQ ID NO: 24868 - DNA, 20 bp, Artificial Sequence
  chemically synthesized
gactgaccagagaggcatga

SEQ ID NO: 24869 - DNA, 20 bp, Artificial Sequence
  chemically synthesized
actgaccagagaggcatgaa

SEQ ID NO: 24870 - DNA, 20 bp, Artificial Sequence
  chemically synthesized
ctgaccagagaggcatgaag

SEQ ID NO: 24871 - DNA, 20 bp, Artificial Sequence
  chemically synthesized
tgaccagagaggcatgaagg

SEQ ID NO: 24872 - DNA, 20 bp, Artificial Sequence
  chemically synthesized
ccagagaggcatgaaggggg

SEQ ID NO: 24873 - DNA, 20 bp, Artificial Sequence
  chemically synthesized
cagagaggcatgaagggggc

SEQ ID NO: 24874 - DNA, 20 bp, Artificial Sequence
  chemically synthesized
aggcatgaagggggcaggct

SEQ ID NO: 24875 - DNA, 20 bp, Artificial Sequence
  chemically synthesized
ggcaggctcagcatgatcac

SEQ ID NO: 24876 - DNA, 20 bp, Artificial Sequence
  chemically synthesized
tcagcatgatcaccagcact

SEQ ID NO: 24877 - DNA, 20 bp, Artificial Sequence
  chemically synthesized
actgagaaccacacaaactg

SEQ ID NO: 24878 - DNA, 20 bp, Artificial Sequence
  chemically synthesized
cacacaaactgaagaactgc

SEQ ID NO: 24879 - DNA, 20 bp, Artificial Sequence
  chemically synthesized
acacaaactgaagaactgct

SEQ ID NO: 24880 - DNA, 20 bp, Artificial Sequence
  chemically synthesized
actgaagaactgctaggtgc

SEQ ID NO: 24881 - DNA, 20 bp, Artificial Sequence
  chemically synthesized
aagaactgctaggtgctggc

SEQ ID NO: 24882 - DNA, 20 bp, Artificial Sequence
  chemically synthesized
aactgctaggtgctggctag

SEQ ID NO: 24883 - DNA, 20 bp, Artificial Sequence
  chemically synthesized
actgctaggtgctggctagt

SEQ ID NO: 24884 - DNA, 20 bp, Artificial Sequence
  chemically synthesized
tgctaggtgctggctagtgg

SEQ ID NO: 24885 - DNA, 20 bp, Artificial Sequence
  chemically synthesized
tgctggctagtgggagactt

SEQ ID NO: 24886 - DNA, 20 bp, Artificial Sequence
  chemically synthesized
aagaccaaccaaccacccta

SEQ ID NO: 24887 - DNA, 20 bp, Artificial Sequence
  chemically synthesized
gaccaaccaaccaccctatg

SEQ ID NO: 24888 - DNA, 20 bp, Artificial Sequence
  chemically synthesized
caaccaaccaccctatggag

SEQ ID NO: 24889 - DNA, 20 bp, Artificial Sequence
  chemically synthesized
caaccaccctatggagcagc

SEQ ID NO: 24890 - DNA, 20 bp, Artificial Sequence
  chemically synthesized
aaccaccctatggagcagcc

SEQ ID NO: 24891 - DNA, 20 bp, Artificial Sequence
  chemically synthesized
ctatggagcagccaggtaat

SEQ ID NO: 24892 - DNA, 20 bp, Artificial Sequence
  chemically synthesized
agccaggtaatcagcatgtt

SEQ ID NO: 24893 - DNA, 20 bp, Artificial Sequence
  chemically synthesized
gccaggtaatcagcatgttt

SEQ ID NO: 24894 - DNA, 20 bp, Artificial Sequence
  chemically synthesized
ccaggtaatcagcatgtttg

SEQ ID NO: 24895 - DNA, 20 bp, Artificial Sequence
  chemically synthesized
caggtaatcagcatgtttgg

SEQ ID NO: 24896 - DNA, 20 bp, Artificial Sequence
  chemically synthesized
gcatgtttgggggctgttaa

SEQ ID NO: 24897 - DNA, 20 bp, Artificial Sequence
  chemically synthesized
tgtttgggggctgttaatgg

SEQ ID NO: 24898 - DNA, 20 bp, Artificial Sequence
  chemically synthesized
tttgggggctgttaatggaa

SEQ ID NO: 24899 - DNA, 20 bp, Artificial Sequence
  chemically synthesized
ctgttaatggaagagttgct

SEQ ID NO: 24900 - DNA, 20 bp, Artificial Sequence
  chemically synthesized
tgttaatggaagagttgctg

SEQ ID NO: 24901 - DNA, 20 bp, Artificial Sequence
  chemically synthesized
gttaatggaagagttgctga

SEQ ID NO: 24902 - DNA, 20 bp, Artificial Sequence
  chemically synthesized
ttaatggaagagttgctgag

SEQ ID NO: 24903 - DNA, 20 bp, Artificial Sequence
  chemically synthesized
gaggggtatgcttacttgtc

SEQ ID NO: 24904 - DNA, 20 bp, Artificial Sequence
  chemically synthesized
ttgtccagttgtgtgtgact

SEQ ID NO: 24905 - DNA, 20 bp, Artificial Sequence
  chemically synthesized
gtccagttgtgtgtgactta

SEQ ID NO: 24906 - DNA, 20 bp, Artificial Sequence
  chemically synthesized
tccagttgtgtgtgacttag

SEQ ID NO: 24907 - DNA, 20 bp, Artificial Sequence
  chemically synthesized
gtgtgacttagaggtgaacc

SEQ ID NO: 24908 - DNA, 20 bp, Artificial Sequence
  chemically synthesized
tgacttagaggtgaacccag

SEQ ID NO: 24909 - DNA, 20 bp, Artificial Sequence
  chemically synthesized
gacttagaggtgaacccagt

SEQ ID NO: 24910 - DNA, 20 bp, Artificial Sequence
  chemically synthesized
gtgaacccagtgggcaaaat

SEQ ID NO: 24911 - DNA, 20 bp, Artificial Sequence
  chemically synthesized
ccagtgggcaaaataagaaa

SEQ ID NO: 24912 - DNA, 20 bp, Artificial Sequence
  chemically synthesized
aaaataagaaacagtatgtg

SEQ ID NO: 24913 - DNA, 20 bp, Artificial Sequence
  chemically synthesized
aataagaaacagtatgtgaa

SEQ ID NO: 24914 - DNA, 20 bp, Artificial Sequence
  chemically synthesized
ataagaaacagtatgtgaag

SEQ ID NO: 24915 - DNA, 20 bp, Artificial Sequence
  chemically synthesized
gaaacagtatgtgaagagga

SEQ ID NO: 24916 - DNA, 20 bp, Artificial Sequence
  chemically synthesized
aacagtatgtgaagaggata

SEQ ID NO: 24917 - DNA, 20 bp, Artificial Sequence
  chemically synthesized
gtatgtgaagaggatagagc

SEQ ID NO: 24918 - DNA, 20 bp, Artificial Sequence
  chemically synthesized
aagaggatagagcaagcctt

SEQ ID NO: 24919 - DNA, 20 bp, Artificial Sequence
  chemically synthesized
aggatagagcaagccttaag

SEQ ID NO: 24920 - DNA, 20 bp, Artificial Sequence
  chemically synthesized
ggatagagcaagccttaagt

SEQ ID NO: 24921 - DNA, 20 bp, Artificial Sequence
  chemically synthesized
tagagcaagccttaagtagg

SEQ ID NO: 24922 - DNA, 20 bp, Artificial Sequence
  chemically synthesized
caagccttaagtaggaagtt

SEQ ID NO: 24923 - DNA, 20 bp, Artificial Sequence
  chemically synthesized
aagccttaagtaggaagtta

SEQ ID NO: 24924 - DNA, 20 bp, Artificial Sequence
  chemically synthesized
ttaagtaggaagttaaggat

SEQ ID NO: 24925 - DNA, 20 bp, Artificial Sequence
  chemically synthesized
taagtaggaagttaaggatg

SEQ ID NO: 24926 - DNA, 20 bp, Artificial Sequence
  chemically synthesized
aagtaggaagttaaggatga

SEQ ID NO: 24927 - DNA, 20 bp, Artificial Sequence
  chemically synthesized
gaagttaaggatgagggaaa

SEQ ID NO: 24928 - DNA, 20 bp, Artificial Sequence
  chemically synthesized
aagttaaggatgagggaaac

SEQ ID NO: 24929 - DNA, 20 bp, Artificial Sequence
  chemically synthesized
ttaaggatgagggaaacagg

SEQ ID NO: 24930 - DNA, 20 bp, Artificial Sequence
  chemically synthesized
taaggatgagggaaacagga

SEQ ID NO: 24931 - DNA, 20 bp, Artificial Sequence
  chemically synthesized
agggaaacaggaaggaaaat

SEQ ID NO: 24932 - DNA, 20 bp, Artificial Sequence
  chemically synthesized
gaaacaggaaggaaaatcag

SEQ ID NO: 24933 - DNA, 20 bp, Artificial Sequence
  chemically synthesized
aaacaggaaggaaaatcagt

SEQ ID NO: 24934 - DNA, 20 bp, Artificial Sequence
  chemically synthesized
aggaaggaaaatcagtagga

SEQ ID NO: 24935 - DNA, 20 bp, Artificial Sequence
  chemically synthesized
ggaaaatcagtaggaaagta

SEQ ID NO: 24936 - DNA, 20 bp, Artificial Sequence
  chemically synthesized
aaatcagtaggaaagtatag

SEQ ID NO: 24937 - DNA, 20 bp, Artificial Sequence
  chemically synthesized
gtaggaaagtatagaagaca

SEQ ID NO: 24938 - DNA, 20 bp, Artificial Sequence
  chemically synthesized
taggaaagtatagaagacaa

SEQ ID NO: 24939 - DNA, 20 bp, Artificial Sequence
  chemically synthesized
ggaaagtatagaagacaaag

SEQ ID NO: 24940 - DNA, 20 bp, Artificial Sequence
  chemically synthesized
agtatagaagacaaaggaga

SEQ ID NO: 24941 - DNA, 20 bp, Artificial Sequence
  chemically synthesized
gtatagaagacaaaggagaa

SEQ ID NO: 24942 - DNA, 20 bp, Artificial Sequence
  chemically synthesized
tatagaagacaaaggagaaa

SEQ ID NO: 24943 - DNA, 20 bp, Artificial Sequence
  chemically synthesized
gaagacaaaggagaaagggc

SEQ ID NO: 24944 - DNA, 20 bp, Artificial Sequence
  chemically synthesized
agacaaaggagaaagggcca

SEQ ID NO: 24945 - DNA, 20 bp, Artificial Sequence
  chemically synthesized
aggagaaagggccagagaaa

SEQ ID NO: 24946 - DNA, 20 bp, Artificial Sequence
  chemically synthesized
agaaagggccagagaaacag

SEQ ID NO: 24947 - DNA, 20 bp, Artificial Sequence
  chemically synthesized
gaaagggccagagaaacaga

SEQ ID NO: 24948 - DNA, 20 bp, Artificial Sequence
  chemically synthesized
agggccagagaaacagaagg

SEQ ID NO: 24949 - DNA, 20 bp, Artificial Sequence
  chemically synthesized
aacagaaggaagaatctgaa

SEQ ID NO: 24950 - DNA, 20 bp, Artificial Sequence
  chemically synthesized
acagaaggaagaatctgaaa

SEQ ID NO: 24951 - DNA, 20 bp, Artificial Sequence
  chemically synthesized
agaaggaagaatctgaaaag

SEQ ID NO: 24952 - DNA, 20 bp, Artificial Sequence
  chemically synthesized
aagaatctgaaaaggagctc

SEQ ID NO: 24953 - DNA, 20 bp, Artificial Sequence
  chemically synthesized
agaatctgaaaaggagctca

SEQ ID NO: 24954 - DNA, 20 bp, Artificial Sequence
  chemically synthesized
gaatctgaaaaggagctcaa

SEQ ID NO: 24955 - DNA, 20 bp, Artificial Sequence
  chemically synthesized
tctgaaaaggagctcaaggg

SEQ ID NO: 24956 - DNA, 20 bp, Artificial Sequence
  chemically synthesized
ctgaaaaggagctcaaggga

SEQ ID NO: 24957 - DNA, 20 bp, Artificial Sequence
  chemically synthesized
ctcaagggaaggttcctctg

SEQ ID NO: 24958 - DNA, 20 bp, Artificial Sequence
  chemically synthesized
tcaagggaaggttcctctgt

SEQ ID NO: 24959 - DNA, 20 bp, Artificial Sequence
  chemically synthesized
agggaaggttcctctgtggg

SEQ ID NO: 24960 - DNA, 20 bp, Artificial Sequence
  chemically synthesized
cctctgtgggtagcctgtta

SEQ ID NO: 24961 - DNA, 20 bp, Artificial Sequence
  chemically synthesized
gtgggtagcctgttaaagaa

SEQ ID NO: 24962 - DNA, 20 bp, Artificial Sequence
  chemically synthesized
tgggtagcctgttaaagaaa

SEQ ID NO: 24963 - DNA, 20 bp, Artificial Sequence
  chemically synthesized
ttaaagaaaaggctacatta

SEQ ID NO: 24964 - DNA, 20 bp, Artificial Sequence
  chemically synthesized
cagactcatgcctgtaatcc

SEQ ID NO: 24965 - DNA, 20 bp, Artificial Sequence
  chemically synthesized
tgcctgtaatcccagcactt

SEQ ID NO: 24966 - DNA, 20 bp, Artificial Sequence
  chemically synthesized
gcctgtaatcccagcacttt

SEQ ID NO: 24967 - DNA, 20 bp, Artificial Sequence
  chemically synthesized
tgtaatcccagcactttggg

SEQ ID NO: 24968 - DNA, 20 bp, Artificial Sequence
  chemically synthesized
tcccagcactttgggtggct

SEQ ID NO: 24969 - DNA, 20 bp, Artificial Sequence
  chemically synthesized
cccagcactttgggtggctg

SEQ ID NO: 24970 - DNA, 20 bp, Artificial Sequence
  chemically synthesized
agcactttgggtggctgagg

SEQ ID NO: 24971 - DNA, 20 bp, Artificial Sequence
  chemically synthesized
gcactttgggtggctgaggc

SEQ ID NO: 24972 - DNA, 20 bp, Artificial Sequence
  chemically synthesized
actttgggtggctgaggcag

SEQ ID NO: 24973 - DNA, 20 bp, Artificial Sequence
  chemically synthesized
ctttgggtggctgaggcagg

SEQ ID NO: 24974 - DNA, 20 bp, Artificial Sequence
  chemically synthesized
ctgaggcaggaggatcacct

SEQ ID NO: 24975 - DNA, 20 bp, Artificial Sequence
  chemically synthesized
tgaggcaggaggatcacctg

SEQ ID NO: 24976 - DNA, 20 bp, Artificial Sequence
  chemically synthesized
gaggcaggaggatcacctga

SEQ ID NO: 24977 - DNA, 20 bp, Artificial Sequence
  chemically synthesized
caggaggatcacctgagggc

SEQ ID NO: 24978 - DNA, 20 bp, Artificial Sequence
  chemically synthesized
ggaggatcacctgagggcaa

SEQ ID NO: 24979 - DNA, 20 bp, Artificial Sequence
  chemically synthesized
tcacctgagggcaagagttc

SEQ ID NO: 24980 - DNA, 20 bp, Artificial Sequence
  chemically synthesized
tgagggcaagagttcgagac

SEQ ID NO: 24981 - DNA, 20 bp, Artificial Sequence
  chemically synthesized
cgagaccagcctgaccaaca

SEQ ID NO: 24982 - DNA, 20 bp, Artificial Sequence
  chemically synthesized
taataaaaatacaaaaaaat

SEQ ID NO: 24983 - DNA, 20 bp, Artificial Sequence
  chemically synthesized
taaaaatacaaaaaaattag

SEQ ID NO: 24984 - DNA, 20 bp, Artificial Sequence
  chemically synthesized
aaaaatacaaaaaaattagc

SEQ ID NO: 24985 - DNA, 20 bp, Artificial Sequence
  chemically synthesized
aaaatacaaaaaaattagca

SEQ ID NO: 24986 - DNA, 20 bp, Artificial Sequence
  chemically synthesized
acaaaaaaattagcagggcc

SEQ ID NO: 24987 - DNA, 20 bp, Artificial Sequence
  chemically synthesized
aaaaaattagcagggcctgg

SEQ ID NO: 24988 - DNA, 20 bp, Artificial Sequence
  chemically synthesized
aaattagcagggcctggtgg

SEQ ID NO: 24989 - DNA, 20 bp, Artificial Sequence
  chemically synthesized
gtggcagatgcctgtaattg

SEQ ID NO: 24990 - DNA, 20 bp, Artificial Sequence
  chemically synthesized
tgcctgtaattgcagctaca

SEQ ID NO: 24991 - DNA, 20 bp, Artificial Sequence
  chemically synthesized
gcctgtaattgcagctacac

SEQ ID NO: 24992 - DNA, 20 bp, Artificial Sequence
  chemically synthesized
ctgtaattgcagctacacag

SEQ ID NO: 24993 - DNA, 20 bp, Artificial Sequence
  chemically synthesized
tgtaattgcagctacacagg

SEQ ID NO: 24994 - DNA, 20 bp, Artificial Sequence
  chemically synthesized
ttgcagctacacaggaggct

SEQ ID NO: 24995 - DNA, 20 bp, Artificial Sequence
  chemically synthesized
tgcagctacacaggaggctg

SEQ ID NO: 24996 - DNA, 20 bp, Artificial Sequence
  chemically synthesized
agctacacaggaggctgagg

SEQ ID NO: 24997 - DNA, 20 bp, Artificial Sequence
  chemically synthesized
gctacacaggaggctgaggt

SEQ ID NO: 24998 - DNA, 20 bp, Artificial Sequence
  chemically synthesized
tacacaggaggctgaggtag

SEQ ID NO: 24999 - DNA, 20 bp, Artificial Sequence
  chemically synthesized
gtaggagaatcgcttgaacc

SEQ ID NO: 25000 - DNA, 20 bp, Artificial Sequence
  chemically synthesized
taggagaatcgcttgaacct

SEQ ID NO: 25001 - DNA, 20 bp, Artificial Sequence
  chemically synthesized
ggagaatcgcttgaacctgg

SEQ ID NO: 25002 - DNA, 20 bp, Artificial Sequence
  chemically synthesized
gagaatcgcttgaacctggg

SEQ ID NO: 25003 - DNA, 20 bp, Artificial Sequence
  chemically synthesized
aatcgcttgaacctgggagg

SEQ ID NO: 25004 - DNA, 20 bp, Artificial Sequence
  chemically synthesized
tcgcttgaacctgggaggcg

SEQ ID NO: 25005 - DNA, 20 bp, Artificial Sequence
  chemically synthesized
cgcttgaacctgggaggcgg

SEQ ID NO: 25006 - DNA, 20 bp, Artificial Sequence
  chemically synthesized
aacctgggaggcggaggttg

SEQ ID NO: 25007 - DNA, 20 bp, Artificial Sequence
  chemically synthesized
tgggaggcggaggttgcagt

SEQ ID NO: 25008 - DNA, 20 bp, Artificial Sequence
  chemically synthesized
ggcggaggttgcagtgagcc

SEQ ID NO: 25009 - DNA, 20 bp, Artificial Sequence
  chemically synthesized
gagatcgcgccattgcactc

SEQ ID NO: 25010 - DNA, 20 bp, Artificial Sequence
  chemically synthesized
atcgcgccattgcactccag

SEQ ID NO: 25011 - DNA, 20 bp, Artificial Sequence
  chemically synthesized
gccattgcactccagcagcc

SEQ ID NO: 25012 - DNA, 20 bp, Artificial Sequence
  chemically synthesized
attgcactccagcagcctgg

SEQ ID NO: 25013 - DNA, 20 bp, Artificial Sequence
  chemically synthesized
ttgcactccagcagcctgga

SEQ ID NO: 25014 - DNA, 20 bp, Artificial Sequence
  chemically synthesized
tccagcagcctggaaggcaa

SEQ ID NO: 25015 - DNA, 20 bp, Artificial Sequence
  chemically synthesized
gcagcctggaaggcaaaagc

SEQ ID NO: 25016 - DNA, 20 bp, Artificial Sequence
  chemically synthesized
ctggaaggcaaaagcaagat

SEQ ID NO: 25017 - DNA, 20 bp, Artificial Sequence
  chemically synthesized
aaggcaaaagcaagatgaga

SEQ ID NO: 25018 - DNA, 20 bp, Artificial Sequence
  chemically synthesized
aaagcaagatgagaaagaaa

SEQ ID NO: 25019 - DNA, 20 bp, Artificial Sequence
  chemically synthesized
agcaagatgagaaagaaata

SEQ ID NO: 25020 - DNA, 20 bp, Artificial Sequence
  chemically synthesized
agatgagaaagaaatagaga

SEQ ID NO: 25021 - DNA, 20 bp, Artificial Sequence
  chemically synthesized
atgagaaagaaatagagaaa

SEQ ID NO: 25022 - DNA, 20 bp, Artificial Sequence
  chemically synthesized
gagaaagaaatagagaaaga

SEQ ID NO: 25023 - DNA, 20 bp, Artificial Sequence
  chemically synthesized
gaaagaaatagagaaagaga

SEQ ID NO: 25024 - DNA, 20 bp, Artificial Sequence
  chemically synthesized
aagaaatagagaaagagaga

SEQ ID NO: 25025 - DNA, 20 bp, Artificial Sequence
  chemically synthesized
agaaatagagaaagagagag

SEQ ID NO: 25026 - DNA, 20 bp, Artificial Sequence
  chemically synthesized
aatagagaaagagagagagg

SEQ ID NO: 25027 - DNA, 20 bp, Artificial Sequence
  chemically synthesized
atagagaaagagagagaggt

SEQ ID NO: 25028 - DNA, 20 bp, Artificial Sequence
  chemically synthesized
tagagaaagagagagaggta

SEQ ID NO: 25029 - DNA, 20 bp, Artificial Sequence
  chemically synthesized
gagaaagagagagaggtagg

SEQ ID NO: 25030 - DNA, 20 bp, Artificial Sequence
  chemically synthesized
agaaagagagagaggtaggg

SEQ ID NO: 25031 - DNA, 20 bp, Artificial Sequence
  chemically synthesized
gaaagagagagaggtaggga

SEQ ID NO: 25032 - DNA, 20 bp, Artificial Sequence
  chemically synthesized
aagagagagaggtagggagg

SEQ ID NO: 25033 - DNA, 20 bp, Artificial Sequence
  chemically synthesized
agagagagaggtagggaggg

SEQ ID NO: 25034 - DNA, 20 bp, Artificial Sequence
  chemically synthesized
gagagaggtagggagggagg

SEQ ID NO: 25035 - DNA, 20 bp, Artificial Sequence
  chemically synthesized
agagaggtagggagggagga

SEQ ID NO: 25036 - DNA, 20 bp, Artificial Sequence
  chemically synthesized
gaggtagggagggaggaagg

SEQ ID NO: 25037 - DNA, 20 bp, Artificial Sequence
  chemically synthesized
aggtagggagggaggaagga

SEQ ID NO: 25038 - DNA, 20 bp, Artificial Sequence
  chemically synthesized
ggtagggagggaggaaggaa

SEQ ID NO: 25039 - DNA, 20 bp, Artificial Sequence
  chemically synthesized
agggagggaggaaggaaggg

SEQ ID NO: 25040 - DNA, 20 bp, Artificial Sequence
  chemically synthesized
gggagggaggaaggaaggga

SEQ ID NO: 25041 - DNA, 20 bp, Artificial Sequence
  chemically synthesized
gggaggaaggaagggaagga

SEQ ID NO: 25042 - DNA, 20 bp, Artificial Sequence
  chemically synthesized
ggaggaaggaagggaaggaa

SEQ ID NO: 25043 - DNA, 20 bp, Artificial Sequence
  chemically synthesized
ggaaggaagggaaggaaagg

SEQ ID NO: 25044 - DNA, 20 bp, Artificial Sequence
  chemically synthesized
gaaggaagggaaggaaagga

SEQ ID NO: 25045 - DNA, 20 bp, Artificial Sequence
  chemically synthesized
ggaagggaaggaaaggaagg

SEQ ID NO: 25046 - DNA, 20 bp, Artificial Sequence
  chemically synthesized
aagggaaggaaaggaaggaa

SEQ ID NO: 25047 - DNA, 20 bp, Artificial Sequence
  chemically synthesized
ggaaggaaaggaaggaagag

SEQ ID NO: 25048 - DNA, 20 bp, Artificial Sequence
  chemically synthesized
aggaaaggaaggaagagaag

SEQ ID NO: 25049 - DNA, 20 bp, Artificial Sequence
  chemically synthesized
aaaggaaggaagagaagaag

SEQ ID NO: 25050 - DNA, 20 bp, Artificial Sequence
  chemically synthesized
ggaaggaagagaagaagaag

SEQ ID NO: 25051 - DNA, 20 bp, Artificial Sequence
  chemically synthesized
aggaagagaagaagaagaag

SEQ ID NO: 25052 - DNA, 20 bp, Artificial Sequence
  chemically synthesized
ggaagagaagaagaagaaga

SEQ ID NO: 25053 - DNA, 20 bp, Artificial Sequence
  chemically synthesized
aagagaagaagaagaagaag

SEQ ID NO: 25054 - DNA, 20 bp, Artificial Sequence
  chemically synthesized
agaagaagaagaagaaggag

SEQ ID NO: 25055 - DNA, 20 bp, Artificial Sequence
  chemically synthesized
gaagaagaagaagaaggaga

SEQ ID NO: 25056 - DNA, 20 bp, Artificial Sequence
  chemically synthesized
agaagaagaagaaggagaag

SEQ ID NO: 25057 - DNA, 20 bp, Artificial Sequence
  chemically synthesized
agaagaagaaggagaaggag

SEQ ID NO: 25058 - DNA, 20 bp, Artificial Sequence
  chemically synthesized
agaaggagaaggagaagaaa

SEQ ID NO: 25059 - DNA, 20 bp, Artificial Sequence
  chemically synthesized
aggagaaggagaagaaaaag

SEQ ID NO: 25060 - DNA, 20 bp, Artificial Sequence
  chemically synthesized
gagaaggagaagaaaaagta

SEQ ID NO: 25061 - DNA, 20 bp, Artificial Sequence
  chemically synthesized
agaaggagaagaaaaagtag

SEQ ID NO: 25062 - DNA, 20 bp, Artificial Sequence
  chemically synthesized
aaggagaagaaaaagtagag

SEQ ID NO: 25063 - DNA, 20 bp, Artificial Sequence
  chemically synthesized
aggagaagaaaaagtagagg

SEQ ID NO: 25064 - DNA, 20 bp, Artificial Sequence
  chemically synthesized
gagaagaaaaagtagaggag

SEQ ID NO: 25065 - DNA, 20 bp, Artificial Sequence
  chemically synthesized
agaagaaaaagtagaggagg

SEQ ID NO: 25066 - DNA, 20 bp, Artificial Sequence
  chemically synthesized
gaaaaagtagaggaggagga

SEQ ID NO: 25067 - DNA, 20 bp, Artificial Sequence
  chemically synthesized
aaaaagtagaggaggaggaa

SEQ ID NO: 25068 - DNA, 20 bp, Artificial Sequence
  chemically synthesized
agtagaggaggaggaaagga

SEQ ID NO: 25069 - DNA, 20 bp, Artificial Sequence
  chemically synthesized
gtagaggaggaggaaaggaa

SEQ ID NO: 25070 - DNA, 20 bp, Artificial Sequence
  chemically synthesized
aggaggaggaaaggaaagga

SEQ ID NO: 25071 - DNA, 20 bp, Artificial Sequence
  chemically synthesized
aggaggaaaggaaaggaaag

SEQ ID NO: 25072 - DNA, 20 bp, Artificial Sequence
  chemically synthesized
ggaggaaaggaaaggaaaga

SEQ ID NO: 25073 - DNA, 20 bp, Artificial Sequence
  chemically synthesized
ggaaaggaaaggaaagaagg

SEQ ID NO: 25074 - DNA, 20 bp, Artificial Sequence
  chemically synthesized
gaaaggaaaggaaagaagga

SEQ ID NO: 25075 - DNA, 20 bp, Artificial Sequence
  chemically synthesized
aggaaaggaaagaaggaagg

SEQ ID NO: 25076 - DNA, 20 bp, Artificial Sequence
  chemically synthesized
ggaaaggaaagaaggaagga

SEQ ID NO: 25077 - DNA, 20 bp, Artificial Sequence
  chemically synthesized
aaagaaggaaggaaggaaat

SEQ ID NO: 25078 - DNA, 20 bp, Artificial Sequence
  chemically synthesized
aagaaggaaggaaggaaatc

SEQ ID NO: 25079 - DNA, 20 bp, Artificial Sequence
  chemically synthesized
agaaggaaggaaggaaatca

SEQ ID NO: 25080 - DNA, 20 bp, Artificial Sequence
  chemically synthesized
ggaaatcagggtattcactt

SEQ ID NO: 25081 - DNA, 20 bp, Artificial Sequence
  chemically synthesized
gggtattcacttgagattca

SEQ ID NO: 25082 - DNA, 20 bp, Artificial Sequence
  chemically synthesized
cacttgagattcaaagtctt

SEQ ID NO: 25083 - DNA, 20 bp, Artificial Sequence
  chemically synthesized
ttagaataaaaattaaaatt

SEQ ID NO: 25084 - DNA, 20 bp, Artificial Sequence
  chemically synthesized
tagaataaaaattaaaattt

SEQ ID NO: 25085 - DNA, 20 bp, Artificial Sequence
  chemically synthesized
aaattaaaatttgggaaaat

SEQ ID NO: 25086 - DNA, 20 bp, Artificial Sequence
  chemically synthesized
tgatgactaattccaatccc

SEQ ID NO: 25087 - DNA, 20 bp, Artificial Sequence
  chemically synthesized
actaattccaatcccaagca

SEQ ID NO: 25088 - DNA, 20 bp, Artificial Sequence
  chemically synthesized
ctaattccaatcccaagcac

SEQ ID NO: 25089 - DNA, 20 bp, Artificial Sequence
  chemically synthesized
gcacgggtctctgtgcaatg

SEQ ID NO: 25090 - DNA, 20 bp, Artificial Sequence
  chemically synthesized
cacgggtctctgtgcaatgc

SEQ ID NO: 25091 - DNA, 20 bp, Artificial Sequence
  chemically synthesized
gtctctgtgcaatgcaggac

SEQ ID NO: 25092 - DNA, 20 bp, Artificial Sequence
  chemically synthesized
tctctgtgcaatgcaggact

SEQ ID NO: 25093 - DNA, 20 bp, Artificial Sequence
  chemically synthesized
ctgtgcaatgcaggactggg

SEQ ID NO: 25094 - DNA, 20 bp, Artificial Sequence
  chemically synthesized
tgtgcaatgcaggactggga

SEQ ID NO: 25095 - DNA, 20 bp, Artificial Sequence
  chemically synthesized
aatgcaggactgggaaggtt

SEQ ID NO: 25096 - DNA, 20 bp, Artificial Sequence
  chemically synthesized
atgcaggactgggaaggttt

SEQ ID NO: 25097 - DNA, 20 bp, Artificial Sequence
  chemically synthesized
caggactgggaaggtttagg

SEQ ID NO: 25098 - DNA, 20 bp, Artificial Sequence
  chemically synthesized
aggactgggaaggtttaggc

SEQ ID NO: 25099 - DNA, 20 bp, Artificial Sequence
  chemically synthesized
ggactgggaaggtttaggca

SEQ ID NO: 25100 - DNA, 20 bp, Artificial Sequence
  chemically synthesized
gactgggaaggtttaggcag

SEQ ID NO: 25101 - DNA, 20 bp, Artificial Sequence
  chemically synthesized
aggggtgctatctgattcat

SEQ ID NO: 25102 - DNA, 20 bp, Artificial Sequence
  chemically synthesized
ctatctgattcatgagacaa

SEQ ID NO: 25103 - DNA, 20 bp, Artificial Sequence
  chemically synthesized
tatctgattcatgagacaac

SEQ ID NO: 25104 - DNA, 20 bp, Artificial Sequence
  chemically synthesized
ttcatgagacaacaggcaca

SEQ ID NO: 25105 - DNA, 20 bp, Artificial Sequence
  chemically synthesized
agacaacaggcacaaagttt

SEQ ID NO: 25106 - DNA, 20 bp, Artificial Sequence
  chemically synthesized
acaaagttttagtccctgcc

SEQ ID NO: 25107 - DNA, 20 bp, Artificial Sequence
  chemically synthesized
ttttagtccctgcctggact

SEQ ID NO: 25108 - DNA, 20 bp, Artificial Sequence
  chemically synthesized
tggacttggtgtcatctctt

SEQ ID NO: 25109 - DNA, 20 bp, Artificial Sequence
  chemically synthesized
tctcttgagcacatgcctaa

SEQ ID NO: 25110 - DNA, 20 bp, Artificial Sequence
  chemically synthesized
ctcctaacattcccctccca

SEQ ID NO: 25111 - DNA, 20 bp, Artificial Sequence
  chemically synthesized
aatgcttccacctcccgctg

SEQ ID NO: 25112 - DNA, 20 bp, Artificial Sequence
  chemically synthesized
tcccgctgcagtccatgaac

SEQ ID NO: 25113 - DNA, 20 bp, Artificial Sequence
  chemically synthesized
cccgctgcagtccatgaacc

SEQ ID NO: 25114 - DNA, 20 bp, Artificial Sequence
  chemically synthesized
tgaaccaggataaaattctc

SEQ ID NO: 25115 - DNA, 20 bp, Artificial Sequence
  chemically synthesized
accaggataaaattctctag

SEQ ID NO: 25116 - DNA, 20 bp, Artificial Sequence
  chemically synthesized
aggataaaattctctagcag

SEQ ID NO: 25117 - DNA, 20 bp, Artificial Sequence
  chemically synthesized
gataaaattctctagcagca

SEQ ID NO: 25118 - DNA, 20 bp, Artificial Sequence
  chemically synthesized
ttctctagcagcagagacca

SEQ ID NO: 25119 - DNA, 20 bp, Artificial Sequence
  chemically synthesized
gagaccaaagacattctctc

SEQ ID NO: 25120 - DNA, 20 bp, Artificial Sequence
  chemically synthesized
aaagacattctctcaagtct

SEQ ID NO: 25121 - DNA, 20 bp, Artificial Sequence
  chemically synthesized
aagacattctctcaagtctc

SEQ ID NO: 25122 - DNA, 20 bp, Artificial Sequence
  chemically synthesized
tctctcaagtctcaggaatg

SEQ ID NO: 25123 - DNA, 20 bp, Artificial Sequence
  chemically synthesized
gtctcaggaatgtggttctg

SEQ ID NO: 25124 - DNA, 20 bp, Artificial Sequence
  chemically synthesized
tctcaggaatgtggttctga

SEQ ID NO: 25125 - DNA, 20 bp, Artificial Sequence
  chemically synthesized
caggaatgtggttctgaagg

SEQ ID NO: 25126 - DNA, 20 bp, Artificial Sequence
  chemically synthesized
ggaatgtggttctgaaggaa

SEQ ID NO: 25127 - DNA, 20 bp, Artificial Sequence
  chemically synthesized
atgtggttctgaaggaagag

SEQ ID NO: 25128 - DNA, 20 bp, Artificial Sequence
  chemically synthesized
catacacatgccaccttgca

SEQ ID NO: 25129 - DNA, 20 bp, Artificial Sequence
  chemically synthesized
tgccaccttgcaaagccact

SEQ ID NO: 25130 - DNA, 20 bp, Artificial Sequence
  chemically synthesized
tgcaaagccacttagtgaca

SEQ ID NO: 25131 - DNA, 20 bp, Artificial Sequence
  chemically synthesized
caaagccacttagtgacaca

SEQ ID NO: 25132 - DNA, 20 bp, Artificial Sequence
  chemically synthesized
cacttagtgacacagagttt

SEQ ID NO: 25133 - DNA, 20 bp, Artificial Sequence
  chemically synthesized
ttagttatttcattgtgaac

SEQ ID NO: 25134 - DNA, 20 bp, Artificial Sequence
  chemically synthesized
ctggaataaaatcattttga

SEQ ID NO: 25135 - DNA, 20 bp, Artificial Sequence
  chemically synthesized
tggaataaaatcattttgaa

SEQ ID NO: 25136 - DNA, 20 bp, Artificial Sequence
  chemically synthesized
gaataaaatcattttgaaag

SEQ ID NO: 25137 - DNA, 20 bp, Artificial Sequence
  chemically synthesized
attttgaaaggagatttttg

SEQ ID NO: 25138 - DNA, 20 bp, Artificial Sequence
  chemically synthesized
aaggagatttttgaagttaa

SEQ ID NO: 25139 - DNA, 20 bp, Artificial Sequence
  chemically synthesized
tttgaagttaaaagcattgc

SEQ ID NO: 25140 - DNA, 20 bp, Artificial Sequence
  chemically synthesized
aagttaaaagcattgccaga

SEQ ID NO: 25141 - DNA, 20 bp, Artificial Sequence
  chemically synthesized
agttaaaagcattgccagaa

SEQ ID NO: 25142 - DNA, 20 bp, Artificial Sequence
  chemically synthesized
ttaaaagcattgccagaaag

SEQ ID NO: 25143 - DNA, 20 bp, Artificial Sequence
  chemically synthesized
gccagaaaggagtcacaatc

SEQ ID NO: 25144 - DNA, 20 bp, Artificial Sequence
  chemically synthesized
ggagtcacaatccagaccct

SEQ ID NO: 25145 - DNA, 20 bp, Artificial Sequence
  chemically synthesized
agtcacaatccagaccctaa

SEQ ID NO: 25146 - DNA, 20 bp, Artificial Sequence
  chemically synthesized
tcacaatccagaccctaaga

SEQ ID NO: 25147 - DNA, 20 bp, Artificial Sequence
  chemically synthesized
cacaatccagaccctaagag

SEQ ID NO: 25148 - DNA, 20 bp, Artificial Sequence
  chemically synthesized
acaatccagaccctaagaga

SEQ ID NO: 25149 - DNA, 20 bp, Artificial Sequence
  chemically synthesized
agaccctaagagagggttct

SEQ ID NO: 25150 - DNA, 20 bp, Artificial Sequence
  chemically synthesized
ggttcttggatttcgtgccc

SEQ ID NO: 25151 - DNA, 20 bp, Artificial Sequence
  chemically synthesized
cttggatttcgtgcccaaga

SEQ ID NO: 25152 - DNA, 20 bp, Artificial Sequence
  chemically synthesized
ttcgtgcccaagaaagaatt

SEQ ID NO: 25153 - DNA, 20 bp, Artificial Sequence
  chemically synthesized
tcgtgcccaagaaagaattt

SEQ ID NO: 25154 - DNA, 20 bp, Artificial Sequence
  chemically synthesized
cgtgcccaagaaagaatttg

SEQ ID NO: 25155 - DNA, 20 bp, Artificial Sequence
  chemically synthesized
gaatttggggcaaatccata

SEQ ID NO: 25156 - DNA, 20 bp, Artificial Sequence
  chemically synthesized
tggggcaaatccatacagaa

SEQ ID NO: 25157 - DNA, 20 bp, Artificial Sequence
  chemically synthesized
aaatccatacagaaaagtga

SEQ ID NO: 25158 - DNA, 20 bp, Artificial Sequence
  chemically synthesized
ccatacagaaaagtgaaagc

SEQ ID NO: 25159 - DNA, 20 bp, Artificial Sequence
  chemically synthesized
aaagtgaaagcaagttaatt

SEQ ID NO: 25160 - DNA, 20 bp, Artificial Sequence
  chemically synthesized
tgaaagcaagttaattaaga

SEQ ID NO: 25161 - DNA, 20 bp, Artificial Sequence
  chemically synthesized
gcaagttaattaagaaagta

SEQ ID NO: 25162 - DNA, 20 bp, Artificial Sequence
  chemically synthesized
caagttaattaagaaagtaa

SEQ ID NO: 25163 - DNA, 20 bp, Artificial Sequence
  chemically synthesized
agttaattaagaaagtaaag

SEQ ID NO: 25164 - DNA, 20 bp, Artificial Sequence
  chemically synthesized
aaagtaaaggagtaaaataa

SEQ ID NO: 25165 - DNA, 20 bp, Artificial Sequence
  chemically synthesized
gtaaaataatggctacccta

SEQ ID NO: 25166 - DNA, 20 bp, Artificial Sequence
  chemically synthesized
taaaataatggctaccctat

SEQ ID NO: 25167 - DNA, 20 bp, Artificial Sequence
  chemically synthesized
aataatggctaccctatagg

SEQ ID NO: 25168 - DNA, 20 bp, Artificial Sequence
  chemically synthesized
tggctaccctataggcagaa

SEQ ID NO: 25169 - DNA, 20 bp, Artificial Sequence
  chemically synthesized
cctataggcagaacagtcct

SEQ ID NO: 25170 - DNA, 20 bp, Artificial Sequence
  chemically synthesized
ctataggcagaacagtcctg

SEQ ID NO: 25171 - DNA, 20 bp, Artificial Sequence
  chemically synthesized
agaacagtcctgaggactgc

SEQ ID NO: 25172 - DNA, 20 bp, Artificial Sequence
  chemically synthesized
ctgctggttgcccattttta

SEQ ID NO: 25173 - DNA, 20 bp, Artificial Sequence
  chemically synthesized
ttattgatgatatgctaaac

SEQ ID NO: 25174 - DNA, 20 bp, Artificial Sequence
  chemically synthesized
tattgatgatatgctaaaca

SEQ ID NO: 25175 - DNA, 20 bp, Artificial Sequence
  chemically synthesized
attgatgatatgctaaacaa

SEQ ID NO: 25176 - DNA, 20 bp, Artificial Sequence
  chemically synthesized
ttgatgatatgctaaacaag

SEQ ID NO: 25177 - DNA, 20 bp, Artificial Sequence
  chemically synthesized
atgatatgctaaacaagggg

SEQ ID NO: 25178 - DNA, 20 bp, Artificial Sequence
  chemically synthesized
ttattcatgcctcccctttt

SEQ ID NO: 25179 - DNA, 20 bp, Artificial Sequence
  chemically synthesized
cctccccttttcagaccgct

SEQ ID NO: 25180 - DNA, 20 bp, Artificial Sequence
  chemically synthesized
gtaacttcctgatgttgcca

SEQ ID NO: 25181 - DNA, 20 bp, Artificial Sequence
  chemically synthesized
gttgccatggcatttctaaa

SEQ ID NO: 25182 - DNA, 20 bp, Artificial Sequence
  chemically synthesized
atggcatttctaaacagtca

SEQ ID NO: 25183 - DNA, 20 bp, Artificial Sequence
  chemically synthesized
tttctaaacagtcatagtgc

SEQ ID NO: 25184 - DNA, 20 bp, Artificial Sequence
  chemically synthesized
ctaaacagtcatagtgctgg

SEQ ID NO: 25185 - DNA, 20 bp, Artificial Sequence
  chemically synthesized
taaacagtcatagtgctggt

SEQ ID NO: 25186 - DNA, 20 bp, Artificial Sequence
  chemically synthesized
aacagtcatagtgctggtgg

SEQ ID NO: 25187 - DNA, 20 bp, Artificial Sequence
  chemically synthesized
cagtcatagtgctggtggga

SEQ ID NO: 25188 - DNA, 20 bp, Artificial Sequence
  chemically synthesized
tcatagtgctggtgggagag

SEQ ID NO: 25189 - DNA, 20 bp, Artificial Sequence
  chemically synthesized
tagtgctggtgggagagtag

SEQ ID NO: 25190 - DNA, 20 bp, Artificial Sequence
  chemically synthesized
gctggtgggagagtagcagt

SEQ ID NO: 25191 - DNA, 20 bp, Artificial Sequence
  chemically synthesized
ctggtgggagagtagcagtg

SEQ ID NO: 25192 - DNA, 20 bp, Artificial Sequence
  chemically synthesized
agagtagcagtgaggactac

SEQ ID NO: 25193 - DNA, 20 bp, Artificial Sequence
  chemically synthesized
agtagcagtgaggactacca

SEQ ID NO: 25194 - DNA, 20 bp, Artificial Sequence
  chemically synthesized
gtagcagtgaggactaccag

SEQ ID NO: 25195 - DNA, 20 bp, Artificial Sequence
  chemically synthesized
ggtcactctcatcacaatct

SEQ ID NO: 25196 - DNA, 20 bp, Artificial Sequence
  chemically synthesized
ctctcatcacaatcttggtt

SEQ ID NO: 25197 - DNA, 20 bp, Artificial Sequence
  chemically synthesized
tcatcacaatcttggtttgg

SEQ ID NO: 25198 - DNA, 20 bp, Artificial Sequence
  chemically synthesized
catcacaatcttggtttggt

SEQ ID NO: 25199 - DNA, 20 bp, Artificial Sequence
  chemically synthesized
aatcttggtttggtgggttt

SEQ ID NO: 25200 - DNA, 20 bp, Artificial Sequence
  chemically synthesized
ttggtttggtgggtttcagc

SEQ ID NO: 25201 - DNA, 20 bp, Artificial Sequence
  chemically synthesized
tttactgcaaactgtttttt

SEQ ID NO: 25202 - DNA, 20 bp, Artificial Sequence
  chemically synthesized
ctgcaaactgttttttcagc

SEQ ID NO: 25203 - DNA, 20 bp, Artificial Sequence
  chemically synthesized
tgcaaactgttttttcagca

SEQ ID NO: 25204 - DNA, 20 bp, Artificial Sequence
  chemically synthesized
tcttatctcatcctgtgact

SEQ ID NO: 25205 - DNA, 20 bp, Artificial Sequence
  chemically synthesized
actgagaatgcctaactttc

SEQ ID NO: 25206 - DNA, 20 bp, Artificial Sequence
  chemically synthesized
ctgagaatgcctaactttct

SEQ ID NO: 25207 - DNA, 20 bp, Artificial Sequence
  chemically synthesized
tgcctaactttctgggaata

SEQ ID NO: 25208 - DNA, 20 bp, Artificial Sequence
  chemically synthesized
aactttctgggaatacagcc

SEQ ID NO: 25209 - DNA, 20 bp, Artificial Sequence
  chemically synthesized
tttctgggaatacagcccag

SEQ ID NO: 25210 - DNA, 20 bp, Artificial Sequence
  chemically synthesized
ttctgggaatacagcccagt

SEQ ID NO: 25211 - DNA, 20 bp, Artificial Sequence
  chemically synthesized
gaatacagcccagtaggtct

SEQ ID NO: 25212 - DNA, 20 bp, Artificial Sequence
  chemically synthesized
ggtctcagccttattgtacc

SEQ ID NO: 25213 - DNA, 20 bp, Artificial Sequence
  chemically synthesized
attgtacccagctcctattt

SEQ ID NO: 25214 - DNA, 20 bp, Artificial Sequence
  chemically synthesized
tacccagctcctatttaaga

SEQ ID NO: 25215 - DNA, 20 bp, Artificial Sequence
  chemically synthesized
cccagctcctatttaagatg

SEQ ID NO: 25216 - DNA, 20 bp, Artificial Sequence
  chemically synthesized
tatttaagatggagttgctc

SEQ ID NO: 25217 - DNA, 20 bp, Artificial Sequence
  chemically synthesized
ggttcaaatgcctctgacaa

SEQ ID NO: 25218 - DNA, 20 bp, Artificial Sequence
  chemically synthesized
gttcaaatgcctctgacaaa

SEQ ID NO: 25219 - DNA, 20 bp, Artificial Sequence
  chemically synthesized
aggaacaaaaatgttgtttc

SEQ ID NO: 25220 - DNA, 20 bp, Artificial Sequence
  chemically synthesized
aaatgttgtttctggtatgc

SEQ ID NO: 25221 - DNA, 20 bp, Artificial Sequence
  chemically synthesized
gtttctggtatgctagcacc

SEQ ID NO: 25222 - DNA, 20 bp, Artificial Sequence
  chemically synthesized
tggtatgctagcacccagaa

SEQ ID NO: 25223 - DNA, 20 bp, Artificial Sequence
  chemically synthesized
gtatgctagcacccagaata

SEQ ID NO: 25224 - DNA, 20 bp, Artificial Sequence
  chemically synthesized
tatgctagcacccagaatag

SEQ ID NO: 25225 - DNA, 20 bp, Artificial Sequence
  chemically synthesized
ctcatgcttaaatcttgacc

SEQ ID NO: 25226 - DNA, 20 bp, Artificial Sequence
  chemically synthesized
tcatgcttaaatcttgacca

SEQ ID NO: 25227 - DNA, 20 bp, Artificial Sequence
  chemically synthesized
tgcattttcctatccttact

SEQ ID NO: 25228 - DNA, 20 bp, Artificial Sequence
  chemically synthesized
attttcctatccttactcag

SEQ ID NO: 25229 - DNA, 20 bp, Artificial Sequence
  chemically synthesized
atccttactcagcagtttgt

SEQ ID NO: 25230 - DNA, 20 bp, Artificial Sequence
  chemically synthesized
tccttactcagcagtttgtg

SEQ ID NO: 25231 - DNA, 20 bp, Artificial Sequence
  chemically synthesized
ctcagcagtttgtgaggaat

SEQ ID NO: 25232 - DNA, 20 bp, Artificial Sequence
  chemically synthesized
gaggaatcagacattcttca

SEQ ID NO: 25233 - DNA, 20 bp, Artificial Sequence
  chemically synthesized
cttcaaagtttcacttctac

SEQ ID NO: 25234 - DNA, 20 bp, Artificial Sequence
  chemically synthesized
tcaaagtttcacttctacca

SEQ ID NO: 25235 - DNA, 20 bp, Artificial Sequence
  chemically synthesized
aagtttcacttctaccagag

SEQ ID NO: 25236 - DNA, 20 bp, Artificial Sequence
  chemically synthesized
gtttcacttctaccagagta

SEQ ID NO: 25237 - DNA, 20 bp, Artificial Sequence
  chemically synthesized
ttacaccccacaactaaccc

SEQ ID NO: 25238 - DNA, 20 bp, Artificial Sequence
  chemically synthesized
caactaacccaagcttcact

SEQ ID NO: 25239 - DNA, 20 bp, Artificial Sequence
  chemically synthesized
cacttggttctttgctccta

SEQ ID NO: 25240 - DNA, 20 bp, Artificial Sequence
  chemically synthesized
cttggttctttgctcctatg

SEQ ID NO: 25241 - DNA, 20 bp, Artificial Sequence
  chemically synthesized
tctttgctcctatggagacc

SEQ ID NO: 25242 - DNA, 20 bp, Artificial Sequence
  chemically synthesized
ctttgctcctatggagaccc

SEQ ID NO: 25243 - DNA, 20 bp, Artificial Sequence
  chemically synthesized
tatggagacccaggctcact

SEQ ID NO: 25244 - DNA, 20 bp, Artificial Sequence
  chemically synthesized
ttgttttttcctctgccatt

SEQ ID NO: 25245 - DNA, 20 bp, Artificial Sequence
  chemically synthesized
ccaataacttaactatgaac

SEQ ID NO: 25246 - DNA, 20 bp, Artificial Sequence
  chemically synthesized
ccagcatgaaaaatcctgtt

SEQ ID NO: 25247 - DNA, 20 bp, Artificial Sequence
  chemically synthesized
aaatcctgttaagtgttctg

SEQ ID NO: 25248 - DNA, 20 bp, Artificial Sequence
  chemically synthesized
aatcctgttaagtgttctgt

SEQ ID NO: 25249 - DNA, 20 bp, Artificial Sequence
  chemically synthesized
ttgtttcatgcttcttcata

SEQ ID NO: 25250 - DNA, 20 bp, Artificial Sequence
  chemically synthesized
cttcttcatacagtcttatg

SEQ ID NO: 25251 - DNA, 20 bp, Artificial Sequence
  chemically synthesized
cttcatacagtcttatgcag

SEQ ID NO: 25252 - DNA, 20 bp, Artificial Sequence
  chemically synthesized
acagtcttatgcagtagttt

SEQ ID NO: 25253 - DNA, 20 bp, Artificial Sequence
  chemically synthesized
cagtcttatgcagtagtttt

SEQ ID NO: 25254 - DNA, 20 bp, Artificial Sequence
  chemically synthesized
cagtagttttgggaattaaa

SEQ ID NO: 25255 - DNA, 20 bp, Artificial Sequence
  chemically synthesized
gttttgggaattaaacagtt

SEQ ID NO: 25256 - DNA, 20 bp, Artificial Sequence
  chemically synthesized
caatcccaccttccacttat

SEQ ID NO: 25257 - DNA, 20 bp, Artificial Sequence
  chemically synthesized
cttattggctgcgtacccta

SEQ ID NO: 25258 - DNA, 20 bp, Artificial Sequence
  chemically synthesized
tggctgcgtaccctatagca

SEQ ID NO: 25259 - DNA, 20 bp, Artificial Sequence
  chemically synthesized
caatttatctttctgtgttt

SEQ ID NO: 25260 - DNA, 20 bp, Artificial Sequence
  chemically synthesized
gttttggtccactcatcttt

SEQ ID NO: 25261 - DNA, 20 bp, Artificial Sequence
  chemically synthesized
ttggtccactcatctttaag

SEQ ID NO: 25262 - DNA, 20 bp, Artificial Sequence
  chemically synthesized
tggtccactcatctttaagt

SEQ ID NO: 25263 - DNA, 20 bp, Artificial Sequence
  chemically synthesized
ggtccactcatctttaagtg

SEQ ID NO: 25264 - DNA, 20 bp, Artificial Sequence
  chemically synthesized
tctttaagtggggataccaa

SEQ ID NO: 25265 - DNA, 20 bp, Artificial Sequence
  chemically synthesized
ggataccaatagtacccaca

SEQ ID NO: 25266 - DNA, 20 bp, Artificial Sequence
  chemically synthesized
aatatgtctaacgtgttcaa

SEQ ID NO: 25267 - DNA, 20 bp, Artificial Sequence
  chemically synthesized
ctaacgtgttcaatagtgcc

SEQ ID NO: 25268 - DNA, 20 bp, Artificial Sequence
  chemically synthesized
aatagtgcctggtccattgt

SEQ ID NO: 25269 - DNA, 20 bp, Artificial Sequence
  chemically synthesized
ctggtccattgtaagtatta

SEQ ID NO: 25270 - DNA, 20 bp, Artificial Sequence
  chemically synthesized
attgaaaattttgtgaaaat

SEQ ID NO: 25271 - DNA, 20 bp, Artificial Sequence
  chemically synthesized
aaatgagacaatttgacctt

SEQ ID NO: 25272 - DNA, 20 bp, Artificial Sequence
  chemically synthesized
aatgagacaatttgaccttt

SEQ ID NO: 25273 - DNA, 20 bp, Artificial Sequence
  chemically synthesized
gacaatttgacctttgggct

SEQ ID NO: 25274 - DNA, 20 bp, Artificial Sequence
  chemically synthesized
aatttgacctttgggctgag

SEQ ID NO: 25275 - DNA, 20 bp, Artificial Sequence
  chemically synthesized
ggctgagaagatactctgtc

SEQ ID NO: 25276 - DNA, 20 bp, Artificial Sequence
  chemically synthesized
tactctgtctagctctgaca

SEQ ID NO: 25277 - DNA, 20 bp, Artificial Sequence
  chemically synthesized
agaaaataaaaacctttaaa

SEQ ID NO: 25278 - DNA, 20 bp, Artificial Sequence
  chemically synthesized
tctcacaatcgtaatacttg

SEQ ID NO: 25279 - DNA, 20 bp, Artificial Sequence
  chemically synthesized
cgtaatacttgaagttacac

SEQ ID NO: 25280 - DNA, 20 bp, Artificial Sequence
  chemically synthesized
acacaagatattctaacata

SEQ ID NO: 25281 - DNA, 20 bp, Artificial Sequence
  chemically synthesized
tattctcacatgcatcctgt

SEQ ID NO: 25282 - DNA, 20 bp, Artificial Sequence
  chemically synthesized
ctcacatgcatcctgtgaga

SEQ ID NO: 25283 - DNA, 20 bp, Artificial Sequence
  chemically synthesized
acatgcatcctgtgagaaag

SEQ ID NO: 25284 - DNA, 20 bp, Artificial Sequence
  chemically synthesized
atgcatcctgtgagaaagca

SEQ ID NO: 25285 - DNA, 20 bp, Artificial Sequence
  chemically synthesized
tcctgtgagaaagcagagca

SEQ ID NO: 25286 - DNA, 20 bp, Artificial Sequence
  chemically synthesized
tgtgagaaagcagagcatag

SEQ ID NO: 25287 - DNA, 20 bp, Artificial Sequence
  chemically synthesized
tgagaaagcagagcatagta

SEQ ID NO: 25288 - DNA, 20 bp, Artificial Sequence
  chemically synthesized
gagaaagcagagcatagtag

SEQ ID NO: 25289 - DNA, 20 bp, Artificial Sequence
  chemically synthesized
gcagagcatagtagaggttt

SEQ ID NO: 25290 - DNA, 20 bp, Artificial Sequence
  chemically synthesized
aggtttcagttttatctgtc

SEQ ID NO: 25291 - DNA, 20 bp, Artificial Sequence
  chemically synthesized
gtttcagttttatctgtcaa

SEQ ID NO: 25292 - DNA, 20 bp, Artificial Sequence
  chemically synthesized
atctgtcaagagcaaaattt

SEQ ID NO: 25293 - DNA, 20 bp, Artificial Sequence
  chemically synthesized
tctgtcaagagcaaaatttg

SEQ ID NO: 25294 - DNA, 20 bp, Artificial Sequence
  chemically synthesized
atttgaggtttctaaacatt

SEQ ID NO: 25295 - DNA, 20 bp, Artificial Sequence
  chemically synthesized
aatattatgctttaaaactg

SEQ ID NO: 25296 - DNA, 20 bp, Artificial Sequence
  chemically synthesized
atattatgctttaaaactga

SEQ ID NO: 25297 - DNA, 20 bp, Artificial Sequence
  chemically synthesized
ttatgctttaaaactgaagg

SEQ ID NO: 25298 - DNA, 20 bp, Artificial Sequence
  chemically synthesized
aactgaaggaagcaaaacct

SEQ ID NO: 25299 - DNA, 20 bp, Artificial Sequence
  chemically synthesized
aaggaagcaaaacctcagca

SEQ ID NO: 25300 - DNA, 20 bp, Artificial Sequence
  chemically synthesized
aggaagcaaaacctcagcat

SEQ ID NO: 25301 - DNA, 20 bp, Artificial Sequence
  chemically synthesized
cctcagcataggccttctga

SEQ ID NO: 25302 - DNA, 20 bp, Artificial Sequence
  chemically synthesized
ggccttctgaaagcttacga

SEQ ID NO: 25303 - DNA, 20 bp, Artificial Sequence
  chemically synthesized
tggcttttctttttttcccc

SEQ ID NO: 25304 - DNA, 20 bp, Artificial Sequence
  chemically synthesized
ggcttttctttttttccccc

SEQ ID NO: 25305 - DNA, 20 bp, Artificial Sequence
  chemically synthesized
gcttttctttttttccccca

SEQ ID NO: 25306 - DNA, 20 bp, Artificial Sequence
  chemically synthesized
tctttttttcccccagggca

SEQ ID NO: 25307 - DNA, 20 bp, Artificial Sequence
  chemically synthesized
cccccagggcaaagtgttct

SEQ ID NO: 25308 - DNA, 20 bp, Artificial Sequence
  chemically synthesized
ccccagggcaaagtgttctt

SEQ ID NO: 25309 - DNA, 20 bp, Artificial Sequence
  chemically synthesized
ccagggcaaagtgttcttag

SEQ ID NO: 25310 - DNA, 20 bp, Artificial Sequence
  chemically synthesized
ggcaaagtgttcttaggagc

SEQ ID NO: 25311 - DNA, 20 bp, Artificial Sequence
  chemically synthesized
tgttcttaggagcaagatgt

SEQ ID NO: 25312 - DNA, 20 bp, Artificial Sequence
  chemically synthesized
gaatttacaccattcttatg

SEQ ID NO: 25313 - DNA, 20 bp, Artificial Sequence
  chemically synthesized
acaccattcttatgtggatt

SEQ ID NO: 25314 - DNA, 20 bp, Artificial Sequence
  chemically synthesized
accattcttatgtggattaa

SEQ ID NO: 25315 - DNA, 20 bp, Artificial Sequence
  chemically synthesized
cattcttatgtggattaaga

SEQ ID NO: 25316 - DNA, 20 bp, Artificial Sequence
  chemically synthesized
attcttatgtggattaagag

SEQ ID NO: 25317 - DNA, 20 bp, Artificial Sequence
  chemically synthesized
attaagagaggtttccttct

SEQ ID NO: 25318 - DNA, 20 bp, Artificial Sequence
  chemically synthesized
ttaagagaggtttccttctg

SEQ ID NO: 25319 - DNA, 20 bp, Artificial Sequence
  chemically synthesized
aggtttccttctgaggatgt

SEQ ID NO: 25320 - DNA, 20 bp, Artificial Sequence
  chemically synthesized
tttccttctgaggatgttgg

SEQ ID NO: 25321 - DNA, 20 bp, Artificial Sequence
  chemically synthesized
ggatgttggaagcctctgtt

SEQ ID NO: 25322 - DNA, 20 bp, Artificial Sequence
  chemically synthesized
gatgttggaagcctctgttc

SEQ ID NO: 25323 - DNA, 20 bp, Artificial Sequence
  chemically synthesized
gttcaggaactttttctttc

SEQ ID NO: 25324 - DNA, 20 bp, Artificial Sequence
  chemically synthesized
ttctttccggatcatgctta

SEQ ID NO: 25325 - DNA, 20 bp, Artificial Sequence
  chemically synthesized
ttacagatctgattacaccc

SEQ ID NO: 25326 - DNA, 20 bp, Artificial Sequence
  chemically synthesized
cagatctgattacacccaag

SEQ ID NO: 25327 - DNA, 20 bp, Artificial Sequence
  chemically synthesized
aagaagcctaaattgtgtgt

SEQ ID NO: 25328 - DNA, 20 bp, Artificial Sequence
  chemically synthesized
taaattgtgtgtcagccaac

SEQ ID NO: 25329 - DNA, 20 bp, Artificial Sequence
  chemically synthesized
gtgtgtcagccaactagatg

SEQ ID NO: 25330 - DNA, 20 bp, Artificial Sequence
  chemically synthesized
tcagccaactagatgtggac

SEQ ID NO: 25331 - DNA, 20 bp, Artificial Sequence
  chemically synthesized
ccaactagatgtggacaaga

SEQ ID NO: 25332 - DNA, 20 bp, Artificial Sequence
  chemically synthesized
gatgtggacaagatagtttt

SEQ ID NO: 25333 - DNA, 20 bp, Artificial Sequence
  chemically synthesized
gatagtttttagcctccttc

SEQ ID NO: 25334 - DNA, 20 bp, Artificial Sequence
  chemically synthesized
atagtttttagcctccttct

SEQ ID NO: 25335 - DNA, 20 bp, Artificial Sequence
  chemically synthesized
ttttagcctccttctgggac

SEQ ID NO: 25336 - DNA, 20 bp, Artificial Sequence
  chemically synthesized
ggactagatattcattcacc

SEQ ID NO: 25337 - DNA, 20 bp, Artificial Sequence
  chemically synthesized
agatattcattcaccaagat

SEQ ID NO: 25338 - DNA, 20 bp, Artificial Sequence
  chemically synthesized
caccaagatgagtgcctttg

SEQ ID NO: 25339 - DNA, 20 bp, Artificial Sequence
  chemically synthesized
caagatgagtgcctttgaag

SEQ ID NO: 25340 - DNA, 20 bp, Artificial Sequence
  chemically synthesized
ctttgaagcagaatctgtga

SEQ ID NO: 25341 - DNA, 20 bp, Artificial Sequence
  chemically synthesized
tttgaagcagaatctgtgat

SEQ ID NO: 25342 - DNA, 20 bp, Artificial Sequence
  chemically synthesized
ttgaagcagaatctgtgata

SEQ ID NO: 25343 - DNA, 20 bp, Artificial Sequence
  chemically synthesized
aagcagaatctgtgataggg

SEQ ID NO: 25344 - DNA, 20 bp, Artificial Sequence
  chemically synthesized
agaatctgtgatagggtggt

SEQ ID NO: 25345 - DNA, 20 bp, Artificial Sequence
  chemically synthesized
gaatctgtgatagggtggtt

SEQ ID NO: 25346 - DNA, 20 bp, Artificial Sequence
  chemically synthesized
gatagggtggttgggccacc

SEQ ID NO: 25347 - DNA, 20 bp, Artificial Sequence
  chemically synthesized
tagggtggttgggccaccta

SEQ ID NO: 25348 - DNA, 20 bp, Artificial Sequence
  chemically synthesized
ttgggccacctagagacata

SEQ ID NO: 25349 - DNA, 20 bp, Artificial Sequence
  chemically synthesized
tagagacatatggccatgac

SEQ ID NO: 25350 - DNA, 20 bp, Artificial Sequence
  chemically synthesized
tatggccatgactagaatct

SEQ ID NO: 25351 - DNA, 20 bp, Artificial Sequence
  chemically synthesized
atggccatgactagaatcta

SEQ ID NO: 25352 - DNA, 20 bp, Artificial Sequence
  chemically synthesized
ccatgactagaatctaaggt

SEQ ID NO: 25353 - DNA, 20 bp, Artificial Sequence
  chemically synthesized
agaatctaaggttagacata

SEQ ID NO: 25354 - DNA, 20 bp, Artificial Sequence
  chemically synthesized
tctaaggttagacatacaga

SEQ ID NO: 25355 - DNA, 20 bp, Artificial Sequence
  chemically synthesized
ctaaggttagacatacagaa

SEQ ID NO: 25356 - DNA, 20 bp, Artificial Sequence
  chemically synthesized
ttagacatacagaaaggatg

SEQ ID NO: 25357 - DNA, 20 bp, Artificial Sequence
  chemically synthesized
aaggatgaagtctttaaaaa

SEQ ID NO: 25358 - DNA, 20 bp, Artificial Sequence
  chemically synthesized
aggatgaagtctttaaaaat

SEQ ID NO: 25359 - DNA, 20 bp, Artificial Sequence
  chemically synthesized
tccattcacacatataacct

SEQ ID NO: 25360 - DNA, 20 bp, Artificial Sequence
  chemically synthesized
ctgagtccctactgattttc

SEQ ID NO: 25361 - DNA, 20 bp, Artificial Sequence
  chemically synthesized
tttctagtactgtactgaat

SEQ ID NO: 25362 - DNA, 20 bp, Artificial Sequence
  chemically synthesized
ttctagtactgtactgaatg

SEQ ID NO: 25363 - DNA, 20 bp, Artificial Sequence
  chemically synthesized
actgaatgaggccaacatga

SEQ ID NO: 25364 - DNA, 20 bp, Artificial Sequence
  chemically synthesized
gaatgaggccaacatgatag

SEQ ID NO: 25365 - DNA, 20 bp, Artificial Sequence
  chemically synthesized
tgaggccaacatgatagaag

SEQ ID NO: 25366 - DNA, 20 bp, Artificial Sequence
  chemically synthesized
gatatgtatgcccatgtgtg

SEQ ID NO: 25367 - DNA, 20 bp, Artificial Sequence
  chemically synthesized
atatgtatgcccatgtgtgt

SEQ ID NO: 25368 - DNA, 20 bp, Artificial Sequence
  chemically synthesized
tatgtatgcccatgtgtgtg

SEQ ID NO: 25369 - DNA, 20 bp, Artificial Sequence
  chemically synthesized
gtatgcccatgtgtgtgggg

SEQ ID NO: 25370 - DNA, 20 bp, Artificial Sequence
  chemically synthesized
tgcccatgtgtgtggggtag

SEQ ID NO: 25371 - DNA, 20 bp, Artificial Sequence
  chemically synthesized
tgtgtggggtagtagaaaca

SEQ ID NO: 25372 - DNA, 20 bp, Artificial Sequence
  chemically synthesized
gggtagtagaaacaaagtca

SEQ ID NO: 25373 - DNA, 20 bp, Artificial Sequence
  chemically synthesized
ggcttaacaaatattaatta

SEQ ID NO: 25374 - DNA, 20 bp, Artificial Sequence
  chemically synthesized
ttaattaaagttattattac

SEQ ID NO: 25375 - DNA, 20 bp, Artificial Sequence
  chemically synthesized
ttaaagttattattactagt

SEQ ID NO: 25376 - DNA, 20 bp, Artificial Sequence
  chemically synthesized
aagttattattactagttag

SEQ ID NO: 25377 - DNA, 20 bp, Artificial Sequence
  chemically synthesized
tactattaacaataatattt

SEQ ID NO: 25378 - DNA, 20 bp, Artificial Sequence
  chemically synthesized
tattaacaataatattttag

SEQ ID NO: 25379 - DNA, 20 bp, Artificial Sequence
  chemically synthesized
tttgcaaaatataacacttt

SEQ ID NO: 25380 - DNA, 20 bp, Artificial Sequence
  chemically synthesized
ttgcaaaatataacactttt

SEQ ID NO: 25381 - DNA, 20 bp, Artificial Sequence
  chemically synthesized
gcaaaatataacacttttag

SEQ ID NO: 25382 - DNA, 20 bp, Artificial Sequence
  chemically synthesized
gaattacatctattatacct

SEQ ID NO: 25383 - DNA, 20 bp, Artificial Sequence
  chemically synthesized
ctcagtaaaactctatgaaa

SEQ ID NO: 25384 - DNA, 20 bp, Artificial Sequence
  chemically synthesized
gactttttatatattttttc

SEQ ID NO: 25385 - DNA, 20 bp, Artificial Sequence
  chemically synthesized
aaaataaaatctgataattt

SEQ ID NO: 25386 - DNA, 20 bp, Artificial Sequence
  chemically synthesized
ataatttgagacatttaaaa

SEQ ID NO: 25387 - DNA, 20 bp, Artificial Sequence
  chemically synthesized
catttaaaaaagtatacaac

SEQ ID NO: 25388 - DNA, 20 bp, Artificial Sequence
  chemically synthesized
taaaaaagtatacaactagt

SEQ ID NO: 25389 - DNA, 20 bp, Artificial Sequence
  chemically synthesized
aaaagtatacaactagtaag

SEQ ID NO: 25390 - DNA, 20 bp, Artificial Sequence
  chemically synthesized
ctccatgtatattaaatata

SEQ ID NO: 25391 - DNA, 20 bp, Artificial Sequence
  chemically synthesized
tgtatattaaatataaagta

SEQ ID NO: 25392 - DNA, 20 bp, Artificial Sequence
  chemically synthesized
ccttacctttctatcctccc

SEQ ID NO: 25393 - DNA, 20 bp, Artificial Sequence
  chemically synthesized
ttacctttctatcctccctg

SEQ ID NO: 25394 - DNA, 20 bp, Artificial Sequence
  chemically synthesized
tatgaacatactcaaataaa

SEQ ID NO: 25395 - DNA, 20 bp, Artificial Sequence
  chemically synthesized
actcaaataaatagtcctat

SEQ ID NO: 25396 - DNA, 20 bp, Artificial Sequence
  chemically synthesized
aaataaatagtcctattggc

SEQ ID NO: 25397 - DNA, 20 bp, Artificial Sequence
  chemically synthesized
taaatagtcctattggctgg

SEQ ID NO: 25398 - DNA, 20 bp, Artificial Sequence
  chemically synthesized
tagtcctattggctggtagc

SEQ ID NO: 25399 - DNA, 20 bp, Artificial Sequence
  chemically synthesized
agtcctattggctggtagca

SEQ ID NO: 25400 - DNA, 20 bp, Artificial Sequence
  chemically synthesized
gtcctattggctggtagcaa

SEQ ID NO: 25401 - DNA, 20 bp, Artificial Sequence
  chemically synthesized
ctggtagcaagggctatgtg

SEQ ID NO: 25402 - DNA, 20 bp, Artificial Sequence
  chemically synthesized
ccatgatgccacactaaaat

SEQ ID NO: 25403 - DNA, 20 bp, Artificial Sequence
  chemically synthesized
ttgtctgcatttttgtgtta

SEQ ID NO: 25404 - DNA, 20 bp, Artificial Sequence
  chemically synthesized
tttttgtgttacagtgaatg

SEQ ID NO: 25405 - DNA, 20 bp, Artificial Sequence
  chemically synthesized
tgtagactaaaatccaaaat

SEQ ID NO: 25406 - DNA, 20 bp, Artificial Sequence
  chemically synthesized
taaaatccaaaataagtcaa

SEQ ID NO: 25407 - DNA, 20 bp, Artificial Sequence
  chemically synthesized
aataagtcaacagttgttaa

SEQ ID NO: 25408 - DNA, 20 bp, Artificial Sequence
  chemically synthesized
gttaaaagtgatgacctcat

SEQ ID NO: 25409 - DNA, 20 bp, Artificial Sequence
  chemically synthesized
cattggttttgctatcaaca

SEQ ID NO: 25410 - DNA, 20 bp, Artificial Sequence
  chemically synthesized
ggttttgctatcaacataga

SEQ ID NO: 25411 - DNA, 20 bp, Artificial Sequence
  chemically synthesized
ttgctatcaacatagaaaga

SEQ ID NO: 25412 - DNA, 20 bp, Artificial Sequence
  chemically synthesized
tgctatcaacatagaaagaa

SEQ ID NO: 25413 - DNA, 20 bp, Artificial Sequence
  chemically synthesized
gctatcaacatagaaagaaa

SEQ ID NO: 25414 - DNA, 20 bp, Artificial Sequence
  chemically synthesized
atcaacatagaaagaaaggg

SEQ ID NO: 25415 - DNA, 20 bp, Artificial Sequence
  chemically synthesized
agaaagggaagacattttct

SEQ ID NO: 25416 - DNA, 20 bp, Artificial Sequence
  chemically synthesized
gaaagggaagacattttctc

SEQ ID NO: 25417 - DNA, 20 bp, Artificial Sequence
  chemically synthesized
ttttctcaggatttttactc

SEQ ID NO: 25418 - DNA, 20 bp, Artificial Sequence
  chemically synthesized
tttctcaggatttttactca

SEQ ID NO: 25419 - DNA, 20 bp, Artificial Sequence
  chemically synthesized
tcaggatttttactcaagga

SEQ ID NO: 25420 - DNA, 20 bp, Artificial Sequence
  chemically synthesized
caggatttttactcaaggaa

SEQ ID NO: 25421 - DNA, 20 bp, Artificial Sequence
  chemically synthesized
gatttttactcaaggaaagg

SEQ ID NO: 25422 - DNA, 20 bp, Artificial Sequence
  chemically synthesized
ttttactcaaggaaaggcag

SEQ ID NO: 25423 - DNA, 20 bp, Artificial Sequence
  chemically synthesized
tttactcaaggaaaggcagt

SEQ ID NO: 25424 - DNA, 20 bp, Artificial Sequence
  chemically synthesized
ttactcaaggaaaggcagtg

SEQ ID NO: 25425 - DNA, 20 bp, Artificial Sequence
  chemically synthesized
tcaaggaaaggcagtgggga

SEQ ID NO: 25426 - DNA, 20 bp, Artificial Sequence
  chemically synthesized
aaggaaaggcagtggggaaa

SEQ ID NO: 25427 - DNA, 20 bp, Artificial Sequence
  chemically synthesized
aggaaaggcagtggggaaag

SEQ ID NO: 25428 - DNA, 20 bp, Artificial Sequence
  chemically synthesized
ggcagtggggaaagaggctt

SEQ ID NO: 25429 - DNA, 20 bp, Artificial Sequence
  chemically synthesized
ctgtgtcaatctgtatcaac

SEQ ID NO: 25430 - DNA, 20 bp, Artificial Sequence
  chemically synthesized
tcttcaaacctccctctgca

SEQ ID NO: 25431 - DNA, 20 bp, Artificial Sequence
  chemically synthesized
aacctccctctgcatggccc

SEQ ID NO: 25432 - DNA, 20 bp, Artificial Sequence
  chemically synthesized
acctccctctgcatggcccc

SEQ ID NO: 25433 - DNA, 20 bp, Artificial Sequence
  chemically synthesized
ctccctctgcatggccccag

SEQ ID NO: 25434 - DNA, 20 bp, Artificial Sequence
  chemically synthesized
ccctctgcatggccccagga

SEQ ID NO: 25435 - DNA, 20 bp, Artificial Sequence
  chemically synthesized
ctgcatggccccaggagagt

SEQ ID NO: 25436 - DNA, 20 bp, Artificial Sequence
  chemically synthesized
aaacctctcctgccatctta

SEQ ID NO: 25437 - DNA, 20 bp, Artificial Sequence
  chemically synthesized
ctgccatcttatggtttgta

SEQ ID NO: 25438 - DNA, 20 bp, Artificial Sequence
  chemically synthesized
atggtttgtacagcatgtgc

SEQ ID NO: 25439 - DNA, 20 bp, Artificial Sequence
  chemically synthesized
gcatgtgcaagctgcttcta

SEQ ID NO: 25440 - DNA, 20 bp, Artificial Sequence
  chemically synthesized
tgcttctatagaaatgcata

SEQ ID NO: 25441 - DNA, 20 bp, Artificial Sequence
  chemically synthesized
agaaatgcatatagaaaata

SEQ ID NO: 25442 - DNA, 20 bp, Artificial Sequence
  chemically synthesized
gaaatgcatatagaaaatac

SEQ ID NO: 25443 - DNA, 20 bp, Artificial Sequence
  chemically synthesized
aaatacaggtatataaatgc

SEQ ID NO: 25444 - DNA, 20 bp, Artificial Sequence
  chemically synthesized
atacaggtatataaatgcta

SEQ ID NO: 25445 - DNA, 20 bp, Artificial Sequence
  chemically synthesized
tacaggtatataaatgctag

SEQ ID NO: 25446 - DNA, 20 bp, Artificial Sequence
  chemically synthesized
tataaatgctagaggctacc

SEQ ID NO: 25447 - DNA, 20 bp, Artificial Sequence
  chemically synthesized
gtatttattattatcattaa

SEQ ID NO: 25448 - DNA, 20 bp, Artificial Sequence
  chemically synthesized
attattatcattaacagtca

SEQ ID NO: 25449 - DNA, 20 bp, Artificial Sequence
  chemically synthesized
ttaacagtcacagtctttta

SEQ ID NO: 25450 - DNA, 20 bp, Artificial Sequence
  chemically synthesized
gtcttttatagtaaatccta

SEQ ID NO: 25451 - DNA, 20 bp, Artificial Sequence
  chemically synthesized
tatagtaaatcctaaagttg

SEQ ID NO: 25452 - DNA, 20 bp, Artificial Sequence
  chemically synthesized
atagtaaatcctaaagttga

SEQ ID NO: 25453 - DNA, 20 bp, Artificial Sequence
  chemically synthesized
aatgctatgaaatattaaat

SEQ ID NO: 25454 - DNA, 20 bp, Artificial Sequence
  chemically synthesized
aaatattaaataagtgacga

SEQ ID NO: 25455 - DNA, 20 bp, Artificial Sequence
  chemically synthesized
tatcttttatgctgactgtc

SEQ ID NO: 25456 - DNA, 20 bp, Artificial Sequence
  chemically synthesized
atcttttatgctgactgtcc

SEQ ID NO: 25457 - DNA, 20 bp, Artificial Sequence
  chemically synthesized
ttatgctgactgtccaggat

SEQ ID NO: 25458 - DNA, 20 bp, Artificial Sequence
  chemically synthesized
gtccaggattggaaatgcta

SEQ ID NO: 25459 - DNA, 20 bp, Artificial Sequence
  chemically synthesized
ggattggaaatgctacagca

SEQ ID NO: 25460 - DNA, 20 bp, Artificial Sequence
  chemically synthesized
tggaaatgctacagcaaagt

SEQ ID NO: 25461 - DNA, 20 bp, Artificial Sequence
  chemically synthesized
aatgctacagcaaagtgaga

SEQ ID NO: 25462 - DNA, 20 bp, Artificial Sequence
  chemically synthesized
atgctacagcaaagtgagat

SEQ ID NO: 25463 - DNA, 20 bp, Artificial Sequence
  chemically synthesized
ttttatgtatatcatctgca

SEQ ID NO: 25464 - DNA, 20 bp, Artificial Sequence
  chemically synthesized
ctgcaaagactaaactaaaa

SEQ ID NO: 25465 - DNA, 20 bp, Artificial Sequence
  chemically synthesized
aaagactaaactaaaatagc

SEQ ID NO: 25466 - DNA, 20 bp, Artificial Sequence
  chemically synthesized
aagactaaactaaaatagct

SEQ ID NO: 25467 - DNA, 20 bp, Artificial Sequence
  chemically synthesized
aactaaaatagctgggttgt

SEQ ID NO: 25468 - DNA, 20 bp, Artificial Sequence
  chemically synthesized
actaaaatagctgggttgtc

SEQ ID NO: 25469 - DNA, 20 bp, Artificial Sequence
  chemically synthesized
aaatagctgggttgtcaggt

SEQ ID NO: 25470 - DNA, 20 bp, Artificial Sequence
  chemically synthesized
atagctgggttgtcaggtca

SEQ ID NO: 25471 - DNA, 20 bp, Artificial Sequence
  chemically synthesized
tgtcaggtcagagcaattta

SEQ ID NO: 25472 - DNA, 20 bp, Artificial Sequence
  chemically synthesized
gtcaggtcagagcaatttac

SEQ ID NO: 25473 - DNA, 20 bp, Artificial Sequence
  chemically synthesized
tcaggtcagagcaatttaca

SEQ ID NO: 25474 - DNA, 20 bp, Artificial Sequence
  chemically synthesized
gaaaattaaattcaaatctt

SEQ ID NO: 25475 - DNA, 20 bp, Artificial Sequence
  chemically synthesized
aaattaaattcaaatcttca

SEQ ID NO: 25476 - DNA, 20 bp, Artificial Sequence
  chemically synthesized
aattaaattcaaatcttcag

SEQ ID NO: 25477 - DNA, 20 bp, Artificial Sequence
  chemically synthesized
atcttcagaggatcatttgt

SEQ ID NO: 25478 - DNA, 20 bp, Artificial Sequence
  chemically synthesized
ggtatgtctctgtccaattt

SEQ ID NO: 25479 - DNA, 20 bp, Artificial Sequence
  chemically synthesized
gtatgtctctgtccaatttg

SEQ ID NO: 25480 - DNA, 20 bp, Artificial Sequence
  chemically synthesized
tatgtctctgtccaatttga

SEQ ID NO: 25481 - DNA, 20 bp, Artificial Sequence
  chemically synthesized
tgagggcaataatttaatgc

SEQ ID NO: 25482 - DNA, 20 bp, Artificial Sequence
  chemically synthesized
tttctcactctttctgtgtt

SEQ ID NO: 25483 - DNA, 20 bp, Artificial Sequence
  chemically synthesized
ctgtgtttagaaatgaataa

SEQ ID NO: 25484 - DNA, 20 bp, Artificial Sequence
  chemically synthesized
actaaatacatttatttaac

SEQ ID NO: 25485 - DNA, 20 bp, Artificial Sequence
  chemically synthesized
aaatacatttatttaacaag

SEQ ID NO: 25486 - DNA, 20 bp, Artificial Sequence
  chemically synthesized
tttaacaagcggtcattgtt

SEQ ID NO: 25487 - DNA, 20 bp, Artificial Sequence
  chemically synthesized
tagttgtttgtttatctaat

SEQ ID NO: 25488 - DNA, 20 bp, Artificial Sequence
  chemically synthesized
gttgtttgtttatctaatga

SEQ ID NO: 25489 - DNA, 20 bp, Artificial Sequence
  chemically synthesized
ttgtttgtttatctaatgag

SEQ ID NO: 25490 - DNA, 20 bp, Artificial Sequence
  chemically synthesized
aatgagaggcttctctattt

SEQ ID NO: 25491 - DNA, 20 bp, Artificial Sequence
  chemically synthesized
ttctctattttagcaactac

SEQ ID NO: 25492 - DNA, 20 bp, Artificial Sequence
  chemically synthesized
tctctattttagcaactact

SEQ ID NO: 25493 - DNA, 20 bp, Artificial Sequence
  chemically synthesized
tactgggtacaaaaatacat

SEQ ID NO: 25494 - DNA, 20 bp, Artificial Sequence
  chemically synthesized
atatattctctgttcctatg

SEQ ID NO: 25495 - DNA, 20 bp, Artificial Sequence
  chemically synthesized
ctatgaagcttgtattttaa

SEQ ID NO: 25496 - DNA, 20 bp, Artificial Sequence
  chemically synthesized
gaagcttgtattttaacgga

SEQ ID NO: 25497 - DNA, 20 bp, Artificial Sequence
  chemically synthesized
aagcttgtattttaacggaa

SEQ ID NO: 25498 - DNA, 20 bp, Artificial Sequence
  chemically synthesized
acggaaaggaaataataaaa

SEQ ID NO: 25499 - DNA, 20 bp, Artificial Sequence
  chemically synthesized
aaaataattacaacctcata

SEQ ID NO: 25500 - DNA, 20 bp, Artificial Sequence
  chemically synthesized
acctcatatagctgctatga

SEQ ID NO: 25501 - DNA, 20 bp, Artificial Sequence
  chemically synthesized
catatagctgctatgaaaga

SEQ ID NO: 25502 - DNA, 20 bp, Artificial Sequence
  chemically synthesized
aaagaaaaaatttgatgcaa

SEQ ID NO: 25503 - DNA, 20 bp, Artificial Sequence
  chemically synthesized
agaaaaaatttgatgcaata

SEQ ID NO: 25504 - DNA, 20 bp, Artificial Sequence
  chemically synthesized
gagaataacaaaatttatgt

SEQ ID NO: 25505 - DNA, 20 bp, Artificial Sequence
  chemically synthesized
ataacaaaatttatgtaagc

SEQ ID NO: 25506 - DNA, 20 bp, Artificial Sequence
  chemically synthesized
gtaagctagtgtgacaaatg

SEQ ID NO: 25507 - DNA, 20 bp, Artificial Sequence
  chemically synthesized
taagctagtgtgacaaatgc

SEQ ID NO: 25508 - DNA, 20 bp, Artificial Sequence
  chemically synthesized
gtgtgacaaatgcgggttct

SEQ ID NO: 25509 - DNA, 20 bp, Artificial Sequence
  chemically synthesized
gtgacaaatgcgggttctga

SEQ ID NO: 25510 - DNA, 20 bp, Artificial Sequence
  chemically synthesized
tgacaaatgcgggttctgag

SEQ ID NO: 25511 - DNA, 20 bp, Artificial Sequence
  chemically synthesized
acaaatgcgggttctgagag

SEQ ID NO: 25512 - DNA, 20 bp, Artificial Sequence
  chemically synthesized
caaatgcgggttctgagagg

SEQ ID NO: 25513 - DNA, 20 bp, Artificial Sequence
  chemically synthesized
tctgagaggaggtaatattt

SEQ ID NO: 25514 - DNA, 20 bp, Artificial Sequence
  chemically synthesized
taatatttcagctgtgacct

SEQ ID NO: 25515 - DNA, 20 bp, Artificial Sequence
  chemically synthesized
atatttcagctgtgacctga

SEQ ID NO: 25516 - DNA, 20 bp, Artificial Sequence
  chemically synthesized
cagctgtgacctgagagttg

SEQ ID NO: 25517 - DNA, 20 bp, Artificial Sequence
  chemically synthesized
gctgtgacctgagagttgta

SEQ ID NO: 25518 - DNA, 20 bp, Artificial Sequence
  chemically synthesized
ctgtgacctgagagttgtag

SEQ ID NO: 25519 - DNA, 20 bp, Artificial Sequence
  chemically synthesized
cctgagagttgtagaggcaa

SEQ ID NO: 25520 - DNA, 20 bp, Artificial Sequence
  chemically synthesized
gagagttgtagaggcaaaag

SEQ ID NO: 25521 - DNA, 20 bp, Artificial Sequence
  chemically synthesized
aggcaaaagaagtattgcca

SEQ ID NO: 25522 - DNA, 20 bp, Artificial Sequence
  chemically synthesized
caaaagaagtattgccatag

SEQ ID NO: 25523 - DNA, 20 bp, Artificial Sequence
  chemically synthesized
aagtattgccatagtggtat

SEQ ID NO: 25524 - DNA, 20 bp, Artificial Sequence
  chemically synthesized
tgccatagtggtattggtcc

SEQ ID NO: 25525 - DNA, 20 bp, Artificial Sequence
  chemically synthesized
ccatagtggtattggtcctg

SEQ ID NO: 25526 - DNA, 20 bp, Artificial Sequence
  chemically synthesized
tggtattggtcctggagctc

SEQ ID NO: 25527 - DNA, 20 bp, Artificial Sequence
  chemically synthesized
tcctggagctctggttcaat

SEQ ID NO: 25528 - DNA, 20 bp, Artificial Sequence
  chemically synthesized
tggagctctggttcaatgag

SEQ ID NO: 25529 - DNA, 20 bp, Artificial Sequence
  chemically synthesized
gctctggttcaatgagcaga

SEQ ID NO: 25530 - DNA, 20 bp, Artificial Sequence
  chemically synthesized
ctggttcaatgagcagacag

SEQ ID NO: 25531 - DNA, 20 bp, Artificial Sequence
  chemically synthesized
tggttcaatgagcagacaga

SEQ ID NO: 25532 - DNA, 20 bp, Artificial Sequence
  chemically synthesized
ttcaatgagcagacagaagg

SEQ ID NO: 25533 - DNA, 20 bp, Artificial Sequence
  chemically synthesized
caatgagcagacagaaggaa

SEQ ID NO: 25534 - DNA, 20 bp, Artificial Sequence
  chemically synthesized
agaaccatatgatcatactt

SEQ ID NO: 25535 - DNA, 20 bp, Artificial Sequence
  chemically synthesized
gaaccatatgatcatacttc

SEQ ID NO: 25536 - DNA, 20 bp, Artificial Sequence
  chemically synthesized
tatgatcatacttcaggaaa

SEQ ID NO: 25537 - DNA, 20 bp, Artificial Sequence
  chemically synthesized
gaaaaagacttacacatgat

SEQ ID NO: 25538 - DNA, 20 bp, Artificial Sequence
  chemically synthesized
aaaaagacttacacatgatt

SEQ ID NO: 25539 - DNA, 20 bp, Artificial Sequence
  chemically synthesized
aaaagacttacacatgattg

SEQ ID NO: 25540 - DNA, 20 bp, Artificial Sequence
  chemically synthesized
cacatgattggggctaccca

SEQ ID NO: 25541 - DNA, 20 bp, Artificial Sequence
  chemically synthesized
acatgattggggctacccaa

SEQ ID NO: 25542 - DNA, 20 bp, Artificial Sequence
  chemically synthesized
catgattggggctacccaaa

SEQ ID NO: 25543 - DNA, 20 bp, Artificial Sequence
  chemically synthesized
ttggggctacccaaagggac

SEQ ID NO: 25544 - DNA, 20 bp, Artificial Sequence
  chemically synthesized
ccaaagggactggtttttcc

SEQ ID NO: 25545 - DNA, 20 bp, Artificial Sequence
  chemically synthesized
aaagggactggtttttccaa

SEQ ID NO: 25546 - DNA, 20 bp, Artificial Sequence
  chemically synthesized
gggactggtttttccaagag

SEQ ID NO: 25547 - DNA, 20 bp, Artificial Sequence
  chemically synthesized
tttccaagagcagataattt

SEQ ID NO: 25548 - DNA, 20 bp, Artificial Sequence
  chemically synthesized
gataatttgagtgataaaaa

SEQ ID NO: 25549 - DNA, 20 bp, Artificial Sequence
  chemically synthesized
ttttgaacccttccttctgc

SEQ ID NO: 25550 - DNA, 20 bp, Artificial Sequence
  chemically synthesized
acccttccttctgctagccc

SEQ ID NO: 25551 - DNA, 20 bp, Artificial Sequence
  chemically synthesized
ccttctgctagccctagcta

SEQ ID NO: 25552 - DNA, 20 bp, Artificial Sequence
  chemically synthesized
gccctagctatggaccacca

SEQ ID NO: 25553 - DNA, 20 bp, Artificial Sequence
  chemically synthesized
atggaccaccatggatattg

SEQ ID NO: 25554 - DNA, 20 bp, Artificial Sequence
  chemically synthesized
accaccatggatattgaagt

SEQ ID NO: 25555 - DNA, 20 bp, Artificial Sequence
  chemically synthesized
ccaccatggatattgaagta

SEQ ID NO: 25556 - DNA, 20 bp, Artificial Sequence
  chemically synthesized
caccatggatattgaagtaa

SEQ ID NO: 25557 - DNA, 20 bp, Artificial Sequence
  chemically synthesized
ttgaagtaagggctttgttt

SEQ ID NO: 25558 - DNA, 20 bp, Artificial Sequence
  chemically synthesized
aattactctccacacattct

SEQ ID NO: 25559 - DNA, 20 bp, Artificial Sequence
  chemically synthesized
attactctccacacattctg

SEQ ID NO: 25560 - DNA, 20 bp, Artificial Sequence
  chemically synthesized
cacacattctgaggatatac

SEQ ID NO: 25561 - DNA, 20 bp, Artificial Sequence
  chemically synthesized
acacattctgaggatataca

SEQ ID NO: 25562 - DNA, 20 bp, Artificial Sequence
  chemically synthesized
cacattctgaggatatacaa

SEQ ID NO: 25563 - DNA, 20 bp, Artificial Sequence
  chemically synthesized
acaagggcactgaaatattc

SEQ ID NO: 25564 - DNA, 20 bp, Artificial Sequence
  chemically synthesized
gggcactgaaatattctaga

SEQ ID NO: 25565 - DNA, 20 bp, Artificial Sequence
  chemically synthesized
gaaatattctagaaagtcca

SEQ ID NO: 25566 - DNA, 20 bp, Artificial Sequence
  chemically synthesized
cattctgatgtttatactct

SEQ ID NO: 25567 - DNA, 20 bp, Artificial Sequence
  chemically synthesized
tgtttatactctaagccaca

SEQ ID NO: 25568 - DNA, 20 bp, Artificial Sequence
  chemically synthesized
agccacacagcacctttccc

SEQ ID NO: 25569 - DNA, 20 bp, Artificial Sequence
  chemically synthesized
acagcacctttccccggatc

SEQ ID NO: 25570 - DNA, 20 bp, Artificial Sequence
  chemically synthesized
cagcacctttccccggatct

SEQ ID NO: 25571 - DNA, 20 bp, Artificial Sequence
  chemically synthesized
agcacctttccccggatcta

SEQ ID NO: 25572 - DNA, 20 bp, Artificial Sequence
  chemically synthesized
ggatctagggtctttcacat

SEQ ID NO: 25573 - DNA, 20 bp, Artificial Sequence
  chemically synthesized
gatctagggtctttcacatt

SEQ ID NO: 25574 - DNA, 20 bp, Artificial Sequence
  chemically synthesized
atttttttaaaactcaaaca

SEQ ID NO: 25575 - DNA, 20 bp, Artificial Sequence
  chemically synthesized
tttttaaaactcaaacacag

SEQ ID NO: 25576 - DNA, 20 bp, Artificial Sequence
  chemically synthesized
catataattctcattctctg

SEQ ID NO: 25577 - DNA, 20 bp, Artificial Sequence
  chemically synthesized
tgtggctcataaacatttaa

SEQ ID NO: 25578 - DNA, 20 bp, Artificial Sequence
  chemically synthesized
tggctcataaacatttaata

SEQ ID NO: 25579 - DNA, 20 bp, Artificial Sequence
  chemically synthesized
tgatgaaactgtaaaaccct

SEQ ID NO: 25580 - DNA, 20 bp, Artificial Sequence
  chemically synthesized
aactgtaaaaccctgagttg

SEQ ID NO: 25581 - DNA, 20 bp, Artificial Sequence
  chemically synthesized
actgtaaaaccctgagttgt

SEQ ID NO: 25582 - DNA, 20 bp, Artificial Sequence
  chemically synthesized
taaaaccctgagttgtaggc

SEQ ID NO: 25583 - DNA, 20 bp, Artificial Sequence
  chemically synthesized
aaaccctgagttgtaggccg

SEQ ID NO: 25584 - DNA, 20 bp, Artificial Sequence
  chemically synthesized
agatataaaatttcaacata

SEQ ID NO: 25585 - DNA, 20 bp, Artificial Sequence
  chemically synthesized
taaagaatgaacaaaatgac

SEQ ID NO: 25586 - DNA, 20 bp, Artificial Sequence
  chemically synthesized
aagaatgaacaaaatgacca

SEQ ID NO: 25587 - DNA, 20 bp, Artificial Sequence
  chemically synthesized
agaatgaacaaaatgaccag

SEQ ID NO: 25588 - DNA, 20 bp, Artificial Sequence
  chemically synthesized
atgaacaaaatgaccagagg

SEQ ID NO: 25589 - DNA, 20 bp, Artificial Sequence
  chemically synthesized
gaacaaaatgaccagaggca

SEQ ID NO: 25590 - DNA, 20 bp, Artificial Sequence
  chemically synthesized
aacaaaatgaccagaggcag

SEQ ID NO: 25591 - DNA, 20 bp, Artificial Sequence
  chemically synthesized
accagaggcagaggtaccct

SEQ ID NO: 25592 - DNA, 20 bp, Artificial Sequence
  chemically synthesized
cagaggcagaggtaccctga

SEQ ID NO: 25593 - DNA, 20 bp, Artificial Sequence
  chemically synthesized
ggcagaggtaccctgagaga

SEQ ID NO: 25594 - DNA, 20 bp, Artificial Sequence
  chemically synthesized
ggtaccctgagagacagtga

SEQ ID NO: 25595 - DNA, 20 bp, Artificial Sequence
  chemically synthesized
gacagtgatagctgtatcta

SEQ ID NO: 25596 - DNA, 20 bp, Artificial Sequence
  chemically synthesized
cagtgatagctgtatctaaa

SEQ ID NO: 25597 - DNA, 20 bp, Artificial Sequence
  chemically synthesized
aagagtactgatattaaaaa

SEQ ID NO: 25598 - DNA, 20 bp, Artificial Sequence
  chemically synthesized
gagtactgatattaaaaata

SEQ ID NO: 25599 - DNA, 20 bp, Artificial Sequence
  chemically synthesized
catatatctcattatatcca

SEQ ID NO: 25600 - DNA, 20 bp, Artificial Sequence
  chemically synthesized
atatatctcattatatccaa

SEQ ID NO: 25601 - DNA, 20 bp, Artificial Sequence
  chemically synthesized
tatatctcattatatccaaa

SEQ ID NO: 25602 - DNA, 20 bp, Artificial Sequence
  chemically synthesized
ttatatccaaagggttacat

SEQ ID NO: 25603 - DNA, 20 bp, Artificial Sequence
  chemically synthesized
caaagggttacataagtttt

SEQ ID NO: 25604 - DNA, 20 bp, Artificial Sequence
  chemically synthesized
aagggttacataagttttaa

SEQ ID NO: 25605 - DNA, 20 bp, Artificial Sequence
  chemically synthesized
ggttacataagttttaagag

SEQ ID NO: 25606 - DNA, 20 bp, Artificial Sequence
  chemically synthesized
ttaagagtggaaataacatg

SEQ ID NO: 25607 - DNA, 20 bp, Artificial Sequence
  chemically synthesized
taagagtggaaataacatga

SEQ ID NO: 25608 - DNA, 20 bp, Artificial Sequence
  chemically synthesized
catgaaggaccctaaacaat

SEQ ID NO: 25609 - DNA, 20 bp, Artificial Sequence
  chemically synthesized
atgaaggaccctaaacaatt

SEQ ID NO: 25610 - DNA, 20 bp, Artificial Sequence
  chemically synthesized
gaccctaaacaattaggaaa

SEQ ID NO: 25611 - DNA, 20 bp, Artificial Sequence
  chemically synthesized
aacagaaatttgacttgctt

SEQ ID NO: 25612 - DNA, 20 bp, Artificial Sequence
  chemically synthesized
atttgacttgcttcagataa

SEQ ID NO: 25613 - DNA, 20 bp, Artificial Sequence
  chemically synthesized
taaaatattttatctgaaac

SEQ ID NO: 25614 - DNA, 20 bp, Artificial Sequence
  chemically synthesized
atattttatctgaaacaagt

SEQ ID NO: 25615 - DNA, 20 bp, Artificial Sequence
  chemically synthesized
gtaagcttgttcaaaaaata

SEQ ID NO: 25616 - DNA, 20 bp, Artificial Sequence
  chemically synthesized
taagcttgttcaaaaaatat

SEQ ID NO: 25617 - DNA, 20 bp, Artificial Sequence
  chemically synthesized
atataggatatatgtgtaca

SEQ ID NO: 25618 - DNA, 20 bp, Artificial Sequence
  chemically synthesized
aggatatatgtgtacatagt

SEQ ID NO: 25619 - DNA, 20 bp, Artificial Sequence
  chemically synthesized
gtgagatgattacttcaatc

SEQ ID NO: 25620 - DNA, 20 bp, Artificial Sequence
  chemically synthesized
catcaatacaacaccttcca

SEQ ID NO: 25621 - DNA, 20 bp, Artificial Sequence
  chemically synthesized
cttttgctttttctttgtgt

SEQ ID NO: 25622 - DNA, 20 bp, Artificial Sequence
  chemically synthesized
ttttgctttttctttgtgta

SEQ ID NO: 25623 - DNA, 20 bp, Artificial Sequence
  chemically synthesized
tttgctttttctttgtgtaa

SEQ ID NO: 25624 - DNA, 20 bp, Artificial Sequence
  chemically synthesized
ctactgtcataacaaatgtt

SEQ ID NO: 25625 - DNA, 20 bp, Artificial Sequence
  chemically synthesized
cataacaaatgtttagttta

SEQ ID NO: 25626 - DNA, 20 bp, Artificial Sequence
  chemically synthesized
caaatgtttagtttacagta

SEQ ID NO: 25627 - DNA, 20 bp, Artificial Sequence
  chemically synthesized
ttagtttacagtacagtatt

SEQ ID NO: 25628 - DNA, 20 bp, Artificial Sequence
  chemically synthesized
taagtcttcatgccatacac

SEQ ID NO: 25629 - DNA, 20 bp, Artificial Sequence
  chemically synthesized
ctaaacttatttatcctata

SEQ ID NO: 25630 - DNA, 20 bp, Artificial Sequence
  chemically synthesized
tatttatcctatacagctgc

SEQ ID NO: 25631 - DNA, 20 bp, Artificial Sequence
  chemically synthesized
tttgaccttatttttctttt

SEQ ID NO: 25632 - DNA, 20 bp, Artificial Sequence
  chemically synthesized
tcttttgagattccacatat

SEQ ID NO: 25633 - DNA, 20 bp, Artificial Sequence
  chemically synthesized
cctttatttgtttctgtgtc

SEQ ID NO: 25634 - DNA, 20 bp, Artificial Sequence
  chemically synthesized
tgtgtctggtttatttcact

SEQ ID NO: 25635 - DNA, 20 bp, Artificial Sequence
  chemically synthesized
tcacttagcaaaatgtactc

SEQ ID NO: 25636 - DNA, 20 bp, Artificial Sequence
  chemically synthesized
cacttagcaaaatgtactct

SEQ ID NO: 25637 - DNA, 20 bp, Artificial Sequence
  chemically synthesized
ttccccccatctcctttttt

SEQ ID NO: 25638 - DNA, 20 bp, Artificial Sequence
  chemically synthesized
tccccccatctcctttttta

SEQ ID NO: 25639 - DNA, 20 bp, Artificial Sequence
  chemically synthesized
atatatcacaatatcatata

SEQ ID NO: 25640 - DNA, 20 bp, Artificial Sequence
  chemically synthesized
tttatctgttcatctatata

SEQ ID NO: 25641 - DNA, 20 bp, Artificial Sequence
  chemically synthesized
atctatatatagataccact

SEQ ID NO: 25642 - DNA, 20 bp, Artificial Sequence
  chemically synthesized
cttagattgtttccatgtct

SEQ ID NO: 25643 - DNA, 20 bp, Artificial Sequence
  chemically synthesized
aataatgctgcaattaacat

SEQ ID NO: 25644 - DNA, 20 bp, Artificial Sequence
  chemically synthesized
taatgctgcaattaacatga

SEQ ID NO: 25645 - DNA, 20 bp, Artificial Sequence
  chemically synthesized
ctgcaattaacatgagagtg

SEQ ID NO: 25646 - DNA, 20 bp, Artificial Sequence
  chemically synthesized
aattaacatgagagtgcaga

SEQ ID NO: 25647 - DNA, 20 bp, Artificial Sequence
  chemically synthesized
catgagagtgcagatagctc

SEQ ID NO: 25648 - DNA, 20 bp, Artificial Sequence
  chemically synthesized
gcagatagctctagaaaatg

SEQ ID NO: 25649 - DNA, 20 bp, Artificial Sequence
  chemically synthesized
aatgcggattttatttattt

SEQ ID NO: 25650 - DNA, 20 bp, Artificial Sequence
  chemically synthesized
atttattttggatacatata

SEQ ID NO: 25651 - DNA, 20 bp, Artificial Sequence
  chemically synthesized
tattttggatacatatacag

SEQ ID NO: 25652 - DNA, 20 bp, Artificial Sequence
  chemically synthesized
ttttggatacatatacagca

SEQ ID NO: 25653 - DNA, 20 bp, Artificial Sequence
  chemically synthesized
tcatacaataactctatttt

SEQ ID NO: 25654 - DNA, 20 bp, Artificial Sequence
  chemically synthesized
aactctatttttagttgttt

SEQ ID NO: 25655 - DNA, 20 bp, Artificial Sequence
  chemically synthesized
cttccatacgttttctataa

SEQ ID NO: 25656 - DNA, 20 bp, Artificial Sequence
  chemically synthesized
atgttaacttacattcccac

SEQ ID NO: 25657 - DNA, 20 bp, Artificial Sequence
  chemically synthesized
cattcccaccagctatgcac

SEQ ID NO: 25658 - DNA, 20 bp, Artificial Sequence
  chemically synthesized
ttcccaccagctatgcacaa

SEQ ID NO: 25659 - DNA, 20 bp, Artificial Sequence
  chemically synthesized
caagagttctcctttctcca

SEQ ID NO: 25660 - DNA, 20 bp, Artificial Sequence
  chemically synthesized
tctcttgtcttttttgataa

SEQ ID NO: 25661 - DNA, 20 bp, Artificial Sequence
  chemically synthesized
tttgataatagccatctcaa

SEQ ID NO: 25662 - DNA, 20 bp, Artificial Sequence
  chemically synthesized
ttgataatagccatctcaac

SEQ ID NO: 25663 - DNA, 20 bp, Artificial Sequence
  chemically synthesized
atagccatctcaacaggtgt

SEQ ID NO: 25664 - DNA, 20 bp, Artificial Sequence
  chemically synthesized
acaggtgtgagtgatacttg

SEQ ID NO: 25665 - DNA, 20 bp, Artificial Sequence
  chemically synthesized
atttgcattttcctgatgat

SEQ ID NO: 25666 - DNA, 20 bp, Artificial Sequence
  chemically synthesized
tttcctgatgattggtgatg

SEQ ID NO: 25667 - DNA, 20 bp, Artificial Sequence
  chemically synthesized
gctgaccatttgcatgtctt

SEQ ID NO: 25668 - DNA, 20 bp, Artificial Sequence
  chemically synthesized
tgaccatttgcatgtcttca

SEQ ID NO: 25669 - DNA, 20 bp, Artificial Sequence
  chemically synthesized
tcttcagagaaatgtatatt

SEQ ID NO: 25670 - DNA, 20 bp, Artificial Sequence
  chemically synthesized
atcctttgcccatttttact

SEQ ID NO: 25671 - DNA, 20 bp, Artificial Sequence
  chemically synthesized
tcctttgcccatttttactt

SEQ ID NO: 25672 - DNA, 20 bp, Artificial Sequence
  chemically synthesized
ctattatattttttcatatt

SEQ ID NO: 25673 - DNA, 20 bp, Artificial Sequence
  chemically synthesized
tttttcatatttagttgatt

SEQ ID NO: 25674 - DNA, 20 bp, Artificial Sequence
  chemically synthesized
attgagttccttatatattt

SEQ ID NO: 25675 - DNA, 20 bp, Artificial Sequence
  chemically synthesized
ttgagttccttatatatttt

SEQ ID NO: 25676 - DNA, 20 bp, Artificial Sequence
  chemically synthesized
tccttatatattttgggtat

SEQ ID NO: 25677 - DNA, 20 bp, Artificial Sequence
  chemically synthesized
tttgggtattagacttgtat

SEQ ID NO: 25678 - DNA, 20 bp, Artificial Sequence
  chemically synthesized
tgattgttttctttgctgtg

SEQ ID NO: 25679 - DNA, 20 bp, Artificial Sequence
  chemically synthesized
tttgctgtgcagaaaatatt

SEQ ID NO: 25680 - DNA, 20 bp, Artificial Sequence
  chemically synthesized
tatttttgcttttgttacct

SEQ ID NO: 25681 - DNA, 20 bp, Artificial Sequence
  chemically synthesized
tgcttttgttacctgagctc

SEQ ID NO: 25682 - DNA, 20 bp, Artificial Sequence
  chemically synthesized
ctgagctctggcacatttta

SEQ ID NO: 25683 - DNA, 20 bp, Artificial Sequence
  chemically synthesized
tgaaaatttgtatgaaacca

SEQ ID NO: 25684 - DNA, 20 bp, Artificial Sequence
  chemically synthesized
aaccacagaacacccccaaa

SEQ ID NO: 25685 - DNA, 20 bp, Artificial Sequence
  chemically synthesized
caaatggccaaaacaatctt

SEQ ID NO: 25686 - DNA, 20 bp, Artificial Sequence
  chemically synthesized
tggccaaaacaatcttgaga

SEQ ID NO: 25687 - DNA, 20 bp, Artificial Sequence
  chemically synthesized
agaaagaaaaaccaacttga

SEQ ID NO: 25688 - DNA, 20 bp, Artificial Sequence
  chemically synthesized
aagaaaaaccaacttgatgg

SEQ ID NO: 25689 - DNA, 20 bp, Artificial Sequence
  chemically synthesized
tgatttcaaattatattaca

SEQ ID NO: 25690 - DNA, 20 bp, Artificial Sequence
  chemically synthesized
caaattatattacaaagcta

SEQ ID NO: 25691 - DNA, 20 bp, Artificial Sequence
  chemically synthesized
caaagctatagtaaccaaaa

SEQ ID NO: 25692 - DNA, 20 bp, Artificial Sequence
  chemically synthesized
ctatagtaaccaaaaaagta

SEQ ID NO: 25693 - DNA, 20 bp, Artificial Sequence
  chemically synthesized
gtatggtactatcacataaa

SEQ ID NO: 25694 - DNA, 20 bp, Artificial Sequence
  chemically synthesized
ctatcacataaatagacaca

SEQ ID NO: 25695 - DNA, 20 bp, Artificial Sequence
  chemically synthesized
gacacatagaccaaattgaa

SEQ ID NO: 25696 - DNA, 20 bp, Artificial Sequence
  chemically synthesized
agaccaaattgaacagaata

SEQ ID NO: 25697 - DNA, 20 bp, Artificial Sequence
  chemically synthesized
accaaattgaacagaataaa

SEQ ID NO: 25698 - DNA, 20 bp, Artificial Sequence
  chemically synthesized
attgaacagaataaagagcc

SEQ ID NO: 25699 - DNA, 20 bp, Artificial Sequence
  chemically synthesized
gaaataaatttacgtatata

SEQ ID NO: 25700 - DNA, 20 bp, Artificial Sequence
  chemically synthesized
aaatttacgtatatacagtc

SEQ ID NO: 25701 - DNA, 20 bp, Artificial Sequence
  chemically synthesized
acagtccagtaattctcaac

SEQ ID NO: 25702 - DNA, 20 bp, Artificial Sequence
  chemically synthesized
cagtccagtaattctcaaca

SEQ ID NO: 25703 - DNA, 20 bp, Artificial Sequence
  chemically synthesized
caacaaggccaccaacacaa

SEQ ID NO: 25704 - DNA, 20 bp, Artificial Sequence
  chemically synthesized
aacaaggccaccaacacaat

SEQ ID NO: 25705 - DNA, 20 bp, Artificial Sequence
  chemically synthesized
acaaggccaccaacacaata

SEQ ID NO: 25706 - DNA, 20 bp, Artificial Sequence
  chemically synthesized
caaggccaccaacacaatag

SEQ ID NO: 25707 - DNA, 20 bp, Artificial Sequence
  chemically synthesized
ggccaccaacacaatagggg

SEQ ID NO: 25708 - DNA, 20 bp, Artificial Sequence
  chemically synthesized
gccaccaacacaatagggga

SEQ ID NO: 25709 - DNA, 20 bp, Artificial Sequence
  chemically synthesized
ccaacacaataggggaagga

SEQ ID NO: 25710 - DNA, 20 bp, Artificial Sequence
  chemically synthesized
aggatagtctcctcaacaaa

SEQ ID NO: 25711 - DNA, 20 bp, Artificial Sequence
  chemically synthesized
gtctcctcaacaaatagtgt

SEQ ID NO: 25712 - DNA, 20 bp, Artificial Sequence
  chemically synthesized
tctcctcaacaaatagtgtt

SEQ ID NO: 25713 - DNA, 20 bp, Artificial Sequence
  chemically synthesized
acaaatagtgttgggaaaac

SEQ ID NO: 25714 - DNA, 20 bp, Artificial Sequence
  chemically synthesized
aactggatatccaaatgcaa

SEQ ID NO: 25715 - DNA, 20 bp, Artificial Sequence
  chemically synthesized
caaatgcaaaagaataaaat

SEQ ID NO: 25716 - DNA, 20 bp, Artificial Sequence
  chemically synthesized
taaaattggacctttacctt

SEQ ID NO: 25717 - DNA, 20 bp, Artificial Sequence
  chemically synthesized
ggacctttaccttaagccat

SEQ ID NO: 25718 - DNA, 20 bp, Artificial Sequence
  chemically synthesized
agccataagtcaactcaaaa

SEQ ID NO: 25719 - DNA, 20 bp, Artificial Sequence
  chemically synthesized
agtcaactcaaaatagatta

SEQ ID NO: 25720 - DNA, 20 bp, Artificial Sequence
  chemically synthesized
tagattaaagacataaatgt

SEQ ID NO: 25721 - DNA, 20 bp, Artificial Sequence
  chemically synthesized
acctgaaatcacaaaactcc

SEQ ID NO: 25722 - DNA, 20 bp, Artificial Sequence
  chemically synthesized
tgaaatcacaaaactcctgg

SEQ ID NO: 25723 - DNA, 20 bp, Artificial Sequence
  chemically synthesized
aactcctggaagaacatgta

SEQ ID NO: 25724 - DNA, 20 bp, Artificial Sequence
  chemically synthesized
ctcctggaagaacatgtata

SEQ ID NO: 25725 - DNA, 20 bp, Artificial Sequence
  chemically synthesized
tggaagaacatgtatagaga

SEQ ID NO: 25726 - DNA, 20 bp, Artificial Sequence
  chemically synthesized
tagagatagctgcttgatat

SEQ ID NO: 25727 - DNA, 20 bp, Artificial Sequence
  chemically synthesized
tagctgcttgatatcagtct

SEQ ID NO: 25728 - DNA, 20 bp, Artificial Sequence
  chemically synthesized
tatcagtctcggcaattttt

SEQ ID NO: 25729 - DNA, 20 bp, Artificial Sequence
  chemically synthesized
ttagatattgtcttgatttg

SEQ ID NO: 25730 - DNA, 20 bp, Artificial Sequence
  chemically synthesized
gatttgaagaaaattttcac

SEQ ID NO: 25731 - DNA, 20 bp, Artificial Sequence
  chemically synthesized
ttgaagaaaattttcactgg

SEQ ID NO: 25732 - DNA, 20 bp, Artificial Sequence
  chemically synthesized
gattttttctttcacaaata

SEQ ID NO: 25733 - DNA, 20 bp, Artificial Sequence
  chemically synthesized
ttctttcacaaataaagttc

SEQ ID NO: 25734 - DNA, 20 bp, Artificial Sequence
  chemically synthesized
caaataaagttccagttttt

SEQ ID NO: 25735 - DNA, 20 bp, Artificial Sequence
  chemically synthesized
aaagttccagtttttgagcc

SEQ ID NO: 25736 - DNA, 20 bp, Artificial Sequence
  chemically synthesized
ttccagtttttgagccaaga

SEQ ID NO: 25737 - DNA, 20 bp, Artificial Sequence
  chemically synthesized
tttgagccaagatggccaaa

SEQ ID NO: 25738 - DNA, 20 bp, Artificial Sequence
  chemically synthesized
ttgagccaagatggccaaat

SEQ ID NO: 25739 - DNA, 20 bp, Artificial Sequence
  chemically synthesized
ccaagatggccaaataggaa

SEQ ID NO: 25740 - DNA, 20 bp, Artificial Sequence
  chemically synthesized
tggccaaataggaacagctc

SEQ ID NO: 25741 - DNA, 20 bp, Artificial Sequence
  chemically synthesized
ataggaacagctctggtcta

SEQ ID NO: 25742 - DNA, 20 bp, Artificial Sequence
  chemically synthesized
cagctctggtctacagctcc

SEQ ID NO: 25743 - DNA, 20 bp, Artificial Sequence
  chemically synthesized
agctcccagcgtgaacaaca

SEQ ID NO: 25744 - DNA, 20 bp, Artificial Sequence
  chemically synthesized
tcccagcgtgaacaacacag

SEQ ID NO: 25745 - DNA, 20 bp, Artificial Sequence
  chemically synthesized
agcgtgaacaacacagaaga

SEQ ID NO: 25746 - DNA, 20 bp, Artificial Sequence
  chemically synthesized
gcgtgaacaacacagaagac

SEQ ID NO: 25747 - DNA, 20 bp, Artificial Sequence
  chemically synthesized
tgatttctgcatttccatct

SEQ ID NO: 25748 - DNA, 20 bp, Artificial Sequence
  chemically synthesized
gatttctgcatttccatctg

SEQ ID NO: 25749 - DNA, 20 bp, Artificial Sequence
  chemically synthesized
ctgcatttccatctgaggta

SEQ ID NO: 25750 - DNA, 20 bp, Artificial Sequence
  chemically synthesized
tgcatttccatctgaggtat

SEQ ID NO: 25751 - DNA, 20 bp, Artificial Sequence
  chemically synthesized
gcatttccatctgaggtatg

SEQ ID NO: 25752 - DNA, 20 bp, Artificial Sequence
  chemically synthesized
aggtatggggttcatctcgc

SEQ ID NO: 25753 - DNA, 20 bp, Artificial Sequence
  chemically synthesized
ggtatggggttcatctcgct

SEQ ID NO: 25754 - DNA, 20 bp, Artificial Sequence
  chemically synthesized
gtatggggttcatctcgcta

SEQ ID NO: 25755 - DNA, 20 bp, Artificial Sequence
  chemically synthesized
atggggttcatctcgctagg

SEQ ID NO: 25756 - DNA, 20 bp, Artificial Sequence
  chemically synthesized
ttcatctcgctagggagtgc

SEQ ID NO: 25757 - DNA, 20 bp, Artificial Sequence
  chemically synthesized
tctcgctagggagtgccaga

SEQ ID NO: 25758 - DNA, 20 bp, Artificial Sequence
  chemically synthesized
cgctagggagtgccagacag

SEQ ID NO: 25759 - DNA, 20 bp, Artificial Sequence
  chemically synthesized
gctagggagtgccagacagt

SEQ ID NO: 25760 - DNA, 20 bp, Artificial Sequence
  chemically synthesized
ggagtgccagacagtgggca

SEQ ID NO: 25761 - DNA, 20 bp, Artificial Sequence
  chemically synthesized
gagtgccagacagtgggcac

SEQ ID NO: 25762 - DNA, 20 bp, Artificial Sequence
  chemically synthesized
gccagacagtgggcacaggt

SEQ ID NO: 25763 - DNA, 20 bp, Artificial Sequence
  chemically synthesized
agacagtgggcacaggtcag

SEQ ID NO: 25764 - DNA, 20 bp, Artificial Sequence
  chemically synthesized
gacagtgggcacaggtcagt

SEQ ID NO: 25765 - DNA, 20 bp, Artificial Sequence
  chemically synthesized
tgggcacaggtcagtgggtg

SEQ ID NO: 25766 - DNA, 20 bp, Artificial Sequence
  chemically synthesized
gggtgcagcacaccatgcac

SEQ ID NO: 25767 - DNA, 20 bp, Artificial Sequence
  chemically synthesized
agcacaccatgcaccagccg

SEQ ID NO: 25768 - DNA, 20 bp, Artificial Sequence
  chemically synthesized
acaccatgcaccagccgaag

SEQ ID NO: 25769 - DNA, 20 bp, Artificial Sequence
  chemically synthesized
caccatgcaccagccgaagc

SEQ ID NO: 25770 - DNA, 20 bp, Artificial Sequence
  chemically synthesized
accatgcaccagccgaagca

SEQ ID NO: 25771 - DNA, 20 bp, Artificial Sequence
  chemically synthesized
tgcaccagccgaagcagggt

SEQ ID NO: 25772 - DNA, 20 bp, Artificial Sequence
  chemically synthesized
gcaccagccgaagcagggtg

SEQ ID NO: 25773 - DNA, 20 bp, Artificial Sequence
  chemically synthesized
gggtgaggcattgcctcact

SEQ ID NO: 25774 - DNA, 20 bp, Artificial Sequence
  chemically synthesized
ggtgaggcattgcctcactt

SEQ ID NO: 25775 - DNA, 20 bp, Artificial Sequence
  chemically synthesized
gaggcattgcctcacttggg

SEQ ID NO: 25776 - DNA, 20 bp, Artificial Sequence
  chemically synthesized
ttgcctcacttgggaagcac

SEQ ID NO: 25777 - DNA, 20 bp, Artificial Sequence
  chemically synthesized
tgcctcacttgggaagcaca

SEQ ID NO: 25778 - DNA, 20 bp, Artificial Sequence
  chemically synthesized
gcctcacttgggaagcacaa

SEQ ID NO: 25779 - DNA, 20 bp, Artificial Sequence
  chemically synthesized
cctcacttgggaagcacaag

SEQ ID NO: 25780 - DNA, 20 bp, Artificial Sequence
  chemically synthesized
ttgggaagcacaaggggtca

SEQ ID NO: 25781 - DNA, 20 bp, Artificial Sequence
  chemically synthesized
gggaagcacaaggggtcatg

SEQ ID NO: 25782 - DNA, 20 bp, Artificial Sequence
  chemically synthesized
ggtcatggagttccctttcc

SEQ ID NO: 25783 - DNA, 20 bp, Artificial Sequence
  chemically synthesized
tggagttccctttcctggtc

SEQ ID NO: 25784 - DNA, 20 bp, Artificial Sequence
  chemically synthesized
ggagttccctttcctggtca

SEQ ID NO: 25785 - DNA, 20 bp, Artificial Sequence
  chemically synthesized
ttccctttcctggtcaagga

SEQ ID NO: 25786 - DNA, 20 bp, Artificial Sequence
  chemically synthesized
tccctttcctggtcaaggaa

SEQ ID NO: 25787 - DNA, 20 bp, Artificial Sequence
  chemically synthesized
ccctttcctggtcaaggaaa

SEQ ID NO: 25788 - DNA, 20 bp, Artificial Sequence
  chemically synthesized
cctttcctggtcaaggaaag

SEQ ID NO: 25789 - DNA, 20 bp, Artificial Sequence
  chemically synthesized
tcaaggaaaggggtgacata

SEQ ID NO: 25790 - DNA, 20 bp, Artificial Sequence
  chemically synthesized
aaggggtgacatacggcacc

SEQ ID NO: 25791 - DNA, 20 bp, Artificial Sequence
  chemically synthesized
acatacggcacctggaaaat

SEQ ID NO: 25792 - DNA, 20 bp, Artificial Sequence
  chemically synthesized
catacggcacctggaaaatt

SEQ ID NO: 25793 - DNA, 20 bp, Artificial Sequence
  chemically synthesized
cgaatactgtgcttttctga

SEQ ID NO: 25794 - DNA, 20 bp, Artificial Sequence
  chemically synthesized
gaatactgtgcttttctgac

SEQ ID NO: 25795 - DNA, 20 bp, Artificial Sequence
  chemically synthesized
ctgtgcttttctgacaggct

SEQ ID NO: 25796 - DNA, 20 bp, Artificial Sequence
  chemically synthesized
tgtgcttttctgacaggctt

SEQ ID NO: 25797 - DNA, 20 bp, Artificial Sequence
  chemically synthesized
tttctgacaggcttaggaaa

SEQ ID NO: 25798 - DNA, 20 bp, Artificial Sequence
  chemically synthesized
aggcttaggaaatggcgcac

SEQ ID NO: 25799 - DNA, 20 bp, Artificial Sequence
  chemically synthesized
ggcttaggaaatggcgcacc

SEQ ID NO: 25800 - DNA, 20 bp, Artificial Sequence
  chemically synthesized
cttaggaaatggcgcaccag

SEQ ID NO: 25801 - DNA, 20 bp, Artificial Sequence
  chemically synthesized
aggagattatatcctgcaca

SEQ ID NO: 25802 - DNA, 20 bp, Artificial Sequence
  chemically synthesized
tatatcctgcacatggctcc

SEQ ID NO: 25803 - DNA, 20 bp, Artificial Sequence
  chemically synthesized
atatcctgcacatggctccg

SEQ ID NO: 25804 - DNA, 20 bp, Artificial Sequence
  chemically synthesized
tatcctgcacatggctccga

SEQ ID NO: 25805 - DNA, 20 bp, Artificial Sequence
  chemically synthesized
ctccgagggtcctacgccca

SEQ ID NO: 25806 - DNA, 20 bp, Artificial Sequence
  chemically synthesized
ccgagggtcctacgcccacg

SEQ ID NO: 25807 - DNA, 20 bp, Artificial Sequence
  chemically synthesized
cacggagtctccctgattgc

SEQ ID NO: 25808 - DNA, 20 bp, Artificial Sequence
  chemically synthesized
agtctccctgattgctagca

SEQ ID NO: 25809 - DNA, 20 bp, Artificial Sequence
  chemically synthesized
ctccctgattgctagcacag

SEQ ID NO: 25810 - DNA, 20 bp, Artificial Sequence
  chemically synthesized
gattgctagcacagcagtct

SEQ ID NO: 25811 - DNA, 20 bp, Artificial Sequence
  chemically synthesized
gcagtctgagatcaaactgc

SEQ ID NO: 25812 - DNA, 20 bp, Artificial Sequence
  chemically synthesized
cagtctgagatcaaactgca

SEQ ID NO: 25813 - DNA, 20 bp, Artificial Sequence
  chemically synthesized
tctgagatcaaactgcaagg

SEQ ID NO: 25814 - DNA, 20 bp, Artificial Sequence
  chemically synthesized
gagatcaaactgcaaggtgg

SEQ ID NO: 25815 - DNA, 20 bp, Artificial Sequence
  chemically synthesized
tcaaactgcaaggtggcagc

SEQ ID NO: 25816 - DNA, 20 bp, Artificial Sequence
  chemically synthesized
caaactgcaaggtggcagcg

SEQ ID NO: 25817 - DNA, 20 bp, Artificial Sequence
  chemically synthesized
ctgcaaggtggcagcgaggc

SEQ ID NO: 25818 - DNA, 20 bp, Artificial Sequence
  chemically synthesized
tgcaaggtggcagcgaggct

SEQ ID NO: 25819 - DNA, 20 bp, Artificial Sequence
  chemically synthesized
gcaaggtggcagcgaggctg

SEQ ID NO: 25820 - DNA, 20 bp, Artificial Sequence
  chemically synthesized
caaggtggcagcgaggctgg

SEQ ID NO: 25821 - DNA, 20 bp, Artificial Sequence
  chemically synthesized
aggtggcagcgaggctgggg

SEQ ID NO: 25822 - DNA, 20 bp, Artificial Sequence
  chemically synthesized
ggtggcagcgaggctggggg

SEQ ID NO: 25823 - DNA, 20 bp, Artificial Sequence
  chemically synthesized
gtggcagcgaggctggggga

SEQ ID NO: 25824 - DNA, 20 bp, Artificial Sequence
  chemically synthesized
tggcagcgaggctgggggag

SEQ ID NO: 25825 - DNA, 20 bp, Artificial Sequence
  chemically synthesized
cagcgaggctgggggagggg

SEQ ID NO: 25826 - DNA, 20 bp, Artificial Sequence
  chemically synthesized
gaggggcagccgccattgcc

SEQ ID NO: 25827 - DNA, 20 bp, Artificial Sequence
  chemically synthesized
aggggcagccgccattgccc

SEQ ID NO: 25828 - DNA, 20 bp, Artificial Sequence
  chemically synthesized
cgccattgcccaggcttgct

SEQ ID NO: 25829 - DNA, 20 bp, Artificial Sequence
  chemically synthesized
gccattgcccaggcttgctt

SEQ ID NO: 25830 - DNA, 20 bp, Artificial Sequence
  chemically synthesized
caggcttgcttaggtaaaca

SEQ ID NO: 25831 - DNA, 20 bp, Artificial Sequence
  chemically synthesized
gcttgcttaggtaaacaaag

SEQ ID NO: 25832 - DNA, 20 bp, Artificial Sequence
  chemically synthesized
gcttaggtaaacaaagcagc

SEQ ID NO: 25833 - DNA, 20 bp, Artificial Sequence
  chemically synthesized
cttaggtaaacaaagcagcc

SEQ ID NO: 25834 - DNA, 20 bp, Artificial Sequence
  chemically synthesized
aggtaaacaaagcagccagg

SEQ ID NO: 25835 - DNA, 20 bp, Artificial Sequence
  chemically synthesized
agcagccaggaagctcaaac

SEQ ID NO: 25836 - DNA, 20 bp, Artificial Sequence
  chemically synthesized
gcagccaggaagctcaaact

SEQ ID NO: 25837 - DNA, 20 bp, Artificial Sequence
  chemically synthesized
gccaggaagctcaaactggg

SEQ ID NO: 25838 - DNA, 20 bp, Artificial Sequence
  chemically synthesized
aaactgggtggaccccacca

SEQ ID NO: 25839 - DNA, 20 bp, Artificial Sequence
  chemically synthesized
ggtggaccccaccacagctc

SEQ ID NO: 25840 - DNA, 20 bp, Artificial Sequence
  chemically synthesized
gtggaccccaccacagctca

SEQ ID NO: 25841 - DNA, 20 bp, Artificial Sequence
  chemically synthesized
ggaccccaccacagctcaag

SEQ ID NO: 25842 - DNA, 20 bp, Artificial Sequence
  chemically synthesized
gaccccaccacagctcaagg

SEQ ID NO: 25843 - DNA, 20 bp, Artificial Sequence
  chemically synthesized
aggaggcctgcctgcctctg

SEQ ID NO: 25844 - DNA, 20 bp, Artificial Sequence
  chemically synthesized
ggaggcctgcctgcctctgt

SEQ ID NO: 25845 - DNA, 20 bp, Artificial Sequence
  chemically synthesized
gcctctgtaggctccacctt

SEQ ID NO: 25846 - DNA, 20 bp, Artificial Sequence
  chemically synthesized
cctctgtaggctccaccttt

SEQ ID NO: 25847 - DNA, 20 bp, Artificial Sequence
  chemically synthesized
ctctgtaggctccacctttg

SEQ ID NO: 25848 - DNA, 20 bp, Artificial Sequence
  chemically synthesized
tctgtaggctccacctttgg

SEQ ID NO: 25849 - DNA, 20 bp, Artificial Sequence
  chemically synthesized
gtaggctccacctttggggg

SEQ ID NO: 25850 - DNA, 20 bp, Artificial Sequence
  chemically synthesized
taggctccacctttgggggc

SEQ ID NO: 25851 - DNA, 20 bp, Artificial Sequence
  chemically synthesized
aggctccacctttgggggca

SEQ ID NO: 25852 - DNA, 20 bp, Artificial Sequence
  chemically synthesized
ccacctttgggggcagggca

SEQ ID NO: 25853 - DNA, 20 bp, Artificial Sequence
  chemically synthesized
gcagggcacagacaaacaaa

SEQ ID NO: 25854 - DNA, 20 bp, Artificial Sequence
  chemically synthesized
ggcacagacaaacaaaaaga

SEQ ID NO: 25855 - DNA, 20 bp, Artificial Sequence
  chemically synthesized
acagacaaacaaaaagacag

SEQ ID NO: 25856 - DNA, 20 bp, Artificial Sequence
  chemically synthesized
aaagacagcagtaacctctg

SEQ ID NO: 25857 - DNA, 20 bp, Artificial Sequence
  chemically synthesized
acttaaatgtccctgtctga

SEQ ID NO: 25858 - DNA, 20 bp, Artificial Sequence
  chemically synthesized
tgtccctgtctgacagcttt

SEQ ID NO: 25859 - DNA, 20 bp, Artificial Sequence
  chemically synthesized
gtccctgtctgacagctttg

SEQ ID NO: 25860 - DNA, 20 bp, Artificial Sequence
  chemically synthesized
ccctgtctgacagctttgag

SEQ ID NO: 25861 - DNA, 20 bp, Artificial Sequence
  chemically synthesized
ctgtctgacagctttgagga

SEQ ID NO: 25862 - DNA, 20 bp, Artificial Sequence
  chemically synthesized
tctgacagctttgaggagag

SEQ ID NO: 25863 - DNA, 20 bp, Artificial Sequence
  chemically synthesized
gacagctttgaggagagcag

SEQ ID NO: 25864 - DNA, 20 bp, Artificial Sequence
  chemically synthesized
gaggagagcagtggttctcc

SEQ ID NO: 25865 - DNA, 20 bp, Artificial Sequence
  chemically synthesized
gcagtggttctcccagcaca

SEQ ID NO: 25866 - DNA, 20 bp, Artificial Sequence
  chemically synthesized
tggttctcccagcacacagc

SEQ ID NO: 25867 - DNA, 20 bp, Artificial Sequence
  chemically synthesized
gttctcccagcacacagctg

SEQ ID NO: 25868 - DNA, 20 bp, Artificial Sequence
  chemically synthesized
cagcacacagctggagatct

SEQ ID NO: 25869 - DNA, 20 bp, Artificial Sequence
  chemically synthesized
cacagctggagatctgagaa

SEQ ID NO: 25870 - DNA, 20 bp, Artificial Sequence
  chemically synthesized
acagctggagatctgagaac

SEQ ID NO: 25871 - DNA, 20 bp, Artificial Sequence
  chemically synthesized
gctggagatctgagaacggg

SEQ ID NO: 25872 - DNA, 20 bp, Artificial Sequence
  chemically synthesized
aacgggcagactgcctcctc

SEQ ID NO: 25873 - DNA, 20 bp, Artificial Sequence
  chemically synthesized
gggcagactgcctcctcaag

SEQ ID NO: 25874 - DNA, 20 bp, Artificial Sequence
  chemically synthesized
ggcagactgcctcctcaagt

SEQ ID NO: 25875 - DNA, 20 bp, Artificial Sequence
  chemically synthesized
gtccctgacccctgaccccc

SEQ ID NO: 25876 - DNA, 20 bp, Artificial Sequence
  chemically synthesized
cctgacccctgacccccgag

SEQ ID NO: 25877 - DNA, 20 bp, Artificial Sequence
  chemically synthesized
tgacccccgagcagcctaac

SEQ ID NO: 25878 - DNA, 20 bp, Artificial Sequence
  chemically synthesized
gacccccgagcagcctaact

SEQ ID NO: 25879 - DNA, 20 bp, Artificial Sequence
  chemically synthesized
cccccgagcagcctaactgg

SEQ ID NO: 25880 - DNA, 20 bp, Artificial Sequence
  chemically synthesized
ccccgagcagcctaactggg

SEQ ID NO: 25881 - DNA, 20 bp, Artificial Sequence
  chemically synthesized
cctaactgggaggcaccccc

SEQ ID NO: 25882 - DNA, 20 bp, Artificial Sequence
  chemically synthesized
actgggaggcacccccaagt

SEQ ID NO: 25883 - DNA, 20 bp, Artificial Sequence
  chemically synthesized
ctgggaggcacccccaagta

SEQ ID NO: 25884 - DNA, 20 bp, Artificial Sequence
  chemically synthesized
tgggaggcacccccaagtaa

SEQ ID NO: 25885 - DNA, 20 bp, Artificial Sequence
  chemically synthesized
gaggcacccccaagtaaggg

SEQ ID NO: 25886 - DNA, 20 bp, Artificial Sequence
  chemically synthesized
gggcagactgacacctcaca

SEQ ID NO: 25887 - DNA, 20 bp, Artificial Sequence
  chemically synthesized
agactgacacctcacacggc

SEQ ID NO: 25888 - DNA, 20 bp, Artificial Sequence
  chemically synthesized
gactgacacctcacacggcc

SEQ ID NO: 25889 - DNA, 20 bp, Artificial Sequence
  chemically synthesized
acacggccaggtactcctct

SEQ ID NO: 25890 - DNA, 20 bp, Artificial Sequence
  chemically synthesized
ctcctctgagacaaaacttc

SEQ ID NO: 25891 - DNA, 20 bp, Artificial Sequence
  chemically synthesized
cctctgagacaaaacttcca

SEQ ID NO: 25892 - DNA, 20 bp, Artificial Sequence
  chemically synthesized
ctctgagacaaaacttccag

SEQ ID NO: 25893 - DNA, 20 bp, Artificial Sequence
  chemically synthesized
aaaacttccagaggaacgat

SEQ ID NO: 25894 - DNA, 20 bp, Artificial Sequence
  chemically synthesized
cttccagaggaacgatcaga

SEQ ID NO: 25895 - DNA, 20 bp, Artificial Sequence
  chemically synthesized
ccagaggaacgatcagacag

SEQ ID NO: 25896 - DNA, 20 bp, Artificial Sequence
  chemically synthesized
cgatcagacagcagcattcg

SEQ ID NO: 25897 - DNA, 20 bp, Artificial Sequence
  chemically synthesized
tcgcggatcacgaaaatctg

SEQ ID NO: 25898 - DNA, 20 bp, Artificial Sequence
  chemically synthesized
cacgaaaatctgcggttctg

SEQ ID NO: 25899 - DNA, 20 bp, Artificial Sequence
  chemically synthesized
cagacaccgctgctgatacc

SEQ ID NO: 25900 - DNA, 20 bp, Artificial Sequence
  chemically synthesized
agacaccgctgctgataccc

SEQ ID NO: 25901 - DNA, 20 bp, Artificial Sequence
  chemically synthesized
gctgctgatacccaggcaaa

SEQ ID NO: 25902 - DNA, 20 bp, Artificial Sequence
  chemically synthesized
ctgctgatacccaggcaaac

SEQ ID NO: 25903 - DNA, 20 bp, Artificial Sequence
  chemically synthesized
tgctgatacccaggcaaaca

SEQ ID NO: 25904 - DNA, 20 bp, Artificial Sequence
  chemically synthesized
atacccaggcaaacagggtc

SEQ ID NO: 25905 - DNA, 20 bp, Artificial Sequence
  chemically synthesized
acccaggcaaacagggtctg

SEQ ID NO: 25906 - DNA, 20 bp, Artificial Sequence
  chemically synthesized
caggcaaacagggtctggag

SEQ ID NO: 25907 - DNA, 20 bp, Artificial Sequence
  chemically synthesized
cagggtctggagtggacctc

SEQ ID NO: 25908 - DNA, 20 bp, Artificial Sequence
  chemically synthesized
ggacctctagcaaactccaa

SEQ ID NO: 25909 - DNA, 20 bp, Artificial Sequence
  chemically synthesized
agcaaactccaacagacctg

SEQ ID NO: 25910 - DNA, 20 bp, Artificial Sequence
  chemically synthesized
actccaacagacctgcagct

SEQ ID NO: 25911 - DNA, 20 bp, Artificial Sequence
  chemically synthesized
ctccaacagacctgcagctg

SEQ ID NO: 25912 - DNA, 20 bp, Artificial Sequence
  chemically synthesized
tccaacagacctgcagctga

SEQ ID NO: 25913 - DNA, 20 bp, Artificial Sequence
  chemically synthesized
cagctgagggtcctgtctgt

SEQ ID NO: 25914 - DNA, 20 bp, Artificial Sequence
  chemically synthesized
ctgagggtcctgtctgttag

SEQ ID NO: 25915 - DNA, 20 bp, Artificial Sequence
  chemically synthesized
tgagggtcctgtctgttaga

SEQ ID NO: 25916 - DNA, 20 bp, Artificial Sequence
  chemically synthesized
ttagaaggaaaactaacaaa

SEQ ID NO: 25917 - DNA, 20 bp, Artificial Sequence
  chemically synthesized
aaggaaaactaacaaacaga

SEQ ID NO: 25918 - DNA, 20 bp, Artificial Sequence
  chemically synthesized
aggaaaactaacaaacagaa

SEQ ID NO: 25919 - DNA, 20 bp, Artificial Sequence
  chemically synthesized
catccacaccaaaaacccat

SEQ ID NO: 25920 - DNA, 20 bp, Artificial Sequence
  chemically synthesized
tcggtacatcactatcatca

SEQ ID NO: 25921 - DNA, 20 bp, Artificial Sequence
  chemically synthesized
tcactatcatcaaagaccaa

SEQ ID NO: 25922 - DNA, 20 bp, Artificial Sequence
  chemically synthesized
ctatcatcaaagaccaaaag

SEQ ID NO: 25923 - DNA, 20 bp, Artificial Sequence
  chemically synthesized
caaaagtagatacaaccaca

SEQ ID NO: 25924 - DNA, 20 bp, Artificial Sequence
  chemically synthesized
agtagatacaaccacaaagt

SEQ ID NO: 25925 - DNA, 20 bp, Artificial Sequence
  chemically synthesized
gtagatacaaccacaaagtt

SEQ ID NO: 25926 - DNA, 20 bp, Artificial Sequence
  chemically synthesized
tagatacaaccacaaagttg

SEQ ID NO: 25927 - DNA, 20 bp, Artificial Sequence
  chemically synthesized
ccacaaagttggggaaaaaa

SEQ ID NO: 25928 - DNA, 20 bp, Artificial Sequence
  chemically synthesized
acaaagttggggaaaaaaca

SEQ ID NO: 25929 - DNA, 20 bp, Artificial Sequence
  chemically synthesized
aagttggggaaaaaacagag

SEQ ID NO: 25930 - DNA, 20 bp, Artificial Sequence
  chemically synthesized
aaaaaacagagcagaaaaac

SEQ ID NO: 25931 - DNA, 20 bp, Artificial Sequence
  chemically synthesized
gaaaaactggaaactctaaa

SEQ ID NO: 25932 - DNA, 20 bp, Artificial Sequence
  chemically synthesized
aaactggaaactctaaaaag

SEQ ID NO: 25933 - DNA, 20 bp, Artificial Sequence
  chemically synthesized
actggaaactctaaaaagca

SEQ ID NO: 25934 - DNA, 20 bp, Artificial Sequence
  chemically synthesized
agagcacctttcctcctcca

SEQ ID NO: 25935 - DNA, 20 bp, Artificial Sequence
  chemically synthesized
gagcacctttcctcctccaa

SEQ ID NO: 25936 - DNA, 20 bp, Artificial Sequence
  chemically synthesized
acctttcctcctccaaagga

SEQ ID NO: 25937 - DNA, 20 bp, Artificial Sequence
  chemically synthesized
tttcctcctccaaaggaaag

SEQ ID NO: 25938 - DNA, 20 bp, Artificial Sequence
  chemically synthesized
aaaggaaagcagttcctcac

SEQ ID NO: 25939 - DNA, 20 bp, Artificial Sequence
  chemically synthesized
aagcagttcctcaccagcaa

SEQ ID NO: 25940 - DNA, 20 bp, Artificial Sequence
  chemically synthesized
tcctcaccagcaacggaaca

SEQ ID NO: 25941 - DNA, 20 bp, Artificial Sequence
  chemically synthesized
caccagcaacggaacaaagc

SEQ ID NO: 25942 - DNA, 20 bp, Artificial Sequence
  chemically synthesized
agcaacggaacaaagctgga

SEQ ID NO: 25943 - DNA, 20 bp, Artificial Sequence
  chemically synthesized
caacggaacaaagctggatg

SEQ ID NO: 25944 - DNA, 20 bp, Artificial Sequence
  chemically synthesized
ggatggagaatgactttgac

SEQ ID NO: 25945 - DNA, 20 bp, Artificial Sequence
  chemically synthesized
gagaatgactttgacgagct

SEQ ID NO: 25946 - DNA, 20 bp, Artificial Sequence
  chemically synthesized
gaatgactttgacgagctga

SEQ ID NO: 25947 - DNA, 20 bp, Artificial Sequence
  chemically synthesized
tgactttgacgagctgagag

SEQ ID NO: 25948 - DNA, 20 bp, Artificial Sequence
  chemically synthesized
ctttgacgagctgagagaag

SEQ ID NO: 25949 - DNA, 20 bp, Artificial Sequence
  chemically synthesized
gagctgagagaagaagactt

SEQ ID NO: 25950 - DNA, 20 bp, Artificial Sequence
  chemically synthesized
tcagacgatgaaactactcc

SEQ ID NO: 25951 - DNA, 20 bp, Artificial Sequence
  chemically synthesized
gatgaaactactccgagcta

SEQ ID NO: 25952 - DNA, 20 bp, Artificial Sequence
  chemically synthesized
atgaaactactccgagctac

SEQ ID NO: 25953 - DNA, 20 bp, Artificial Sequence
  chemically synthesized
gaaactactccgagctacag

SEQ ID NO: 25954 - DNA, 20 bp, Artificial Sequence
  chemically synthesized
aaactactccgagctacagg

SEQ ID NO: 25955 - DNA, 20 bp, Artificial Sequence
  chemically synthesized
acaggaggaaattcaaacca

SEQ ID NO: 25956 - DNA, 20 bp, Artificial Sequence
  chemically synthesized
caggaggaaattcaaaccaa

SEQ ID NO: 25957 - DNA, 20 bp, Artificial Sequence
  chemically synthesized
ggaaattcaaaccaaaggca

SEQ ID NO: 25958 - DNA, 20 bp, Artificial Sequence
  chemically synthesized
aattcaaaccaaaggcaaag

SEQ ID NO: 25959 - DNA, 20 bp, Artificial Sequence
  chemically synthesized
aaaaactttgaaaaaaaatt

SEQ ID NO: 25960 - DNA, 20 bp, Artificial Sequence
  chemically synthesized
aatttagatgaatgtataac

SEQ ID NO: 25961 - DNA, 20 bp, Artificial Sequence
  chemically synthesized
tataactagaataaccaata

SEQ ID NO: 25962 - DNA, 20 bp, Artificial Sequence
  chemically synthesized
taactagaataaccaataca

SEQ ID NO: 25963 - DNA, 20 bp, Artificial Sequence
  chemically synthesized
ctagaataaccaatacagag

SEQ ID NO: 25964 - DNA, 20 bp, Artificial Sequence
  chemically synthesized
ccaatacagagaagtgctta

SEQ ID NO: 25965 - DNA, 20 bp, Artificial Sequence
  chemically synthesized
caatacagagaagtgcttaa

SEQ ID NO: 25966 - DNA, 20 bp, Artificial Sequence
  chemically synthesized
atacagagaagtgcttaaag

SEQ ID NO: 25967 - DNA, 20 bp, Artificial Sequence
  chemically synthesized
gaagtgcttaaaggagctga

SEQ ID NO: 25968 - DNA, 20 bp, Artificial Sequence
  chemically synthesized
agtgcttaaaggagctgatg

SEQ ID NO: 25969 - DNA, 20 bp, Artificial Sequence
  chemically synthesized
aaaggagctgatggagctga

SEQ ID NO: 25970 - DNA, 20 bp, Artificial Sequence
  chemically synthesized
agctgatggagctgaaagcc

SEQ ID NO: 25971 - DNA, 20 bp, Artificial Sequence
  chemically synthesized
gctgatggagctgaaagcca

SEQ ID NO: 25972 - DNA, 20 bp, Artificial Sequence
  chemically synthesized
ggagctgaaagccaaggctc

SEQ ID NO: 25973 - DNA, 20 bp, Artificial Sequence
  chemically synthesized
caaggctcgagaatgacgtg

SEQ ID NO: 25974 - DNA, 20 bp, Artificial Sequence
  chemically synthesized
ctcgagaatgacgtgaagaa

SEQ ID NO: 25975 - DNA, 20 bp, Artificial Sequence
  chemically synthesized
cgagaatgacgtgaagaatg

SEQ ID NO: 25976 - DNA, 20 bp, Artificial Sequence
  chemically synthesized
gaatgacgtgaagaatggag

SEQ ID NO: 25977 - DNA, 20 bp, Artificial Sequence
  chemically synthesized
cgtgaagaatggagaagcct

SEQ ID NO: 25978 - DNA, 20 bp, Artificial Sequence
  chemically synthesized
gtgaagaatggagaagcctc

SEQ ID NO: 25979 - DNA, 20 bp, Artificial Sequence
  chemically synthesized
gaagaatggagaagcctcag

SEQ ID NO: 25980 - DNA, 20 bp, Artificial Sequence
  chemically synthesized
caggagctgatgcgatcaac

SEQ ID NO: 25981 - DNA, 20 bp, Artificial Sequence
  chemically synthesized
gagctgatgcgatcaactgg

SEQ ID NO: 25982 - DNA, 20 bp, Artificial Sequence
  chemically synthesized
tgatgcgatcaactggaaga

SEQ ID NO: 25983 - DNA, 20 bp, Artificial Sequence
  chemically synthesized
gatgcgatcaactggaagaa

SEQ ID NO: 25984 - DNA, 20 bp, Artificial Sequence
  chemically synthesized
atgcgatcaactggaagaaa

SEQ ID NO: 25985 - DNA, 20 bp, Artificial Sequence
  chemically synthesized
tcaactggaagaaagggtat

SEQ ID NO: 25986 - DNA, 20 bp, Artificial Sequence
  chemically synthesized
ggaagaaagggtatcagtga

SEQ ID NO: 25987 - DNA, 20 bp, Artificial Sequence
  chemically synthesized
agaaagggtatcagtgatgg

SEQ ID NO: 25988 - DNA, 20 bp, Artificial Sequence
  chemically synthesized
aagatgaaataaatgaaatg

SEQ ID NO: 25989 - DNA, 20 bp, Artificial Sequence
  chemically synthesized
tgaaataaatgaaatgaagc

SEQ ID NO: 25990 - DNA, 20 bp, Artificial Sequence
  chemically synthesized
aataaatgaaatgaagcgag

SEQ ID NO: 25991 - DNA, 20 bp, Artificial Sequence
  chemically synthesized
ataaatgaaatgaagcgaga

SEQ ID NO: 25992 - DNA, 20 bp, Artificial Sequence
  chemically synthesized
taaatgaaatgaagcgagaa

SEQ ID NO: 25993 - DNA, 20 bp, Artificial Sequence
  chemically synthesized
atgaaatgaagcgagaaggg

SEQ ID NO: 25994 - DNA, 20 bp, Artificial Sequence
  chemically synthesized
atgaagcgagaagggaagtt

SEQ ID NO: 25995 - DNA, 20 bp, Artificial Sequence
  chemically synthesized
gaagcgagaagggaagttta

SEQ ID NO: 25996 - DNA, 20 bp, Artificial Sequence
  chemically synthesized
gaagggaagtttagagaaaa

SEQ ID NO: 25997 - DNA, 20 bp, Artificial Sequence
  chemically synthesized
tttagagaaaaaagaataaa

SEQ ID NO: 25998 - DNA, 20 bp, Artificial Sequence
  chemically synthesized
agaataaaaagaaatgaaca

SEQ ID NO: 25999 - DNA, 20 bp, Artificial Sequence
  chemically synthesized
aagaaatgaacaaagcctcc

SEQ ID NO: 26000 - DNA, 20 bp, Artificial Sequence
  chemically synthesized
aacaaagcctccaagaaata

SEQ ID NO: 26001 - DNA, 20 bp, Artificial Sequence
  chemically synthesized
acaaagcctccaagaaatat

SEQ ID NO: 26002 - DNA, 20 bp, Artificial Sequence
  chemically synthesized
gaaatatgggactatgtgaa

SEQ ID NO: 26003 - DNA, 20 bp, Artificial Sequence
  chemically synthesized
ctatgtgaaaagatcaaatc

SEQ ID NO: 26004 - DNA, 20 bp, Artificial Sequence
  chemically synthesized
tatgtgaaaagatcaaatct

SEQ ID NO: 26005 - DNA, 20 bp, Artificial Sequence
  chemically synthesized
agatcaaatctaggtctgat

SEQ ID NO: 26006 - DNA, 20 bp, Artificial Sequence
  chemically synthesized
ggtctgattggtgtacctga

SEQ ID NO: 26007 - DNA, 20 bp, Artificial Sequence
  chemically synthesized
attggtgtacctgaaagtga

SEQ ID NO: 26008 - DNA, 20 bp, Artificial Sequence
  chemically synthesized
ttggtgtacctgaaagtgac

SEQ ID NO: 26009 - DNA, 20 bp, Artificial Sequence
  chemically synthesized
tggtgtacctgaaagtgacg

SEQ ID NO: 26010 - DNA, 20 bp, Artificial Sequence
  chemically synthesized
gtgtacctgaaagtgacggg

SEQ ID NO: 26011 - DNA, 20 bp, Artificial Sequence
  chemically synthesized
gtgacggggagaatcgaacc

SEQ ID NO: 26012 - DNA, 20 bp, Artificial Sequence
  chemically synthesized
cggggagaatcgaaccaagt

SEQ ID NO: 26013 - DNA, 20 bp, Artificial Sequence
  chemically synthesized
ccaagttggaaaacactctg

SEQ ID NO: 26014 - DNA, 20 bp, Artificial Sequence
  chemically synthesized
caagttggaaaacactctgc

SEQ ID NO: 26015 - DNA, 20 bp, Artificial Sequence
  chemically synthesized
acactctgcaggatattatc

SEQ ID NO: 26016 - DNA, 20 bp, Artificial Sequence
  chemically synthesized
cactctgcaggatattatcc

SEQ ID NO: 26017 - DNA, 20 bp, Artificial Sequence
  chemically synthesized
ctctgcaggatattatccag

SEQ ID NO: 26018 - DNA, 20 bp, Artificial Sequence
  chemically synthesized
ccaggagaacttccccaatc

SEQ ID NO: 26019 - DNA, 20 bp, Artificial Sequence
  chemically synthesized
gagaacttccccaatctagc

SEQ ID NO: 26020 - DNA, 20 bp, Artificial Sequence
  chemically synthesized
agaacttccccaatctagca

SEQ ID NO: 26021 - DNA, 20 bp, Artificial Sequence
  chemically synthesized
acttccccaatctagcaagg

SEQ ID NO: 26022 - DNA, 20 bp, Artificial Sequence
  chemically synthesized
cttccccaatctagcaaggc

SEQ ID NO: 26023 - DNA, 20 bp, Artificial Sequence
  chemically synthesized
tagcaaggcaggccaacatt

SEQ ID NO: 26024 - DNA, 20 bp, Artificial Sequence
  chemically synthesized
ggcaggccaacattcagatt

SEQ ID NO: 26025 - DNA, 20 bp, Artificial Sequence
  chemically synthesized
gcaggccaacattcagattc

SEQ ID NO: 26026 - DNA, 20 bp, Artificial Sequence
  chemically synthesized
acattcagattcaggaaata

SEQ ID NO: 26027 - DNA, 20 bp, Artificial Sequence
  chemically synthesized
attcagattcaggaaataca

SEQ ID NO: 26028 - DNA, 20 bp, Artificial Sequence
  chemically synthesized
acgccacaaacatactcctc

SEQ ID NO: 26029 - DNA, 20 bp, Artificial Sequence
  chemically synthesized
ccacaaacatactcctcgag

SEQ ID NO: 26030 - DNA, 20 bp, Artificial Sequence
  chemically synthesized
acaaacatactcctcgagaa

SEQ ID NO: 26031 - DNA, 20 bp, Artificial Sequence
  chemically synthesized
tcctcgagaagagcaactcc

SEQ ID NO: 26032 - DNA, 20 bp, Artificial Sequence
  chemically synthesized
actccaagacacataattgt

SEQ ID NO: 26033 - DNA, 20 bp, Artificial Sequence
  chemically synthesized
cataattgtcagattcacca

SEQ ID NO: 26034 - DNA, 20 bp, Artificial Sequence
  chemically synthesized
gattcaccaaagttgaaatg

SEQ ID NO: 26035 - DNA, 20 bp, Artificial Sequence
  chemically synthesized
attcaccaaagttgaaatga

SEQ ID NO: 26036 - DNA, 20 bp, Artificial Sequence
  chemically synthesized
gaaatgaaggaaaaaatgtt

SEQ ID NO: 26037 - DNA, 20 bp, Artificial Sequence
  chemically synthesized
aaatgaaggaaaaaatgtta

SEQ ID NO: 26038 - DNA, 20 bp, Artificial Sequence
  chemically synthesized
aatgaaggaaaaaatgttaa

SEQ ID NO: 26039 - DNA, 20 bp, Artificial Sequence
  chemically synthesized
gaaggaaaaaatgttaaggg

SEQ ID NO: 26040 - DNA, 20 bp, Artificial Sequence
  chemically synthesized
gaaaaaatgttaagggcagc

SEQ ID NO: 26041 - DNA, 20 bp, Artificial Sequence
  chemically synthesized
aaaaatgttaagggcagcca

SEQ ID NO: 26042 - DNA, 20 bp, Artificial Sequence
  chemically synthesized
aaatgttaagggcagccaga

SEQ ID NO: 26043 - DNA, 20 bp, Artificial Sequence
  chemically synthesized
gttaagggcagccagagaga

SEQ ID NO: 26044 - DNA, 20 bp, Artificial Sequence
  chemically synthesized
ttaagggcagccagagagaa

SEQ ID NO: 26045 - DNA, 20 bp, Artificial Sequence
  chemically synthesized
gggcagccagagagaaaggt

SEQ ID NO: 26046 - DNA, 20 bp, Artificial Sequence
  chemically synthesized
ggcagccagagagaaaggtc

SEQ ID NO: 26047 - DNA, 20 bp, Artificial Sequence
  chemically synthesized
gaaaggtcgggttacccaca

SEQ ID NO: 26048 - DNA, 20 bp, Artificial Sequence
  chemically synthesized
aaaggtcgggttacccacaa

SEQ ID NO: 26049 - DNA, 20 bp, Artificial Sequence
  chemically synthesized
aaggtcgggttacccacaaa

SEQ ID NO: 26050 - DNA, 20 bp, Artificial Sequence
  chemically synthesized
gtcgggttacccacaaaggg

SEQ ID NO: 26051 - DNA, 20 bp, Artificial Sequence
  chemically synthesized
acccacaaagggaagcccat

SEQ ID NO: 26052 - DNA, 20 bp, Artificial Sequence
  chemically synthesized
agggaagcccatcagactaa

SEQ ID NO: 26053 - DNA, 20 bp, Artificial Sequence
  chemically synthesized
gaagcccatcagactaacag

SEQ ID NO: 26054 - DNA, 20 bp, Artificial Sequence
  chemically synthesized
cagactaacagcagctctct

SEQ ID NO: 26055 - DNA, 20 bp, Artificial Sequence
  chemically synthesized
actaacagcagctctcttgg

SEQ ID NO: 26056 - DNA, 20 bp, Artificial Sequence
  chemically synthesized
tctcttggcagaaactctac

SEQ ID NO: 26057 - DNA, 20 bp, Artificial Sequence
  chemically synthesized
ttggcagaaactctacaagc

SEQ ID NO: 26058 - DNA, 20 bp, Artificial Sequence
  chemically synthesized
gcagaaactctacaagccag

SEQ ID NO: 26059 - DNA, 20 bp, Artificial Sequence
  chemically synthesized
agaaactctacaagccagaa

SEQ ID NO: 26060 - DNA, 20 bp, Artificial Sequence
  chemically synthesized
aaactctacaagccagaaga

SEQ ID NO: 26061 - DNA, 20 bp, Artificial Sequence
  chemically synthesized
ctctacaagccagaagagag

SEQ ID NO: 26062 - DNA, 20 bp, Artificial Sequence
  chemically synthesized
tctacaagccagaagagagt

SEQ ID NO: 26063 - DNA, 20 bp, Artificial Sequence
  chemically synthesized
ctacaagccagaagagagtg

SEQ ID NO: 26064 - DNA, 20 bp, Artificial Sequence
  chemically synthesized
tacaagccagaagagagtgg

SEQ ID NO: 26065 - DNA, 20 bp, Artificial Sequence
  chemically synthesized
gccaatattcaacatcctta

SEQ ID NO: 26066 - DNA, 20 bp, Artificial Sequence
  chemically synthesized
ccaatattcaacatccttaa

SEQ ID NO: 26067 - DNA, 20 bp, Artificial Sequence
  chemically synthesized
tattcaacatccttaaagga

SEQ ID NO: 26068 - DNA, 20 bp, Artificial Sequence
  chemically synthesized
aaaggaaagaattttcaaca

SEQ ID NO: 26069 - DNA, 20 bp, Artificial Sequence
  chemically synthesized
tcaacacagaatttaatatc

SEQ ID NO: 26070 - DNA, 20 bp, Artificial Sequence
  chemically synthesized
atttaatatccagccaaact

SEQ ID NO: 26071 - DNA, 20 bp, Artificial Sequence
  chemically synthesized
ccagccaaactaagcttcat

SEQ ID NO: 26072 - DNA, 20 bp, Artificial Sequence
  chemically synthesized
caaactaagcttcataagtg

SEQ ID NO: 26073 - DNA, 20 bp, Artificial Sequence
  chemically synthesized
aaactaagcttcataagtga

SEQ ID NO: 26074 - DNA, 20 bp, Artificial Sequence
  chemically synthesized
actaagcttcataagtgaag

SEQ ID NO: 26075 - DNA, 20 bp, Artificial Sequence
  chemically synthesized
aggagaaataaaatacttta

SEQ ID NO: 26076 - DNA, 20 bp, Artificial Sequence
  chemically synthesized
aaataaaatactttacagac

SEQ ID NO: 26077 - DNA, 20 bp, Artificial Sequence
  chemically synthesized
tttacagacaagcaaatgct

SEQ ID NO: 26078 - DNA, 20 bp, Artificial Sequence
  chemically synthesized
tacagacaagcaaatgctga

SEQ ID NO: 26079 - DNA, 20 bp, Artificial Sequence
  chemically synthesized
ctgagagattttgtcatcac

SEQ ID NO: 26080 - DNA, 20 bp, Artificial Sequence
  chemically synthesized
tgagagattttgtcatcacc

SEQ ID NO: 26081 - DNA, 20 bp, Artificial Sequence
  chemically synthesized
catcaccaggcctgacctaa

SEQ ID NO: 26082 - DNA, 20 bp, Artificial Sequence
  chemically synthesized
tcaccaggcctgacctaaaa

SEQ ID NO: 26083 - DNA, 20 bp, Artificial Sequence
  chemically synthesized
ctgacctaaaagagctcctg

SEQ ID NO: 26084 - DNA, 20 bp, Artificial Sequence
  chemically synthesized
tgacctaaaagagctcctga

SEQ ID NO: 26085 - DNA, 20 bp, Artificial Sequence
  chemically synthesized
cctaaaagagctcctgaagg

SEQ ID NO: 26086 - DNA, 20 bp, Artificial Sequence
  chemically synthesized
cctgaaggaagcactaaaca

SEQ ID NO: 26087 - DNA, 20 bp, Artificial Sequence
  chemically synthesized
aaggaagcactaaacatgga

SEQ ID NO: 26088 - DNA, 20 bp, Artificial Sequence
  chemically synthesized
aggaagcactaaacatggaa

SEQ ID NO: 26089 - DNA, 20 bp, Artificial Sequence
  chemically synthesized
taaacatggaaaggcacaac

SEQ ID NO: 26090 - DNA, 20 bp, Artificial Sequence
  chemically synthesized
tggaaaggcacaaccggtac

SEQ ID NO: 26091 - DNA, 20 bp, Artificial Sequence
  chemically synthesized
ggtaccagccactgcaaaat

SEQ ID NO: 26092 - DNA, 20 bp, Artificial Sequence
  chemically synthesized
gtaccagccactgcaaaatc

SEQ ID NO: 26093 - DNA, 20 bp, Artificial Sequence
  chemically synthesized
caaaatcaggccaaaatgtg

SEQ ID NO: 26094 - DNA, 20 bp, Artificial Sequence
  chemically synthesized
gccaaaatgtgaagaccatc

SEQ ID NO: 26095 - DNA, 20 bp, Artificial Sequence
  chemically synthesized
aatgtgaagaccatcaagac

SEQ ID NO: 26096 - DNA, 20 bp, Artificial Sequence
  chemically synthesized
atgtgaagaccatcaagact

SEQ ID NO: 26097 - DNA, 20 bp, Artificial Sequence
  chemically synthesized
tgaagaccatcaagactagg

SEQ ID NO: 26098 - DNA, 20 bp, Artificial Sequence
  chemically synthesized
aagaaactgcatcaactaac

SEQ ID NO: 26099 - DNA, 20 bp, Artificial Sequence
  chemically synthesized
caactaacgagcaaaataac

SEQ ID NO: 26100 - DNA, 20 bp, Artificial Sequence
  chemically synthesized
ataaccagctatcataatga

SEQ ID NO: 26101 - DNA, 20 bp, Artificial Sequence
  chemically synthesized
taaccagctatcataatgac

SEQ ID NO: 26102 - DNA, 20 bp, Artificial Sequence
  chemically synthesized
atattaactttaaatgtaaa

SEQ ID NO: 26103 - DNA, 20 bp, Artificial Sequence
  chemically synthesized
actttaaatgtaaatggact

SEQ ID NO: 26104 - DNA, 20 bp, Artificial Sequence
  chemically synthesized
ggactaagtgctccaattga

SEQ ID NO: 26105 - DNA, 20 bp, Artificial Sequence
  chemically synthesized
agtgctccaattgaaagaca

SEQ ID NO: 26106 - DNA, 20 bp, Artificial Sequence
  chemically synthesized
tccaattgaaagacacagac

SEQ ID NO: 26107 - DNA, 20 bp, Artificial Sequence
  chemically synthesized
aaagacacagactggcaaat

SEQ ID NO: 26108 - DNA, 20 bp, Artificial Sequence
  chemically synthesized
acagactggcaaattggata

SEQ ID NO: 26109 - DNA, 20 bp, Artificial Sequence
  chemically synthesized
agactggcaaattggataaa

SEQ ID NO: 26110 - DNA, 20 bp, Artificial Sequence
  chemically synthesized
aattggataaagagtgtatt

SEQ ID NO: 26111 - DNA, 20 bp, Artificial Sequence
  chemically synthesized
attggataaagagtgtattc

SEQ ID NO: 26112 - DNA, 20 bp, Artificial Sequence
  chemically synthesized
ctcatgtgcacacacacaca

SEQ ID NO: 26113 - DNA, 20 bp, Artificial Sequence
  chemically synthesized
tcatgtgcacacacacacat

SEQ ID NO: 26114 - DNA, 20 bp, Artificial Sequence
  chemically synthesized
cacacataggctcaaaataa

SEQ ID NO: 26115 - DNA, 20 bp, Artificial Sequence
  chemically synthesized
acacataggctcaaaataaa

SEQ ID NO: 26116 - DNA, 20 bp, Artificial Sequence
  chemically synthesized
ataggctcaaaataaaagga

SEQ ID NO: 26117 - DNA, 20 bp, Artificial Sequence
  chemically synthesized
aggctcaaaataaaaggatg

SEQ ID NO: 26118 - DNA, 20 bp, Artificial Sequence
  chemically synthesized
ggctcaaaataaaaggatgg

SEQ ID NO: 26119 - DNA, 20 bp, Artificial Sequence
  chemically synthesized
tcaaaataaaaggatggagg

SEQ ID NO: 26120 - DNA, 20 bp, Artificial Sequence
  chemically synthesized
aggatggaggaagatctacc

SEQ ID NO: 26121 - DNA, 20 bp, Artificial Sequence
  chemically synthesized
aggaagatctaccaagcaaa

SEQ ID NO: 26122 - DNA, 20 bp, Artificial Sequence
  chemically synthesized
aagcaaatggaaaacaaaaa

SEQ ID NO: 26123 - DNA, 20 bp, Artificial Sequence
  chemically synthesized
agcaaatggaaaacaaaaaa

SEQ ID NO: 26124 - DNA, 20 bp, Artificial Sequence
  chemically synthesized
aaatggaaaacaaaaaaagg

SEQ ID NO: 26125 - DNA, 20 bp, Artificial Sequence
  chemically synthesized
aatggaaaacaaaaaaaggc

SEQ ID NO: 26126 - DNA, 20 bp, Artificial Sequence
  chemically synthesized
atggaaaacaaaaaaaggca

SEQ ID NO: 26127 - DNA, 20 bp, Artificial Sequence
  chemically synthesized
tggaaaacaaaaaaaggcag

SEQ ID NO: 26128 - DNA, 20 bp, Artificial Sequence
  chemically synthesized
aaaggcaggggttgcaatcc

SEQ ID NO: 26129 - DNA, 20 bp, Artificial Sequence
  chemically synthesized
aatcctagtctctgataaaa

SEQ ID NO: 26130 - DNA, 20 bp, Artificial Sequence
  chemically synthesized
atcctagtctctgataaaac

SEQ ID NO: 26131 - DNA, 20 bp, Artificial Sequence
  chemically synthesized
aaacaggctttaaaccaaca

SEQ ID NO: 26132 - DNA, 20 bp, Artificial Sequence
  chemically synthesized
tttaaaccaacaaagatcaa

SEQ ID NO: 26133 - DNA, 20 bp, Artificial Sequence
  chemically synthesized
taaaccaacaaagatcaaaa

SEQ ID NO: 26134 - DNA, 20 bp, Artificial Sequence
  chemically synthesized
aacaaagatcaaaagagaca

SEQ ID NO: 26135 - DNA, 20 bp, Artificial Sequence
  chemically synthesized
aaagatcaaaagagacaaag

SEQ ID NO: 26136 - DNA, 20 bp, Artificial Sequence
  chemically synthesized
aagatcaaaagagacaaaga

SEQ ID NO: 26137 - DNA, 20 bp, Artificial Sequence
  chemically synthesized
caaagaaggccattacataa

SEQ ID NO: 26138 - DNA, 20 bp, Artificial Sequence
  chemically synthesized
aaggccattacataatggta

SEQ ID NO: 26139 - DNA, 20 bp, Artificial Sequence
  chemically synthesized
aggccattacataatggtaa

SEQ ID NO: 26140 - DNA, 20 bp, Artificial Sequence
  chemically synthesized
ggccattacataatggtaaa

SEQ ID NO: 26141 - DNA, 20 bp, Artificial Sequence
  chemically synthesized
ggtaaagggatcaattcaac

SEQ ID NO: 26142 - DNA, 20 bp, Artificial Sequence
  chemically synthesized
aaagggatcaattcaacaag

SEQ ID NO: 26143 - DNA, 20 bp, Artificial Sequence
  chemically synthesized
agggatcaattcaacaagaa

SEQ ID NO: 26144 - DNA, 20 bp, Artificial Sequence
  chemically synthesized
aaatatatatgcacccaata

SEQ ID NO: 26145 - DNA, 20 bp, Artificial Sequence
  chemically synthesized
aatatatatgcacccaatac

SEQ ID NO: 26146 - DNA, 20 bp, Artificial Sequence
  chemically synthesized
tatatatgcacccaatacag

SEQ ID NO: 26147 - DNA, 20 bp, Artificial Sequence
  chemically synthesized
gcacccaatacaggagcacc

SEQ ID NO: 26148 - DNA, 20 bp, Artificial Sequence
  chemically synthesized
caggagcacccagattcata

SEQ ID NO: 26149 - DNA, 20 bp, Artificial Sequence
  chemically synthesized
agcacccagattcataaagc

SEQ ID NO: 26150 - DNA, 20 bp, Artificial Sequence
  chemically synthesized
agattcataaagcaagtcct

SEQ ID NO: 26151 - DNA, 20 bp, Artificial Sequence
  chemically synthesized
attcataaagcaagtcctta

SEQ ID NO: 26152 - DNA, 20 bp, Artificial Sequence
  chemically synthesized
caagtccttagagacctaca

SEQ ID NO: 26153 - DNA, 20 bp, Artificial Sequence
  chemically synthesized
agtccttagagacctacaaa

SEQ ID NO: 26154 - DNA, 20 bp, Artificial Sequence
  chemically synthesized
tagagacctacaaagagact

SEQ ID NO: 26155 - DNA, 20 bp, Artificial Sequence
  chemically synthesized
agactcccacactttaataa

SEQ ID NO: 26156 - DNA, 20 bp, Artificial Sequence
  chemically synthesized
gactcccacactttaataat

SEQ ID NO: 26157 - DNA, 20 bp, Artificial Sequence
  chemically synthesized
ctcccacactttaataatgg

SEQ ID NO: 26158 - DNA, 20 bp, Artificial Sequence
  chemically synthesized
taataccccactgtcaacat

SEQ ID NO: 26159 - DNA, 20 bp, Artificial Sequence
  chemically synthesized
accccactgtcaacattaga

SEQ ID NO: 26160 - DNA, 20 bp, Artificial Sequence
  chemically synthesized
tcaacattagacagatcaac

SEQ ID NO: 26161 - DNA, 20 bp, Artificial Sequence
  chemically synthesized
cattagacagatcaacgaga

SEQ ID NO: 26162 - DNA, 20 bp, Artificial Sequence
  chemically synthesized
agacagatcaacgagacaga

SEQ ID NO: 26163 - DNA, 20 bp, Artificial Sequence
  chemically synthesized
caacgagacagaaagttaac

SEQ ID NO: 26164 - DNA, 20 bp, Artificial Sequence
  chemically synthesized
aacgagacagaaagttaaca

SEQ ID NO: 26165 - DNA, 20 bp, Artificial Sequence
  chemically synthesized
agaaagttaacaaggatatc

SEQ ID NO: 26166 - DNA, 20 bp, Artificial Sequence
  chemically synthesized
gaaagttaacaaggatatcc

SEQ ID NO: 26167 - DNA, 20 bp, Artificial Sequence
  chemically synthesized
ggatatccaggaattgaaca

SEQ ID NO: 26168 - DNA, 20 bp, Artificial Sequence
  chemically synthesized
attgaacacagctctgcacc

SEQ ID NO: 26169 - DNA, 20 bp, Artificial Sequence
  chemically synthesized
gaacacagctctgcaccaag

SEQ ID NO: 26170 - DNA, 20 bp, Artificial Sequence
  chemically synthesized
tctgcaccaagcagacctaa

SEQ ID NO: 26171 - DNA, 20 bp, Artificial Sequence
  chemically synthesized
gcagacctaatagacatcta

SEQ ID NO: 26172 - DNA, 20 bp, Artificial Sequence
  chemically synthesized
aactctccaccccaaatcaa

SEQ ID NO: 26173 - DNA, 20 bp, Artificial Sequence
  chemically synthesized
acagaatatacatttttttt

SEQ ID NO: 26174 - DNA, 20 bp, Artificial Sequence
  chemically synthesized
tccaaaattgaccacatact

SEQ ID NO: 26175 - DNA, 20 bp, Artificial Sequence
  chemically synthesized
aaaattgaccacatacttgg

SEQ ID NO: 26176 - DNA, 20 bp, Artificial Sequence
  chemically synthesized
tgaccacatacttggaagta

SEQ ID NO: 26177 - DNA, 20 bp, Artificial Sequence
  chemically synthesized
cttggaagtaaagctctcct

SEQ ID NO: 26178 - DNA, 20 bp, Artificial Sequence
  chemically synthesized
gctctcctcagcaaatataa

SEQ ID NO: 26179 - DNA, 20 bp, Artificial Sequence
  chemically synthesized
cctcagcaaatataaaagaa

SEQ ID NO: 26180 - DNA, 20 bp, Artificial Sequence
  chemically synthesized
aattataacaaactgtctct

SEQ ID NO: 26181 - DNA, 20 bp, Artificial Sequence
  chemically synthesized
acaaactgtctctcagacca

SEQ ID NO: 26182 - DNA, 20 bp, Artificial Sequence
  chemically synthesized
agaccacagtgcaatcaaac

SEQ ID NO: 26183 - DNA, 20 bp, Artificial Sequence
  chemically synthesized
agtgcaatcaaactagaact

SEQ ID NO: 26184 - DNA, 20 bp, Artificial Sequence
  chemically synthesized
gtgcaatcaaactagaactc

SEQ ID NO: 26185 - DNA, 20 bp, Artificial Sequence
  chemically synthesized
tcaaactagaactcaggatt

SEQ ID NO: 26186 - DNA, 20 bp, Artificial Sequence
  chemically synthesized
ctcaaaaccactcaactaca

SEQ ID NO: 26187 - DNA, 20 bp, Artificial Sequence
  chemically synthesized
acctgctcctgaatgactac

SEQ ID NO: 26188 - DNA, 20 bp, Artificial Sequence
  chemically synthesized
cctgctcctgaatgactact

SEQ ID NO: 26189 - DNA, 20 bp, Artificial Sequence
  chemically synthesized
actgggtacataacgaaatg

SEQ ID NO: 26190 - DNA, 20 bp, Artificial Sequence
  chemically synthesized
ctgggtacataacgaaatga

SEQ ID NO: 26191 - DNA, 20 bp, Artificial Sequence
  chemically synthesized
ggtacataacgaaatgaagg

SEQ ID NO: 26192 - DNA, 20 bp, Artificial Sequence
  chemically synthesized
acgaaatgaaggcagaaata

SEQ ID NO: 26193 - DNA, 20 bp, Artificial Sequence
  chemically synthesized
agatgttctttgaaaccaat

SEQ ID NO: 26194 - DNA, 20 bp, Artificial Sequence
  chemically synthesized
ctttgaaaccaatgagaaca

SEQ ID NO: 26195 - DNA, 20 bp, Artificial Sequence
  chemically synthesized
agaacaaagacacaacatac

SEQ ID NO: 26196 - DNA, 20 bp, Artificial Sequence
  chemically synthesized
acacaacataccagaatctc

SEQ ID NO: 26197 - DNA, 20 bp, Artificial Sequence
  chemically synthesized
cacaacataccagaatctct

SEQ ID NO: 26198 - DNA, 20 bp, Artificial Sequence
  chemically synthesized
tctctgggacacattcgaat

SEQ ID NO: 26199 - DNA, 20 bp, Artificial Sequence
  chemically synthesized
gacacattcgaatcagtgtg

SEQ ID NO: 26200 - DNA, 20 bp, Artificial Sequence
  chemically synthesized
acacattcgaatcagtgtgt

SEQ ID NO: 26201 - DNA, 20 bp, Artificial Sequence
  chemically synthesized
cacattcgaatcagtgtgta

SEQ ID NO: 26202 - DNA, 20 bp, Artificial Sequence
  chemically synthesized
acattcgaatcagtgtgtag

SEQ ID NO: 26203 - DNA, 20 bp, Artificial Sequence
  chemically synthesized
cattcgaatcagtgtgtagg

SEQ ID NO: 26204 - DNA, 20 bp, Artificial Sequence
  chemically synthesized
agtgtgtagggggaaattta

SEQ ID NO: 26205 - DNA, 20 bp, Artificial Sequence
  chemically synthesized
ttatagcactaaacgcccac

SEQ ID NO: 26206 - DNA, 20 bp, Artificial Sequence
  chemically synthesized
atagcactaaacgcccacaa

SEQ ID NO: 26207 - DNA, 20 bp, Artificial Sequence
  chemically synthesized
cactaaacgcccacaagaga

SEQ ID NO: 26208 - DNA, 20 bp, Artificial Sequence
  chemically synthesized
aaacgcccacaagagaaagc

SEQ ID NO: 26209 - DNA, 20 bp, Artificial Sequence
  chemically synthesized
gcccacaagagaaagcaaga

SEQ ID NO: 26210 - DNA, 20 bp, Artificial Sequence
  chemically synthesized
caccctaacatcacaattaa

SEQ ID NO: 26211 - DNA, 20 bp, Artificial Sequence
  chemically synthesized
aacatcacaattaaaagaac

SEQ ID NO: 26212 - DNA, 20 bp, Artificial Sequence
  chemically synthesized
cacaattaaaagaactagat

SEQ ID NO: 26213 - DNA, 20 bp, Artificial Sequence
  chemically synthesized
attaaaagaactagataagc

SEQ ID NO: 26214 - DNA, 20 bp, Artificial Sequence
  chemically synthesized
taaaagaactagataagcaa

SEQ ID NO: 26215 - DNA, 20 bp, Artificial Sequence
  chemically synthesized
gcaagagcaaacacattcaa

SEQ ID NO: 26216 - DNA, 20 bp, Artificial Sequence
  chemically synthesized
gagcaaacacattcaaaagc

SEQ ID NO: 26217 - DNA, 20 bp, Artificial Sequence
  chemically synthesized
caaacacattcaaaagctag

SEQ ID NO: 26218 - DNA, 20 bp, Artificial Sequence
  chemically synthesized
acacattcaaaagctagcag

SEQ ID NO: 26219 - DNA, 20 bp, Artificial Sequence
  chemically synthesized
ttcaaaagctagcagaagtc

SEQ ID NO: 26220 - DNA, 20 bp, Artificial Sequence
  chemically synthesized
agtcaagaaataactaaaat

SEQ ID NO: 26221 - DNA, 20 bp, Artificial Sequence
  chemically synthesized
tcaagaaataactaaaatca

SEQ ID NO: 26222 - DNA, 20 bp, Artificial Sequence
  chemically synthesized
agaaataactaaaatcagag

SEQ ID NO: 26223 - DNA, 20 bp, Artificial Sequence
  chemically synthesized
ctaaaatcagagcagaactg

SEQ ID NO: 26224 - DNA, 20 bp, Artificial Sequence
  chemically synthesized
taaaatcagagcagaactga

SEQ ID NO: 26225 - DNA, 20 bp, Artificial Sequence
  chemically synthesized
cagagcagaactgaaggaaa

SEQ ID NO: 26226 - DNA, 20 bp, Artificial Sequence
  chemically synthesized
gagcagaactgaaggaaaca

SEQ ID NO: 26227 - DNA, 20 bp, Artificial Sequence
  chemically synthesized
cttcaaaaaattaatgaatc

SEQ ID NO: 26228 - DNA, 20 bp, Artificial Sequence
  chemically synthesized
ttcaaaaaattaatgaatct

SEQ ID NO: 26229 - DNA, 20 bp, Artificial Sequence
  chemically synthesized
caaaaaattaatgaatctgg

SEQ ID NO: 26230 - DNA, 20 bp, Artificial Sequence
  chemically synthesized
aaattaatgaatctgggagc

SEQ ID NO: 26231 - DNA, 20 bp, Artificial Sequence
  chemically synthesized
tctgggagctggttttttga

SEQ ID NO: 26232 - DNA, 20 bp, Artificial Sequence
  chemically synthesized
ctgggagctggttttttgaa

SEQ ID NO: 26233 - DNA, 20 bp, Artificial Sequence
  chemically synthesized
gaaaggatcaacaaaactga

SEQ ID NO: 26234 - DNA, 20 bp, Artificial Sequence
  chemically synthesized
caacaaaactgatagaccgc

SEQ ID NO: 26235 - DNA, 20 bp, Artificial Sequence
  chemically synthesized
aaaactgatagaccgctagc

SEQ ID NO: 26236 - DNA, 20 bp, Artificial Sequence
  chemically synthesized
agaccgctagcaagactaat

SEQ ID NO: 26237 - DNA, 20 bp, Artificial Sequence
  chemically synthesized
gctagcaagactaataagaa

SEQ ID NO: 26238 - DNA, 20 bp, Artificial Sequence
  chemically synthesized
tagcaagactaataagaaaa

SEQ ID NO: 26239 - DNA, 20 bp, Artificial Sequence
  chemically synthesized
gcaagactaataagaaaaga

SEQ ID NO: 26240 - DNA, 20 bp, Artificial Sequence
  chemically synthesized
agactaataagaaaagagag

SEQ ID NO: 26241 - DNA, 20 bp, Artificial Sequence
  chemically synthesized
gaaaagagagaagaatcaaa

SEQ ID NO: 26242 - DNA, 20 bp, Artificial Sequence
  chemically synthesized
gacacaataaaaaaatgata

SEQ ID NO: 26243 - DNA, 20 bp, Artificial Sequence
  chemically synthesized
acacaataaaaaaatgataa

SEQ ID NO: 26244 - DNA, 20 bp, Artificial Sequence
  chemically synthesized
cacaataaaaaaatgataaa

SEQ ID NO: 26245 - DNA, 20 bp, Artificial Sequence
  chemically synthesized
acaataaaaaaatgataaag

SEQ ID NO: 26246 - DNA, 20 bp, Artificial Sequence
  chemically synthesized
ggatatcaccaccgatccca

SEQ ID NO: 26247 - DNA, 20 bp, Artificial Sequence
  chemically synthesized
acagaaatacaaactgccat

SEQ ID NO: 26248 - DNA, 20 bp, Artificial Sequence
  chemically synthesized
agaaatacaaactgccatca

SEQ ID NO: 26249 - DNA, 20 bp, Artificial Sequence
  chemically synthesized
acacctctacgcaaataaac

SEQ ID NO: 26250 - DNA, 20 bp, Artificial Sequence
  chemically synthesized
cgcaaataaactagaaaatc

SEQ ID NO: 26251 - DNA, 20 bp, Artificial Sequence
  chemically synthesized
aaataaactagaaaatctag

SEQ ID NO: 26252 - DNA, 20 bp, Artificial Sequence
  chemically synthesized
actagaaaatctagaagaaa

SEQ ID NO: 26253 - DNA, 20 bp, Artificial Sequence
  chemically synthesized
agaagaaatggataaattcc

SEQ ID NO: 26254 - DNA, 20 bp, Artificial Sequence
  chemically synthesized
ctggacacatacactatccc

SEQ ID NO: 26255 - DNA, 20 bp, Artificial Sequence
  chemically synthesized
acactatcccaagactaaac

SEQ ID NO: 26256 - DNA, 20 bp, Artificial Sequence
  chemically synthesized
cactatcccaagactaaacc

SEQ ID NO: 26257 - DNA, 20 bp, Artificial Sequence
  chemically synthesized
tatcccaagactaaaccagg

SEQ ID NO: 26258 - DNA, 20 bp, Artificial Sequence
  chemically synthesized
cccaagactaaaccaggaag

SEQ ID NO: 26259 - DNA, 20 bp, Artificial Sequence
  chemically synthesized
gaagaagttgaatctctgaa

SEQ ID NO: 26260 - DNA, 20 bp, Artificial Sequence
  chemically synthesized
atctctgaatagaccaataa

SEQ ID NO: 26261 - DNA, 20 bp, Artificial Sequence
  chemically synthesized
tctctgaatagaccaataac

SEQ ID NO: 26262 - DNA, 20 bp, Artificial Sequence
  chemically synthesized
aataacaggatctgaaattg

SEQ ID NO: 26263 - DNA, 20 bp, Artificial Sequence
  chemically synthesized
gaaattgtggcaataatcaa

SEQ ID NO: 26264 - DNA, 20 bp, Artificial Sequence
  chemically synthesized
tcaatagcttaccaaccaaa

SEQ ID NO: 26265 - DNA, 20 bp, Artificial Sequence
  chemically synthesized
aatagcttaccaaccaaaaa

SEQ ID NO: 26266 - DNA, 20 bp, Artificial Sequence
  chemically synthesized
cttaccaaccaaaaagagtc

SEQ ID NO: 26267 - DNA, 20 bp, Artificial Sequence
  chemically synthesized
ttaccaaccaaaaagagtcc

SEQ ID NO: 26268 - DNA, 20 bp, Artificial Sequence
  chemically synthesized
aaccaaaaagagtccaggac

SEQ ID NO: 26269 - DNA, 20 bp, Artificial Sequence
  chemically synthesized
aaaaagagtccaggaccaga

SEQ ID NO: 26270 - DNA, 20 bp, Artificial Sequence
  chemically synthesized
tccaggaccagatggattca

SEQ ID NO: 26271 - DNA, 20 bp, Artificial Sequence
  chemically synthesized
gattcacagccaaattctaa

SEQ ID NO: 26272 - DNA, 20 bp, Artificial Sequence
  chemically synthesized
ttcacagccaaattctaaca

SEQ ID NO: 26273 - DNA, 20 bp, Artificial Sequence
  chemically synthesized
tcacagccaaattctaacag

SEQ ID NO: 26274 - DNA, 20 bp, Artificial Sequence
  chemically synthesized
ccaaattctaacagaggtac

SEQ ID NO: 26275 - DNA, 20 bp, Artificial Sequence
  chemically synthesized
caaattctaacagaggtaca

SEQ ID NO: 26276 - DNA, 20 bp, Artificial Sequence
  chemically synthesized
aattctaacagaggtacaag

SEQ ID NO: 26277 - DNA, 20 bp, Artificial Sequence
  chemically synthesized
attctaacagaggtacaagg

SEQ ID NO: 26278 - DNA, 20 bp, Artificial Sequence
  chemically synthesized
acagaggtacaaggaggaat

SEQ ID NO: 26279 - DNA, 20 bp, Artificial Sequence
  chemically synthesized
tctgaaactattccaatcaa

SEQ ID NO: 26280 - DNA, 20 bp, Artificial Sequence
  chemically synthesized
actattccaatcaacagaaa

SEQ ID NO: 26281 - DNA, 20 bp, Artificial Sequence
  chemically synthesized
attccaatcaacagaaaaag

SEQ ID NO: 26282 - DNA, 20 bp, Artificial Sequence
  chemically synthesized
ttccaatcaacagaaaaaga

SEQ ID NO: 26283 - DNA, 20 bp, Artificial Sequence
  chemically synthesized
tcctccctaactcattttat

SEQ ID NO: 26284 - DNA, 20 bp, Artificial Sequence
  chemically synthesized
cctccctaactcattttatg

SEQ ID NO: 26285 - DNA, 20 bp, Artificial Sequence
  chemically synthesized
cctaactcattttatgaggc

SEQ ID NO: 26286 - DNA, 20 bp, Artificial Sequence
  chemically synthesized
ccagcatcatcctaatacca

SEQ ID NO: 26287 - DNA, 20 bp, Artificial Sequence
  chemically synthesized
catcatcctaataccaaagc

SEQ ID NO: 26288 - DNA, 20 bp, Artificial Sequence
  chemically synthesized
atcctaataccaaagccaga

SEQ ID NO: 26289 - DNA, 20 bp, Artificial Sequence
  chemically synthesized
cctaataccaaagccagaaa

SEQ ID NO: 26290 - DNA, 20 bp, Artificial Sequence
  chemically synthesized
agaaagagacacaaccaaaa

SEQ ID NO: 26291 - DNA, 20 bp, Artificial Sequence
  chemically synthesized
aaagagacacaaccaaaaaa

SEQ ID NO: 26292 - DNA, 20 bp, Artificial Sequence
  chemically synthesized
acaaccaaaaaagagaattt

SEQ ID NO: 26293 - DNA, 20 bp, Artificial Sequence
  chemically synthesized
aaaaatcctcaataaaatac

SEQ ID NO: 26294 - DNA, 20 bp, Artificial Sequence
  chemically synthesized
aaatactggcaaaccgaatc

SEQ ID NO: 26295 - DNA, 20 bp, Artificial Sequence
  chemically synthesized
tactggcaaaccgaatccag

SEQ ID NO: 26296 - DNA, 20 bp, Artificial Sequence
  chemically synthesized
gaatccagcagcacatcaaa

SEQ ID NO: 26297 - DNA, 20 bp, Artificial Sequence
  chemically synthesized
aaagcttatccacgatgatc

SEQ ID NO: 26298 - DNA, 20 bp, Artificial Sequence
  chemically synthesized
gcttatccacgatgatcaag

SEQ ID NO: 26299 - DNA, 20 bp, Artificial Sequence
  chemically synthesized
gatcaagtggacttcatccc

SEQ ID NO: 26300 - DNA, 20 bp, Artificial Sequence
  chemically synthesized
atcaagtggacttcatccct

SEQ ID NO: 26301 - DNA, 20 bp, Artificial Sequence
  chemically synthesized
ggacttcatccctgggatgc

SEQ ID NO: 26302 - DNA, 20 bp, Artificial Sequence
  chemically synthesized
gacttcatccctgggatgca

SEQ ID NO: 26303 - DNA, 20 bp, Artificial Sequence
  chemically synthesized
tcatccctgggatgcaaggc

SEQ ID NO: 26304 - DNA, 20 bp, Artificial Sequence
  chemically synthesized
gcaaatcaataaatgtaatc

SEQ ID NO: 26305 - DNA, 20 bp, Artificial Sequence
  chemically synthesized
aatgtaatccagcatataaa

SEQ ID NO: 26306 - DNA, 20 bp, Artificial Sequence
  chemically synthesized
ccagcatataaacagaacca

SEQ ID NO: 26307 - DNA, 20 bp, Artificial Sequence
  chemically synthesized
aaaccacatgattatctcaa

SEQ ID NO: 26308 - DNA, 20 bp, Artificial Sequence
  chemically synthesized
catgattatctcaatagatg

SEQ ID NO: 26309 - DNA, 20 bp, Artificial Sequence
  chemically synthesized
ttatctcaatagatgcagaa

SEQ ID NO: 26310 - DNA, 20 bp, Artificial Sequence
  chemically synthesized
tatctcaatagatgcagaaa

SEQ ID NO: 26311 - DNA, 20 bp, Artificial Sequence
  chemically synthesized
gctaaaaactttcaataaat

SEQ ID NO: 26312 - DNA, 20 bp, Artificial Sequence
  chemically synthesized
ctaaaaactttcaataaatt

SEQ ID NO: 26313 - DNA, 20 bp, Artificial Sequence
  chemically synthesized
ttcaataaattaggtattga

SEQ ID NO: 26314 - DNA, 20 bp, Artificial Sequence
  chemically synthesized
tcaataaattaggtattgat

SEQ ID NO: 26315 - DNA, 20 bp, Artificial Sequence
  chemically synthesized
gggacatatctcaaaataat

SEQ ID NO: 26316 - DNA, 20 bp, Artificial Sequence
  chemically synthesized
gacatatctcaaaataataa

SEQ ID NO: 26317 - DNA, 20 bp, Artificial Sequence
  chemically synthesized
agctatctatgacaaaccca

SEQ ID NO: 26318 - DNA, 20 bp, Artificial Sequence
  chemically synthesized
acagccaatatcatactgaa

SEQ ID NO: 26319 - DNA, 20 bp, Artificial Sequence
  chemically synthesized
cagccaatatcatactgaat

SEQ ID NO: 26320 - DNA, 20 bp, Artificial Sequence
  chemically synthesized
catactgaatgggcaaaaac

SEQ ID NO: 26321 - DNA, 20 bp, Artificial Sequence
  chemically synthesized
actgaatgggcaaaaactgg

SEQ ID NO: 26322 - DNA, 20 bp, Artificial Sequence
  chemically synthesized
gaagcattccctttgtaaac

SEQ ID NO: 26323 - DNA, 20 bp, Artificial Sequence
  chemically synthesized
ttccctttgtaaactggcac

SEQ ID NO: 26324 - DNA, 20 bp, Artificial Sequence
  chemically synthesized
ctttgtaaactggcacaaga

SEQ ID NO: 26325 - DNA, 20 bp, Artificial Sequence
  chemically synthesized
tttgtaaactggcacaagac

SEQ ID NO: 26326 - DNA, 20 bp, Artificial Sequence
  chemically synthesized
ttgtaaactggcacaagaca

SEQ ID NO: 26327 - DNA, 20 bp, Artificial Sequence
  chemically synthesized
ctcactactcctattcaaca

SEQ ID NO: 26328 - DNA, 20 bp, Artificial Sequence
  chemically synthesized
actcctattcaacatagtgt

SEQ ID NO: 26329 - DNA, 20 bp, Artificial Sequence
  chemically synthesized
cctattcaacatagtgttgg

SEQ ID NO: 26330 - DNA, 20 bp, Artificial Sequence
  chemically synthesized
caacatagtgttggaagttc

SEQ ID NO: 26331 - DNA, 20 bp, Artificial Sequence
  chemically synthesized
atagtgttggaagttctggc

SEQ ID NO: 26332 - DNA, 20 bp, Artificial Sequence
  chemically synthesized
tagtgttggaagttctggcc

SEQ ID NO: 26333 - DNA, 20 bp, Artificial Sequence
  chemically synthesized
agtgttggaagttctggcca

SEQ ID NO: 26334 - DNA, 20 bp, Artificial Sequence
  chemically synthesized
gaagttctggccagggcaat

SEQ ID NO: 26335 - DNA, 20 bp, Artificial Sequence
  chemically synthesized
aagttctggccagggcaatt

SEQ ID NO: 26336 - DNA, 20 bp, Artificial Sequence
  chemically synthesized
ttctggccagggcaattagg

SEQ ID NO: 26337 - DNA, 20 bp, Artificial Sequence
  chemically synthesized
tggccagggcaattaggcag

SEQ ID NO: 26338 - DNA, 20 bp, Artificial Sequence
  chemically synthesized
cagggcaattaggcagaaga

SEQ ID NO: 26339 - DNA, 20 bp, Artificial Sequence
  chemically synthesized
agggcaattaggcagaagac

SEQ ID NO: 26340 - DNA, 20 bp, Artificial Sequence
  chemically synthesized
ttaggcagaagacaggaaaa

SEQ ID NO: 26341 - DNA, 20 bp, Artificial Sequence
  chemically synthesized
taggcagaagacaggaaaaa

SEQ ID NO: 26342 - DNA, 20 bp, Artificial Sequence
  chemically synthesized
aggcagaagacaggaaaaaa

SEQ ID NO: 26343 - DNA, 20 bp, Artificial Sequence
  chemically synthesized
ggaaaaaagggtattcaatt

SEQ ID NO: 26344 - DNA, 20 bp, Artificial Sequence
  chemically synthesized
aaagggtattcaattaagaa

SEQ ID NO: 26345 - DNA, 20 bp, Artificial Sequence
  chemically synthesized
agggtattcaattaagaaaa

SEQ ID NO: 26346 - DNA, 20 bp, Artificial Sequence
  chemically synthesized
gggtattcaattaagaaaag

SEQ ID NO: 26347 - DNA, 20 bp, Artificial Sequence
  chemically synthesized
tattcaattaagaaaagagg

SEQ ID NO: 26348 - DNA, 20 bp, Artificial Sequence
  chemically synthesized
agtcaaattgtccctgtttg

SEQ ID NO: 26349 - DNA, 20 bp, Artificial Sequence
  chemically synthesized
agacgacatgattgtatatc

SEQ ID NO: 26350 - DNA, 20 bp, Artificial Sequence
  chemically synthesized
tctagaaaacccccttgtct

SEQ ID NO: 26351 - DNA, 20 bp, Artificial Sequence
  chemically synthesized
tctcagcccaaaatctcctt

SEQ ID NO: 26352 - DNA, 20 bp, Artificial Sequence
  chemically synthesized
caaaatctccttaagctgat

SEQ ID NO: 26353 - DNA, 20 bp, Artificial Sequence
  chemically synthesized
cttaagctgataagcaactt

SEQ ID NO: 26354 - DNA, 20 bp, Artificial Sequence
  chemically synthesized
gctgataagcaacttcagca

SEQ ID NO: 26355 - DNA, 20 bp, Artificial Sequence
  chemically synthesized
aagcaacttcagcaaagcct

SEQ ID NO: 26356 - DNA, 20 bp, Artificial Sequence
  chemically synthesized
agcaacttcagcaaagcctc

SEQ ID NO: 26357 - DNA, 20 bp, Artificial Sequence
  chemically synthesized
aaccaatgtgcaaaaatcac

SEQ ID NO: 26358 - DNA, 20 bp, Artificial Sequence
  chemically synthesized
gcattcttatacaccaataa

SEQ ID NO: 26359 - DNA, 20 bp, Artificial Sequence
  chemically synthesized
atacaccaataacagacaaa

SEQ ID NO: 26360 - DNA, 20 bp, Artificial Sequence
  chemically synthesized
acaccaataacagacaaaca

SEQ ID NO: 26361 - DNA, 20 bp, Artificial Sequence
  chemically synthesized
accaataacagacaaacaga

SEQ ID NO: 26362 - DNA, 20 bp, Artificial Sequence
  chemically synthesized
caaacagagagccaaatcat

SEQ ID NO: 26363 - DNA, 20 bp, Artificial Sequence
  chemically synthesized
aaacagagagccaaatcatg

SEQ ID NO: 26364 - DNA, 20 bp, Artificial Sequence
  chemically synthesized
aacagagagccaaatcatga

SEQ ID NO: 26365 - DNA, 20 bp, Artificial Sequence
  chemically synthesized
tcccattcacaattgcttca

SEQ ID NO: 26366 - DNA, 20 bp, Artificial Sequence
  chemically synthesized
ccattcacaattgcttcaaa

SEQ ID NO: 26367 - DNA, 20 bp, Artificial Sequence
  chemically synthesized
ttcaaagagaataaaatacc

SEQ ID NO: 26368 - DNA, 20 bp, Artificial Sequence
  chemically synthesized
tcaaagagaataaaatacct

SEQ ID NO: 26369 - DNA, 20 bp, Artificial Sequence
  chemically synthesized
tacctaggaatccaacttac

SEQ ID NO: 26370 - DNA, 20 bp, Artificial Sequence
  chemically synthesized
acctaggaatccaacttaca

SEQ ID NO: 26371 - DNA, 20 bp, Artificial Sequence
  chemically synthesized
cctaggaatccaacttacaa

SEQ ID NO: 26372 - DNA, 20 bp, Artificial Sequence
  chemically synthesized
tccaacttacaagggatgtg

SEQ ID NO: 26373 - DNA, 20 bp, Artificial Sequence
  chemically synthesized
ccaacttacaagggatgtga

SEQ ID NO: 26374 - DNA, 20 bp, Artificial Sequence
  chemically synthesized
gggatgtgaaggacctcttc

SEQ ID NO: 26375 - DNA, 20 bp, Artificial Sequence
  chemically synthesized
ggatgtgaaggacctcttca

SEQ ID NO: 26376 - DNA, 20 bp, Artificial Sequence
  chemically synthesized
atgtgaaggacctcttcaag

SEQ ID NO: 26377 - DNA, 20 bp, Artificial Sequence
  chemically synthesized
accactgctcaatgaaataa

SEQ ID NO: 26378 - DNA, 20 bp, Artificial Sequence
  chemically synthesized
actgctcaatgaaataaaag

SEQ ID NO: 26379 - DNA, 20 bp, Artificial Sequence
  chemically synthesized
taaaagaagatacaaacaaa

SEQ ID NO: 26380 - DNA, 20 bp, Artificial Sequence
  chemically synthesized
aagaagatacaaacaaatgg

SEQ ID NO: 26381 - DNA, 20 bp, Artificial Sequence
  chemically synthesized
ggaagaacattccatgctta

SEQ ID NO: 26382 - DNA, 20 bp, Artificial Sequence
  chemically synthesized
gaagaacattccatgcttat

SEQ ID NO: 26383 - DNA, 20 bp, Artificial Sequence
  chemically synthesized
gaacattccatgcttatggg

SEQ ID NO: 26384 - DNA, 20 bp, Artificial Sequence
  chemically synthesized
aacattccatgcttatgggt

SEQ ID NO: 26385 - DNA, 20 bp, Artificial Sequence
  chemically synthesized
attccatgcttatgggtagg

SEQ ID NO: 26386 - DNA, 20 bp, Artificial Sequence
  chemically synthesized
aagaatcaatatcatcaaaa

SEQ ID NO: 26387 - DNA, 20 bp, Artificial Sequence
  chemically synthesized
tcaaaatggccataatgccc

SEQ ID NO: 26388 - DNA, 20 bp, Artificial Sequence
  chemically synthesized
caaaatggccataatgccca

SEQ ID NO: 26389 - DNA, 20 bp, Artificial Sequence
  chemically synthesized
ataatgcccaaggtaattta

SEQ ID NO: 26390 - DNA, 20 bp, Artificial Sequence
  chemically synthesized
gattcaatgccatccccatc

SEQ ID NO: 26391 - DNA, 20 bp, Artificial Sequence
  chemically synthesized
gctaccaatgattttcttca

SEQ ID NO: 26392 - DNA, 20 bp, Artificial Sequence
  chemically synthesized
aatgattttcttcacagaat

SEQ ID NO: 26393 - DNA, 20 bp, Artificial Sequence
  chemically synthesized
gaattggaaaaacgacttta

SEQ ID NO: 26394 - DNA, 20 bp, Artificial Sequence
  chemically synthesized
aaacgactttaaagttcata

SEQ ID NO: 26395 - DNA, 20 bp, Artificial Sequence
  chemically synthesized
aagttcatatggaaccaaaa

SEQ ID NO: 26396 - DNA, 20 bp, Artificial Sequence
  chemically synthesized
gttcatatggaaccaaaaaa

SEQ ID NO: 26397 - DNA, 20 bp, Artificial Sequence
  chemically synthesized
aaaaaagagcctgcattgcc

SEQ ID NO: 26398 - DNA, 20 bp, Artificial Sequence
  chemically synthesized
tgcattgccaagtcaatcct

SEQ ID NO: 26399 - DNA, 20 bp, Artificial Sequence
  chemically synthesized
ccaagtcaatcctaagccaa

SEQ ID NO: 26400 - DNA, 20 bp, Artificial Sequence
  chemically synthesized
aatcctaagccaaaagaaca

SEQ ID NO: 26401 - DNA, 20 bp, Artificial Sequence
  chemically synthesized
ctaagccaaaagaacaaagc

SEQ ID NO: 26402 - DNA, 20 bp, Artificial Sequence
  chemically synthesized
aagccaaaagaacaaagctg

SEQ ID NO: 26403 - DNA, 20 bp, Artificial Sequence
  chemically synthesized
agccaaaagaacaaagctgg

SEQ ID NO: 26404 - DNA, 20 bp, Artificial Sequence
  chemically synthesized
aagaacaaagctggaggcat

SEQ ID NO: 26405 - DNA, 20 bp, Artificial Sequence
  chemically synthesized
agaacaaagctggaggcatc

SEQ ID NO: 26406 - DNA, 20 bp, Artificial Sequence
  chemically synthesized
ctcacttcaaactatactac

SEQ ID NO: 26407 - DNA, 20 bp, Artificial Sequence
  chemically synthesized
tcacttcaaactatactaca

SEQ ID NO: 26408 - DNA, 20 bp, Artificial Sequence
  chemically synthesized
caaactatactacaaggcta

SEQ ID NO: 26409 - DNA, 20 bp, Artificial Sequence
  chemically synthesized
caaggctacagtaaccaaaa

SEQ ID NO: 26410 - DNA, 20 bp, Artificial Sequence
  chemically synthesized
taaccaaaacagcatgttac

SEQ ID NO: 26411 - DNA, 20 bp, Artificial Sequence
  chemically synthesized
atgttactggtaccaaaaca

SEQ ID NO: 26412 - DNA, 20 bp, Artificial Sequence
  chemically synthesized
ctggtaccaaaacacagata

SEQ ID NO: 26413 - DNA, 20 bp, Artificial Sequence
  chemically synthesized
aaaacacagatatagatcaa

SEQ ID NO: 26414 - DNA, 20 bp, Artificial Sequence
  chemically synthesized
acagatatagatcaatggaa

SEQ ID NO: 26415 - DNA, 20 bp, Artificial Sequence
  chemically synthesized
tatagatcaatggaacagaa

SEQ ID NO: 26416 - DNA, 20 bp, Artificial Sequence
  chemically synthesized
tagatcaatggaacagaaca

SEQ ID NO: 26417 - DNA, 20 bp, Artificial Sequence
  chemically synthesized
atggaacagaacagagccct

SEQ ID NO: 26418 - DNA, 20 bp, Artificial Sequence
  chemically synthesized
atctgatctttgaaaaacct

SEQ ID NO: 26419 - DNA, 20 bp, Artificial Sequence
  chemically synthesized
ttgaaaaacctgagaaaaac

SEQ ID NO: 26420 - DNA, 20 bp, Artificial Sequence
  chemically synthesized
aacctgagaaaaacaagaaa

SEQ ID NO: 26421 - DNA, 20 bp, Artificial Sequence
  chemically synthesized
acctgagaaaaacaagaaat

SEQ ID NO: 26422 - DNA, 20 bp, Artificial Sequence
  chemically synthesized
cctgagaaaaacaagaaatg

SEQ ID NO: 26423 - DNA, 20 bp, Artificial Sequence
  chemically synthesized
agaaaaacaagaaatgggga

SEQ ID NO: 26424 - DNA, 20 bp, Artificial Sequence
  chemically synthesized
gaaaaacaagaaatggggaa

SEQ ID NO: 26425 - DNA, 20 bp, Artificial Sequence
  chemically synthesized
aggattccctatttaataaa

SEQ ID NO: 26426 - DNA, 20 bp, Artificial Sequence
  chemically synthesized
ccctatttaataaatggtgc

SEQ ID NO: 26427 - DNA, 20 bp, Artificial Sequence
  chemically synthesized
cctatttaataaatggtgct

SEQ ID NO: 26428 - DNA, 20 bp, Artificial Sequence
  chemically synthesized
tatttaataaatggtgctgg

SEQ ID NO: 26429 - DNA, 20 bp, Artificial Sequence
  chemically synthesized
ataaatggtgctgggagaac

SEQ ID NO: 26430 - DNA, 20 bp, Artificial Sequence
  chemically synthesized
atggtgctgggagaactggc

SEQ ID NO: 26431 - DNA, 20 bp, Artificial Sequence
  chemically synthesized
gagaactggctagccatatg

SEQ ID NO: 26432 - DNA, 20 bp, Artificial Sequence
  chemically synthesized
catatgtagaatgctgaaac

SEQ ID NO: 26433 - DNA, 20 bp, Artificial Sequence
  chemically synthesized
ccttatacaaaaattaattc

SEQ ID NO: 26434 - DNA, 20 bp, Artificial Sequence
  chemically synthesized
atacaaaaattaattcaaga

SEQ ID NO: 26435 - DNA, 20 bp, Artificial Sequence
  chemically synthesized
aattaattcaagatggatta

SEQ ID NO: 26436 - DNA, 20 bp, Artificial Sequence
  chemically synthesized
tggattaaagacttaaacat

SEQ ID NO: 26437 - DNA, 20 bp, Artificial Sequence
  chemically synthesized
acctaaaaccataaaaaccc

SEQ ID NO: 26438 - DNA, 20 bp, Artificial Sequence
  chemically synthesized
taaaaccataaaaaccctag

SEQ ID NO: 26439 - DNA, 20 bp, Artificial Sequence
  chemically synthesized
aaaaaccctagaagaaaacg

SEQ ID NO: 26440 - DNA, 20 bp, Artificial Sequence
  chemically synthesized
aaaaccctagaagaaaacgc

SEQ ID NO: 26441 - DNA, 20 bp, Artificial Sequence
  chemically synthesized
aaaacgcaggcattaccatt

SEQ ID NO: 26442 - DNA, 20 bp, Artificial Sequence
  chemically synthesized
aaacgcaggcattaccattc

SEQ ID NO: 26443 - DNA, 20 bp, Artificial Sequence
  chemically synthesized
aggcattaccattcaggaca

SEQ ID NO: 26444 - DNA, 20 bp, Artificial Sequence
  chemically synthesized
ggcattaccattcaggacat

SEQ ID NO: 26445 - DNA, 20 bp, Artificial Sequence
  chemically synthesized
taccattcaggacataggca

SEQ ID NO: 26446 - DNA, 20 bp, Artificial Sequence
  chemically synthesized
accattcaggacataggcat

SEQ ID NO: 26447 - DNA, 20 bp, Artificial Sequence
  chemically synthesized
ttcaggacataggcatgggc

SEQ ID NO: 26448 - DNA, 20 bp, Artificial Sequence
  chemically synthesized
tcaggacataggcatgggca

SEQ ID NO: 26449 - DNA, 20 bp, Artificial Sequence
  chemically synthesized
cttcatgtctaaaacaccaa

SEQ ID NO: 26450 - DNA, 20 bp, Artificial Sequence
  chemically synthesized
gtctaaaacaccaaaagcga

SEQ ID NO: 26451 - DNA, 20 bp, Artificial Sequence
  chemically synthesized
accaaaagcgatggcaacaa

SEQ ID NO: 26452 - DNA, 20 bp, Artificial Sequence
  chemically synthesized
caaaagccaaaattcactaa

SEQ ID NO: 26453 - DNA, 20 bp, Artificial Sequence
  chemically synthesized
aaaagccaaaattcactaat

SEQ ID NO: 26454 - DNA, 20 bp, Artificial Sequence
  chemically synthesized
aatgggatctaatgaaacta

SEQ ID NO: 26455 - DNA, 20 bp, Artificial Sequence
  chemically synthesized
tgggatctaatgaaactaaa

SEQ ID NO: 26456 - DNA, 20 bp, Artificial Sequence
  chemically synthesized
gaaactaaagagcttctgca

SEQ ID NO: 26457 - DNA, 20 bp, Artificial Sequence
  chemically synthesized
aaagagcttctgcacagcta

SEQ ID NO: 26458 - DNA, 20 bp, Artificial Sequence
  chemically synthesized
acagctaaagaaactaccat

SEQ ID NO: 26459 - DNA, 20 bp, Artificial Sequence
  chemically synthesized
agctaaagaaactaccatca

SEQ ID NO: 26460 - DNA, 20 bp, Artificial Sequence
  chemically synthesized
gaaactaccatcagagtgaa

SEQ ID NO: 26461 - DNA, 20 bp, Artificial Sequence
  chemically synthesized
aaactaccatcagagtgaac

SEQ ID NO: 26462 - DNA, 20 bp, Artificial Sequence
  chemically synthesized
tgaacaggcaacctacacaa

SEQ ID NO: 26463 - DNA, 20 bp, Artificial Sequence
  chemically synthesized
gaacaggcaacctacacaat

SEQ ID NO: 26464 - DNA, 20 bp, Artificial Sequence
  chemically synthesized
acaggcaacctacacaatgg

SEQ ID NO: 26465 - DNA, 20 bp, Artificial Sequence
  chemically synthesized
cacaacctactcatctgaca

SEQ ID NO: 26466 - DNA, 20 bp, Artificial Sequence
  chemically synthesized
acaacctactcatctgacaa

SEQ ID NO: 26467 - DNA, 20 bp, Artificial Sequence
  chemically synthesized
caacctactcatctgacaaa

SEQ ID NO: 26468 - DNA, 20 bp, Artificial Sequence
  chemically synthesized
tctgacaaagggctaatatc

SEQ ID NO: 26469 - DNA, 20 bp, Artificial Sequence
  chemically synthesized
atgaactcaaacaaatttac

SEQ ID NO: 26470 - DNA, 20 bp, Artificial Sequence
  chemically synthesized
atttacaagaaaaaaacaaa

SEQ ID NO: 26471 - DNA, 20 bp, Artificial Sequence
  chemically synthesized
aaacaaacagccccatcaac

SEQ ID NO: 26472 - DNA, 20 bp, Artificial Sequence
  chemically synthesized
caaacagccccatcaacaag

SEQ ID NO: 26473 - DNA, 20 bp, Artificial Sequence
  chemically synthesized
aaacagccccatcaacaagt

SEQ ID NO: 26474 - DNA, 20 bp, Artificial Sequence
  chemically synthesized
gccccatcaacaagtgggca

SEQ ID NO: 26475 - DNA, 20 bp, Artificial Sequence
  chemically synthesized
ccccatcaacaagtgggcaa

SEQ ID NO: 26476 - DNA, 20 bp, Artificial Sequence
  chemically synthesized
aagtgggcaaaggatatgaa

SEQ ID NO: 26477 - DNA, 20 bp, Artificial Sequence
  chemically synthesized
tatgaacagacacttctcaa

SEQ ID NO: 26478 - DNA, 20 bp, Artificial Sequence
  chemically synthesized
gaaaacatttatgcaaccaa

SEQ ID NO: 26479 - DNA, 20 bp, Artificial Sequence
  chemically synthesized
gaaaaaatgctcatcatcac

SEQ ID NO: 26480 - DNA, 20 bp, Artificial Sequence
  chemically synthesized
tgctcatcatcactggccat

SEQ ID NO: 26481 - DNA, 20 bp, Artificial Sequence
  chemically synthesized
ctcatcatcactggccatca

SEQ ID NO: 26482 - DNA, 20 bp, Artificial Sequence
  chemically synthesized
atgcaaatcaaaaccacaat

SEQ ID NO: 26483 - DNA, 20 bp, Artificial Sequence
  chemically synthesized
aatgagataccatctcatac

SEQ ID NO: 26484 - DNA, 20 bp, Artificial Sequence
  chemically synthesized
agataccatctcataccagt

SEQ ID NO: 26485 - DNA, 20 bp, Artificial Sequence
  chemically synthesized
ccatctcataccagttagaa

SEQ ID NO: 26486 - DNA, 20 bp, Artificial Sequence
  chemically synthesized
ttagaatggcaatcattaaa

SEQ ID NO: 26487 - DNA, 20 bp, Artificial Sequence
  chemically synthesized
aatggcaatcattaaaaagt

SEQ ID NO: 26488 - DNA, 20 bp, Artificial Sequence
  chemically synthesized
atggcaatcattaaaaagtc

SEQ ID NO: 26489 - DNA, 20 bp, Artificial Sequence
  chemically synthesized
attaaaaagtcaggaaacaa

SEQ ID NO: 26490 - DNA, 20 bp, Artificial Sequence
  chemically synthesized
ttaaaaagtcaggaaacaac

SEQ ID NO: 26491 - DNA, 20 bp, Artificial Sequence
  chemically synthesized
agtcaggaaacaacaggtgc

SEQ ID NO: 26492 - DNA, 20 bp, Artificial Sequence
  chemically synthesized
tcaggaaacaacaggtgctg

SEQ ID NO: 26493 - DNA, 20 bp, Artificial Sequence
  chemically synthesized
aggaaacaacaggtgctgga

SEQ ID NO: 26494 - DNA, 20 bp, Artificial Sequence
  chemically synthesized
ggaaacaacaggtgctggag

SEQ ID NO: 26495 - DNA, 20 bp, Artificial Sequence
  chemically synthesized
aacaggtgctggagaggatg

SEQ ID NO: 26496 - DNA, 20 bp, Artificial Sequence
  chemically synthesized
caggtgctggagaggatgtg

SEQ ID NO: 26497 - DNA, 20 bp, Artificial Sequence
  chemically synthesized
ctggagaggatgtggagaaa

SEQ ID NO: 26498 - DNA, 20 bp, Artificial Sequence
  chemically synthesized
tggagaggatgtggagaaat

SEQ ID NO: 26499 - DNA, 20 bp, Artificial Sequence
  chemically synthesized
taggaacacttttacactct

SEQ ID NO: 26500 - DNA, 20 bp, Artificial Sequence
  chemically synthesized
gaacacttttacactcttgg

SEQ ID NO: 26501 - DNA, 20 bp, Artificial Sequence
  chemically synthesized
aacacttttacactcttggt

SEQ ID NO: 26502 - DNA, 20 bp, Artificial Sequence
  chemically synthesized
ctcttggtgggactgtaaac

SEQ ID NO: 26503 - DNA, 20 bp, Artificial Sequence
  chemically synthesized
gtaaactagttcaaccattg

SEQ ID NO: 26504 - DNA, 20 bp, Artificial Sequence
  chemically synthesized
aactagttcaaccattgtgg

SEQ ID NO: 26505 - DNA, 20 bp, Artificial Sequence
  chemically synthesized
agttcaaccattgtggaagt

SEQ ID NO: 26506 - DNA, 20 bp, Artificial Sequence
  chemically synthesized
aaccattgtggaagtcagtg

SEQ ID NO: 26507 - DNA, 20 bp, Artificial Sequence
  chemically synthesized
aagtcagtgtggcgattcct

SEQ ID NO: 26508 - DNA, 20 bp, Artificial Sequence
  chemically synthesized
agtcagtgtggcgattcctc

SEQ ID NO: 26509 - DNA, 20 bp, Artificial Sequence
  chemically synthesized
gtcagtgtggcgattcctca

SEQ ID NO: 26510 - DNA, 20 bp, Artificial Sequence
  chemically synthesized
gtggcgattcctcagggatc

SEQ ID NO: 26511 - DNA, 20 bp, Artificial Sequence
  chemically synthesized
attcctcagggatctagaac

SEQ ID NO: 26512 - DNA, 20 bp, Artificial Sequence
  chemically synthesized
actagaaataccatttgacc

SEQ ID NO: 26513 - DNA, 20 bp, Artificial Sequence
  chemically synthesized
tgacccagccatcccattac

SEQ ID NO: 26514 - DNA, 20 bp, Artificial Sequence
  chemically synthesized
gacccagccatcccattact

SEQ ID NO: 26515 - DNA, 20 bp, Artificial Sequence
  chemically synthesized
cattactgggtatataccca

SEQ ID NO: 26516 - DNA, 20 bp, Artificial Sequence
  chemically synthesized
attactgggtatatacccaa

SEQ ID NO: 26517 - DNA, 20 bp, Artificial Sequence
  chemically synthesized
atataaatcatgctgctata

SEQ ID NO: 26518 - DNA, 20 bp, Artificial Sequence
  chemically synthesized
atgcacacgtatgtttattg

SEQ ID NO: 26519 - DNA, 20 bp, Artificial Sequence
  chemically synthesized
tattgcggtactattcacaa

SEQ ID NO: 26520 - DNA, 20 bp, Artificial Sequence
  chemically synthesized
cggtactattcacaatagca

SEQ ID NO: 26521 - DNA, 20 bp, Artificial Sequence
  chemically synthesized
tattcacaatagcaaagact

SEQ ID NO: 26522 - DNA, 20 bp, Artificial Sequence
  chemically synthesized
acccaaatgtccaacaatga

SEQ ID NO: 26523 - DNA, 20 bp, Artificial Sequence
  chemically synthesized
aatgtccaacaatgatagac

SEQ ID NO: 26524 - DNA, 20 bp, Artificial Sequence
  chemically synthesized
caacaatgatagactggatt

SEQ ID NO: 26525 - DNA, 20 bp, Artificial Sequence
  chemically synthesized
tagactggattaagaaaatg

SEQ ID NO: 26526 - DNA, 20 bp, Artificial Sequence
  chemically synthesized
aatgtggcacatatacacca

SEQ ID NO: 26527 - DNA, 20 bp, Artificial Sequence
  chemically synthesized
atacaccatggaatactatg

SEQ ID NO: 26528 - DNA, 20 bp, Artificial Sequence
  chemically synthesized
tatgcagccataaaaatgat

SEQ ID NO: 26529 - DNA, 20 bp, Artificial Sequence
  chemically synthesized
tgatgagttcatgtcctttg

SEQ ID NO: 26530 - DNA, 20 bp, Artificial Sequence
  chemically synthesized
gatgagttcatgtcctttgt

SEQ ID NO: 26531 - DNA, 20 bp, Artificial Sequence
  chemically synthesized
atgagttcatgtcctttgta

SEQ ID NO: 26532 - DNA, 20 bp, Artificial Sequence
  chemically synthesized
tcatgtcctttgtagggaca

SEQ ID NO: 26533 - DNA, 20 bp, Artificial Sequence
  chemically synthesized
tgtagggacatggatgaaat

SEQ ID NO: 26534 - DNA, 20 bp, Artificial Sequence
  chemically synthesized
aaattggaaatcatcattct

SEQ ID NO: 26535 - DNA, 20 bp, Artificial Sequence
  chemically synthesized
cattctcagtaaactatcgc

SEQ ID NO: 26536 - DNA, 20 bp, Artificial Sequence
  chemically synthesized
attctcagtaaactatcgca

SEQ ID NO: 26537 - DNA, 20 bp, Artificial Sequence
  chemically synthesized
acaccacatattctcactca

SEQ ID NO: 26538 - DNA, 20 bp, Artificial Sequence
  chemically synthesized
cacatattctcactcataga

SEQ ID NO: 26539 - DNA, 20 bp, Artificial Sequence
  chemically synthesized
acatattctcactcatagat

SEQ ID NO: 26540 - DNA, 20 bp, Artificial Sequence
  chemically synthesized
atagatgggaactgaacaat

SEQ ID NO: 26541 - DNA, 20 bp, Artificial Sequence
  chemically synthesized
aactgaacaatgagaacaca

SEQ ID NO: 26542 - DNA, 20 bp, Artificial Sequence
  chemically synthesized
acaatgagaacacatggaca

SEQ ID NO: 26543 - DNA, 20 bp, Artificial Sequence
  chemically synthesized
caatgagaacacatggacac

SEQ ID NO: 26544 - DNA, 20 bp, Artificial Sequence
  chemically synthesized
tgagaacacatggacacagg

SEQ ID NO: 26545 - DNA, 20 bp, Artificial Sequence
  chemically synthesized
gagaacacatggacacagga

SEQ ID NO: 26546 - DNA, 20 bp, Artificial Sequence
  chemically synthesized
agaacacatggacacaggaa

SEQ ID NO: 26547 - DNA, 20 bp, Artificial Sequence
  chemically synthesized
gaacacatggacacaggaag

SEQ ID NO: 26548 - DNA, 20 bp, Artificial Sequence
  chemically synthesized
ggaaggggaacatcacactc

SEQ ID NO: 26549 - DNA, 20 bp, Artificial Sequence
  chemically synthesized
gaaggggaacatcacactct

SEQ ID NO: 26550 - DNA, 20 bp, Artificial Sequence
  chemically synthesized
aaggggaacatcacactctg

SEQ ID NO: 26551 - DNA, 20 bp, Artificial Sequence
  chemically synthesized
tcacactctggggactgttg

SEQ ID NO: 26552 - DNA, 20 bp, Artificial Sequence
  chemically synthesized
cacactctggggactgttgt

SEQ ID NO: 26553 - DNA, 20 bp, Artificial Sequence
  chemically synthesized
acactctggggactgttgtg

SEQ ID NO: 26554 - DNA, 20 bp, Artificial Sequence
  chemically synthesized
ctctggggactgttgtgggg

SEQ ID NO: 26555 - DNA, 20 bp, Artificial Sequence
  chemically synthesized
tctggggactgttgtggggt

SEQ ID NO: 26556 - DNA, 20 bp, Artificial Sequence
  chemically synthesized
ctggggactgttgtggggtg

SEQ ID NO: 26557 - DNA, 20 bp, Artificial Sequence
  chemically synthesized
tggggactgttgtggggtgg

SEQ ID NO: 26558 - DNA, 20 bp, Artificial Sequence
  chemically synthesized
actgttgtggggtgggggtg

SEQ ID NO: 26559 - DNA, 20 bp, Artificial Sequence
  chemically synthesized
ctgttgtggggtgggggtgc

SEQ ID NO: 26560 - DNA, 20 bp, Artificial Sequence
  chemically synthesized
tgttgtggggtgggggtgca

SEQ ID NO: 26561 - DNA, 20 bp, Artificial Sequence
  chemically synthesized
ttgtggggtgggggtgcagg

SEQ ID NO: 26562 - DNA, 20 bp, Artificial Sequence
  chemically synthesized
tgtggggtgggggtgcaggg

SEQ ID NO: 26563 - DNA, 20 bp, Artificial Sequence
  chemically synthesized
gtggggtgggggtgcaggga

SEQ ID NO: 26564 - DNA, 20 bp, Artificial Sequence
  chemically synthesized
ggtgggggtgcagggaggga

SEQ ID NO: 26565 - DNA, 20 bp, Artificial Sequence
  chemically synthesized
ggtgcagggagggatggcat

SEQ ID NO: 26566 - DNA, 20 bp, Artificial Sequence
  chemically synthesized
gtgcagggagggatggcatt

SEQ ID NO: 26567 - DNA, 20 bp, Artificial Sequence
  chemically synthesized
gcagggagggatggcattag

SEQ ID NO: 26568 - DNA, 20 bp, Artificial Sequence
  chemically synthesized
tatacctaatgctaaattac

SEQ ID NO: 26569 - DNA, 20 bp, Artificial Sequence
  chemically synthesized
aatgctaaattacgagttaa

SEQ ID NO: 26570 - DNA, 20 bp, Artificial Sequence
  chemically synthesized
atgctaaattacgagttaat

SEQ ID NO: 26571 - DNA, 20 bp, Artificial Sequence
  chemically synthesized
aaattacgagttaatgggtg

SEQ ID NO: 26572 - DNA, 20 bp, Artificial Sequence
  chemically synthesized
atgggtgcagcacaccaaca

SEQ ID NO: 26573 - DNA, 20 bp, Artificial Sequence
  chemically synthesized
tgtatacatatgtaactaac

SEQ ID NO: 26574 - DNA, 20 bp, Artificial Sequence
  chemically synthesized
cacatgtaccctaaatctta

SEQ ID NO: 26575 - DNA, 20 bp, Artificial Sequence
  chemically synthesized
aaataaaaaaataaaaaata

SEQ ID NO: 26576 - DNA, 20 bp, Artificial Sequence
  chemically synthesized
aaaaataaaaaataaagttc

SEQ ID NO: 26577 - DNA, 20 bp, Artificial Sequence
  chemically synthesized
aaagttccagtttatttttt

SEQ ID NO: 26578 - DNA, 20 bp, Artificial Sequence
  chemically synthesized
aagttccagtttattttttc

SEQ ID NO: 26579 - DNA, 20 bp, Artificial Sequence
  chemically synthesized
ctttttctatgtctgctttt

SEQ ID NO: 26580 - DNA, 20 bp, Artificial Sequence
  chemically synthesized
tctatgtctgcttttaagat

SEQ ID NO: 26581 - DNA, 20 bp, Artificial Sequence
  chemically synthesized
ttgttgtttatgccatttgt

SEQ ID NO: 26582 - DNA, 20 bp, Artificial Sequence
  chemically synthesized
ccatttgtaagatatgcatt

SEQ ID NO: 26583 - DNA, 20 bp, Artificial Sequence
  chemically synthesized
ttttttaattgacattgctc

SEQ ID NO: 26584 - DNA, 20 bp, Artificial Sequence
  chemically synthesized
tttttaattgacattgctca

SEQ ID NO: 26585 - DNA, 20 bp, Artificial Sequence
  chemically synthesized
taattgacattgctcaaggt

SEQ ID NO: 26586 - DNA, 20 bp, Artificial Sequence
  chemically synthesized
acattgctcaaggttagcta

SEQ ID NO: 26587 - DNA, 20 bp, Artificial Sequence
  chemically synthesized
tagctaaagatatgaattaa

SEQ ID NO: 26588 - DNA, 20 bp, Artificial Sequence
  chemically synthesized
gaattaatagattttatgtc

SEQ ID NO: 26589 - DNA, 20 bp, Artificial Sequence
  chemically synthesized
tgtccagatgttgaaacatt

SEQ ID NO: 26590 - DNA, 20 bp, Artificial Sequence
  chemically synthesized
atccattttttgtttccttt

SEQ ID NO: 26591 - DNA, 20 bp, Artificial Sequence
  chemically synthesized
tagaattctaatttcacata

SEQ ID NO: 26592 - DNA, 20 bp, Artificial Sequence
  chemically synthesized
aattctaatttcacatatgg

SEQ ID NO: 26593 - DNA, 20 bp, Artificial Sequence
  chemically synthesized
ctaatttcacatatggtgga

SEQ ID NO: 26594 - DNA, 20 bp, Artificial Sequence
  chemically synthesized
acagcttgatactttcccat

SEQ ID NO: 26595 - DNA, 20 bp, Artificial Sequence
  chemically synthesized
ttgatactttcccatgagtc

SEQ ID NO: 26596 - DNA, 20 bp, Artificial Sequence
  chemically synthesized
ttcccatgagtctggctttc

SEQ ID NO: 26597 - DNA, 20 bp, Artificial Sequence
  chemically synthesized
tcccatgagtctggctttct

SEQ ID NO: 26598 - DNA, 20 bp, Artificial Sequence
  chemically synthesized
gctttctgggtttctctccc

SEQ ID NO: 26599 - DNA, 20 bp, Artificial Sequence
  chemically synthesized
tgtctgctttctgccatgtt

SEQ ID NO: 26600 - DNA, 20 bp, Artificial Sequence
  chemically synthesized
ctttctgccatgtttggaac

SEQ ID NO: 26601 - DNA, 20 bp, Artificial Sequence
  chemically synthesized
gccatgtttggaaccagcat

SEQ ID NO: 26602 - DNA, 20 bp, Artificial Sequence
  chemically synthesized
aaccagcatgagacctttat

SEQ ID NO: 26603 - DNA, 20 bp, Artificial Sequence
  chemically synthesized
cagatgcaaccgcccgatct

SEQ ID NO: 26604 - DNA, 20 bp, Artificial Sequence
  chemically synthesized
ccgcccgatcttggactttt

SEQ ID NO: 26605 - DNA, 20 bp, Artificial Sequence
  chemically synthesized
atcttggacttttaagtcac

SEQ ID NO: 26606 - DNA, 20 bp, Artificial Sequence
  chemically synthesized
aaactttaaaaaaaaaaaat

SEQ ID NO: 26607 - DNA, 20 bp, Artificial Sequence
  chemically synthesized
aaaaaaaaaaataagctacc

SEQ ID NO: 26608 - DNA, 20 bp, Artificial Sequence
  chemically synthesized
aaaaataagctacccagact

SEQ ID NO: 26609 - DNA, 20 bp, Artificial Sequence
  chemically synthesized
aaaataagctacccagactc

SEQ ID NO: 26610 - DNA, 20 bp, Artificial Sequence
  chemically synthesized
cagactcaggtactctgtta

SEQ ID NO: 26611 - DNA, 20 bp, Artificial Sequence
  chemically synthesized
tgcaaaatacactaaaactt

SEQ ID NO: 26612 - DNA, 20 bp, Artificial Sequence
  chemically synthesized
actaaaactttagcccaact

SEQ ID NO: 26613 - DNA, 20 bp, Artificial Sequence
  chemically synthesized
taaaactttagcccaacttg

SEQ ID NO: 26614 - DNA, 20 bp, Artificial Sequence
  chemically synthesized
aactttagcccaacttggag

SEQ ID NO: 26615 - DNA, 20 bp, Artificial Sequence
  chemically synthesized
actttagcccaacttggagt

SEQ ID NO: 26616 - DNA, 20 bp, Artificial Sequence
  chemically synthesized
ctttagcccaacttggagtg

SEQ ID NO: 26617 - DNA, 20 bp, Artificial Sequence
  chemically synthesized
ttagcccaacttggagtggg

SEQ ID NO: 26618 - DNA, 20 bp, Artificial Sequence
  chemically synthesized
gcccaacttggagtggggag

SEQ ID NO: 26619 - DNA, 20 bp, Artificial Sequence
  chemically synthesized
ccaacttggagtggggagaa

SEQ ID NO: 26620 - DNA, 20 bp, Artificial Sequence
  chemically synthesized
cttggagtggggagaagaga

SEQ ID NO: 26621 - DNA, 20 bp, Artificial Sequence
  chemically synthesized
gagaagagatggtttcccaa

SEQ ID NO: 26622 - DNA, 20 bp, Artificial Sequence
  chemically synthesized
agaagagatggtttcccaaa

SEQ ID NO: 26623 - DNA, 20 bp, Artificial Sequence
  chemically synthesized
gaagagatggtttcccaaaa

SEQ ID NO: 26624 - DNA, 20 bp, Artificial Sequence
  chemically synthesized
aagagatggtttcccaaaag

SEQ ID NO: 26625 - DNA, 20 bp, Artificial Sequence
  chemically synthesized
ccaaaaggggtctctctgaa

SEQ ID NO: 26626 - DNA, 20 bp, Artificial Sequence
  chemically synthesized
ttcacaatgaaaatgaaaat

SEQ ID NO: 26627 - DNA, 20 bp, Artificial Sequence
  chemically synthesized
gttccctttcataatgactg

SEQ ID NO: 26628 - DNA, 20 bp, Artificial Sequence
  chemically synthesized
tccctttcataatgactgaa

SEQ ID NO: 26629 - DNA, 20 bp, Artificial Sequence
  chemically synthesized
cctttcataatgactgaaga

SEQ ID NO: 26630 - DNA, 20 bp, Artificial Sequence
  chemically synthesized
ctttcataatgactgaagag

SEQ ID NO: 26631 - DNA, 20 bp, Artificial Sequence
  chemically synthesized
tcataatgactgaagagagg

SEQ ID NO: 26632 - DNA, 20 bp, Artificial Sequence
  chemically synthesized
cataatgactgaagagaggt

SEQ ID NO: 26633 - DNA, 20 bp, Artificial Sequence
  chemically synthesized
agagaggtaggatgttacga

SEQ ID NO: 26634 - DNA, 20 bp, Artificial Sequence
  chemically synthesized
gaggtaggatgttacgaaag

SEQ ID NO: 26635 - DNA, 20 bp, Artificial Sequence
  chemically synthesized
aggtaggatgttacgaaaga

SEQ ID NO: 26636 - DNA, 20 bp, Artificial Sequence
  chemically synthesized
acgaaagaaggcgtttctga

SEQ ID NO: 26637 - DNA, 20 bp, Artificial Sequence
  chemically synthesized
gaaagaaggcgtttctgaaa

SEQ ID NO: 26638 - DNA, 20 bp, Artificial Sequence
  chemically synthesized
cgtttctgaaagagttgctg

SEQ ID NO: 26639 - DNA, 20 bp, Artificial Sequence
  chemically synthesized
gtttctgaaagagttgctgt

SEQ ID NO: 26640 - DNA, 20 bp, Artificial Sequence
  chemically synthesized
tctgaaagagttgctgtggg

SEQ ID NO: 26641 - DNA, 20 bp, Artificial Sequence
  chemically synthesized
agagttgctgtgggaagatg

SEQ ID NO: 26642 - DNA, 20 bp, Artificial Sequence
  chemically synthesized
agttgctgtgggaagatgtg

SEQ ID NO: 26643 - DNA, 20 bp, Artificial Sequence
  chemically synthesized
agacttctctgtaaaccttc

SEQ ID NO: 26644 - DNA, 20 bp, Artificial Sequence
  chemically synthesized
ccagactctctgtgcacaca

SEQ ID NO: 26645 - DNA, 20 bp, Artificial Sequence
  chemically synthesized
tctctgtgcacacacagatg

SEQ ID NO: 26646 - DNA, 20 bp, Artificial Sequence
  chemically synthesized
ctctgtgcacacacagatgc

SEQ ID NO: 26647 - DNA, 20 bp, Artificial Sequence
  chemically synthesized
cacacacagatgcaggtgtc

SEQ ID NO: 26648 - DNA, 20 bp, Artificial Sequence
  chemically synthesized
acacacagatgcaggtgtcc

SEQ ID NO: 26649 - DNA, 20 bp, Artificial Sequence
  chemically synthesized
cacacagatgcaggtgtcca

SEQ ID NO: 26650 - DNA, 20 bp, Artificial Sequence
  chemically synthesized
cacagatgcaggtgtccagg

SEQ ID NO: 26651 - DNA, 20 bp, Artificial Sequence
  chemically synthesized
acagatgcaggtgtccaggg

SEQ ID NO: 26652 - DNA, 20 bp, Artificial Sequence
  chemically synthesized
gatgcaggtgtccagggagg

SEQ ID NO: 26653 - DNA, 20 bp, Artificial Sequence
  chemically synthesized
atgcaggtgtccagggaggc

SEQ ID NO: 26654 - DNA, 20 bp, Artificial Sequence
  chemically synthesized
tgcaggtgtccagggaggca

SEQ ID NO: 26655 - DNA, 20 bp, Artificial Sequence
  chemically synthesized
gcaggtgtccagggaggcag

SEQ ID NO: 26656 - DNA, 20 bp, Artificial Sequence
  chemically synthesized
caggtgtccagggaggcagg

SEQ ID NO: 26657 - DNA, 20 bp, Artificial Sequence
  chemically synthesized
tgtccagggaggcaggggga

SEQ ID NO: 26658 - DNA, 20 bp, Artificial Sequence
  chemically synthesized
attgcaacatgaaaatttct

SEQ ID NO: 26659 - DNA, 20 bp, Artificial Sequence
  chemically synthesized
ttgcaacatgaaaatttctt

SEQ ID NO: 26660 - DNA, 20 bp, Artificial Sequence
  chemically synthesized
tgcaacatgaaaatttctta

SEQ ID NO: 26661 - DNA, 20 bp, Artificial Sequence
  chemically synthesized
gcaacatgaaaatttcttag

SEQ ID NO: 26662 - DNA, 20 bp, Artificial Sequence
  chemically synthesized
tgaaaatttcttaggggctg

SEQ ID NO: 26663 - DNA, 20 bp, Artificial Sequence
  chemically synthesized
atttcttaggggctgtggac

SEQ ID NO: 26664 - DNA, 20 bp, Artificial Sequence
  chemically synthesized
ttaggggctgtggaccagtc

SEQ ID NO: 26665 - DNA, 20 bp, Artificial Sequence
  chemically synthesized
ggggctgtggaccagtccag

SEQ ID NO: 26666 - DNA, 20 bp, Artificial Sequence
  chemically synthesized
accagtccagaagacccttt

SEQ ID NO: 26667 - DNA, 20 bp, Artificial Sequence
  chemically synthesized
tttggcaatcctaacttctg

SEQ ID NO: 26668 - DNA, 20 bp, Artificial Sequence
  chemically synthesized
ttggcaatcctaacttctgt

SEQ ID NO: 26669 - DNA, 20 bp, Artificial Sequence
  chemically synthesized
ctaacttctgtgggtctctc

SEQ ID NO: 26670 - DNA, 20 bp, Artificial Sequence
  chemically synthesized
tgtgggtctctccagtctga

SEQ ID NO: 26671 - DNA, 20 bp, Artificial Sequence
  chemically synthesized
atcgatctcacaccacaaaa

SEQ ID NO: 26672 - DNA, 20 bp, Artificial Sequence
  chemically synthesized
cgatctcacaccacaaaatg

SEQ ID NO: 26673 - DNA, 20 bp, Artificial Sequence
  chemically synthesized
accacaaaatggagttcttc

SEQ ID NO: 26674 - DNA, 20 bp, Artificial Sequence
  chemically synthesized
ccacaaaatggagttcttct

SEQ ID NO: 26675 - DNA, 20 bp, Artificial Sequence
  chemically synthesized
caaaatggagttcttctggg

SEQ ID NO: 26676 - DNA, 20 bp, Artificial Sequence
  chemically synthesized
aaaatggagttcttctggga

SEQ ID NO: 26677 - DNA, 20 bp, Artificial Sequence
  chemically synthesized
ctgggaaggacttgttctaa

SEQ ID NO: 26678 - DNA, 20 bp, Artificial Sequence
  chemically synthesized
tgggaaggacttgttctaac

SEQ ID NO: 26679 - DNA, 20 bp, Artificial Sequence
  chemically synthesized
ggacttgttctaacaggcct

SEQ ID NO: 26680 - DNA, 20 bp, Artificial Sequence
  chemically synthesized
acttgttctaacaggcctga

SEQ ID NO: 26681 - DNA, 20 bp, Artificial Sequence
  chemically synthesized
gttctaacaggcctgagagt

SEQ ID NO: 26682 - DNA, 20 bp, Artificial Sequence
  chemically synthesized
ttctaacaggcctgagagtg

SEQ ID NO: 26683 - DNA, 20 bp, Artificial Sequence
  chemically synthesized
ctgagagtgaggtgaccttg

SEQ ID NO: 26684 - DNA, 20 bp, Artificial Sequence
  chemically synthesized
cttgtggccattttctgtga

SEQ ID NO: 26685 - DNA, 20 bp, Artificial Sequence
  chemically synthesized
tgtggccattttctgtgaca

SEQ ID NO: 26686 - DNA, 20 bp, Artificial Sequence
  chemically synthesized
ctgtgacagagacacctaaa

SEQ ID NO: 26687 - DNA, 20 bp, Artificial Sequence
  chemically synthesized
gtgacagagacacctaaaaa

SEQ ID NO: 26688 - DNA, 20 bp, Artificial Sequence
  chemically synthesized
acctaaaaagagtctgttgt

SEQ ID NO: 26689 - DNA, 20 bp, Artificial Sequence
  chemically synthesized
aaaagagtctgttgtgagtc

SEQ ID NO: 26690 - DNA, 20 bp, Artificial Sequence
  chemically synthesized
aagagtctgttgtgagtctg

SEQ ID NO: 26691 - DNA, 20 bp, Artificial Sequence
  chemically synthesized
gttgtgagtctggagacatt

SEQ ID NO: 26692 - DNA, 20 bp, Artificial Sequence
  chemically synthesized
ggagacattgagaaccctgt

SEQ ID NO: 26693 - DNA, 20 bp, Artificial Sequence
  chemically synthesized
acattgagaaccctgtgagt

SEQ ID NO: 26694 - DNA, 20 bp, Artificial Sequence
  chemically synthesized
cattgagaaccctgtgagta

SEQ ID NO: 26695 - DNA, 20 bp, Artificial Sequence
  chemically synthesized
ctgtgagtaaggattttatt

SEQ ID NO: 26696 - DNA, 20 bp, Artificial Sequence
  chemically synthesized
tgtgagtaaggattttattt

SEQ ID NO: 26697 - DNA, 20 bp, Artificial Sequence
  chemically synthesized
attttatttaggtctgtttc

SEQ ID NO: 26698 - DNA, 20 bp, Artificial Sequence
  chemically synthesized
tatttaggtctgtttctggt

SEQ ID NO: 26699 - DNA, 20 bp, Artificial Sequence
  chemically synthesized
tttaggtctgtttctggtca

SEQ ID NO: 26700 - DNA, 20 bp, Artificial Sequence
  chemically synthesized
aggtctgtttctggtcagag

SEQ ID NO: 26701 - DNA, 20 bp, Artificial Sequence
  chemically synthesized
ggtctgtttctggtcagagt

SEQ ID NO: 26702 - DNA, 20 bp, Artificial Sequence
  chemically synthesized
gtctgtttctggtcagagtg

SEQ ID NO: 26703 - DNA, 20 bp, Artificial Sequence
  chemically synthesized
tctggtcagagtggggattt

SEQ ID NO: 26704 - DNA, 20 bp, Artificial Sequence
  chemically synthesized
ctggtcagagtggggattta

SEQ ID NO: 26705 - DNA, 20 bp, Artificial Sequence
  chemically synthesized
cagagtggggatttaaggct

SEQ ID NO: 26706 - DNA, 20 bp, Artificial Sequence
  chemically synthesized
aaggcttggtcaatatgatt

SEQ ID NO: 26707 - DNA, 20 bp, Artificial Sequence
  chemically synthesized
ggtcaatatgattaagacta

SEQ ID NO: 26708 - DNA, 20 bp, Artificial Sequence
  chemically synthesized
gtcaatatgattaagactaa

SEQ ID NO: 26709 - DNA, 20 bp, Artificial Sequence
  chemically synthesized
aagactaaaggccacacaca

SEQ ID NO: 26710 - DNA, 20 bp, Artificial Sequence
  chemically synthesized
ccacacacatagatttgtgt

SEQ ID NO: 26711 - DNA, 20 bp, Artificial Sequence
  chemically synthesized
ccatctgtaaaaatctgaaa

SEQ ID NO: 26712 - DNA, 20 bp, Artificial Sequence
  chemically synthesized
tgtaaaaatctgaaaaagct

SEQ ID NO: 26713 - DNA, 20 bp, Artificial Sequence
  chemically synthesized
ctatctctctccatcaattt

SEQ ID NO: 26714 - DNA, 20 bp, Artificial Sequence
  chemically synthesized
tttagtttttatgtgtttgt

SEQ ID NO: 26715 - DNA, 20 bp, Artificial Sequence
  chemically synthesized
ttttatgtgtttgtaagatg

SEQ ID NO: 26716 - DNA, 20 bp, Artificial Sequence
  chemically synthesized
gatatgtctattttgtgcat

SEQ ID NO: 26717 - DNA, 20 bp, Artificial Sequence
  chemically synthesized
tatgtctattttgtgcatga

SEQ ID NO: 26718 - DNA, 20 bp, Artificial Sequence
  chemically synthesized
tgtctattttgtgcatgaga

SEQ ID NO: 26719 - DNA, 20 bp, Artificial Sequence
  chemically synthesized
tctattttgtgcatgagaga

SEQ ID NO: 26720 - DNA, 20 bp, Artificial Sequence
  chemically synthesized
ctattttgtgcatgagagag

SEQ ID NO: 26721 - DNA, 20 bp, Artificial Sequence
  chemically synthesized
ttttgtgcatgagagagagg

SEQ ID NO: 26722 - DNA, 20 bp, Artificial Sequence
  chemically synthesized
agagaggaagatcatcctca

SEQ ID NO: 26723 - DNA, 20 bp, Artificial Sequence
  chemically synthesized
gagaggaagatcatcctcaa

SEQ ID NO: 26724 - DNA, 20 bp, Artificial Sequence
  chemically synthesized
aggaagatcatcctcaaagg

SEQ ID NO: 26725 - DNA, 20 bp, Artificial Sequence
  chemically synthesized
tcctcaaaggaagaatgaac

SEQ ID NO: 26726 - DNA, 20 bp, Artificial Sequence
  chemically synthesized
caaaggaagaatgaactggt

SEQ ID NO: 26727 - DNA, 20 bp, Artificial Sequence
  chemically synthesized
aggaagaatgaactggttgg

SEQ ID NO: 26728 - DNA, 20 bp, Artificial Sequence
  chemically synthesized
atgaactggttggcagcttt

SEQ ID NO: 26729 - DNA, 20 bp, Artificial Sequence
  chemically synthesized
gttggcagctttcagctgtg

SEQ ID NO: 26730 - DNA, 20 bp, Artificial Sequence
  chemically synthesized
ggcagctttcagctgtgtag

SEQ ID NO: 26731 - DNA, 20 bp, Artificial Sequence
  chemically synthesized
gcagctttcagctgtgtagt

SEQ ID NO: 26732 - DNA, 20 bp, Artificial Sequence
  chemically synthesized
tcagctgtgtagtgggtatt

SEQ ID NO: 26733 - DNA, 20 bp, Artificial Sequence
  chemically synthesized
cagctgtgtagtgggtattg

SEQ ID NO: 26734 - DNA, 20 bp, Artificial Sequence
  chemically synthesized
tgtagtgggtattgaggaca

SEQ ID NO: 26735 - DNA, 20 bp, Artificial Sequence
  chemically synthesized
gtagtgggtattgaggacac

SEQ ID NO: 26736 - DNA, 20 bp, Artificial Sequence
  chemically synthesized
gtgggtattgaggacacggg

SEQ ID NO: 26737 - DNA, 20 bp, Artificial Sequence
  chemically synthesized
tgggtattgaggacacggga

SEQ ID NO: 26738 - DNA, 20 bp, Artificial Sequence
  chemically synthesized
gtattgaggacacgggaagg

SEQ ID NO: 26739 - DNA, 20 bp, Artificial Sequence
  chemically synthesized
aggacacgggaaggtggtgc

SEQ ID NO: 26740 - DNA, 20 bp, Artificial Sequence
  chemically synthesized
acacgggaaggtggtgctgg

SEQ ID NO: 26741 - DNA, 20 bp, Artificial Sequence
  chemically synthesized
ggaaggtggtgctggaagaa

SEQ ID NO: 26742 - DNA, 20 bp, Artificial Sequence
  chemically synthesized
agccacattttcttgtgccc

SEQ ID NO: 26743 - DNA, 20 bp, Artificial Sequence
  chemically synthesized
gccacattttcttgtgccct

SEQ ID NO: 26744 - DNA, 20 bp, Artificial Sequence
  chemically synthesized
ccacattttcttgtgccctg

SEQ ID NO: 26745 - DNA, 20 bp, Artificial Sequence
  chemically synthesized
attttcttgtgccctgggga

SEQ ID NO: 26746 - DNA, 20 bp, Artificial Sequence
  chemically synthesized
ttcttgtgccctggggatag

SEQ ID NO: 26747 - DNA, 20 bp, Artificial Sequence
  chemically synthesized
tcttgtgccctggggatagt

SEQ ID NO: 26748 - DNA, 20 bp, Artificial Sequence
  chemically synthesized
cttgtgccctggggatagta

SEQ ID NO: 26749 - DNA, 20 bp, Artificial Sequence
  chemically synthesized
ccctggggatagtagggcct

SEQ ID NO: 26750 - DNA, 20 bp, Artificial Sequence
  chemically synthesized
ggatagtagggccttggtgc

SEQ ID NO: 26751 - DNA, 20 bp, Artificial Sequence
  chemically synthesized
agtagggccttggtgctggt

SEQ ID NO: 26752 - DNA, 20 bp, Artificial Sequence
  chemically synthesized
cttggtgctggtcagaattt

SEQ ID NO: 26753 - DNA, 20 bp, Artificial Sequence
  chemically synthesized
tcagaatttaagcctatcct

SEQ ID NO: 26754 - DNA, 20 bp, Artificial Sequence
  chemically synthesized
cagaatttaagcctatcctt

SEQ ID NO: 26755 - DNA, 20 bp, Artificial Sequence
  chemically synthesized
cttgggctgaatgctccccc

SEQ ID NO: 26756 - DNA, 20 bp, Artificial Sequence
  chemically synthesized
gggctgaatgctccccctgg

SEQ ID NO: 26757 - DNA, 20 bp, Artificial Sequence
  chemically synthesized
gctccccctggtggctacat

SEQ ID NO: 26758 - DNA, 20 bp, Artificial Sequence
  chemically synthesized
gtggctacattggaaaacca

SEQ ID NO: 26759 - DNA, 20 bp, Artificial Sequence
  chemically synthesized
ggaaaaccacagcatgtgta

SEQ ID NO: 26760 - DNA, 20 bp, Artificial Sequence
  chemically synthesized
cacagcatgtgtacagacct

SEQ ID NO: 26761 - DNA, 20 bp, Artificial Sequence
  chemically synthesized
acagcatgtgtacagacctt

SEQ ID NO: 26762 - DNA, 20 bp, Artificial Sequence
  chemically synthesized
cagcatgtgtacagaccttg

SEQ ID NO: 26763 - DNA, 20 bp, Artificial Sequence
  chemically synthesized
gtgtacagaccttggggatt

SEQ ID NO: 26764 - DNA, 20 bp, Artificial Sequence
  chemically synthesized
ttggggattcagttctcctg

SEQ ID NO: 26765 - DNA, 20 bp, Artificial Sequence
  chemically synthesized
tggggattcagttctcctga

SEQ ID NO: 26766 - DNA, 20 bp, Artificial Sequence
  chemically synthesized
aaggaatctcctacttcacc

SEQ ID NO: 26767 - DNA, 20 bp, Artificial Sequence
  chemically synthesized
atctcctacttcaccaagcc

SEQ ID NO: 26768 - DNA, 20 bp, Artificial Sequence
  chemically synthesized
ctacttcaccaagcctggct

SEQ ID NO: 26769 - DNA, 20 bp, Artificial Sequence
  chemically synthesized
cttcaccaagcctggctcag

SEQ ID NO: 26770 - DNA, 20 bp, Artificial Sequence
  chemically synthesized
ttcaccaagcctggctcagt

SEQ ID NO: 26771 - DNA, 20 bp, Artificial Sequence
  chemically synthesized
ccaagcctggctcagtgggc

SEQ ID NO: 26772 - DNA, 20 bp, Artificial Sequence
  chemically synthesized
gcctggctcagtgggctggc

SEQ ID NO: 26773 - DNA, 20 bp, Artificial Sequence
  chemically synthesized
cctggctcagtgggctggct

SEQ ID NO: 26774 - DNA, 20 bp, Artificial Sequence
  chemically synthesized
ggctggctaggtatcaattc

SEQ ID NO: 26775 - DNA, 20 bp, Artificial Sequence
  chemically synthesized
ggctaggtatcaattctgga

SEQ ID NO: 26776 - DNA, 20 bp, Artificial Sequence
  chemically synthesized
ctaggtatcaattctggata

SEQ ID NO: 26777 - DNA, 20 bp, Artificial Sequence
  chemically synthesized
taggtatcaattctggatag

SEQ ID NO: 26778 - DNA, 20 bp, Artificial Sequence
  chemically synthesized
tccttaaataaaacttatac

SEQ ID NO: 26779 - DNA, 20 bp, Artificial Sequence
  chemically synthesized
aacttatactggccccttga

SEQ ID NO: 26780 - DNA, 20 bp, Artificial Sequence
  chemically synthesized
tatactggccccttgaaagc

SEQ ID NO: 26781 - DNA, 20 bp, Artificial Sequence
  chemically synthesized
atactggccccttgaaagcc

SEQ ID NO: 26782 - DNA, 20 bp, Artificial Sequence
  chemically synthesized
accatttgcacattaacaaa

SEQ ID NO: 26783 - DNA, 20 bp, Artificial Sequence
  chemically synthesized
ccatttgcacattaacaaat

SEQ ID NO: 26784 - DNA, 20 bp, Artificial Sequence
  chemically synthesized
aacaaataggtacactgtta

SEQ ID NO: 26785 - DNA, 20 bp, Artificial Sequence
  chemically synthesized
acagtgacacttttcacttt

SEQ ID NO: 26786 - DNA, 20 bp, Artificial Sequence
  chemically synthesized
acacttttcacttttagtaa

SEQ ID NO: 26787 - DNA, 20 bp, Artificial Sequence
  chemically synthesized
ttcacttttagtaatggatt

SEQ ID NO: 26788 - DNA, 20 bp, Artificial Sequence
  chemically synthesized
taatgaattctaatacctta

SEQ ID NO: 26789 - DNA, 20 bp, Artificial Sequence
  chemically synthesized
aatgaattctaataccttaa

SEQ ID NO: 26790 - DNA, 20 bp, Artificial Sequence
  chemically synthesized
attctaataccttaaaggtt

SEQ ID NO: 26791 - DNA, 20 bp, Artificial Sequence
  chemically synthesized
ttctaataccttaaaggtta

SEQ ID NO: 26792 - DNA, 20 bp, Artificial Sequence
  chemically synthesized
aatattcgcatgattaccca

SEQ ID NO: 26793 - DNA, 20 bp, Artificial Sequence
  chemically synthesized
cgcatgattacccacagtga

SEQ ID NO: 26794 - DNA, 20 bp, Artificial Sequence
  chemically synthesized
catgattacccacagtgata

SEQ ID NO: 26795 - DNA, 20 bp, Artificial Sequence
  chemically synthesized
attacccacagtgatagaga

SEQ ID NO: 26796 - DNA, 20 bp, Artificial Sequence
  chemically synthesized
ttacccacagtgatagagat

SEQ ID NO: 26797 - DNA, 20 bp, Artificial Sequence
  chemically synthesized
acagtgatagagataggtcc

SEQ ID NO: 26798 - DNA, 20 bp, Artificial Sequence
  chemically synthesized
cagtgatagagataggtccg

SEQ ID NO: 26799 - DNA, 20 bp, Artificial Sequence
  chemically synthesized
tgtccccatcatcctcctct

SEQ ID NO: 26800 - DNA, 20 bp, Artificial Sequence
  chemically synthesized
atcatcctcctcttggcctc

SEQ ID NO: 26801 - DNA, 20 bp, Artificial Sequence
  chemically synthesized
tcatcctcctcttggcctcc

SEQ ID NO: 26802 - DNA, 20 bp, Artificial Sequence
  chemically synthesized
tcctcttggcctccaggctt

SEQ ID NO: 26803 - DNA, 20 bp, Artificial Sequence
  chemically synthesized
agaaactacctctgccttcc

SEQ ID NO: 26804 - DNA, 20 bp, Artificial Sequence
  chemically synthesized
ctacctctgccttcctagcc

SEQ ID NO: 26805 - DNA, 20 bp, Artificial Sequence
  chemically synthesized
tacctctgccttcctagcct

SEQ ID NO: 26806 - DNA, 20 bp, Artificial Sequence
  chemically synthesized
tctgccttcctagcctgggc

SEQ ID NO: 26807 - DNA, 20 bp, Artificial Sequence
  chemically synthesized
ctgggctagtgaccctattt

SEQ ID NO: 26808 - DNA, 20 bp, Artificial Sequence
  chemically synthesized
ctaacatctttactcaatgt

SEQ ID NO: 26809 - DNA, 20 bp, Artificial Sequence
  chemically synthesized
tactcaatgtgagcttcata

SEQ ID NO: 26810 - DNA, 20 bp, Artificial Sequence
  chemically synthesized
actcaatgtgagcttcataa

SEQ ID NO: 26811 - DNA, 20 bp, Artificial Sequence
  chemically synthesized
aatgtgagcttcataaaggc

SEQ ID NO: 26812 - DNA, 20 bp, Artificial Sequence
  chemically synthesized
atgttaatctgtctatcttc

SEQ ID NO: 26813 - DNA, 20 bp, Artificial Sequence
  chemically synthesized
tctatcttcaagttcttgat

SEQ ID NO: 26814 - DNA, 20 bp, Artificial Sequence
  chemically synthesized
tatcttcaagttcttgatca

SEQ ID NO: 26815 - DNA, 20 bp, Artificial Sequence
  chemically synthesized
ttcttgatcagagtttctca

SEQ ID NO: 26816 - DNA, 20 bp, Artificial Sequence
  chemically synthesized
tcttgatcagagtttctcac

SEQ ID NO: 26817 - DNA, 20 bp, Artificial Sequence
  chemically synthesized
gcacgtcaatgaaaattgat

SEQ ID NO: 26818 - DNA, 20 bp, Artificial Sequence
  chemically synthesized
gagaatgtttaatgtaattt

SEQ ID NO: 26819 - DNA, 20 bp, Artificial Sequence
  chemically synthesized
gtaatttcagtcacacttca

SEQ ID NO: 26820 - DNA, 20 bp, Artificial Sequence
  chemically synthesized
aatttcagtcacacttcaaa

SEQ ID NO: 26821 - DNA, 20 bp, Artificial Sequence
  chemically synthesized
atttcagtcacacttcaaag

SEQ ID NO: 26822 - DNA, 20 bp, Artificial Sequence
  chemically synthesized
gatatgataaaacaaatcta

SEQ ID NO: 26823 - DNA, 20 bp, Artificial Sequence
  chemically synthesized
atatgataaaacaaatctaa

SEQ ID NO: 26824 - DNA, 20 bp, Artificial Sequence
  chemically synthesized
aaacaaatctaaaggtcatt

SEQ ID NO: 26825 - DNA, 20 bp, Artificial Sequence
  chemically synthesized
acaaatctaaaggtcattta

SEQ ID NO: 26826 - DNA, 20 bp, Artificial Sequence
  chemically synthesized
aaaggtcatttagagcaata

SEQ ID NO: 26827 - DNA, 20 bp, Artificial Sequence
  chemically synthesized
aataaagaatcaaaaatgct

SEQ ID NO: 26828 - DNA, 20 bp, Artificial Sequence
  chemically synthesized
aaatgctgagttctttcatt

SEQ ID NO: 26829 - DNA, 20 bp, Artificial Sequence
  chemically synthesized
tttcaaataaatctattgct

SEQ ID NO: 26830 - DNA, 20 bp, Artificial Sequence
  chemically synthesized
taaatctattgcttggaaac

SEQ ID NO: 26831 - DNA, 20 bp, Artificial Sequence
  chemically synthesized
ggtccttcaattatataatt

SEQ ID NO: 26832 - DNA, 20 bp, Artificial Sequence
  chemically synthesized
tccttcaattatataattca

SEQ ID NO: 26833 - DNA, 20 bp, Artificial Sequence
  chemically synthesized
aattatataattcagagaaa

SEQ ID NO: 26834 - DNA, 20 bp, Artificial Sequence
  chemically synthesized
attcagagaaatagaatata

SEQ ID NO: 26835 - DNA, 20 bp, Artificial Sequence
  chemically synthesized
tagaatataaagctattata

SEQ ID NO: 26836 - DNA, 20 bp, Artificial Sequence
  chemically synthesized
taaagctattatacagatgt

SEQ ID NO: 26837 - DNA, 20 bp, Artificial Sequence
  chemically synthesized
atacagatgttagtttaaaa

SEQ ID NO: 26838 - DNA, 20 bp, Artificial Sequence
  chemically synthesized
agatgttagtttaaaaaagt

SEQ ID NO: 26839 - DNA, 20 bp, Artificial Sequence
  chemically synthesized
ttaaaaaagtaagcaaatat

SEQ ID NO: 26840 - DNA, 20 bp, Artificial Sequence
  chemically synthesized
aaaaaagtaagcaaatatta

SEQ ID NO: 26841 - DNA, 20 bp, Artificial Sequence
  chemically synthesized
aaatattagagatctctaaa

SEQ ID NO: 26842 - DNA, 20 bp, Artificial Sequence
  chemically synthesized
tattagagatctctaaatgg

SEQ ID NO: 26843 - DNA, 20 bp, Artificial Sequence
  chemically synthesized
attagagatctctaaatggt

SEQ ID NO: 26844 - DNA, 20 bp, Artificial Sequence
  chemically synthesized
atggtaggttatccactaaa

SEQ ID NO: 26845 - DNA, 20 bp, Artificial Sequence
  chemically synthesized
gtattgtttatctacgtaaa

SEQ ID NO: 26846 - DNA, 20 bp, Artificial Sequence
  chemically synthesized
gtcaattacatatctgcatc

SEQ ID NO: 26847 - DNA, 20 bp, Artificial Sequence
  chemically synthesized
accaaaataacatctgtttc

SEQ ID NO: 26848 - DNA, 20 bp, Artificial Sequence
  chemically synthesized
aataacatctgtttccagtg

SEQ ID NO: 26849 - DNA, 20 bp, Artificial Sequence
  chemically synthesized
atattgttaacaatgtactc

SEQ ID NO: 26850 - DNA, 20 bp, Artificial Sequence
  chemically synthesized
acatgtcatataaactcatt

SEQ ID NO: 26851 - DNA, 20 bp, Artificial Sequence
  chemically synthesized
catgtcatataaactcattc

SEQ ID NO: 26852 - DNA, 20 bp, Artificial Sequence
  chemically synthesized
atgtcatataaactcattca

SEQ ID NO: 26853 - DNA, 20 bp, Artificial Sequence
  chemically synthesized
tacctctactgttttattcc

SEQ ID NO: 26854 - DNA, 20 bp, Artificial Sequence
  chemically synthesized
acctctactgttttattcca

SEQ ID NO: 26855 - DNA, 20 bp, Artificial Sequence
  chemically synthesized
taaatgttatatttgatcac

SEQ ID NO: 26856 - DNA, 20 bp, Artificial Sequence
  chemically synthesized
ttgatcaccggaaaatctta

SEQ ID NO: 26857 - DNA, 20 bp, Artificial Sequence
  chemically synthesized
cttacactacccctcctttt

SEQ ID NO: 26858 - DNA, 20 bp, Artificial Sequence
  chemically synthesized
tttggaaatacctttctata

SEQ ID NO: 26859 - DNA, 20 bp, Artificial Sequence
  chemically synthesized
tttctataaagccctatctg

SEQ ID NO: 26860 - DNA, 20 bp, Artificial Sequence
  chemically synthesized
atctgtggttgattcttaat

SEQ ID NO: 26861 - DNA, 20 bp, Artificial Sequence
  chemically synthesized
tgattcttaattagtcttca

SEQ ID NO: 26862 - DNA, 20 bp, Artificial Sequence
  chemically synthesized
cttaattagtcttcatagct

SEQ ID NO: 26863 - DNA, 20 bp, Artificial Sequence
  chemically synthesized
ttaattagtcttcatagctc

SEQ ID NO: 26864 - DNA, 20 bp, Artificial Sequence
  chemically synthesized
ttagtcttcatagctcaggt

SEQ ID NO: 26865 - DNA, 20 bp, Artificial Sequence
  chemically synthesized
tagtcttcatagctcaggtt

SEQ ID NO: 26866 - DNA, 20 bp, Artificial Sequence
  chemically synthesized
agtcttcatagctcaggttg

SEQ ID NO: 26867 - DNA, 20 bp, Artificial Sequence
  chemically synthesized
gctcaggttggggccttccc

SEQ ID NO: 26868 - DNA, 20 bp, Artificial Sequence
  chemically synthesized
ccttccctggccctcacctg

SEQ ID NO: 26869 - DNA, 20 bp, Artificial Sequence
  chemically synthesized
cttccctggccctcacctgt

SEQ ID NO: 26870 - DNA, 20 bp, Artificial Sequence
  chemically synthesized
cctggccctcacctgtgggc

SEQ ID NO: 26871 - DNA, 20 bp, Artificial Sequence
  chemically synthesized
ctggccctcacctgtgggcc

SEQ ID NO: 26872 - DNA, 20 bp, Artificial Sequence
  chemically synthesized
tccatctcttacattgcgct

SEQ ID NO: 26873 - DNA, 20 bp, Artificial Sequence
  chemically synthesized
tctcttacattgcgctaaga

SEQ ID NO: 26874 - DNA, 20 bp, Artificial Sequence
  chemically synthesized
ttttcctatcttatgtgtga

SEQ ID NO: 26875 - DNA, 20 bp, Artificial Sequence
  chemically synthesized
tgatagatgcccctgaataa

SEQ ID NO: 26876 - DNA, 20 bp, Artificial Sequence
  chemically synthesized
atagcaatatttgctgttgc

SEQ ID NO: 26877 - DNA, 20 bp, Artificial Sequence
  chemically synthesized
tttgctgttgctggtaataa

SEQ ID NO: 26878 - DNA, 20 bp, Artificial Sequence
  chemically synthesized
gctgttgctggtaataatag

SEQ ID NO: 26879 - DNA, 20 bp, Artificial Sequence
  chemically synthesized
tgttgctgttatactgtcct

SEQ ID NO: 26880 - DNA, 20 bp, Artificial Sequence
  chemically synthesized
gctgttatactgtccttggc

SEQ ID NO: 26881 - DNA, 20 bp, Artificial Sequence
  chemically synthesized
ctgttatactgtccttggct

SEQ ID NO: 26882 - DNA, 20 bp, Artificial Sequence
  chemically synthesized
actgtccttggctaggatcc

SEQ ID NO: 26883 - DNA, 20 bp, Artificial Sequence
  chemically synthesized
tggctaggatcccagtgaaa

SEQ ID NO: 26884 - DNA, 20 bp, Artificial Sequence
  chemically synthesized
ggctaggatcccagtgaaat

SEQ ID NO: 26885 - DNA, 20 bp, Artificial Sequence
  chemically synthesized
aatcatgttcttaataaatg

SEQ ID NO: 26886 - DNA, 20 bp, Artificial Sequence
  chemically synthesized
atcatgttcttaataaatgc

SEQ ID NO: 26887 - DNA, 20 bp, Artificial Sequence
  chemically synthesized
aggattttctgaaatttttc

SEQ ID NO: 26888 - DNA, 20 bp, Artificial Sequence
  chemically synthesized
attttctgaaatttttctgg

SEQ ID NO: 26889 - DNA, 20 bp, Artificial Sequence
  chemically synthesized
ttctgaaatttttctggtag

SEQ ID NO: 26890 - DNA, 20 bp, Artificial Sequence
  chemically synthesized
gtagtggtgccctctcctac

SEQ ID NO: 26891 - DNA, 20 bp, Artificial Sequence
  chemically synthesized
ctctcctacaagcctaaatg

SEQ ID NO: 26892 - DNA, 20 bp, Artificial Sequence
  chemically synthesized
caagcctaaatgaagatgct

SEQ ID NO: 26893 - DNA, 20 bp, Artificial Sequence
  chemically synthesized
agctccttcctattgtaccg

SEQ ID NO: 26894 - DNA, 20 bp, Artificial Sequence
  chemically synthesized
ccttcctattgtaccgaagc

SEQ ID NO: 26895 - DNA, 20 bp, Artificial Sequence
  chemically synthesized
cctcataactacaatttaat

SEQ ID NO: 26896 - DNA, 20 bp, Artificial Sequence
  chemically synthesized
accctgactctcctacactc

SEQ ID NO: 26897 - DNA, 20 bp, Artificial Sequence
  chemically synthesized
tacactctggccctaacaac

SEQ ID NO: 26898 - DNA, 20 bp, Artificial Sequence
  chemically synthesized
ctaacaaccagttacttacc

SEQ ID NO: 26899 - DNA, 20 bp, Artificial Sequence
  chemically synthesized
accagttacttacccggtgt

SEQ ID NO: 26900 - DNA, 20 bp, Artificial Sequence
  chemically synthesized
ccagttacttacccggtgta

SEQ ID NO: 26901 - DNA, 20 bp, Artificial Sequence
  chemically synthesized
gttacttacccggtgtaagg

SEQ ID NO: 26902 - DNA, 20 bp, Artificial Sequence
  chemically synthesized
aaggtggtgccacttctgtc

SEQ ID NO: 26903 - DNA, 20 bp, Artificial Sequence
  chemically synthesized
aggtggtgccacttctgtct

SEQ ID NO: 26904 - DNA, 20 bp, Artificial Sequence
  chemically synthesized
gtgccacttctgtctgggtg

SEQ ID NO: 26905 - DNA, 20 bp, Artificial Sequence
  chemically synthesized
tgggtgtggtctgatcacaa

SEQ ID NO: 26906 - DNA, 20 bp, Artificial Sequence
  chemically synthesized
atggcatgtcataaacttca

SEQ ID NO: 26907 - DNA, 20 bp, Artificial Sequence
  chemically synthesized
tggcatgtcataaacttcat

SEQ ID NO: 26908 - DNA, 20 bp, Artificial Sequence
  chemically synthesized
aacttcatgggtctctgtcc

SEQ ID NO: 26909 - DNA, 20 bp, Artificial Sequence
  chemically synthesized
atgggtctctgtcctggttt

SEQ ID NO: 26910 - DNA, 20 bp, Artificial Sequence
  chemically synthesized
tagatctgtatgccccgttt

SEQ ID NO: 26911 - DNA, 20 bp, Artificial Sequence
  chemically synthesized
gatctgtatgccccgttttg

SEQ ID NO: 26912 - DNA, 20 bp, Artificial Sequence
  chemically synthesized
aatcaaccatgccctattta

SEQ ID NO: 26913 - DNA, 20 bp, Artificial Sequence
  chemically synthesized
atcaaccatgccctatttaa

SEQ ID NO: 26914 - DNA, 20 bp, Artificial Sequence
  chemically synthesized
tgtaataccttgcttcatgc

SEQ ID NO: 26915 - DNA, 20 bp, Artificial Sequence
  chemically synthesized
cttgcttcatgccagtctcc

SEQ ID NO: 26916 - DNA, 20 bp, Artificial Sequence
  chemically synthesized
tgcttcatgccagtctccaa

SEQ ID NO: 26917 - DNA, 20 bp, Artificial Sequence
  chemically synthesized
caagagtgtgtgtgtgtttg

SEQ ID NO: 26918 - DNA, 20 bp, Artificial Sequence
  chemically synthesized
gagtgtgtgtgtgtttgtgg

SEQ ID NO: 26919 - DNA, 20 bp, Artificial Sequence
  chemically synthesized
gtgtgtgtgtgtttgtggtg

SEQ ID NO: 26920 - DNA, 20 bp, Artificial Sequence
  chemically synthesized
gtgtgtgtgtttgtggtgga

SEQ ID NO: 26921 - DNA, 20 bp, Artificial Sequence
  chemically synthesized
tgtgtgtgtttgtggtggag

SEQ ID NO: 26922 - DNA, 20 bp, Artificial Sequence
  chemically synthesized
gtggtggagaggttgtgtgt

SEQ ID NO: 26923 - DNA, 20 bp, Artificial Sequence
  chemically synthesized
aggttgtgtgtgagttttga

SEQ ID NO: 26924 - DNA, 20 bp, Artificial Sequence
  chemically synthesized
gtgtgtgagttttgaaagaa

SEQ ID NO: 26925 - DNA, 20 bp, Artificial Sequence
  chemically synthesized
gtgtgagttttgaaagaaaa

SEQ ID NO: 26926 - DNA, 20 bp, Artificial Sequence
  chemically synthesized
atgacctgatcacattaact

SEQ ID NO: 26927 - DNA, 20 bp, Artificial Sequence
  chemically synthesized
tgacctgatcacattaactc

SEQ ID NO: 26928 - DNA, 20 bp, Artificial Sequence
  chemically synthesized
tcacattaactcaggttctg

SEQ ID NO: 26929 - DNA, 20 bp, Artificial Sequence
  chemically synthesized
ttaactcaggttctgtagca

SEQ ID NO: 26930 - DNA, 20 bp, Artificial Sequence
  chemically synthesized
tcaggttctgtagcatagtc

SEQ ID NO: 26931 - DNA, 20 bp, Artificial Sequence
  chemically synthesized
caggttctgtagcatagtct

SEQ ID NO: 26932 - DNA, 20 bp, Artificial Sequence
  chemically synthesized
aggttctgtagcatagtctg

SEQ ID NO: 26933 - DNA, 20 bp, Artificial Sequence
  chemically synthesized
ttctgtagcatagtctgggg

SEQ ID NO: 26934 - DNA, 20 bp, Artificial Sequence
  chemically synthesized
tgtagcatagtctggggaag

SEQ ID NO: 26935 - DNA, 20 bp, Artificial Sequence
  chemically synthesized
atagtctggggaagaagtac

SEQ ID NO: 26936 - DNA, 20 bp, Artificial Sequence
  chemically synthesized
tttttttttctaaatgttga

SEQ ID NO: 26937 - DNA, 20 bp, Artificial Sequence
  chemically synthesized
atgttgatggcatttgctac

SEQ ID NO: 26938 - DNA, 20 bp, Artificial Sequence
  chemically synthesized
gatggcatttgctaccagaa

SEQ ID NO: 26939 - DNA, 20 bp, Artificial Sequence
  chemically synthesized
ggcatttgctaccagaaaag

SEQ ID NO: 26940 - DNA, 20 bp, Artificial Sequence
  chemically synthesized
gcatttgctaccagaaaaga

SEQ ID NO: 26941 - DNA, 20 bp, Artificial Sequence
  chemically synthesized
ctaccagaaaagaaggaaaa

SEQ ID NO: 26942 - DNA, 20 bp, Artificial Sequence
  chemically synthesized
agaaggaaaaaagttttgta

SEQ ID NO: 26943 - DNA, 20 bp, Artificial Sequence
  chemically synthesized
gaaggaaaaaagttttgtaa

SEQ ID NO: 26944 - DNA, 20 bp, Artificial Sequence
  chemically synthesized
tttgtaaaggctacttgttg

SEQ ID NO: 26945 - DNA, 20 bp, Artificial Sequence
  chemically synthesized
ttgtaaaggctacttgttgt

SEQ ID NO: 26946 - DNA, 20 bp, Artificial Sequence
  chemically synthesized
tgtaaaggctacttgttgta

SEQ ID NO: 26947 - DNA, 20 bp, Artificial Sequence
  chemically synthesized
acttgttgtagggctcattg

SEQ ID NO: 26948 - DNA, 20 bp, Artificial Sequence
  chemically synthesized
cttgttgtagggctcattga

SEQ ID NO: 26949 - DNA, 20 bp, Artificial Sequence
  chemically synthesized
ttgtagggctcattgaagga

SEQ ID NO: 26950 - DNA, 20 bp, Artificial Sequence
  chemically synthesized
gggctcattgaaggaaagtc

SEQ ID NO: 26951 - DNA, 20 bp, Artificial Sequence
  chemically synthesized
aggaaagtccagtgcattca

SEQ ID NO: 26952 - DNA, 20 bp, Artificial Sequence
  chemically synthesized
gtccagtgcattcaaagatg

SEQ ID NO: 26953 - DNA, 20 bp, Artificial Sequence
  chemically synthesized
cagtgcattcaaagatgaag

SEQ ID NO: 26954 - DNA, 20 bp, Artificial Sequence
  chemically synthesized
gtgcattcaaagatgaagta

SEQ ID NO: 26955 - DNA, 20 bp, Artificial Sequence
  chemically synthesized
gcattcaaagatgaagtaga

SEQ ID NO: 26956 - DNA, 20 bp, Artificial Sequence
  chemically synthesized
aaagatgaagtagagagctt

SEQ ID NO: 26957 - DNA, 20 bp, Artificial Sequence
  chemically synthesized
aagatgaagtagagagcttt

SEQ ID NO: 26958 - DNA, 20 bp, Artificial Sequence
  chemically synthesized
tgaagtagagagctttggga

SEQ ID NO: 26959 - DNA, 20 bp, Artificial Sequence
  chemically synthesized
agagagctttgggaaagcct

SEQ ID NO: 26960 - DNA, 20 bp, Artificial Sequence
  chemically synthesized
gaaagcctgagacactgacc

SEQ ID NO: 26961 - DNA, 20 bp, Artificial Sequence
  chemically synthesized
cactgacctggacatttgtt

SEQ ID NO: 26962 - DNA, 20 bp, Artificial Sequence
  chemically synthesized
actgacctggacatttgttt

SEQ ID NO: 26963 - DNA, 20 bp, Artificial Sequence
  chemically synthesized
ctgacctggacatttgtttg

SEQ ID NO: 26964 - DNA, 20 bp, Artificial Sequence
  chemically synthesized
acctggacatttgtttgggg

SEQ ID NO: 26965 - DNA, 20 bp, Artificial Sequence
  chemically synthesized
cctggacatttgtttggggt

SEQ ID NO: 26966 - DNA, 20 bp, Artificial Sequence
  chemically synthesized
tggggtaggattgaatatgc

SEQ ID NO: 26967 - DNA, 20 bp, Artificial Sequence
  chemically synthesized
gaatatgcaagattgacttc

SEQ ID NO: 26968 - DNA, 20 bp, Artificial Sequence
  chemically synthesized
aatatgcaagattgacttct

SEQ ID NO: 26969 - DNA, 20 bp, Artificial Sequence
  chemically synthesized
aagattgacttctaggtcca

SEQ ID NO: 26970 - DNA, 20 bp, Artificial Sequence
  chemically synthesized
gacttctaggtccaaagata

SEQ ID NO: 26971 - DNA, 20 bp, Artificial Sequence
  chemically synthesized
cttctaggtccaaagatata

SEQ ID NO: 26972 - DNA, 20 bp, Artificial Sequence
  chemically synthesized
ttctaggtccaaagatatag

SEQ ID NO: 26973 - DNA, 20 bp, Artificial Sequence
  chemically synthesized
aggtccaaagatatagaggc

SEQ ID NO: 26974 - DNA, 20 bp, Artificial Sequence
  chemically synthesized
tccaaagatatagaggctgg

SEQ ID NO: 26975 - DNA, 20 bp, Artificial Sequence
  chemically synthesized
caaagatatagaggctggca

SEQ ID NO: 26976 - DNA, 20 bp, Artificial Sequence
  chemically synthesized
gatatagaggctggcagaga

SEQ ID NO: 26977 - DNA, 20 bp, Artificial Sequence
  chemically synthesized
tatagaggctggcagagatg

SEQ ID NO: 26978 - DNA, 20 bp, Artificial Sequence
  chemically synthesized
atagaggctggcagagatgg

SEQ ID NO: 26979 - DNA, 20 bp, Artificial Sequence
  chemically synthesized
tagaggctggcagagatgga

SEQ ID NO: 26980 - DNA, 20 bp, Artificial Sequence
  chemically synthesized
gagggcaatttaattatctg

SEQ ID NO: 26981 - DNA, 20 bp, Artificial Sequence
  chemically synthesized
atttaattatctgcagtaaa

SEQ ID NO: 26982 - DNA, 20 bp, Artificial Sequence
  chemically synthesized
agtaaatggaaatataaaaa

SEQ ID NO: 26983 - DNA, 20 bp, Artificial Sequence
  chemically synthesized
aatggaaatataaaaataga

SEQ ID NO: 26984 - DNA, 20 bp, Artificial Sequence
  chemically synthesized
atggaaatataaaaatagac

SEQ ID NO: 26985 - DNA, 20 bp, Artificial Sequence
  chemically synthesized
ataaaaatagacaggaaaat

SEQ ID NO: 26986 - DNA, 20 bp, Artificial Sequence
  chemically synthesized
aatagacaggaaaatgagtg

SEQ ID NO: 26987 - DNA, 20 bp, Artificial Sequence
  chemically synthesized
atagacaggaaaatgagtgc

SEQ ID NO: 26988 - DNA, 20 bp, Artificial Sequence
  chemically synthesized
agacaggaaaatgagtgcag

SEQ ID NO: 26989 - DNA, 20 bp, Artificial Sequence
  chemically synthesized
aggaaaatgagtgcaggagt

SEQ ID NO: 26990 - DNA, 20 bp, Artificial Sequence
  chemically synthesized
gaaaatgagtgcaggagtga

SEQ ID NO: 26991 - DNA, 20 bp, Artificial Sequence
  chemically synthesized
gcaggagtgagagaatcttg

SEQ ID NO: 26992 - DNA, 20 bp, Artificial Sequence
  chemically synthesized
ggagtgagagaatcttgaag

SEQ ID NO: 26993 - DNA, 20 bp, Artificial Sequence
  chemically synthesized
gtgagagaatcttgaagtag

SEQ ID NO: 26994 - DNA, 20 bp, Artificial Sequence
  chemically synthesized
tcttgaagtagtggtgattg

SEQ ID NO: 26995 - DNA, 20 bp, Artificial Sequence
  chemically synthesized
agtggtgattgtggtgcttc

SEQ ID NO: 26996 - DNA, 20 bp, Artificial Sequence
  chemically synthesized
gtggtgattgtggtgcttca

SEQ ID NO: 26997 - DNA, 20 bp, Artificial Sequence
  chemically synthesized
gtgattgtggtgcttcaagg

SEQ ID NO: 26998 - DNA, 20 bp, Artificial Sequence
  chemically synthesized
aaggcagatgtgcaatttaa

SEQ ID NO: 26999 - DNA, 20 bp, Artificial Sequence
  chemically synthesized
aagccactgtgaacatcaca

SEQ ID NO: 27000 - DNA, 20 bp, Artificial Sequence
  chemically synthesized
tatactacatccgacctctc

SEQ ID NO: 27001 - DNA, 20 bp, Artificial Sequence
  chemically synthesized
ccgacctctctggaaaacga

SEQ ID NO: 27002 - DNA, 20 bp, Artificial Sequence
  chemically synthesized
cgacctctctggaaaacgac

SEQ ID NO: 27003 - DNA, 20 bp, Artificial Sequence
  chemically synthesized
gaaaacgacgggtccattac

SEQ ID NO: 27004 - DNA, 20 bp, Artificial Sequence
  chemically synthesized
aacgacgggtccattactag

SEQ ID NO: 27005 - DNA, 20 bp, Artificial Sequence
  chemically synthesized
ggtccattactagtggataa

SEQ ID NO: 27006 - DNA, 20 bp, Artificial Sequence
  chemically synthesized
ccattactagtggataacag

SEQ ID NO: 27007 - DNA, 20 bp, Artificial Sequence
  chemically synthesized
tactagtggataacagaaga

SEQ ID NO: 27008 - DNA, 20 bp, Artificial Sequence
  chemically synthesized
aagacagtaaataaaatgat

SEQ ID NO: 27009 - DNA, 20 bp, Artificial Sequence
  chemically synthesized
tttatgaaattaaaaataaa

SEQ ID NO: 27010 - DNA, 20 bp, Artificial Sequence
  chemically synthesized
gaaattaaaaataaacagat

SEQ ID NO: 27011 - DNA, 20 bp, Artificial Sequence
  chemically synthesized
aaattaaaaataaacagata

SEQ ID NO: 27012 - DNA, 20 bp, Artificial Sequence
  chemically synthesized
ttaaaaataaacagataagg

SEQ ID NO: 27013 - DNA, 20 bp, Artificial Sequence
  chemically synthesized
aaaataaacagataaggcag

SEQ ID NO: 27014 - DNA, 20 bp, Artificial Sequence
  chemically synthesized
aggcagtagtacttttgttg

SEQ ID NO: 27015 - DNA, 20 bp, Artificial Sequence
  chemically synthesized
cagtagtacttttgttgcag

SEQ ID NO: 27016 - DNA, 20 bp, Artificial Sequence
  chemically synthesized
tgttgcagcagatgtctgtg

SEQ ID NO: 27017 - DNA, 20 bp, Artificial Sequence
  chemically synthesized
atgtctgtgtagccaaaacc

SEQ ID NO: 27018 - DNA, 20 bp, Artificial Sequence
  chemically synthesized
tgtctgtgtagccaaaacct

SEQ ID NO: 27019 - DNA, 20 bp, Artificial Sequence
  chemically synthesized
gtctgtgtagccaaaacctg

SEQ ID NO: 27020 - DNA, 20 bp, Artificial Sequence
  chemically synthesized
cctggggactgaatgctaaa

SEQ ID NO: 27021 - DNA, 20 bp, Artificial Sequence
  chemically synthesized
gggactgaatgctaaaaagt

SEQ ID NO: 27022 - DNA, 20 bp, Artificial Sequence
  chemically synthesized
ggactgaatgctaaaaagtt

SEQ ID NO: 27023 - DNA, 20 bp, Artificial Sequence
  chemically synthesized
gactgaatgctaaaaagtta

SEQ ID NO: 27024 - DNA, 20 bp, Artificial Sequence
  chemically synthesized
gctaaaaagttagggctctt

SEQ ID NO: 27025 - DNA, 20 bp, Artificial Sequence
  chemically synthesized
aagttagggctcttcagctt

SEQ ID NO: 27026 - DNA, 20 bp, Artificial Sequence
  chemically synthesized
agttagggctcttcagcttc

SEQ ID NO: 27027 - DNA, 20 bp, Artificial Sequence
  chemically synthesized
ttagggctcttcagcttcag

SEQ ID NO: 27028 - DNA, 20 bp, Artificial Sequence
  chemically synthesized
ggctcttcagcttcaggaga

SEQ ID NO: 27029 - DNA, 20 bp, Artificial Sequence
  chemically synthesized
gctcttcagcttcaggagac

SEQ ID NO: 27030 - DNA, 20 bp, Artificial Sequence
  chemically synthesized
ctcttcagcttcaggagaca

SEQ ID NO: 27031 - DNA, 20 bp, Artificial Sequence
  chemically synthesized
tcttcagcttcaggagacag

SEQ ID NO: 27032 - DNA, 20 bp, Artificial Sequence
  chemically synthesized
tcagcttcaggagacagggg

SEQ ID NO: 27033 - DNA, 20 bp, Artificial Sequence
  chemically synthesized
agcttcaggagacaggggtg

SEQ ID NO: 27034 - DNA, 20 bp, Artificial Sequence
  chemically synthesized
aggagacaggggtggagata

SEQ ID NO: 27035 - DNA, 20 bp, Artificial Sequence
  chemically synthesized
gacaggggtggagataaaga

SEQ ID NO: 27036 - DNA, 20 bp, Artificial Sequence
  chemically synthesized
taaagaaagtttcctgccca

SEQ ID NO: 27037 - DNA, 20 bp, Artificial Sequence
  chemically synthesized
aaagaaagtttcctgcccat

SEQ ID NO: 27038 - DNA, 20 bp, Artificial Sequence
  chemically synthesized
tttcctgcccataggattcc

SEQ ID NO: 27039 - DNA, 20 bp, Artificial Sequence
  chemically synthesized
gcccataggattcccagccc

SEQ ID NO: 27040 - DNA, 20 bp, Artificial Sequence
  chemically synthesized
cccataggattcccagccct

SEQ ID NO: 27041 - DNA, 20 bp, Artificial Sequence
  chemically synthesized
ccataggattcccagccctg

SEQ ID NO: 27042 - DNA, 20 bp, Artificial Sequence
  chemically synthesized
gggaccctttgtttaccatt

SEQ ID NO: 27043 - DNA, 20 bp, Artificial Sequence
  chemically synthesized
tgtttaccattaagttctcc

SEQ ID NO: 27044 - DNA, 20 bp, Artificial Sequence
  chemically synthesized
taccattaagttctcccagc

SEQ ID NO: 27045 - DNA, 20 bp, Artificial Sequence
  chemically synthesized
ccattaagttctcccagctg

SEQ ID NO: 27046 - DNA, 20 bp, Artificial Sequence
  chemically synthesized
agttctcccagctggagcca

SEQ ID NO: 27047 - DNA, 20 bp, Artificial Sequence
  chemically synthesized
ccagctggagccatggtctt

SEQ ID NO: 27048 - DNA, 20 bp, Artificial Sequence
  chemically synthesized
cagctggagccatggtcttt

SEQ ID NO: 27049 - DNA, 20 bp, Artificial Sequence
  chemically synthesized
gctggagccatggtctttag

SEQ ID NO: 27050 - DNA, 20 bp, Artificial Sequence
  chemically synthesized
ctggagccatggtctttagg

SEQ ID NO: 27051 - DNA, 20 bp, Artificial Sequence
  chemically synthesized
gaggataaatccttctgtga

SEQ ID NO: 27052 - DNA, 20 bp, Artificial Sequence
  chemically synthesized
aaatccttctgtgacagcca

SEQ ID NO: 27053 - DNA, 20 bp, Artificial Sequence
  chemically synthesized
agccacagccttgtgcctct

SEQ ID NO: 27054 - DNA, 20 bp, Artificial Sequence
  chemically synthesized
tatactcttctttcttcctt

SEQ ID NO: 27055 - DNA, 20 bp, Artificial Sequence
  chemically synthesized
ttcctttggaacctactcat

SEQ ID NO: 27056 - DNA, 20 bp, Artificial Sequence
  chemically synthesized
acatttttgttattacctgc

SEQ ID NO: 27057 - DNA, 20 bp, Artificial Sequence
  chemically synthesized
ttttgttattacctgctggt

SEQ ID NO: 27058 - DNA, 20 bp, Artificial Sequence
  chemically synthesized
gtctcactactgtcttgtgc

SEQ ID NO: 27059 - DNA, 20 bp, Artificial Sequence
  chemically synthesized
tctcactactgtcttgtgcc

SEQ ID NO: 27060 - DNA, 20 bp, Artificial Sequence
  chemically synthesized
ctcactactgtcttgtgccg

SEQ ID NO: 27061 - DNA, 20 bp, Artificial Sequence
  chemically synthesized
actgtcttgtgccggggttt

SEQ ID NO: 27062 - DNA, 20 bp, Artificial Sequence
  chemically synthesized
ctgtcttgtgccggggtttc

SEQ ID NO: 27063 - DNA, 20 bp, Artificial Sequence
  chemically synthesized
gtcttgtgccggggtttcag

SEQ ID NO: 27064 - DNA, 20 bp, Artificial Sequence
  chemically synthesized
ttgtgccggggtttcaggag

SEQ ID NO: 27065 - DNA, 20 bp, Artificial Sequence
  chemically synthesized
tgtgccggggtttcaggagt

SEQ ID NO: 27066 - DNA, 20 bp, Artificial Sequence
  chemically synthesized
gggtttcaggagtgggtaat

SEQ ID NO: 27067 - DNA, 20 bp, Artificial Sequence
  chemically synthesized
ggtttcaggagtgggtaatt

SEQ ID NO: 27068 - DNA, 20 bp, Artificial Sequence
  chemically synthesized
gtttcaggagtgggtaatta

SEQ ID NO: 27069 - DNA, 20 bp, Artificial Sequence
  chemically synthesized
tttcaggagtgggtaattag

SEQ ID NO: 27070 - DNA, 20 bp, Artificial Sequence
  chemically synthesized
ttcaggagtgggtaattagg

SEQ ID NO: 27071 - DNA, 20 bp, Artificial Sequence
  chemically synthesized
agtgggtaattagggggaca

SEQ ID NO: 27072 - DNA, 20 bp, Artificial Sequence
  chemically synthesized
gtgggtaattagggggacat

SEQ ID NO: 27073 - DNA, 20 bp, Artificial Sequence
  chemically synthesized
gggtaattagggggacatgg

SEQ ID NO: 27074 - DNA, 20 bp, Artificial Sequence
  chemically synthesized
gtaattagggggacatggga

SEQ ID NO: 27075 - DNA, 20 bp, Artificial Sequence
  chemically synthesized
aattagggggacatgggaga

SEQ ID NO: 27076 - DNA, 20 bp, Artificial Sequence
  chemically synthesized
attagggggacatgggagag

SEQ ID NO: 27077 - DNA, 20 bp, Artificial Sequence
  chemically synthesized
tagggggacatgggagagag

SEQ ID NO: 27078 - DNA, 20 bp, Artificial Sequence
  chemically synthesized
agggggacatgggagagagg

SEQ ID NO: 27079 - DNA, 20 bp, Artificial Sequence
  chemically synthesized
gggggacatgggagagagga

SEQ ID NO: 27080 - DNA, 20 bp, Artificial Sequence
  chemically synthesized
gggacatgggagagaggagg

SEQ ID NO: 27081 - DNA, 20 bp, Artificial Sequence
  chemically synthesized
ggagagaggagggagaaaat

SEQ ID NO: 27082 - DNA, 20 bp, Artificial Sequence
  chemically synthesized
gagagaggagggagaaaatg

SEQ ID NO: 27083 - DNA, 20 bp, Artificial Sequence
  chemically synthesized
agagaggagggagaaaatga

SEQ ID NO: 27084 - DNA, 20 bp, Artificial Sequence
  chemically synthesized
agggagaaaatgagggaaaa

SEQ ID NO: 27085 - DNA, 20 bp, Artificial Sequence
  chemically synthesized
gggagaaaatgagggaaaat

SEQ ID NO: 27086 - DNA, 20 bp, Artificial Sequence
  chemically synthesized
tgagggaaaatgggaatgca

SEQ ID NO: 27087 - DNA, 20 bp, Artificial Sequence
  chemically synthesized
gagggaaaatgggaatgcat

SEQ ID NO: 27088 - DNA, 20 bp, Artificial Sequence
  chemically synthesized
ggaatgcataggtatcacaa

SEQ ID NO: 27089 - DNA, 20 bp, Artificial Sequence
  chemically synthesized
atgcataggtatcacaaaag

SEQ ID NO: 27090 - DNA, 20 bp, Artificial Sequence
  chemically synthesized
ataggtatcacaaaagcagt

SEQ ID NO: 27091 - DNA, 20 bp, Artificial Sequence
  chemically synthesized
acaaaagcagtgagcccaaa

SEQ ID NO: 27092 - DNA, 20 bp, Artificial Sequence
  chemically synthesized
gcagtgagcccaaaaagaca

SEQ ID NO: 27093 - DNA, 20 bp, Artificial Sequence
  chemically synthesized
agcccaaaaagacatggtct

SEQ ID NO: 27094 - DNA, 20 bp, Artificial Sequence
  chemically synthesized
acatggtctcagttacaatt

SEQ ID NO: 27095 - DNA, 20 bp, Artificial Sequence
  chemically synthesized
catggtctcagttacaatta

SEQ ID NO: 27096 - DNA, 20 bp, Artificial Sequence
  chemically synthesized
cccaaatgtttgaatgtcct

SEQ ID NO: 27097 - DNA, 20 bp, Artificial Sequence
  chemically synthesized
tttgaatgtccttagccaaa

SEQ ID NO: 27098 - DNA, 20 bp, Artificial Sequence
  chemically synthesized
ttccccacattccctgcact

SEQ ID NO: 27099 - DNA, 20 bp, Artificial Sequence
  chemically synthesized
attccctgcactaagcctaa

SEQ ID NO: 27100 - DNA, 20 bp, Artificial Sequence
  chemically synthesized
ttccctgcactaagcctaat

SEQ ID NO: 27101 - DNA, 20 bp, Artificial Sequence
  chemically synthesized
gtttctttgtttgttgtttt

SEQ ID NO: 27102 - DNA, 20 bp, Artificial Sequence
  chemically synthesized
tgtttgttgtttttagaaat

SEQ ID NO: 27103 - DNA, 20 bp, Artificial Sequence
  chemically synthesized
gtttgttgtttttagaaatg

SEQ ID NO: 27104 - DNA, 20 bp, Artificial Sequence
  chemically synthesized
ttgtttttagaaatgaggtc

SEQ ID NO: 27105 - DNA, 20 bp, Artificial Sequence
  chemically synthesized
tgaggtctagctctgttacc

SEQ ID NO: 27106 - DNA, 20 bp, Artificial Sequence
  chemically synthesized
gaggtctagctctgttaccc

SEQ ID NO: 27107 - DNA, 20 bp, Artificial Sequence
  chemically synthesized
tagctctgttacccaggcta

SEQ ID NO: 27108 - DNA, 20 bp, Artificial Sequence
  chemically synthesized
ctgttacccaggctacagtg

SEQ ID NO: 27109 - DNA, 20 bp, Artificial Sequence
  chemically synthesized
ttacccaggctacagtgcag

SEQ ID NO: 27110 - DNA, 20 bp, Artificial Sequence
  chemically synthesized
acagtgcagtggtgtaatca

SEQ ID NO: 27111 - DNA, 20 bp, Artificial Sequence
  chemically synthesized
agctcactgtaaactcaaac

SEQ ID NO: 27112 - DNA, 20 bp, Artificial Sequence
  chemically synthesized
tgtaaactcaaaccggattc

SEQ ID NO: 27113 - DNA, 20 bp, Artificial Sequence
  chemically synthesized
tcctcccaccttattcttcc

SEQ ID NO: 27114 - DNA, 20 bp, Artificial Sequence
  chemically synthesized
accttattcttccaagttgc

SEQ ID NO: 27115 - DNA, 20 bp, Artificial Sequence
  chemically synthesized
ccttattcttccaagttgcc

SEQ ID NO: 27116 - DNA, 20 bp, Artificial Sequence
  chemically synthesized
ttccaagttgccaggattat

SEQ ID NO: 27117 - DNA, 20 bp, Artificial Sequence
  chemically synthesized
taagtgtgaaccaccatata

SEQ ID NO: 27118 - DNA, 20 bp, Artificial Sequence
  chemically synthesized
gtgtgaaccaccatatacag

SEQ ID NO: 27119 - DNA, 20 bp, Artificial Sequence
  chemically synthesized
aaccaccatatacagcagtc

SEQ ID NO: 27120 - DNA, 20 bp, Artificial Sequence
  chemically synthesized
accaccatatacagcagtct

SEQ ID NO: 27121 - DNA, 20 bp, Artificial Sequence
  chemically synthesized
atatacagcagtctgggcct

SEQ ID NO: 27122 - DNA, 20 bp, Artificial Sequence
  chemically synthesized
tgggccttagatttttcact

SEQ ID NO: 27123 - DNA, 20 bp, Artificial Sequence
  chemically synthesized
gatttttcacttggaaaatg

SEQ ID NO: 27124 - DNA, 20 bp, Artificial Sequence
  chemically synthesized
tcacttggaaaatgaagtct

SEQ ID NO: 27125 - DNA, 20 bp, Artificial Sequence
  chemically synthesized
gaaaatgaagtcttagaaac

SEQ ID NO: 27126 - DNA, 20 bp, Artificial Sequence
  chemically synthesized
aaaatgaagtcttagaaacc

SEQ ID NO: 27127 - DNA, 20 bp, Artificial Sequence
  chemically synthesized
aaatgaagtcttagaaacca

SEQ ID NO: 27128 - DNA, 20 bp, Artificial Sequence
  chemically synthesized
cttagaaaccagggttctca

SEQ ID NO: 27129 - DNA, 20 bp, Artificial Sequence
  chemically synthesized
agaatctcttctgatattct

SEQ ID NO: 27130 - DNA, 20 bp, Artificial Sequence
  chemically synthesized
aatctcttctgatattctca

SEQ ID NO: 27131 - DNA, 20 bp, Artificial Sequence
  chemically synthesized
atattctcagagtctatgca

SEQ ID NO: 27132 - DNA, 20 bp, Artificial Sequence
  chemically synthesized
tcagagtctatgcacagaac

SEQ ID NO: 27133 - DNA, 20 bp, Artificial Sequence
  chemically synthesized
agagtctatgcacagaacca

SEQ ID NO: 27134 - DNA, 20 bp, Artificial Sequence
  chemically synthesized
tctatgcacagaaccagagc

SEQ ID NO: 27135 - DNA, 20 bp, Artificial Sequence
  chemically synthesized
tatgcacagaaccagagcca

SEQ ID NO: 27136 - DNA, 20 bp, Artificial Sequence
  chemically synthesized
cacagaaccagagccagaga

SEQ ID NO: 27137 - DNA, 20 bp, Artificial Sequence
  chemically synthesized
aaccagagccagagaaagaa

SEQ ID NO: 27138 - DNA, 20 bp, Artificial Sequence
  chemically synthesized
gccagagaaagaacagaaaa

SEQ ID NO: 27139 - DNA, 20 bp, Artificial Sequence
  chemically synthesized
ccagagaaagaacagaaaac

SEQ ID NO: 27140 - DNA, 20 bp, Artificial Sequence
  chemically synthesized
aaaacaggaccttctcttgc

SEQ ID NO: 27141 - DNA, 20 bp, Artificial Sequence
  chemically synthesized
aggaccttctcttgctggaa

SEQ ID NO: 27142 - DNA, 20 bp, Artificial Sequence
  chemically synthesized
gaccttctcttgctggaaaa

SEQ ID NO: 27143 - DNA, 20 bp, Artificial Sequence
  chemically synthesized
accttctcttgctggaaaag

SEQ ID NO: 27144 - DNA, 20 bp, Artificial Sequence
  chemically synthesized
tctcttgctggaaaagaggc

SEQ ID NO: 27145 - DNA, 20 bp, Artificial Sequence
  chemically synthesized
aaaagaggcgagctcatctg

SEQ ID NO: 27146 - DNA, 20 bp, Artificial Sequence
  chemically synthesized
gctcatctgcagtattctgt

SEQ ID NO: 27147 - DNA, 20 bp, Artificial Sequence
  chemically synthesized
ctcatctgcagtattctgtt

SEQ ID NO: 27148 - DNA, 20 bp, Artificial Sequence
  chemically synthesized
atctgcagtattctgttagg

SEQ ID NO: 27149 - DNA, 20 bp, Artificial Sequence
  chemically synthesized
tctgcagtattctgttagga

SEQ ID NO: 27150 - DNA, 20 bp, Artificial Sequence
  chemically synthesized
cagtattctgttaggaaggc

SEQ ID NO: 27151 - DNA, 20 bp, Artificial Sequence
  chemically synthesized
agtattctgttaggaaggcc

SEQ ID NO: 27152 - DNA, 20 bp, Artificial Sequence
  chemically synthesized
tattctgttaggaaggccag

SEQ ID NO: 27153 - DNA, 20 bp, Artificial Sequence
  chemically synthesized
attctgttaggaaggccagg

SEQ ID NO: 27154 - DNA, 20 bp, Artificial Sequence
  chemically synthesized
ctgttaggaaggccaggagg

SEQ ID NO: 27155 - DNA, 20 bp, Artificial Sequence
  chemically synthesized
tgttaggaaggccaggaggc

SEQ ID NO: 27156 - DNA, 20 bp, Artificial Sequence
  chemically synthesized
gttaggaaggccaggaggca

SEQ ID NO: 27157 - DNA, 20 bp, Artificial Sequence
  chemically synthesized
ggctgcctcactcccctgat

SEQ ID NO: 27158 - DNA, 20 bp, Artificial Sequence
  chemically synthesized
tcccctgatgagtgcctgca

SEQ ID NO: 27159 - DNA, 20 bp, Artificial Sequence
  chemically synthesized
ctgatgagtgcctgcatggc

SEQ ID NO: 27160 - DNA, 20 bp, Artificial Sequence
  chemically synthesized
tgatgagtgcctgcatggcc

SEQ ID NO: 27161 - DNA, 20 bp, Artificial Sequence
  chemically synthesized
gagtgcctgcatggccaggc

SEQ ID NO: 27162 - DNA, 20 bp, Artificial Sequence
  chemically synthesized
tggccaggccagcccctccc

SEQ ID NO: 27163 - DNA, 20 bp, Artificial Sequence
  chemically synthesized
gcccctccctggatcatgtc

SEQ ID NO: 27164 - DNA, 20 bp, Artificial Sequence
  chemically synthesized
cctccctggatcatgtctag

SEQ ID NO: 27165 - DNA, 20 bp, Artificial Sequence
  chemically synthesized
cctggatcatgtctagaagt

SEQ ID NO: 27166 - DNA, 20 bp, Artificial Sequence
  chemically synthesized
ctggatcatgtctagaagtc

SEQ ID NO: 27167 - DNA, 20 bp, Artificial Sequence
  chemically synthesized
atcatgtctagaagtcagga

SEQ ID NO: 27168 - DNA, 20 bp, Artificial Sequence
  chemically synthesized
atgtctagaagtcaggatgg

SEQ ID NO: 27169 - DNA, 20 bp, Artificial Sequence
  chemically synthesized
tctagaagtcaggatggcag

SEQ ID NO: 27170 - DNA, 20 bp, Artificial Sequence
  chemically synthesized
tcaggatggcagaagccctc

SEQ ID NO: 27171 - DNA, 20 bp, Artificial Sequence
  chemically synthesized
tctctatactctttcctgcc

SEQ ID NO: 27172 - DNA, 20 bp, Artificial Sequence
  chemically synthesized
ctctttcctgccgagccatc

SEQ ID NO: 27173 - DNA, 20 bp, Artificial Sequence
  chemically synthesized
caccctctccttactctcat

SEQ ID NO: 27174 - DNA, 20 bp, Artificial Sequence
  chemically synthesized
ccttactctcatcagaaaaa

SEQ ID NO: 27175 - DNA, 20 bp, Artificial Sequence
  chemically synthesized
attaaatgcattttatatgc

SEQ ID NO: 27176 - DNA, 20 bp, Artificial Sequence
  chemically synthesized
atgcattttatatgctggtc

SEQ ID NO: 27177 - DNA, 20 bp, Artificial Sequence
  chemically synthesized
atatgctggtccagttaaca

SEQ ID NO: 27178 - DNA, 20 bp, Artificial Sequence
  chemically synthesized
ctggtccagttaacatagaa

SEQ ID NO: 27179 - DNA, 20 bp, Artificial Sequence
  chemically synthesized
acaacaccttgtaacttccc

SEQ ID NO: 27180 - DNA, 20 bp, Artificial Sequence
  chemically synthesized
cttgtaacttccccagtatc

SEQ ID NO: 27181 - DNA, 20 bp, Artificial Sequence
  chemically synthesized
ttgtaacttccccagtatcc

SEQ ID NO: 27182 - DNA, 20 bp, Artificial Sequence
  chemically synthesized
cttccccagtatccaggata

SEQ ID NO: 27183 - DNA, 20 bp, Artificial Sequence
  chemically synthesized
ctcctctatcctactaaaaa

SEQ ID NO: 27184 - DNA, 20 bp, Artificial Sequence
  chemically synthesized
tcctctatcctactaaaaac

SEQ ID NO: 27185 - DNA, 20 bp, Artificial Sequence
  chemically synthesized
actaaaaacaggcatgttta

SEQ ID NO: 27186 - DNA, 20 bp, Artificial Sequence
  chemically synthesized
aaacaggcatgtttacagat

SEQ ID NO: 27187 - DNA, 20 bp, Artificial Sequence
  chemically synthesized
acagatgagtttgaccactg

SEQ ID NO: 27188 - DNA, 20 bp, Artificial Sequence
  chemically synthesized
accactgtggaaatgttctc

SEQ ID NO: 27189 - DNA, 20 bp, Artificial Sequence
  chemically synthesized
ccactgtggaaatgttctct

SEQ ID NO: 27190 - DNA, 20 bp, Artificial Sequence
  chemically synthesized
cactgtggaaatgttctcta

SEQ ID NO: 27191 - DNA, 20 bp, Artificial Sequence
  chemically synthesized
actgtggaaatgttctctag

SEQ ID NO: 27192 - DNA, 20 bp, Artificial Sequence
  chemically synthesized
gggttcaaaaatgaataatc

SEQ ID NO: 27193 - DNA, 20 bp, Artificial Sequence
  chemically synthesized
aaaaatgaataatctggttc

SEQ ID NO: 27194 - DNA, 20 bp, Artificial Sequence
  chemically synthesized
ctggttcaagtccttgtgtt

SEQ ID NO: 27195 - DNA, 20 bp, Artificial Sequence
  chemically synthesized
tggttcaagtccttgtgttt

SEQ ID NO: 27196 - DNA, 20 bp, Artificial Sequence
  chemically synthesized
caagtccttgtgtttaggtg

SEQ ID NO: 27197 - DNA, 20 bp, Artificial Sequence
  chemically synthesized
ttgcatattctcctatttac

SEQ ID NO: 27198 - DNA, 20 bp, Artificial Sequence
  chemically synthesized
attctcctatttacaagaaa

SEQ ID NO: 27199 - DNA, 20 bp, Artificial Sequence
  chemically synthesized
aacagtatcctccaccaatg

SEQ ID NO: 27200 - DNA, 20 bp, Artificial Sequence
  chemically synthesized
ctaatattaaattcaaacaa

SEQ ID NO: 27201 - DNA, 20 bp, Artificial Sequence
  chemically synthesized
aattcaaacaaaagaatatt

SEQ ID NO: 27202 - DNA, 20 bp, Artificial Sequence
  chemically synthesized
aacaaaagaatatttagaca

SEQ ID NO: 27203 - DNA, 20 bp, Artificial Sequence
  chemically synthesized
acaaaagaatatttagacac

SEQ ID NO: 27204 - DNA, 20 bp, Artificial Sequence
  chemically synthesized
aagaatatttagacacaggt

SEQ ID NO: 27205 - DNA, 20 bp, Artificial Sequence
  chemically synthesized
agaatatttagacacaggtg

SEQ ID NO: 27206 - DNA, 20 bp, Artificial Sequence
  chemically synthesized
atatttagacacaggtgagg

SEQ ID NO: 27207 - DNA, 20 bp, Artificial Sequence
  chemically synthesized
atttagacacaggtgaggta

SEQ ID NO: 27208 - DNA, 20 bp, Artificial Sequence
  chemically synthesized
ttagacacaggtgaggtaga

SEQ ID NO: 27209 - DNA, 20 bp, Artificial Sequence
  chemically synthesized
gtatactgaaaatctctttt

SEQ ID NO: 27210 - DNA, 20 bp, Artificial Sequence
  chemically synthesized
tatactgaaaatctcttttc

SEQ ID NO: 27211 - DNA, 20 bp, Artificial Sequence
  chemically synthesized
ggaattttctcctgtgatct

SEQ ID NO: 27212 - DNA, 20 bp, Artificial Sequence
  chemically synthesized
tattttaattatgttgtaat

SEQ ID NO: 27213 - DNA, 20 bp, Artificial Sequence
  chemically synthesized
tagatgtaactgactgctct

SEQ ID NO: 27214 - DNA, 20 bp, Artificial Sequence
  chemically synthesized
atgtaactgactgctctgag

SEQ ID NO: 27215 - DNA, 20 bp, Artificial Sequence
  chemically synthesized
gagtggactcctccattgct

SEQ ID NO: 27216 - DNA, 20 bp, Artificial Sequence
  chemically synthesized
tggactcctccattgcttag

SEQ ID NO: 27217 - DNA, 20 bp, Artificial Sequence
  chemically synthesized
tgactgttgctctcctatca

SEQ ID NO: 27218 - DNA, 20 bp, Artificial Sequence
  chemically synthesized
tggataattatctctcttgc

SEQ ID NO: 27219 - DNA, 20 bp, Artificial Sequence
  chemically synthesized
ggataattatctctcttgct

SEQ ID NO: 27220 - DNA, 20 bp, Artificial Sequence
  chemically synthesized
ataattatctctcttgctag

SEQ ID NO: 27221 - DNA, 20 bp, Artificial Sequence
  chemically synthesized
ttgctaggagaaatccccta

SEQ ID NO: 27222 - DNA, 20 bp, Artificial Sequence
  chemically synthesized
tcccctaaagctttcttccc

SEQ ID NO: 27223 - DNA, 20 bp, Artificial Sequence
  chemically synthesized
ccctaaagctttcttcccaa

SEQ ID NO: 27224 - DNA, 20 bp, Artificial Sequence
  chemically synthesized
cctaaagctttcttcccaag

SEQ ID NO: 27225 - DNA, 20 bp, Artificial Sequence
  chemically synthesized
aaagctttcttcccaagagg

SEQ ID NO: 27226 - DNA, 20 bp, Artificial Sequence
  chemically synthesized
caagaggaagtatactttcc

SEQ ID NO: 27227 - DNA, 20 bp, Artificial Sequence
  chemically synthesized
agaggaagtatactttccaa

SEQ ID NO: 27228 - DNA, 20 bp, Artificial Sequence
  chemically synthesized
ctttccaagagaaataatcc

SEQ ID NO: 27229 - DNA, 20 bp, Artificial Sequence
  chemically synthesized
gccctgtcattgtctctgta

SEQ ID NO: 27230 - DNA, 20 bp, Artificial Sequence
  chemically synthesized
tatagacatcttgtttctac

SEQ ID NO: 27231 - DNA, 20 bp, Artificial Sequence
  chemically synthesized
ctgtccatctcatcactctg

SEQ ID NO: 27232 - DNA, 20 bp, Artificial Sequence
  chemically synthesized
ccatctcatcactctgaagt

SEQ ID NO: 27233 - DNA, 20 bp, Artificial Sequence
  chemically synthesized
cactctgaagttggtgaaca

SEQ ID NO: 27234 - DNA, 20 bp, Artificial Sequence
  chemically synthesized
ctctgaagttggtgaacaca

SEQ ID NO: 27235 - DNA, 20 bp, Artificial Sequence
  chemically synthesized
ggtgaacacagagctgacaa

SEQ ID NO: 27236 - DNA, 20 bp, Artificial Sequence
  chemically synthesized
cagagctgacaacagaaccc

SEQ ID NO: 27237 - DNA, 20 bp, Artificial Sequence
  chemically synthesized
agagctgacaacagaacccc

SEQ ID NO: 27238 - DNA, 20 bp, Artificial Sequence
  chemically synthesized
acaacagaaccccaggcaca

SEQ ID NO: 27239 - DNA, 20 bp, Artificial Sequence
  chemically synthesized
gaaccccaggcacaaagaat

SEQ ID NO: 27240 - DNA, 20 bp, Artificial Sequence
  chemically synthesized
aaccccaggcacaaagaatc

SEQ ID NO: 27241 - DNA, 20 bp, Artificial Sequence
  chemically synthesized
caggcacaaagaatcaggat

SEQ ID NO: 27242 - DNA, 20 bp, Artificial Sequence
  chemically synthesized
ggcacaaagaatcaggataa

SEQ ID NO: 27243 - DNA, 20 bp, Artificial Sequence
  chemically synthesized
gcacaaagaatcaggataag

SEQ ID NO: 27244 - DNA, 20 bp, Artificial Sequence
  chemically synthesized
aaagaatcaggataagaggt

SEQ ID NO: 27245 - DNA, 20 bp, Artificial Sequence
  chemically synthesized
actttatttattcacccatt

SEQ ID NO: 27246 - DNA, 20 bp, Artificial Sequence
  chemically synthesized
catgcaaaaaaatatatata

SEQ ID NO: 27247 - DNA, 20 bp, Artificial Sequence
  chemically synthesized
gcaaaaaaatatatatatag

SEQ ID NO: 27248 - DNA, 20 bp, Artificial Sequence
  chemically synthesized
tagtggtacctaccacatct

SEQ ID NO: 27249 - DNA, 20 bp, Artificial Sequence
  chemically synthesized
taccacatcttagacactgt

SEQ ID NO: 27250 - DNA, 20 bp, Artificial Sequence
  chemically synthesized
accacatcttagacactgtc

SEQ ID NO: 27251 - DNA, 20 bp, Artificial Sequence
  chemically synthesized
tcttagacactgtcaggctc

SEQ ID NO: 27252 - DNA, 20 bp, Artificial Sequence
  chemically synthesized
cttagacactgtcaggctcc

SEQ ID NO: 27253 - DNA, 20 bp, Artificial Sequence
  chemically synthesized
ttagacactgtcaggctcca

SEQ ID NO: 27254 - DNA, 20 bp, Artificial Sequence
  chemically synthesized
tagacactgtcaggctccag

SEQ ID NO: 27255 - DNA, 20 bp, Artificial Sequence
  chemically synthesized
tgtcaggctccaggggcctt

SEQ ID NO: 27256 - DNA, 20 bp, Artificial Sequence
  chemically synthesized
tcaggctccaggggccttta

SEQ ID NO: 27257 - DNA, 20 bp, Artificial Sequence
  chemically synthesized
caggggcctttagagaattc

SEQ ID NO: 27258 - DNA, 20 bp, Artificial Sequence
  chemically synthesized
caacttaaaaaatgaattat

SEQ ID NO: 27259 - DNA, 20 bp, Artificial Sequence
  chemically synthesized
aacttaaaaaatgaattatt

SEQ ID NO: 27260 - DNA, 20 bp, Artificial Sequence
  chemically synthesized
taaaaaatgaattattaggt

SEQ ID NO: 27261 - DNA, 20 bp, Artificial Sequence
  chemically synthesized
ttaggttggtgaaaaattaa

SEQ ID NO: 27262 - DNA, 20 bp, Artificial Sequence
  chemically synthesized
ggttggtgaaaaattaatgg

SEQ ID NO: 27263 - DNA, 20 bp, Artificial Sequence
  chemically synthesized
tgttctaaacatgtataata

SEQ ID NO: 27264 - DNA, 20 bp, Artificial Sequence
  chemically synthesized
tataatatatatgttgtaca

SEQ ID NO: 27265 - DNA, 20 bp, Artificial Sequence
  chemically synthesized
tgtttacatatataaatata

SEQ ID NO: 27266 - DNA, 20 bp, Artificial Sequence
  chemically synthesized
ttatatataaaaaatctata

SEQ ID NO: 27267 - DNA, 20 bp, Artificial Sequence
  chemically synthesized
aaaaatctataaagtatata

SEQ ID NO: 27268 - DNA, 20 bp, Artificial Sequence
  chemically synthesized
actaaaatgtatattctata

SEQ ID NO: 27269 - DNA, 20 bp, Artificial Sequence
  chemically synthesized
atattctataaagtatttat

SEQ ID NO: 27270 - DNA, 20 bp, Artificial Sequence
  chemically synthesized
tatacatatgtgtacttata

SEQ ID NO: 27271 - DNA, 20 bp, Artificial Sequence
  chemically synthesized
gtgtacttatatggatgtat

SEQ ID NO: 27272 - DNA, 20 bp, Artificial Sequence
  chemically synthesized
tgttctatatatatatcaat

SEQ ID NO: 27273 - DNA, 20 bp, Artificial Sequence
  chemically synthesized
tatataaatataaaaatata

SEQ ID NO: 27274 - DNA, 20 bp, Artificial Sequence
  chemically synthesized
tgtgtgtatttacaccttaa

SEQ ID NO: 27275 - DNA, 20 bp, Artificial Sequence
  chemically synthesized
tacaccttaatagtacatta

SEQ ID NO: 27276 - DNA, 20 bp, Artificial Sequence
  chemically synthesized
acaccttaatagtacattac

SEQ ID NO: 27277 - DNA, 20 bp, Artificial Sequence
  chemically synthesized
gtacattacaggtactacgt

SEQ ID NO: 27278 - DNA, 20 bp, Artificial Sequence
  chemically synthesized
ttacaggtactacgtgagaa

SEQ ID NO: 27279 - DNA, 20 bp, Artificial Sequence
  chemically synthesized
acaggtactacgtgagaaca

SEQ ID NO: 27280 - DNA, 20 bp, Artificial Sequence
  chemically synthesized
gtactacgtgagaacagaga

SEQ ID NO: 27281 - DNA, 20 bp, Artificial Sequence
  chemically synthesized
gaaagatgtacctaatgcta

SEQ ID NO: 27282 - DNA, 20 bp, Artificial Sequence
  chemically synthesized
agatgtacctaatgctacag

SEQ ID NO: 27283 - DNA, 20 bp, Artificial Sequence
  chemically synthesized
gatgtacctaatgctacaga

SEQ ID NO: 27284 - DNA, 20 bp, Artificial Sequence
  chemically synthesized
gtacctaatgctacagaagg

SEQ ID NO: 27285 - DNA, 20 bp, Artificial Sequence
  chemically synthesized
ctaatgctacagaaggaagt

SEQ ID NO: 27286 - DNA, 20 bp, Artificial Sequence
  chemically synthesized
taatgctacagaaggaagtc

SEQ ID NO: 27287 - DNA, 20 bp, Artificial Sequence
  chemically synthesized
atgctacagaaggaagtcag

SEQ ID NO: 27288 - DNA, 20 bp, Artificial Sequence
  chemically synthesized
gctacagaaggaagtcagga

SEQ ID NO: 27289 - DNA, 20 bp, Artificial Sequence
  chemically synthesized
ggaagtcaggagagatttga

SEQ ID NO: 27290 - DNA, 20 bp, Artificial Sequence
  chemically synthesized
agtcaggagagatttgacag

SEQ ID NO: 27291 - DNA, 20 bp, Artificial Sequence
  chemically synthesized
caggagagatttgacagaag

SEQ ID NO: 27292 - DNA, 20 bp, Artificial Sequence
  chemically synthesized
gaagaagtgatatttgtact

SEQ ID NO: 27293 - DNA, 20 bp, Artificial Sequence
  chemically synthesized
gatatttgtactaagtctta

SEQ ID NO: 27294 - DNA, 20 bp, Artificial Sequence
  chemically synthesized
atatttgtactaagtcttaa

SEQ ID NO: 27295 - DNA, 20 bp, Artificial Sequence
  chemically synthesized
ctaagtcttaaaggatccgc

SEQ ID NO: 27296 - DNA, 20 bp, Artificial Sequence
  chemically synthesized
aaggatccgcaagtgtttac

SEQ ID NO: 27297 - DNA, 20 bp, Artificial Sequence
  chemically synthesized
atccgcaagtgtttactggt

SEQ ID NO: 27298 - DNA, 20 bp, Artificial Sequence
  chemically synthesized
gtgtttactggttggaaaaa

SEQ ID NO: 27299 - DNA, 20 bp, Artificial Sequence
  chemically synthesized
tgtttactggttggaaaaac

SEQ ID NO: 27300 - DNA, 20 bp, Artificial Sequence
  chemically synthesized
gtttactggttggaaaaaca

SEQ ID NO: 27301 - DNA, 20 bp, Artificial Sequence
  chemically synthesized
tttactggttggaaaaacag

SEQ ID NO: 27302 - DNA, 20 bp, Artificial Sequence
  chemically synthesized
actggttggaaaaacagggg

SEQ ID NO: 27303 - DNA, 20 bp, Artificial Sequence
  chemically synthesized
aaacaggggtggtttttgcc

SEQ ID NO: 27304 - DNA, 20 bp, Artificial Sequence
  chemically synthesized
aggggtggtttttgccaaga

SEQ ID NO: 27305 - DNA, 20 bp, Artificial Sequence
  chemically synthesized
tgccaagaaagcaataaata

SEQ ID NO: 27306 - DNA, 20 bp, Artificial Sequence
  chemically synthesized
caagaaagcaataaatatag

SEQ ID NO: 27307 - DNA, 20 bp, Artificial Sequence
  chemically synthesized
aaatatagaagaataaaaac

SEQ ID NO: 27308 - DNA, 20 bp, Artificial Sequence
  chemically synthesized
tagaagaataaaaacaagaa

SEQ ID NO: 27309 - DNA, 20 bp, Artificial Sequence
  chemically synthesized
aaaaacaagaaaagtatgtg

SEQ ID NO: 27310 - DNA, 20 bp, Artificial Sequence
  chemically synthesized
aaaacaagaaaagtatgtgt

SEQ ID NO: 27311 - DNA, 20 bp, Artificial Sequence
  chemically synthesized
aaacaagaaaagtatgtgta

SEQ ID NO: 27312 - DNA, 20 bp, Artificial Sequence
  chemically synthesized
aaagtatgtgtagggaattg

SEQ ID NO: 27313 - DNA, 20 bp, Artificial Sequence
  chemically synthesized
aattgaagaaaaaaatgata

SEQ ID NO: 27314 - DNA, 20 bp, Artificial Sequence
  chemically synthesized
attgaagaaaaaaatgatat

SEQ ID NO: 27315 - DNA, 20 bp, Artificial Sequence
  chemically synthesized
aatgatatgggtgtgttgac

SEQ ID NO: 27316 - DNA, 20 bp, Artificial Sequence
  chemically synthesized
atgatatgggtgtgttgact

SEQ ID NO: 27317 - DNA, 20 bp, Artificial Sequence
  chemically synthesized
atgggtgtgttgactgggaa

SEQ ID NO: 27318 - DNA, 20 bp, Artificial Sequence
  chemically synthesized
gtgtgttgactgggaaaaga

SEQ ID NO: 27319 - DNA, 20 bp, Artificial Sequence
  chemically synthesized
tgtgttgactgggaaaagat

SEQ ID NO: 27320 - DNA, 20 bp, Artificial Sequence
  chemically synthesized
tgactgggaaaagatgggtt

SEQ ID NO: 27321 - DNA, 20 bp, Artificial Sequence
  chemically synthesized
tgggaaaagatgggtttgga

SEQ ID NO: 27322 - DNA, 20 bp, Artificial Sequence
  chemically synthesized
gggaaaagatgggtttggaa

SEQ ID NO: 27323 - DNA, 20 bp, Artificial Sequence
  chemically synthesized
gtttggaaaggtgccaaaac

SEQ ID NO: 27324 - DNA, 20 bp, Artificial Sequence
  chemically synthesized
tggaaaggtgccaaaacaag

SEQ ID NO: 27325 - DNA, 20 bp, Artificial Sequence
  chemically synthesized
ggaaaggtgccaaaacaaga

SEQ ID NO: 27326 - DNA, 20 bp, Artificial Sequence
  chemically synthesized
ggtgccaaaacaagaaggac

SEQ ID NO: 27327 - DNA, 20 bp, Artificial Sequence
  chemically synthesized
gtgccaaaacaagaaggacc

SEQ ID NO: 27328 - DNA, 20 bp, Artificial Sequence
  chemically synthesized
aaacaagaaggaccgggcta

SEQ ID NO: 27329 - DNA, 20 bp, Artificial Sequence
  chemically synthesized
aagaaggaccgggctaaaga

SEQ ID NO: 27330 - DNA, 20 bp, Artificial Sequence
  chemically synthesized
ccgggctaaagatggtgtta

SEQ ID NO: 27331 - DNA, 20 bp, Artificial Sequence
  chemically synthesized
cgggctaaagatggtgttac

SEQ ID NO: 27332 - DNA, 20 bp, Artificial Sequence
  chemically synthesized
gggctaaagatggtgttaca

SEQ ID NO: 27333 - DNA, 20 bp, Artificial Sequence
  chemically synthesized
gatggtgttacagggtgttt

SEQ ID NO: 27334 - DNA, 20 bp, Artificial Sequence
  chemically synthesized
atggtgttacagggtgtttg

SEQ ID NO: 27335 - DNA, 20 bp, Artificial Sequence
  chemically synthesized
tacagggtgtttgaggctac

SEQ ID NO: 27336 - DNA, 20 bp, Artificial Sequence
  chemically synthesized
acagggtgtttgaggctacc

SEQ ID NO: 27337 - DNA, 20 bp, Artificial Sequence
  chemically synthesized
cagggtgtttgaggctacca

SEQ ID NO: 27338 - DNA, 20 bp, Artificial Sequence
  chemically synthesized
gaggctaccagggccatgca

SEQ ID NO: 27339 - DNA, 20 bp, Artificial Sequence
  chemically synthesized
ggctaccagggccatgcata

SEQ ID NO: 27340 - DNA, 20 bp, Artificial Sequence
  chemically synthesized
ctaccagggccatgcataga

SEQ ID NO: 27341 - DNA, 20 bp, Artificial Sequence
  chemically synthesized
gggccatgcatagagagaca

SEQ ID NO: 27342 - DNA, 20 bp, Artificial Sequence
  chemically synthesized
ggccatgcatagagagacaa

SEQ ID NO: 27343 - DNA, 20 bp, Artificial Sequence
  chemically synthesized
tcctgattttcgctcactac

SEQ ID NO: 27344 - DNA, 20 bp, Artificial Sequence
  chemically synthesized
cctgattttcgctcactacc

SEQ ID NO: 27345 - DNA, 20 bp, Artificial Sequence
  chemically synthesized
tttcgctcactaccaggcct

SEQ ID NO: 27346 - DNA, 20 bp, Artificial Sequence
  chemically synthesized
ttcgctcactaccaggcctt

SEQ ID NO: 27347 - DNA, 20 bp, Artificial Sequence
  chemically synthesized
gatgattgtttacctttttg

SEQ ID NO: 27348 - DNA, 20 bp, Artificial Sequence
  chemically synthesized
tttgtagttttctccttgtg

SEQ ID NO: 27349 - DNA, 20 bp, Artificial Sequence
  chemically synthesized
gtagttttctccttgtgaag

SEQ ID NO: 27350 - DNA, 20 bp, Artificial Sequence
  chemically synthesized
agtagtaataaaatgtttca

SEQ ID NO: 27351 - DNA, 20 bp, Artificial Sequence
  chemically synthesized
gaaatattcatgattatgtc

SEQ ID NO: 27352 - DNA, 20 bp, Artificial Sequence
  chemically synthesized
tgattatgtcaagcttttca

SEQ ID NO: 27353 - DNA, 20 bp, Artificial Sequence
  chemically synthesized
cacagcatctaaatcatgta

SEQ ID NO: 27354 - DNA, 20 bp, Artificial Sequence
  chemically synthesized
catgtatggcctcaataaat

SEQ ID NO: 27355 - DNA, 20 bp, Artificial Sequence
  chemically synthesized
aataaattggactatcacca

SEQ ID NO: 27356 - DNA, 20 bp, Artificial Sequence
  chemically synthesized
tatcaccacagatcttttac

SEQ ID NO: 27357 - DNA, 20 bp, Artificial Sequence
  chemically synthesized
tttgaactttattctaatga

SEQ ID NO: 27358 - DNA, 20 bp, Artificial Sequence
  chemically synthesized
ttgaactttattctaatgat

SEQ ID NO: 27359 - DNA, 20 bp, Artificial Sequence
  chemically synthesized
gaactttattctaatgatag

SEQ ID NO: 27360 - DNA, 20 bp, Artificial Sequence
  chemically synthesized
tctaatgataggagctactg

SEQ ID NO: 27361 - DNA, 20 bp, Artificial Sequence
  chemically synthesized
agctactgaagtactgaaaa

SEQ ID NO: 27362 - DNA, 20 bp, Artificial Sequence
  chemically synthesized
ctgaagtactgaaaacagtg

SEQ ID NO: 27363 - DNA, 20 bp, Artificial Sequence
  chemically synthesized
gaaaacagtgcagtgattca

SEQ ID NO: 27364 - DNA, 20 bp, Artificial Sequence
  chemically synthesized
aaacagtgcagtgattcata

SEQ ID NO: 27365 - DNA, 20 bp, Artificial Sequence
  chemically synthesized
agtgcagtgattcatagagt

SEQ ID NO: 27366 - DNA, 20 bp, Artificial Sequence
  chemically synthesized
tagtactttctgcataatct

SEQ ID NO: 27367 - DNA, 20 bp, Artificial Sequence
  chemically synthesized
tactttctgcataatctcgg

SEQ ID NO: 27368 - DNA, 20 bp, Artificial Sequence
  chemically synthesized
ctgcataatctcggtggctg

SEQ ID NO: 27369 - DNA, 20 bp, Artificial Sequence
  chemically synthesized
cataatctcggtggctgcag

SEQ ID NO: 27370 - DNA, 20 bp, Artificial Sequence
  chemically synthesized
taatctcggtggctgcagta

SEQ ID NO: 27371 - DNA, 20 bp, Artificial Sequence
  chemically synthesized
aatctcggtggctgcagtag

SEQ ID NO: 27372 - DNA, 20 bp, Artificial Sequence
  chemically synthesized
tcggtggctgcagtagagga

SEQ ID NO: 27373 - DNA, 20 bp, Artificial Sequence
  chemically synthesized
gctgcagtagaggatggacc

SEQ ID NO: 27374 - DNA, 20 bp, Artificial Sequence
  chemically synthesized
ctgcagtagaggatggacca

SEQ ID NO: 27375 - DNA, 20 bp, Artificial Sequence
  chemically synthesized
tgcagtagaggatggaccaa

SEQ ID NO: 27376 - DNA, 20 bp, Artificial Sequence
  chemically synthesized
agtagaggatggaccaaggg

SEQ ID NO: 27377 - DNA, 20 bp, Artificial Sequence
  chemically synthesized
gtagaggatggaccaaggga

SEQ ID NO: 27378 - DNA, 20 bp, Artificial Sequence
  chemically synthesized
agaggatggaccaagggaag

SEQ ID NO: 27379 - DNA, 20 bp, Artificial Sequence
  chemically synthesized
gaggatggaccaagggaagg

SEQ ID NO: 27380 - DNA, 20 bp, Artificial Sequence
  chemically synthesized
ggatggaccaagggaaggag

SEQ ID NO: 27381 - DNA, 20 bp, Artificial Sequence
  chemically synthesized
gaccaagggaaggaggagcc

SEQ ID NO: 27382 - DNA, 20 bp, Artificial Sequence
  chemically synthesized
tggctttgcatgttgaatga

SEQ ID NO: 27383 - DNA, 20 bp, Artificial Sequence
  chemically synthesized
ggctttgcatgttgaatgac

SEQ ID NO: 27384 - DNA, 20 bp, Artificial Sequence
  chemically synthesized
ttgcatgttgaatgacaggt

SEQ ID NO: 27385 - DNA, 20 bp, Artificial Sequence
  chemically synthesized
tgcatgttgaatgacaggtc

SEQ ID NO: 27386 - DNA, 20 bp, Artificial Sequence
  chemically synthesized
tgttgaatgacaggtcaggc

SEQ ID NO: 27387 - DNA, 20 bp, Artificial Sequence
  chemically synthesized
tgaatgacaggtcaggcaag

SEQ ID NO: 27388 - DNA, 20 bp, Artificial Sequence
  chemically synthesized
gaatgacaggtcaggcaagc

SEQ ID NO: 27389 - DNA, 20 bp, Artificial Sequence
  chemically synthesized
acaggtcaggcaagcaggtg

SEQ ID NO: 27390 - DNA, 20 bp, Artificial Sequence
  chemically synthesized
tcaggcaagcaggtgtggaa

SEQ ID NO: 27391 - DNA, 20 bp, Artificial Sequence
  chemically synthesized
caagcaggtgtggaaaagct

SEQ ID NO: 27392 - DNA, 20 bp, Artificial Sequence
  chemically synthesized
ggtgtggaaaagctaagaac

SEQ ID NO: 27393 - DNA, 20 bp, Artificial Sequence
  chemically synthesized
gtgtggaaaagctaagaaca

SEQ ID NO: 27394 - DNA, 20 bp, Artificial Sequence
  chemically synthesized
aaagctaagaacaaggacat

SEQ ID NO: 27395 - DNA, 20 bp, Artificial Sequence
  chemically synthesized
aagaacaaggacattggcta

SEQ ID NO: 27396 - DNA, 20 bp, Artificial Sequence
  chemically synthesized
gaacaaggacattggctaca

SEQ ID NO: 27397 - DNA, 20 bp, Artificial Sequence
  chemically synthesized
ggacattggctacagagatg

SEQ ID NO: 27398 - DNA, 20 bp, Artificial Sequence
  chemically synthesized
gctacagagatgaagatgaa

SEQ ID NO: 27399 - DNA, 20 bp, Artificial Sequence
  chemically synthesized
agatgaagatgaatagatta

SEQ ID NO: 27400 - DNA, 20 bp, Artificial Sequence
  chemically synthesized
gatgaagatgaatagattac

SEQ ID NO: 27401 - DNA, 20 bp, Artificial Sequence
  chemically synthesized
atgaagatgaatagattaca

SEQ ID NO: 27402 - DNA, 20 bp, Artificial Sequence
  chemically synthesized
agatgaatagattacaggga

SEQ ID NO: 27403 - DNA, 20 bp, Artificial Sequence
  chemically synthesized
agattacagggatagattaa

SEQ ID NO: 27404 - DNA, 20 bp, Artificial Sequence
  chemically synthesized
agggatagattaaaagaact

SEQ ID NO: 27405 - DNA, 20 bp, Artificial Sequence
  chemically synthesized
aaaagaacttagttaaaaat

SEQ ID NO: 27406 - DNA, 20 bp, Artificial Sequence
  chemically synthesized
acttagttaaaaattagata

SEQ ID NO: 27407 - DNA, 20 bp, Artificial Sequence
  chemically synthesized
agttaaaaattagatacaga

SEQ ID NO: 27408 - DNA, 20 bp, Artificial Sequence
  chemically synthesized
ttaaaaattagatacagaaa

SEQ ID NO: 27409 - DNA, 20 bp, Artificial Sequence
  chemically synthesized
taaaaattagatacagaaag

SEQ ID NO: 27410 - DNA, 20 bp, Artificial Sequence
  chemically synthesized
aaaaattagatacagaaaga

SEQ ID NO: 27411 - DNA, 20 bp, Artificial Sequence
  chemically synthesized
aaattagatacagaaagagg

SEQ ID NO: 27412 - DNA, 20 bp, Artificial Sequence
  chemically synthesized
attagatacagaaagaggga

SEQ ID NO: 27413 - DNA, 20 bp, Artificial Sequence
  chemically synthesized
ttagatacagaaagagggag

SEQ ID NO: 27414 - DNA, 20 bp, Artificial Sequence
  chemically synthesized
tagatacagaaagagggaga

SEQ ID NO: 27415 - DNA, 20 bp, Artificial Sequence
  chemically synthesized
acagaaagagggagagggtt

SEQ ID NO: 27416 - DNA, 20 bp, Artificial Sequence
  chemically synthesized
gaaagagggagagggttgag

SEQ ID NO: 27417 - DNA, 20 bp, Artificial Sequence
  chemically synthesized
aagagggagagggttgagta

SEQ ID NO: 27418 - DNA, 20 bp, Artificial Sequence
  chemically synthesized
gagagggttgagtagagcat

SEQ ID NO: 27419 - DNA, 20 bp, Artificial Sequence
  chemically synthesized
ctcaaaaatgttgtcttgaa

SEQ ID NO: 27420 - DNA, 20 bp, Artificial Sequence
  chemically synthesized
aaaaatgttgtcttgaatgg

SEQ ID NO: 27421 - DNA, 20 bp, Artificial Sequence
  chemically synthesized
aaaatgttgtcttgaatggc

SEQ ID NO: 27422 - DNA, 20 bp, Artificial Sequence
  chemically synthesized
ttgtcttgaatggcaggaaa

SEQ ID NO: 27423 - DNA, 20 bp, Artificial Sequence
  chemically synthesized
tataaaaaatgcataaatat

SEQ ID NO: 27424 - DNA, 20 bp, Artificial Sequence
  chemically synthesized
aaaaaatgcataaatatgag

SEQ ID NO: 27425 - DNA, 20 bp, Artificial Sequence
  chemically synthesized
tgcataaatatgagaagaat

SEQ ID NO: 27426 - DNA, 20 bp, Artificial Sequence
  chemically synthesized
gcataaatatgagaagaatc

SEQ ID NO: 27427 - DNA, 20 bp, Artificial Sequence
  chemically synthesized
tgagaagaatcaggtgtgaa

SEQ ID NO: 27428 - DNA, 20 bp, Artificial Sequence
  chemically synthesized
aagaatcaggtgtgaaaaga

SEQ ID NO: 27429 - DNA, 20 bp, Artificial Sequence
  chemically synthesized
aggtgtgaaaagatggatgc

SEQ ID NO: 27430 - DNA, 20 bp, Artificial Sequence
  chemically synthesized
ggtgtgaaaagatggatgct

SEQ ID NO: 27431 - DNA, 20 bp, Artificial Sequence
  chemically synthesized
atggatgctgggctcaatat

SEQ ID NO: 27432 - DNA, 20 bp, Artificial Sequence
  chemically synthesized
ggctcaatattagacgtgtt

SEQ ID NO: 27433 - DNA, 20 bp, Artificial Sequence
  chemically synthesized
ttagacgtgttgagtttcat

SEQ ID NO: 27434 - DNA, 20 bp, Artificial Sequence
  chemically synthesized
gagtttcatcagtatccttt

SEQ ID NO: 27435 - DNA, 20 bp, Artificial Sequence
  chemically synthesized
agtatccttttggaaacacc

SEQ ID NO: 27436 - DNA, 20 bp, Artificial Sequence
  chemically synthesized
tccttttggaaacacctagt

SEQ ID NO: 27437 - DNA, 20 bp, Artificial Sequence
  chemically synthesized
ttttggaaacacctagtgag

SEQ ID NO: 27438 - DNA, 20 bp, Artificial Sequence
  chemically synthesized
tttggaaacacctagtgaga

SEQ ID NO: 27439 - DNA, 20 bp, Artificial Sequence
  chemically synthesized
ggaaacacctagtgagaagg

SEQ ID NO: 27440 - DNA, 20 bp, Artificial Sequence
  chemically synthesized
ctagtgagaaggcagaaact

SEQ ID NO: 27441 - DNA, 20 bp, Artificial Sequence
  chemically synthesized
tagtgagaaggcagaaactc

SEQ ID NO: 27442 - DNA, 20 bp, Artificial Sequence
  chemically synthesized
aactcaggcctgatatgtaa

SEQ ID NO: 27443 - DNA, 20 bp, Artificial Sequence
  chemically synthesized
ctcaggcctgatatgtaacg

SEQ ID NO: 27444 - DNA, 20 bp, Artificial Sequence
  chemically synthesized
tgatatgtaacggagttatc

SEQ ID NO: 27445 - DNA, 20 bp, Artificial Sequence
  chemically synthesized
tgtaacggagttatctggac

SEQ ID NO: 27446 - DNA, 20 bp, Artificial Sequence
  chemically synthesized
taacggagttatctggacta

SEQ ID NO: 27447 - DNA, 20 bp, Artificial Sequence
  chemically synthesized
tggactagagattaatgtct

SEQ ID NO: 27448 - DNA, 20 bp, Artificial Sequence
  chemically synthesized
gactagagattaatgtctaa

SEQ ID NO: 27449 - DNA, 20 bp, Artificial Sequence
  chemically synthesized
tctaagagccaccactgtat

SEQ ID NO: 27450 - DNA, 20 bp, Artificial Sequence
  chemically synthesized
tgtataagtaataataataa

SEQ ID NO: 27451 - DNA, 20 bp, Artificial Sequence
  chemically synthesized
taatagataatataatgaat

SEQ ID NO: 27452 - DNA, 20 bp, Artificial Sequence
  chemically synthesized
tagataatataatgaatgag

SEQ ID NO: 27453 - DNA, 20 bp, Artificial Sequence
  chemically synthesized
aatataatgaatgagaagtt

SEQ ID NO: 27454 - DNA, 20 bp, Artificial Sequence
  chemically synthesized
atataatgaatgagaagtta

SEQ ID NO: 27455 - DNA, 20 bp, Artificial Sequence
  chemically synthesized
aatgagaagttaaggtgttc

SEQ ID NO: 27456 - DNA, 20 bp, Artificial Sequence
  chemically synthesized
atgagaagttaaggtgttca

SEQ ID NO: 27457 - DNA, 20 bp, Artificial Sequence
  chemically synthesized
gaagttaaggtgttcaagga

SEQ ID NO: 27458 - DNA, 20 bp, Artificial Sequence
  chemically synthesized
actgaataacataaatattt

SEQ ID NO: 27459 - DNA, 20 bp, Artificial Sequence
  chemically synthesized
taacataaatatttgagcaa

SEQ ID NO: 27460 - DNA, 20 bp, Artificial Sequence
  chemically synthesized
aatatttgagcaatggaaat

SEQ ID NO: 27461 - DNA, 20 bp, Artificial Sequence
  chemically synthesized
tatttgagcaatggaaataa

SEQ ID NO: 27462 - DNA, 20 bp, Artificial Sequence
  chemically synthesized
tttgagcaatggaaataaga

SEQ ID NO: 27463 - DNA, 20 bp, Artificial Sequence
  chemically synthesized
aatggaaataagagagtgca

SEQ ID NO: 27464 - DNA, 20 bp, Artificial Sequence
  chemically synthesized
ggaaataagagagtgcatag

SEQ ID NO: 27465 - DNA, 20 bp, Artificial Sequence
  chemically synthesized
atagaagctatcacaaaaat

SEQ ID NO: 27466 - DNA, 20 bp, Artificial Sequence
  chemically synthesized
gaagctatcacaaaaatcag

SEQ ID NO: 27467 - DNA, 20 bp, Artificial Sequence
  chemically synthesized
agctatcacaaaaatcagaa

SEQ ID NO: 27468 - DNA, 20 bp, Artificial Sequence
  chemically synthesized
cacaaaaatcagaagagaac

SEQ ID NO: 27469 - DNA, 20 bp, Artificial Sequence
  chemically synthesized
aaaaatcagaagagaaccag

SEQ ID NO: 27470 - DNA, 20 bp, Artificial Sequence
  chemically synthesized
agaagagaaccagcagatct

SEQ ID NO: 27471 - DNA, 20 bp, Artificial Sequence
  chemically synthesized
aaccagcagatcttggcatt

SEQ ID NO: 27472 - DNA, 20 bp, Artificial Sequence
  chemically synthesized
atcttggcattaagaatttc

SEQ ID NO: 27473 - DNA, 20 bp, Artificial Sequence
  chemically synthesized
cttggcattaagaatttcta

SEQ ID NO: 27474 - DNA, 20 bp, Artificial Sequence
  chemically synthesized
tggcattaagaatttctaga

SEQ ID NO: 27475 - DNA, 20 bp, Artificial Sequence
  chemically synthesized
gcattaagaatttctagaga

SEQ ID NO: 27476 - DNA, 20 bp, Artificial Sequence
  chemically synthesized
tttctagagagagctctaaa

SEQ ID NO: 27477 - DNA, 20 bp, Artificial Sequence
  chemically synthesized
ttctagagagagctctaaaa

SEQ ID NO: 27478 - DNA, 20 bp, Artificial Sequence
  chemically synthesized
tagagagagctctaaaaagg

SEQ ID NO: 27479 - DNA, 20 bp, Artificial Sequence
  chemically synthesized
agagagagctctaaaaagga

SEQ ID NO: 27480 - DNA, 20 bp, Artificial Sequence
  chemically synthesized
gagctctaaaaaggaaggca

SEQ ID NO: 27481 - DNA, 20 bp, Artificial Sequence
  chemically synthesized
tctaaaaaggaaggcatggc

SEQ ID NO: 27482 - DNA, 20 bp, Artificial Sequence
  chemically synthesized
taaaaaggaaggcatggcca

SEQ ID NO: 27483 - DNA, 20 bp, Artificial Sequence
  chemically synthesized
ttgcacaaaaaaatcaataa

SEQ ID NO: 27484 - DNA, 20 bp, Artificial Sequence
  chemically synthesized
cacaaaaaaatcaataaaag

SEQ ID NO: 27485 - DNA, 20 bp, Artificial Sequence
  chemically synthesized
acaaaaaaatcaataaaagc

SEQ ID NO: 27486 - DNA, 20 bp, Artificial Sequence
  chemically synthesized
caataaaagcaggtatgatt

SEQ ID NO: 27487 - DNA, 20 bp, Artificial Sequence
  chemically synthesized
ttaagactctccattgcatt

SEQ ID NO: 27488 - DNA, 20 bp, Artificial Sequence
  chemically synthesized
tctccattgcatttggcccc

SEQ ID NO: 27489 - DNA, 20 bp, Artificial Sequence
  chemically synthesized
ccattgcatttggcccctag

SEQ ID NO: 27490 - DNA, 20 bp, Artificial Sequence
  chemically synthesized
atttggcccctagaagtcac

SEQ ID NO: 27491 - DNA, 20 bp, Artificial Sequence
  chemically synthesized
tagaagtcactggtgaattt

SEQ ID NO: 27492 - DNA, 20 bp, Artificial Sequence
  chemically synthesized
agaagtcactggtgaattta

SEQ ID NO: 27493 - DNA, 20 bp, Artificial Sequence
  chemically synthesized
aagtcactggtgaatttaag

SEQ ID NO: 27494 - DNA, 20 bp, Artificial Sequence
  chemically synthesized
gaatttaaggagcattgctt

SEQ ID NO: 27495 - DNA, 20 bp, Artificial Sequence
  chemically synthesized
taaggagcattgctttagct

SEQ ID NO: 27496 - DNA, 20 bp, Artificial Sequence
  chemically synthesized
ggagcattgctttagctaag

SEQ ID NO: 27497 - DNA, 20 bp, Artificial Sequence
  chemically synthesized
gagcattgctttagctaagt

SEQ ID NO: 27498 - DNA, 20 bp, Artificial Sequence
  chemically synthesized
gggttttaaaaaaaacatta

SEQ ID NO: 27499 - DNA, 20 bp, Artificial Sequence
  chemically synthesized
ggttttaaaaaaaacattat

SEQ ID NO: 27500 - DNA, 20 bp, Artificial Sequence
  chemically synthesized
gttttaaaaaaaacattata

SEQ ID NO: 27501 - DNA, 20 bp, Artificial Sequence
  chemically synthesized
ttaaaaaaaacattataggg

SEQ ID NO: 27502 - DNA, 20 bp, Artificial Sequence
  chemically synthesized
aaaaaacattatagggtggt

SEQ ID NO: 27503 - DNA, 20 bp, Artificial Sequence
  chemically synthesized
acattatagggtggttggtt

SEQ ID NO: 27504 - DNA, 20 bp, Artificial Sequence
  chemically synthesized
ttatagggtggttggttgag

SEQ ID NO: 27505 - DNA, 20 bp, Artificial Sequence
  chemically synthesized
ggttggttgagtagtaaact

SEQ ID NO: 27506 - DNA, 20 bp, Artificial Sequence
  chemically synthesized
tggttgagtagtaaactgag

SEQ ID NO: 27507 - DNA, 20 bp, Artificial Sequence
  chemically synthesized
gagtagtaaactgagaagta

SEQ ID NO: 27508 - DNA, 20 bp, Artificial Sequence
  chemically synthesized
taaactgagaagtaaagaaa

SEQ ID NO: 27509 - DNA, 20 bp, Artificial Sequence
  chemically synthesized
tgagaagtaaagaaatggaa

SEQ ID NO: 27510 - DNA, 20 bp, Artificial Sequence
  chemically synthesized
agaaatggaaaagataaatg

SEQ ID NO: 27511 - DNA, 20 bp, Artificial Sequence
  chemically synthesized
ctattttttaccccttgcca

SEQ ID NO: 27512 - DNA, 20 bp, Artificial Sequence
  chemically synthesized
accccttgccaaagtgatgt

SEQ ID NO: 27513 - DNA, 20 bp, Artificial Sequence
  chemically synthesized
atgtaagccttatatccatg

SEQ ID NO: 27514 - DNA, 20 bp, Artificial Sequence
  chemically synthesized
gcacctctgctctcaactcg

SEQ ID NO: 27515 - DNA, 20 bp, Artificial Sequence
  chemically synthesized
gctctcaactcgaagctcac

SEQ ID NO: 27516 - DNA, 20 bp, Artificial Sequence
  chemically synthesized
cacaagtataataaaattca

SEQ ID NO: 27517 - DNA, 20 bp, Artificial Sequence
  chemically synthesized
aagtataataaaattcaaag

SEQ ID NO: 27518 - DNA, 20 bp, Artificial Sequence
  chemically synthesized
aagtagcttgcgtgacctgc

SEQ ID NO: 27519 - DNA, 20 bp, Artificial Sequence
  chemically synthesized
ctgcaagatcatacatgacg

SEQ ID NO: 27520 - DNA, 20 bp, Artificial Sequence
  chemically synthesized
atcatacatgacgtagcatt

SEQ ID NO: 27521 - DNA, 20 bp, Artificial Sequence
  chemically synthesized
tagcatttagctgctacttc

SEQ ID NO: 27522 - DNA, 20 bp, Artificial Sequence
  chemically synthesized
catttagctgctacttcaag

SEQ ID NO: 27523 - DNA, 20 bp, Artificial Sequence
  chemically synthesized
ttcctccattgaatatacat

SEQ ID NO: 27524 - DNA, 20 bp, Artificial Sequence
  chemically synthesized
ttttgtcttttaaacttgtc

SEQ ID NO: 27525 - DNA, 20 bp, Artificial Sequence
  chemically synthesized
tgtcaagctgctctctgctt

SEQ ID NO: 27526 - DNA, 20 bp, Artificial Sequence
  chemically synthesized
gtcaagctgctctctgcttc

SEQ ID NO: 27527 - DNA, 20 bp, Artificial Sequence
  chemically synthesized
ttccttgaatgtttttccct

SEQ ID NO: 27528 - DNA, 20 bp, Artificial Sequence
  chemically synthesized
ttgaatgtttttccctaaga

SEQ ID NO: 27529 - DNA, 20 bp, Artificial Sequence
  chemically synthesized
cttctctaaaattacctact

SEQ ID NO: 27530 - DNA, 20 bp, Artificial Sequence
  chemically synthesized
tctctaaaattacctactca

SEQ ID NO: 27531 - DNA, 20 bp, Artificial Sequence
  chemically synthesized
tctaaaattacctactcaga

SEQ ID NO: 27532 - DNA, 20 bp, Artificial Sequence
  chemically synthesized
ctaaaattacctactcagag

SEQ ID NO: 27533 - DNA, 20 bp, Artificial Sequence
  chemically synthesized
cattacattaccttgcattg

SEQ ID NO: 27534 - DNA, 20 bp, Artificial Sequence
  chemically synthesized
gtttctgttcattgtatttt

SEQ ID NO: 27535 - DNA, 20 bp, Artificial Sequence
  chemically synthesized
ttcattgtattttcagtacc

SEQ ID NO: 27536 - DNA, 20 bp, Artificial Sequence
  chemically synthesized
tcattgtattttcagtacct

SEQ ID NO: 27537 - DNA, 20 bp, Artificial Sequence
  chemically synthesized
ttttcagtacctaggtgtaa

SEQ ID NO: 27538 - DNA, 20 bp, Artificial Sequence
  chemically synthesized
cctaggtgtaaaagtaattg

SEQ ID NO: 27539 - DNA, 20 bp, Artificial Sequence
  chemically synthesized
attgcagttcttgccattga

SEQ ID NO: 27540 - DNA, 20 bp, Artificial Sequence
  chemically synthesized
gttcttgccattgaaagtaa

SEQ ID NO: 27541 - DNA, 20 bp, Artificial Sequence
  chemically synthesized
ttacttttgcaccaacctaa

SEQ ID NO: 27542 - DNA, 20 bp, Artificial Sequence
  chemically synthesized
attgaaataattattgaaat

SEQ ID NO: 27543 - DNA, 20 bp, Artificial Sequence
  chemically synthesized
aattattgaaataagattaa

SEQ ID NO: 27544 - DNA, 20 bp, Artificial Sequence
  chemically synthesized
atttattcaaataatattta

SEQ ID NO: 27545 - DNA, 20 bp, Artificial Sequence
  chemically synthesized
tttattcaaataatatttaa

SEQ ID NO: 27546 - DNA, 20 bp, Artificial Sequence
  chemically synthesized
tttaaaggattccaatgata

SEQ ID NO: 27547 - DNA, 20 bp, Artificial Sequence
  chemically synthesized
aaaggattccaatgatatgg

SEQ ID NO: 27548 - DNA, 20 bp, Artificial Sequence
  chemically synthesized
caatgatatggtggctaaaa

SEQ ID NO: 27549 - DNA, 20 bp, Artificial Sequence
  chemically synthesized
tggctaaaaaagtcaatccc

SEQ ID NO: 27550 - DNA, 20 bp, Artificial Sequence
  chemically synthesized
gctaaaaaagtcaatcccta

SEQ ID NO: 27551 - DNA, 20 bp, Artificial Sequence
  chemically synthesized
agctaatattaaaattaaaa

SEQ ID NO: 27552 - DNA, 20 bp, Artificial Sequence
  chemically synthesized
ctaatattaaaattaaaaaa

SEQ ID NO: 27553 - DNA, 20 bp, Artificial Sequence
  chemically synthesized
tattaaaattaaaaaagaga

SEQ ID NO: 27554 - DNA, 20 bp, Artificial Sequence
  chemically synthesized
aattaaaaaagagacagtca

SEQ ID NO: 27555 - DNA, 20 bp, Artificial Sequence
  chemically synthesized
cagtcatggtttatgtccac

SEQ ID NO: 27556 - DNA, 20 bp, Artificial Sequence
  chemically synthesized
agtcatggtttatgtccaca

SEQ ID NO: 27557 - DNA, 20 bp, Artificial Sequence
  chemically synthesized
tccacaaggaattcacatta

SEQ ID NO: 27558 - DNA, 20 bp, Artificial Sequence
  chemically synthesized
acaaggaattcacattatag

SEQ ID NO: 27559 - DNA, 20 bp, Artificial Sequence
  chemically synthesized
ttcacattatagaagcaata

SEQ ID NO: 27560 - DNA, 20 bp, Artificial Sequence
  chemically synthesized
tacagaaattgacaatgctg

SEQ ID NO: 27561 - DNA, 20 bp, Artificial Sequence
  chemically synthesized
acagaaattgacaatgctgc

SEQ ID NO: 27562 - DNA, 20 bp, Artificial Sequence
  chemically synthesized
cagaaattgacaatgctgca

SEQ ID NO: 27563 - DNA, 20 bp, Artificial Sequence
  chemically synthesized
atgctgcagggaaaatatca

SEQ ID NO: 27564 - DNA, 20 bp, Artificial Sequence
  chemically synthesized
agggaaaatatcatggtaat

SEQ ID NO: 27565 - DNA, 20 bp, Artificial Sequence
  chemically synthesized
atatcatggtaattagtgca

SEQ ID NO: 27566 - DNA, 20 bp, Artificial Sequence
  chemically synthesized
aattagtgcatagtgaacta

SEQ ID NO: 27567 - DNA, 20 bp, Artificial Sequence
  chemically synthesized
attagtgcatagtgaactac

SEQ ID NO: 27568 - DNA, 20 bp, Artificial Sequence
  chemically synthesized
tagtgaactacaggaacaca

SEQ ID NO: 27569 - DNA, 20 bp, Artificial Sequence
  chemically synthesized
agtgaactacaggaacacat

SEQ ID NO: 27570 - DNA, 20 bp, Artificial Sequence
  chemically synthesized
tgaactacaggaacacatag

SEQ ID NO: 27571 - DNA, 20 bp, Artificial Sequence
  chemically synthesized
aactacaggaacacatagga

SEQ ID NO: 27572 - DNA, 20 bp, Artificial Sequence
  chemically synthesized
actacaggaacacataggag

SEQ ID NO: 27573 - DNA, 20 bp, Artificial Sequence
  chemically synthesized
ctacaggaacacataggaga

SEQ ID NO: 27574 - DNA, 20 bp, Artificial Sequence
  chemically synthesized
gagggtattcaaactaaact

SEQ ID NO: 27575 - DNA, 20 bp, Artificial Sequence
  chemically synthesized
agggtattcaaactaaactt

SEQ ID NO: 27576 - DNA, 20 bp, Artificial Sequence
  chemically synthesized
gggtattcaaactaaacttg

SEQ ID NO: 27577 - DNA, 20 bp, Artificial Sequence
  chemically synthesized
aaactaaacttggggaattt

SEQ ID NO: 27578 - DNA, 20 bp, Artificial Sequence
  chemically synthesized
ctaaacttggggaatttaag

SEQ ID NO: 27579 - DNA, 20 bp, Artificial Sequence
  chemically synthesized
taaacttggggaatttaaga

SEQ ID NO: 27580 - DNA, 20 bp, Artificial Sequence
  chemically synthesized
gaatttaagaaggccttctg

SEQ ID NO: 27581 - DNA, 20 bp, Artificial Sequence
  chemically synthesized
aatttaagaaggccttctga

SEQ ID NO: 27582 - DNA, 20 bp, Artificial Sequence
  chemically synthesized
ttctgaaggacatcatatct

SEQ ID NO: 27583 - DNA, 20 bp, Artificial Sequence
  chemically synthesized
aaggacatcatatctaagct

SEQ ID NO: 27584 - DNA, 20 bp, Artificial Sequence
  chemically synthesized
aggacatcatatctaagcta

SEQ ID NO: 27585 - DNA, 20 bp, Artificial Sequence
  chemically synthesized
acatcatatctaagctaagg

SEQ ID NO: 27586 - DNA, 20 bp, Artificial Sequence
  chemically synthesized
catcatatctaagctaaggt

SEQ ID NO: 27587 - DNA, 20 bp, Artificial Sequence
  chemically synthesized
taagctaaggtgggttatat

SEQ ID NO: 27588 - DNA, 20 bp, Artificial Sequence
  chemically synthesized
gctaaggtgggttatattag

SEQ ID NO: 27589 - DNA, 20 bp, Artificial Sequence
  chemically synthesized
aaggtgggttatattagtag

SEQ ID NO: 27590 - DNA, 20 bp, Artificial Sequence
  chemically synthesized
ttatattagtagaagttaac

SEQ ID NO: 27591 - DNA, 20 bp, Artificial Sequence
  chemically synthesized
tagtagaagttaactagaca

SEQ ID NO: 27592 - DNA, 20 bp, Artificial Sequence
  chemically synthesized
aagttaactagacaaagatt

SEQ ID NO: 27593 - DNA, 20 bp, Artificial Sequence
  chemically synthesized
agttaactagacaaagatta

SEQ ID NO: 27594 - DNA, 20 bp, Artificial Sequence
  chemically synthesized
gttaactagacaaagattaa

SEQ ID NO: 27595 - DNA, 20 bp, Artificial Sequence
  chemically synthesized
actagacaaagattaaggga

SEQ ID NO: 27596 - DNA, 20 bp, Artificial Sequence
  chemically synthesized
agattaagggaaagctattt

SEQ ID NO: 27597 - DNA, 20 bp, Artificial Sequence
  chemically synthesized
gattaagggaaagctatttc

SEQ ID NO: 27598 - DNA, 20 bp, Artificial Sequence
  chemically synthesized
aggaaaaaatgtttttattc

SEQ ID NO: 27599 - DNA, 20 bp, Artificial Sequence
  chemically synthesized
ggaaaaaatgtttttattcc

SEQ ID NO: 27600 - DNA, 20 bp, Artificial Sequence
  chemically synthesized
aaaaatgtttttattccagg

SEQ ID NO: 27601 - DNA, 20 bp, Artificial Sequence
  chemically synthesized
aaatacaaatgtttacctat

SEQ ID NO: 27602 - DNA, 20 bp, Artificial Sequence
  chemically synthesized
acaaatgtttacctatgagc

SEQ ID NO: 27603 - DNA, 20 bp, Artificial Sequence
  chemically synthesized
ttacctatgagcaagcatac

SEQ ID NO: 27604 - DNA, 20 bp, Artificial Sequence
  chemically synthesized
agcaagcatactagataaac

SEQ ID NO: 27605 - DNA, 20 bp, Artificial Sequence
  chemically synthesized
aagcatactagataaactgg

SEQ ID NO: 27606 - DNA, 20 bp, Artificial Sequence
  chemically synthesized
gataaactggaagaattgtt

SEQ ID NO: 27607 - DNA, 20 bp, Artificial Sequence
  chemically synthesized
tcattaacaccgtgaatata

SEQ ID NO: 27608 - DNA, 20 bp, Artificial Sequence
  chemically synthesized
attaacaccgtgaatataca

SEQ ID NO: 27609 - DNA, 20 bp, Artificial Sequence
  chemically synthesized
ttaacaccgtgaatatacag

SEQ ID NO: 27610 - DNA, 20 bp, Artificial Sequence
  chemically synthesized
cgtgaatatacagaggaaat

SEQ ID NO: 27611 - DNA, 20 bp, Artificial Sequence
  chemically synthesized
gtgaatatacagaggaaatt

SEQ ID NO: 27612 - DNA, 20 bp, Artificial Sequence
  chemically synthesized
atatacagaggaaattagga

SEQ ID NO: 27613 - DNA, 20 bp, Artificial Sequence
  chemically synthesized
cagaggaaattaggatagat

SEQ ID NO: 27614 - DNA, 20 bp, Artificial Sequence
  chemically synthesized
aattaggatagataagaaaa

SEQ ID NO: 27615 - DNA, 20 bp, Artificial Sequence
  chemically synthesized
attaggatagataagaaaat

SEQ ID NO: 27616 - DNA, 20 bp, Artificial Sequence
  chemically synthesized
ataagaaaataggatataca

SEQ ID NO: 27617 - DNA, 20 bp, Artificial Sequence
  chemically synthesized
aagaaaataggatatacacg

SEQ ID NO: 27618 - DNA, 20 bp, Artificial Sequence
  chemically synthesized
gaaaataggatatacacgga

SEQ ID NO: 27619 - DNA, 20 bp, Artificial Sequence
  chemically synthesized
gatatacacggagagaaaat

SEQ ID NO: 27620 - DNA, 20 bp, Artificial Sequence
  chemically synthesized
atatacacggagagaaaata

SEQ ID NO: 27621 - DNA, 20 bp, Artificial Sequence
  chemically synthesized
tacacggagagaaaataagg

SEQ ID NO: 27622 - DNA, 20 bp, Artificial Sequence
  chemically synthesized
acacggagagaaaataaggt

SEQ ID NO: 27623 - DNA, 20 bp, Artificial Sequence
  chemically synthesized
cacggagagaaaataaggta

SEQ ID NO: 27624 - DNA, 20 bp, Artificial Sequence
  chemically synthesized
tatacgtctctcttgctata

SEQ ID NO: 27625 - DNA, 20 bp, Artificial Sequence
  chemically synthesized
acgtctctcttgctatatag

SEQ ID NO: 27626 - DNA, 20 bp, Artificial Sequence
  chemically synthesized
atatagtagtcaactgaata

SEQ ID NO: 27627 - DNA, 20 bp, Artificial Sequence
  chemically synthesized
tagtagtcaactgaatacag

SEQ ID NO: 27628 - DNA, 20 bp, Artificial Sequence
  chemically synthesized
aactgaatacagtagtacaa

SEQ ID NO: 27629 - DNA, 20 bp, Artificial Sequence
  chemically synthesized
aatacagtagtacaaaagat

SEQ ID NO: 27630 - DNA, 20 bp, Artificial Sequence
  chemically synthesized
tagtacaaaagatgagtcac

SEQ ID NO: 27631 - DNA, 20 bp, Artificial Sequence
  chemically synthesized
caaaagatgagtcactggaa

SEQ ID NO: 27632 - DNA, 20 bp, Artificial Sequence
  chemically synthesized
agtcactggaatagtcctga

SEQ ID NO: 27633 - DNA, 20 bp, Artificial Sequence
  chemically synthesized
tcactggaatagtcctgaaa

SEQ ID NO: 27634 - DNA, 20 bp, Artificial Sequence
  chemically synthesized
cctgaaagagtgatctgaat

SEQ ID NO: 27635 - DNA, 20 bp, Artificial Sequence
  chemically synthesized
aagagtgatctgaattagaa

SEQ ID NO: 27636 - DNA, 20 bp, Artificial Sequence
  chemically synthesized
gaattagaatagcatcaatg

SEQ ID NO: 27637 - DNA, 20 bp, Artificial Sequence
  chemically synthesized
aattagaatagcatcaatga

SEQ ID NO: 27638 - DNA, 20 bp, Artificial Sequence
  chemically synthesized
aatagcatcaatgaaggtga

SEQ ID NO: 27639 - DNA, 20 bp, Artificial Sequence
  chemically synthesized
gcatcaatgaaggtgacggt

SEQ ID NO: 27640 - DNA, 20 bp, Artificial Sequence
  chemically synthesized
tgaaggtgacggtgagtaaa

SEQ ID NO: 27641 - DNA, 20 bp, Artificial Sequence
  chemically synthesized
gacggtgagtaaacagactt

SEQ ID NO: 27642 - DNA, 20 bp, Artificial Sequence
  chemically synthesized
acggtgagtaaacagacttg

SEQ ID NO: 27643 - DNA, 20 bp, Artificial Sequence
  chemically synthesized
gtaaacagacttgaggtatt

SEQ ID NO: 27644 - DNA, 20 bp, Artificial Sequence
  chemically synthesized
gacttgaggtattcagtaaa

SEQ ID NO: 27645 - DNA, 20 bp, Artificial Sequence
  chemically synthesized
tattcagtaaacagaaaccc

SEQ ID NO: 27646 - DNA, 20 bp, Artificial Sequence
  chemically synthesized
attcagtaaacagaaaccct

SEQ ID NO: 27647 - DNA, 20 bp, Artificial Sequence
  chemically synthesized
taaacagaaaccctaggact

SEQ ID NO: 27648 - DNA, 20 bp, Artificial Sequence
  chemically synthesized
aaaccctaggacttggtgat

SEQ ID NO: 27649 - DNA, 20 bp, Artificial Sequence
  chemically synthesized
ggacttggtgattggttgat

SEQ ID NO: 27650 - DNA, 20 bp, Artificial Sequence
  chemically synthesized
gattggttgattagatacta

SEQ ID NO: 27651 - DNA, 20 bp, Artificial Sequence
  chemically synthesized
ttggttgattagatactatg

SEQ ID NO: 27652 - DNA, 20 bp, Artificial Sequence
  chemically synthesized
ggttgattagatactatgga

SEQ ID NO: 27653 - DNA, 20 bp, Artificial Sequence
  chemically synthesized
tactatggagagatgtgata

SEQ ID NO: 27654 - DNA, 20 bp, Artificial Sequence
  chemically synthesized
ctatggagagatgtgatatg

SEQ ID NO: 27655 - DNA, 20 bp, Artificial Sequence
  chemically synthesized
tggagagatgtgatatggag

SEQ ID NO: 27656 - DNA, 20 bp, Artificial Sequence
  chemically synthesized
taaaacatgacatttgactt

SEQ ID NO: 27657 - DNA, 20 bp, Artificial Sequence
  chemically synthesized
gacatttgacttgagccact

SEQ ID NO: 27658 - DNA, 20 bp, Artificial Sequence
  chemically synthesized
tgagccactgagataatgaa

SEQ ID NO: 27659 - DNA, 20 bp, Artificial Sequence
  chemically synthesized
cactgagataatgaaaagta

SEQ ID NO: 27660 - DNA, 20 bp, Artificial Sequence
  chemically synthesized
atgaaaagtacagatgttgc

SEQ ID NO: 27661 - DNA, 20 bp, Artificial Sequence
  chemically synthesized
gaaaagtacagatgttgcta

SEQ ID NO: 27662 - DNA, 20 bp, Artificial Sequence
  chemically synthesized
gtacagatgttgctagagtc

SEQ ID NO: 27663 - DNA, 20 bp, Artificial Sequence
  chemically synthesized
tgctagagtctggaaatcaa

SEQ ID NO: 27664 - DNA, 20 bp, Artificial Sequence
  chemically synthesized
ctagagtctggaaatcaaaa

SEQ ID NO: 27665 - DNA, 20 bp, Artificial Sequence
  chemically synthesized
agagtctggaaatcaaaaga

SEQ ID NO: 27666 - DNA, 20 bp, Artificial Sequence
  chemically synthesized
tctggaaatcaaaagagaga

SEQ ID NO: 27667 - DNA, 20 bp, Artificial Sequence
  chemically synthesized
aaatcaaaagagagaaagac

SEQ ID NO: 27668 - DNA, 20 bp, Artificial Sequence
  chemically synthesized
aaagagagaaagacaagttc

SEQ ID NO: 27669 - DNA, 20 bp, Artificial Sequence
  chemically synthesized
atttgttatttatcaatata

SEQ ID NO: 27670 - DNA, 20 bp, Artificial Sequence
  chemically synthesized
gttatttatcaatatatgga

SEQ ID NO: 27671 - DNA, 20 bp, Artificial Sequence
  chemically synthesized
atggatggtaaatgaaatca

SEQ ID NO: 27672 - DNA, 20 bp, Artificial Sequence
  chemically synthesized
gatggtaaatgaaatcatgg

SEQ ID NO: 27673 - DNA, 20 bp, Artificial Sequence
  chemically synthesized
ggtaaatgaaatcatggtag

SEQ ID NO: 27674 - DNA, 20 bp, Artificial Sequence
  chemically synthesized
tcatggtagtggatgacatt

SEQ ID NO: 27675 - DNA, 20 bp, Artificial Sequence
  chemically synthesized
tggtagtggatgacattaag

SEQ ID NO: 27676 - DNA, 20 bp, Artificial Sequence
  chemically synthesized
atgacattaagaagaaataa

SEQ ID NO: 27677 - DNA, 20 bp, Artificial Sequence
  chemically synthesized
taagaagaaataatagaata

SEQ ID NO: 27678 - DNA, 20 bp, Artificial Sequence
  chemically synthesized
aagaaataatagaatatggc

SEQ ID NO: 27679 - DNA, 20 bp, Artificial Sequence
  chemically synthesized
agaaataatagaatatggcc

SEQ ID NO: 27680 - DNA, 20 bp, Artificial Sequence
  chemically synthesized
aatatggccaggaaattgcc

SEQ ID NO: 27681 - DNA, 20 bp, Artificial Sequence
  chemically synthesized
atatggccaggaaattgcca

SEQ ID NO: 27682 - DNA, 20 bp, Artificial Sequence
  chemically synthesized
ggccaggaaattgccaagga

SEQ ID NO: 27683 - DNA, 20 bp, Artificial Sequence
  chemically synthesized
gccaggaaattgccaaggat

SEQ ID NO: 27684 - DNA, 20 bp, Artificial Sequence
  chemically synthesized
aggaaattgccaaggatggg

SEQ ID NO: 27685 - DNA, 20 bp, Artificial Sequence
  chemically synthesized
ggatgggaagaactatactt

SEQ ID NO: 27686 - DNA, 20 bp, Artificial Sequence
  chemically synthesized
gatgggaagaactatactta

SEQ ID NO: 27687 - DNA, 20 bp, Artificial Sequence
  chemically synthesized
atgggaagaactatacttaa

SEQ ID NO: 27688 - DNA, 20 bp, Artificial Sequence
  chemically synthesized
aagaactatacttaagggtt

SEQ ID NO: 27689 - DNA, 20 bp, Artificial Sequence
  chemically synthesized
tacttaagggttgagcaata

SEQ ID NO: 27690 - DNA, 20 bp, Artificial Sequence
  chemically synthesized
acttaagggttgagcaataa

SEQ ID NO: 27691 - DNA, 20 bp, Artificial Sequence
  chemically synthesized
gttgagcaataaaggcacac

SEQ ID NO: 27692 - DNA, 20 bp, Artificial Sequence
  chemically synthesized
gcaataaaggcacaccagca

SEQ ID NO: 27693 - DNA, 20 bp, Artificial Sequence
  chemically synthesized
aataaaggcacaccagcaaa

SEQ ID NO: 27694 - DNA, 20 bp, Artificial Sequence
  chemically synthesized
ataaaggcacaccagcaaag

SEQ ID NO: 27695 - DNA, 20 bp, Artificial Sequence
  chemically synthesized
aaggcacaccagcaaagagg

SEQ ID NO: 27696 - DNA, 20 bp, Artificial Sequence
  chemically synthesized
ggcacaccagcaaagaggca

SEQ ID NO: 27697 - DNA, 20 bp, Artificial Sequence
  chemically synthesized
cacaccagcaaagaggcaga

SEQ ID NO: 27698 - DNA, 20 bp, Artificial Sequence
  chemically synthesized
acaccagcaaagaggcagag

SEQ ID NO: 27699 - DNA, 20 bp, Artificial Sequence
  chemically synthesized
gaactgaaataattgaaata

SEQ ID NO: 27700 - DNA, 20 bp, Artificial Sequence
  chemically synthesized
actgaaataattgaaataca

SEQ ID NO: 27701 - DNA, 20 bp, Artificial Sequence
  chemically synthesized
ctgaaataattgaaatacag

SEQ ID NO: 27702 - DNA, 20 bp, Artificial Sequence
  chemically synthesized
attgaaatacagaggaaaac

SEQ ID NO: 27703 - DNA, 20 bp, Artificial Sequence
  chemically synthesized
aaatacagaggaaaactggt

SEQ ID NO: 27704 - DNA, 20 bp, Artificial Sequence
  chemically synthesized
aatacagaggaaaactggtg

SEQ ID NO: 27705 - DNA, 20 bp, Artificial Sequence
  chemically synthesized
atacagaggaaaactggtga

SEQ ID NO: 27706 - DNA, 20 bp, Artificial Sequence
  chemically synthesized
agaggaaaactggtgagggc

SEQ ID NO: 27707 - DNA, 20 bp, Artificial Sequence
  chemically synthesized
gaggaaaactggtgagggcg

SEQ ID NO: 27708 - DNA, 20 bp, Artificial Sequence
  chemically synthesized
tggtgagggcgaggttatca

SEQ ID NO: 27709 - DNA, 20 bp, Artificial Sequence
  chemically synthesized
gagggcgaggttatcaaaga

SEQ ID NO: 27710 - DNA, 20 bp, Artificial Sequence
  chemically synthesized
ttatcaaagaaagttcaata

SEQ ID NO: 27711 - DNA, 20 bp, Artificial Sequence
  chemically synthesized
tcaaagaaagttcaataaag

SEQ ID NO: 27712 - DNA, 20 bp, Artificial Sequence
  chemically synthesized
agaaagttcaataaagtagt

SEQ ID NO: 27713 - DNA, 20 bp, Artificial Sequence
  chemically synthesized
gttcaataaagtagtgagat

SEQ ID NO: 27714 - DNA, 20 bp, Artificial Sequence
  chemically synthesized
caataaagtagtgagattgg

SEQ ID NO: 27715 - DNA, 20 bp, Artificial Sequence
  chemically synthesized
gtgagattggcagaattcat

SEQ ID NO: 27716 - DNA, 20 bp, Artificial Sequence
  chemically synthesized
tgagattggcagaattcata

SEQ ID NO: 27717 - DNA, 20 bp, Artificial Sequence
  chemically synthesized
gagattggcagaattcataa

SEQ ID NO: 27718 - DNA, 20 bp, Artificial Sequence
  chemically synthesized
attggcagaattcataaggg

SEQ ID NO: 27719 - DNA, 20 bp, Artificial Sequence
  chemically synthesized
tggcagaattcataagggtg

SEQ ID NO: 27720 - DNA, 20 bp, Artificial Sequence
  chemically synthesized
cagaattcataagggtggag

SEQ ID NO: 27721 - DNA, 20 bp, Artificial Sequence
  chemically synthesized
gggtggagtagataatacta

SEQ ID NO: 27722 - DNA, 20 bp, Artificial Sequence
  chemically synthesized
ggtggagtagataatactaa

SEQ ID NO: 27723 - DNA, 20 bp, Artificial Sequence
  chemically synthesized
actaaaggtgatgatgacca

SEQ ID NO: 27724 - DNA, 20 bp, Artificial Sequence
  chemically synthesized
gcttgtgatgttgtgaatgt

SEQ ID NO: 27725 - DNA, 20 bp, Artificial Sequence
  chemically synthesized
tgatgttgtgaatgttagtg

SEQ ID NO: 27726 - DNA, 20 bp, Artificial Sequence
  chemically synthesized
tgtgaatgttagtgaagctg

SEQ ID NO: 27727 - DNA, 20 bp, Artificial Sequence
  chemically synthesized
gaagctgaagaattaataac

SEQ ID NO: 27728 - DNA, 20 bp, Artificial Sequence
  chemically synthesized
cagaaatatccatttatttt

SEQ ID NO: 27729 - DNA, 20 bp, Artificial Sequence
  chemically synthesized
ttattttcagctcaatcccc

SEQ ID NO: 27730 - DNA, 20 bp, Artificial Sequence
  chemically synthesized
tattttcagctcaatccccg

SEQ ID NO: 27731 - DNA, 20 bp, Artificial Sequence
  chemically synthesized
gctcaatccccgaggaatgt

SEQ ID NO: 27732 - DNA, 20 bp, Artificial Sequence
  chemically synthesized
atgtcagtccaatattcgct

SEQ ID NO: 27733 - DNA, 20 bp, Artificial Sequence
  chemically synthesized
tgctgctatccaacattact

SEQ ID NO: 27734 - DNA, 20 bp, Artificial Sequence
  chemically synthesized
ctatccaacattactcagtt

SEQ ID NO: 27735 - DNA, 20 bp, Artificial Sequence
  chemically synthesized
agccccatattctatctcac

SEQ ID NO: 27736 - DNA, 20 bp, Artificial Sequence
  chemically synthesized
ttctatctcaccagctttcc

SEQ ID NO: 27737 - DNA, 20 bp, Artificial Sequence
  chemically synthesized
tctcaccagctttcctggat

SEQ ID NO: 27738 - DNA, 20 bp, Artificial Sequence
  chemically synthesized
caccagctttcctggattgg

SEQ ID NO: 27739 - DNA, 20 bp, Artificial Sequence
  chemically synthesized
accagctttcctggattgga

SEQ ID NO: 27740 - DNA, 20 bp, Artificial Sequence
  chemically synthesized
gattggaaggcatcaaacac

SEQ ID NO: 27741 - DNA, 20 bp, Artificial Sequence
  chemically synthesized
cccctttttctttatgtaca

SEQ ID NO: 27742 - DNA, 20 bp, Artificial Sequence
  chemically synthesized
tatgtacatggttgccatct

SEQ ID NO: 27743 - DNA, 20 bp, Artificial Sequence
  chemically synthesized
atgtacatggttgccatctc

SEQ ID NO: 27744 - DNA, 20 bp, Artificial Sequence
  chemically synthesized
gtttcattctgatcattatt

SEQ ID NO: 27745 - DNA, 20 bp, Artificial Sequence
  chemically synthesized
gtactatctactatccttgc

SEQ ID NO: 27746 - DNA, 20 bp, Artificial Sequence
  chemically synthesized
cttgctggccctcactgacc

SEQ ID NO: 27747 - DNA, 20 bp, Artificial Sequence
  chemically synthesized
ttgctggccctcactgacct

SEQ ID NO: 27748 - DNA, 20 bp, Artificial Sequence
  chemically synthesized
tgctggccctcactgacctg

SEQ ID NO: 27749 - DNA, 20 bp, Artificial Sequence
  chemically synthesized
gtccacgttgcccaccacta

SEQ ID NO: 27750 - DNA, 20 bp, Artificial Sequence
  chemically synthesized
tccacgttgcccaccactat

SEQ ID NO: 27751 - DNA, 20 bp, Artificial Sequence
  chemically synthesized
ccacgttgcccaccactatg

SEQ ID NO: 27752 - DNA, 20 bp, Artificial Sequence
  chemically synthesized
ccaccactatggggatcttc

SEQ ID NO: 27753 - DNA, 20 bp, Artificial Sequence
  chemically synthesized
atcttctggtttaactccca

SEQ ID NO: 27754 - DNA, 20 bp, Artificial Sequence
  chemically synthesized
aactcccatagtatctactt

SEQ ID NO: 27755 - DNA, 20 bp, Artificial Sequence
  chemically synthesized
ctcccatagtatctactttg

SEQ ID NO: 27756 - DNA, 20 bp, Artificial Sequence
  chemically synthesized
actttggagcgtgtcaaatc

SEQ ID NO: 27757 - DNA, 20 bp, Artificial Sequence
  chemically synthesized
catccactctttttccttca

SEQ ID NO: 27758 - DNA, 20 bp, Artificial Sequence
  chemically synthesized
tccactctttttccttcatg

SEQ ID NO: 27759 - DNA, 20 bp, Artificial Sequence
  chemically synthesized
tttttccttcatggagtcct

SEQ ID NO: 27760 - DNA, 20 bp, Artificial Sequence
  chemically synthesized
gatgtcctttgaccgccttg

SEQ ID NO: 27761 - DNA, 20 bp, Artificial Sequence
  chemically synthesized
gtggccatctgccaccctct

SEQ ID NO: 27762 - DNA, 20 bp, Artificial Sequence
  chemically synthesized
tggccatctgccaccctctg

SEQ ID NO: 27763 - DNA, 20 bp, Artificial Sequence
  chemically synthesized
ctgccaccctctgaggtatt

SEQ ID NO: 27764 - DNA, 20 bp, Artificial Sequence
  chemically synthesized
aggtattcggtcattatcac

SEQ ID NO: 27765 - DNA, 20 bp, Artificial Sequence
  chemically synthesized
attcggtcattatcactggc

SEQ ID NO: 27766 - DNA, 20 bp, Artificial Sequence
  chemically synthesized
ggtcattatcactggccagc

SEQ ID NO: 27767 - DNA, 20 bp, Artificial Sequence
  chemically synthesized
cattatcactggccagcaag

SEQ ID NO: 27768 - DNA, 20 bp, Artificial Sequence
  chemically synthesized
atcactggccagcaagtggt

SEQ ID NO: 27769 - DNA, 20 bp, Artificial Sequence
  chemically synthesized
cactggccagcaagtggtca

SEQ ID NO: 27770 - DNA, 20 bp, Artificial Sequence
  chemically synthesized
tggccagcaagtggtcagag

SEQ ID NO: 27771 - DNA, 20 bp, Artificial Sequence
  chemically synthesized
ggccagcaagtggtcagagc

SEQ ID NO: 27772 - DNA, 20 bp, Artificial Sequence
  chemically synthesized
caggcctaattgtcatcttc

SEQ ID NO: 27773 - DNA, 20 bp, Artificial Sequence
  chemically synthesized
aggcctaattgtcatcttcc

SEQ ID NO: 27774 - DNA, 20 bp, Artificial Sequence
  chemically synthesized
ggcctaattgtcatcttccg

SEQ ID NO: 27775 - DNA, 20 bp, Artificial Sequence
  chemically synthesized
tgtcatcttccggggacctg

SEQ ID NO: 27776 - DNA, 20 bp, Artificial Sequence
  chemically synthesized
tccctattgtcctcctcctg

SEQ ID NO: 27777 - DNA, 20 bp, Artificial Sequence
  chemically synthesized
ccctattgtcctcctcctga

SEQ ID NO: 27778 - DNA, 20 bp, Artificial Sequence
  chemically synthesized
ctgaaggcttttccctactg

SEQ ID NO: 27779 - DNA, 20 bp, Artificial Sequence
  chemically synthesized
ttttccctactgtggatctg

SEQ ID NO: 27780 - DNA, 20 bp, Artificial Sequence
  chemically synthesized
cccactcattttgcctgcac

SEQ ID NO: 27781 - DNA, 20 bp, Artificial Sequence
  chemically synthesized
ccactcattttgcctgcacc

SEQ ID NO: 27782 - DNA, 20 bp, Artificial Sequence
  chemically synthesized
ctcattttgcctgcaccagg

SEQ ID NO: 27783 - DNA, 20 bp, Artificial Sequence
  chemically synthesized
gcctgcaccaggaagtgata

SEQ ID NO: 27784 - DNA, 20 bp, Artificial Sequence
  chemically synthesized
gcaccaggaagtgatacagc

SEQ ID NO: 27785 - DNA, 20 bp, Artificial Sequence
  chemically synthesized
agtgatacagctggcctgca

SEQ ID NO: 27786 - DNA, 20 bp, Artificial Sequence
  chemically synthesized
atcaccttcaataatctgta

SEQ ID NO: 27787 - DNA, 20 bp, Artificial Sequence
  chemically synthesized
caataatctgtatggactga

SEQ ID NO: 27788 - DNA, 20 bp, Artificial Sequence
  chemically synthesized
taatctgtatggactgatgg

SEQ ID NO: 27789 - DNA, 20 bp, Artificial Sequence
  chemically synthesized
tctgtatggactgatggtgg

SEQ ID NO: 27790 - DNA, 20 bp, Artificial Sequence
  chemically synthesized
ggtagttttcactgtgatgc

SEQ ID NO: 27791 - DNA, 20 bp, Artificial Sequence
  chemically synthesized
tttcactgtgatgctggacc

SEQ ID NO: 27792 - DNA, 20 bp, Artificial Sequence
  chemically synthesized
gtgctcatcgcactgtccta

SEQ ID NO: 27793 - DNA, 20 bp, Artificial Sequence
  chemically synthesized
ctatggactcatcctgcaca

SEQ ID NO: 27794 - DNA, 20 bp, Artificial Sequence
  chemically synthesized
tggactcatcctgcacacag

SEQ ID NO: 27795 - DNA, 20 bp, Artificial Sequence
  chemically synthesized
actcatcctgcacacagtag

SEQ ID NO: 27796 - DNA, 20 bp, Artificial Sequence
  chemically synthesized
ctcatcctgcacacagtagc

SEQ ID NO: 27797 - DNA, 20 bp, Artificial Sequence
  chemically synthesized
cctgcacacagtagcaggcc

SEQ ID NO: 27798 - DNA, 20 bp, Artificial Sequence
  chemically synthesized
agtagcaggcctggcctccc

SEQ ID NO: 27799 - DNA, 20 bp, Artificial Sequence
  chemically synthesized
tagcaggcctggcctcccaa

SEQ ID NO: 27800 - DNA, 20 bp, Artificial Sequence
  chemically synthesized
agcaggcctggcctcccaag

SEQ ID NO: 27801 - DNA, 20 bp, Artificial Sequence
  chemically synthesized
caggcctggcctcccaagag

SEQ ID NO: 27802 - DNA, 20 bp, Artificial Sequence
  chemically synthesized
gcctggcctcccaagaggag

SEQ ID NO: 27803 - DNA, 20 bp, Artificial Sequence
  chemically synthesized
aggagcagcgccgtgccttt

SEQ ID NO: 27804 - DNA, 20 bp, Artificial Sequence
  chemically synthesized
cgctcctctctgtgctgtgc

SEQ ID NO: 27805 - DNA, 20 bp, Artificial Sequence
  chemically synthesized
agtattctttgtgcccatga

SEQ ID NO: 27806 - DNA, 20 bp, Artificial Sequence
  chemically synthesized
gtattctttgtgcccatgat

SEQ ID NO: 27807 - DNA, 20 bp, Artificial Sequence
  chemically synthesized
tattctttgtgcccatgatg

SEQ ID NO: 27808 - DNA, 20 bp, Artificial Sequence
  chemically synthesized
gcccatgatggggctgtccc

SEQ ID NO: 27809 - DNA, 20 bp, Artificial Sequence
  chemically synthesized
ctgtccctggtgcaccgttt

SEQ ID NO: 27810 - DNA, 20 bp, Artificial Sequence
  chemically synthesized
tgtccctggtgcaccgtttt

SEQ ID NO: 27811 - DNA, 20 bp, Artificial Sequence
  chemically synthesized
ccctggtgcaccgttttggg

SEQ ID NO: 27812 - DNA, 20 bp, Artificial Sequence
  chemically synthesized
acctgctattcatcttctta

SEQ ID NO: 27813 - DNA, 20 bp, Artificial Sequence
  chemically synthesized
atgcttaacccaatcatata

SEQ ID NO: 27814 - DNA, 20 bp, Artificial Sequence
  chemically synthesized
acccaatcatatacagcatt

SEQ ID NO: 27815 - DNA, 20 bp, Artificial Sequence
  chemically synthesized
tcatatacagcattaagacc

SEQ ID NO: 27816 - DNA, 20 bp, Artificial Sequence
  chemically synthesized
catatacagcattaagacca

SEQ ID NO: 27817 - DNA, 20 bp, Artificial Sequence
  chemically synthesized
tatacagcattaagaccaag

SEQ ID NO: 27818 - DNA, 20 bp, Artificial Sequence
  chemically synthesized
agatccaccgtgccattatc

SEQ ID NO: 27819 - DNA, 20 bp, Artificial Sequence
  chemically synthesized
ccgtgccattatcaagttcc

SEQ ID NO: 27820 - DNA, 20 bp, Artificial Sequence
  chemically synthesized
cgtgccattatcaagttcct

SEQ ID NO: 27821 - DNA, 20 bp, Artificial Sequence
  chemically synthesized
tcaagttcctaggtcttaaa

SEQ ID NO: 27822 - DNA, 20 bp, Artificial Sequence
  chemically synthesized
caagttcctaggtcttaaaa

SEQ ID NO: 27823 - DNA, 20 bp, Artificial Sequence
  chemically synthesized
ttcctaggtcttaaaaaggc

SEQ ID NO: 27824 - DNA, 20 bp, Artificial Sequence
  chemically synthesized
tcttaaaaaggccagtaaat

SEQ ID NO: 27825 - DNA, 20 bp, Artificial Sequence
  chemically synthesized
aaaggccagtaaatgagtcc

SEQ ID NO: 27826 - DNA, 20 bp, Artificial Sequence
  chemically synthesized
aaggccagtaaatgagtcct

SEQ ID NO: 27827 - DNA, 20 bp, Artificial Sequence
  chemically synthesized
aggccagtaaatgagtcctg

SEQ ID NO: 27828 - DNA, 20 bp, Artificial Sequence
  chemically synthesized
cctggggctaaaactccccc

SEQ ID NO: 27829 - DNA, 20 bp, Artificial Sequence
  chemically synthesized
tggggctaaaactcccccta

SEQ ID NO: 27830 - DNA, 20 bp, Artificial Sequence
  chemically synthesized
ggggctaaaactccccctag

SEQ ID NO: 27831 - DNA, 20 bp, Artificial Sequence
  chemically synthesized
aactccccctagaggcctat

SEQ ID NO: 27832 - DNA, 20 bp, Artificial Sequence
  chemically synthesized
tccccctagaggcctataag

SEQ ID NO: 27833 - DNA, 20 bp, Artificial Sequence
  chemically synthesized
ccccctagaggcctataaga

SEQ ID NO: 27834 - DNA, 20 bp, Artificial Sequence
  chemically synthesized
cctataagaaggccccaaat

SEQ ID NO: 27835 - DNA, 20 bp, Artificial Sequence
  chemically synthesized
cccaaattggactgaaaatt

SEQ ID NO: 27836 - DNA, 20 bp, Artificial Sequence
  chemically synthesized
caaattggactgaaaatttg

SEQ ID NO: 27837 - DNA, 20 bp, Artificial Sequence
  chemically synthesized
gactgaaaatttggagtatt

SEQ ID NO: 27838 - DNA, 20 bp, Artificial Sequence
  chemically synthesized
aatttggagtattgagtata

SEQ ID NO: 27839 - DNA, 20 bp, Artificial Sequence
  chemically synthesized
gagtatatagcatgctctta

SEQ ID NO: 27840 - DNA, 20 bp, Artificial Sequence
  chemically synthesized
cccctgtcctaaataaaata

SEQ ID NO: 27841 - DNA, 20 bp, Artificial Sequence
  chemically synthesized
ccctgtcctaaataaaatat

SEQ ID NO: 27842 - DNA, 20 bp, Artificial Sequence
  chemically synthesized
aatatgggcaaatttatgtc

SEQ ID NO: 27843 - DNA, 20 bp, Artificial Sequence
  chemically synthesized
tatgggcaaatttatgtctg

SEQ ID NO: 27844 - DNA, 20 bp, Artificial Sequence
  chemically synthesized
caaatttatgtctggagttg

SEQ ID NO: 27845 - DNA, 20 bp, Artificial Sequence
  chemically synthesized
aaaactgaacttctcttgct

SEQ ID NO: 27846 - DNA, 20 bp, Artificial Sequence
  chemically synthesized
ttctcttgcttagattttaa

SEQ ID NO: 27847 - DNA, 20 bp, Artificial Sequence
  chemically synthesized
gattttaatggctcctccta

SEQ ID NO: 27848 - DNA, 20 bp, Artificial Sequence
  chemically synthesized
taatggctcctcctacagct

SEQ ID NO: 27849 - DNA, 20 bp, Artificial Sequence
  chemically synthesized
ctcctcctacagctgagaac

SEQ ID NO: 27850 - DNA, 20 bp, Artificial Sequence
  chemically synthesized
cagctgagaactggcatttt

SEQ ID NO: 27851 - DNA, 20 bp, Artificial Sequence
  chemically synthesized
ctgagaactggcatttttgg

SEQ ID NO: 27852 - DNA, 20 bp, Artificial Sequence
  chemically synthesized
tggcatttttggtagcatca

SEQ ID NO: 27853 - DNA, 20 bp, Artificial Sequence
  chemically synthesized
ttggtagcatcaaagctatc

SEQ ID NO: 27854 - DNA, 20 bp, Artificial Sequence
  chemically synthesized
gtagcatcaaagctatccag

SEQ ID NO: 27855 - DNA, 20 bp, Artificial Sequence
  chemically synthesized
tagcatcaaagctatccaga

SEQ ID NO: 27856 - DNA, 20 bp, Artificial Sequence
  chemically synthesized
tccagaaggcaactttattg

SEQ ID NO: 27857 - DNA, 20 bp, Artificial Sequence
  chemically synthesized
ccagaaggcaactttattga

SEQ ID NO: 27858 - DNA, 20 bp, Artificial Sequence
  chemically synthesized
gaaactaaataaaaactaaa

SEQ ID NO: 27859 - DNA, 20 bp, Artificial Sequence
  chemically synthesized
ctaaaaagaacaataaatac

SEQ ID NO: 27860 - DNA, 20 bp, Artificial Sequence
  chemically synthesized
aaaaagaacaataaatacca

SEQ ID NO: 27861 - DNA, 20 bp, Artificial Sequence
  chemically synthesized
acaataaataccagagcacc

SEQ ID NO: 27862 - DNA, 20 bp, Artificial Sequence
  chemically synthesized
aataaataccagagcaccca

SEQ ID NO: 27863 - DNA, 20 bp, Artificial Sequence
  chemically synthesized
ataaataccagagcacccag

SEQ ID NO: 27864 - DNA, 20 bp, Artificial Sequence
  chemically synthesized
aaataccagagcacccagag

SEQ ID NO: 27865 - DNA, 20 bp, Artificial Sequence
  chemically synthesized
ataccagagcacccagagga

SEQ ID NO: 27866 - DNA, 20 bp, Artificial Sequence
  chemically synthesized
agagcacccagaggagagcc

SEQ ID NO: 27867 - DNA, 20 bp, Artificial Sequence
  chemically synthesized
gcacccagaggagagcctgg

SEQ ID NO: 27868 - DNA, 20 bp, Artificial Sequence
  chemically synthesized
acccagaggagagcctggca

SEQ ID NO: 27869 - DNA, 20 bp, Artificial Sequence
  chemically synthesized
gaggagagcctggcagagac

SEQ ID NO: 27870 - DNA, 20 bp, Artificial Sequence
  chemically synthesized
aggagagcctggcagagacc

SEQ ID NO: 27871 - DNA, 20 bp, Artificial Sequence
  chemically synthesized
catttgctctaactcacctc

SEQ ID NO: 27872 - DNA, 20 bp, Artificial Sequence
  chemically synthesized
cggaaatacacctccttcca

SEQ ID NO: 27873 - DNA, 20 bp, Artificial Sequence
  chemically synthesized
cacctccttccatggttcct

SEQ ID NO: 27874 - DNA, 20 bp, Artificial Sequence
  chemically synthesized
acctccttccatggttcctt

SEQ ID NO: 27875 - DNA, 20 bp, Artificial Sequence
  chemically synthesized
ctgcttccatcttatctacc

SEQ ID NO: 27876 - DNA, 20 bp, Artificial Sequence
  chemically synthesized
tccatcttatctacctggcc

SEQ ID NO: 27877 - DNA, 20 bp, Artificial Sequence
  chemically synthesized
cttctcatctttttctatcc

SEQ ID NO: 27878 - DNA, 20 bp, Artificial Sequence
  chemically synthesized
tcatctttttctatcctggt

SEQ ID NO: 27879 - DNA, 20 bp, Artificial Sequence
  chemically synthesized
tctttttctatcctggtcag

SEQ ID NO: 27880 - DNA, 20 bp, Artificial Sequence
  chemically synthesized
tcctggtcagcagtaacttt

SEQ ID NO: 27881 - DNA, 20 bp, Artificial Sequence
  chemically synthesized
gcagtaactttcagaccccc

SEQ ID NO: 27882 - DNA, 20 bp, Artificial Sequence
  chemically synthesized
ttcagacccccaagtcacat

SEQ ID NO: 27883 - DNA, 20 bp, Artificial Sequence
  chemically synthesized
ccaagtcacatcagaaacct

SEQ ID NO: 27884 - DNA, 20 bp, Artificial Sequence
  chemically synthesized
tcttcctcaacacctgtttc

SEQ ID NO: 27885 - DNA, 20 bp, Artificial Sequence
  chemically synthesized
caacacccccccaaatttct

SEQ ID NO: 27886 - DNA, 20 bp, Artificial Sequence
  chemically synthesized
aacacccccccaaatttcta

SEQ ID NO: 27887 - DNA, 20 bp, Artificial Sequence
  chemically synthesized
ctctcctgaccatattcctc

SEQ ID NO: 27888 - DNA, 20 bp, Artificial Sequence
  chemically synthesized
tcctgaccatattcctctag

SEQ ID NO: 27889 - DNA, 20 bp, Artificial Sequence
  chemically synthesized
tgaccatattcctctagaag

SEQ ID NO: 27890 - DNA, 20 bp, Artificial Sequence
  chemically synthesized
accatattcctctagaagaa

SEQ ID NO: 27891 - DNA, 20 bp, Artificial Sequence
  chemically synthesized
tgattttaccttacaacctc

SEQ ID NO: 27892 - DNA, 20 bp, Artificial Sequence
  chemically synthesized
acaacctcaagtctgacatt

SEQ ID NO: 27893 - DNA, 20 bp, Artificial Sequence
  chemically synthesized
tcaagtctgacattaagcta

SEQ ID NO: 27894 - DNA, 20 bp, Artificial Sequence
  chemically synthesized
gtctgacattaagctacagt

SEQ ID NO: 27895 - DNA, 20 bp, Artificial Sequence
  chemically synthesized
ctacagtcagtatttacttg

SEQ ID NO: 27896 - DNA, 20 bp, Artificial Sequence
  chemically synthesized
tacagtcagtatttacttgt

SEQ ID NO: 27897 - DNA, 20 bp, Artificial Sequence
  chemically synthesized
gtatttacttgtaggtgttt

SEQ ID NO: 27898 - DNA, 20 bp, Artificial Sequence
  chemically synthesized
tgaacaatgacatgtaacgt

SEQ ID NO: 27899 - DNA, 20 bp, Artificial Sequence
  chemically synthesized
caatgacatgtaacgtgaga

SEQ ID NO: 27900 - DNA, 20 bp, Artificial Sequence
  chemically synthesized
catgtaacgtgagaaagctt

SEQ ID NO: 27901 - DNA, 20 bp, Artificial Sequence
  chemically synthesized
aacgtgagaaagcttcagcc

SEQ ID NO: 27902 - DNA, 20 bp, Artificial Sequence
  chemically synthesized
acgtgagaaagcttcagcca

SEQ ID NO: 27903 - DNA, 20 bp, Artificial Sequence
  chemically synthesized
aaactcacacaaacatattg

SEQ ID NO: 27904 - DNA, 20 bp, Artificial Sequence
  chemically synthesized
gaagtcacaatcccattgct

SEQ ID NO: 27905 - DNA, 20 bp, Artificial Sequence
  chemically synthesized
aagtcacaatcccattgctc

SEQ ID NO: 27906 - DNA, 20 bp, Artificial Sequence
  chemically synthesized
gtcacaatcccattgctcag

SEQ ID NO: 27907 - DNA, 20 bp, Artificial Sequence
  chemically synthesized
tcacaatcccattgctcagg

SEQ ID NO: 27908 - DNA, 20 bp, Artificial Sequence
  chemically synthesized
ggaggaaataaactttacat

SEQ ID NO: 27909 - DNA, 20 bp, Artificial Sequence
  chemically synthesized
taaactttacattggctgat

SEQ ID NO: 27910 - DNA, 20 bp, Artificial Sequence
  chemically synthesized
gctgatcagcctgtccctac

SEQ ID NO: 27911 - DNA, 20 bp, Artificial Sequence
  chemically synthesized
gtgactaaatgcaatccttg

SEQ ID NO: 27912 - DNA, 20 bp, Artificial Sequence
  chemically synthesized
tgactaaatgcaatccttgc

SEQ ID NO: 27913 - DNA, 20 bp, Artificial Sequence
  chemically synthesized
gactaaatgcaatccttgca

SEQ ID NO: 27914 - DNA, 20 bp, Artificial Sequence
  chemically synthesized
actaaatgcaatccttgcag

SEQ ID NO: 27915 - DNA, 20 bp, Artificial Sequence
  chemically synthesized
tgcaatccttgcaggggtct

SEQ ID NO: 27916 - DNA, 20 bp, Artificial Sequence
  chemically synthesized
agctttgaaattgcttcctc

SEQ ID NO: 27917 - DNA, 20 bp, Artificial Sequence
  chemically synthesized
gctttgaaattgcttcctca

SEQ ID NO: 27918 - DNA, 20 bp, Artificial Sequence
  chemically synthesized
cttcctcaaggacattttca

SEQ ID NO: 27919 - DNA, 20 bp, Artificial Sequence
  chemically synthesized
ctcaaggacattttcacaga

SEQ ID NO: 27920 - DNA, 20 bp, Artificial Sequence
  chemically synthesized
gatagctcctccctttccaa

SEQ ID NO: 27921 - DNA, 20 bp, Artificial Sequence
  chemically synthesized
ctcctccctttccaatggta

SEQ ID NO: 27922 - DNA, 20 bp, Artificial Sequence
  chemically synthesized
taaagcaccaaatgctccat

SEQ ID NO: 27923 - DNA, 20 bp, Artificial Sequence
  chemically synthesized
gctccatcggtttccttcca

SEQ ID NO: 27924 - DNA, 20 bp, Artificial Sequence
  chemically synthesized
ccgttgtaacatttgtcaca

SEQ ID NO: 27925 - DNA, 20 bp, Artificial Sequence
  chemically synthesized
acagtaatgtcctgtttatg

SEQ ID NO: 27926 - DNA, 20 bp, Artificial Sequence
  chemically synthesized
cagtaatgtcctgtttatga

SEQ ID NO: 27927 - DNA, 20 bp, Artificial Sequence
  chemically synthesized
aggtgtgtgcatgtgtccat

SEQ ID NO: 27928 - DNA, 20 bp, Artificial Sequence
  chemically synthesized
tccattagaatgactaaatc

SEQ ID NO: 27929 - DNA, 20 bp, Artificial Sequence
  chemically synthesized
aatgactaaatcaagatccc

SEQ ID NO: 27930 - DNA, 20 bp, Artificial Sequence
  chemically synthesized
tgactaaatcaagatccctg

SEQ ID NO: 27931 - DNA, 20 bp, Artificial Sequence
  chemically synthesized
gactaaatcaagatccctgg

SEQ ID NO: 27932 - DNA, 20 bp, Artificial Sequence
  chemically synthesized
atcaagatccctggaggaat

SEQ ID NO: 27933 - DNA, 20 bp, Artificial Sequence
  chemically synthesized
tcaagatccctggaggaatt

SEQ ID NO: 27934 - DNA, 20 bp, Artificial Sequence
  chemically synthesized
attaggcatgtcttgctcgc

SEQ ID NO: 27935 - DNA, 20 bp, Artificial Sequence
  chemically synthesized
atgtatataaatacaatgcc

SEQ ID NO: 27936 - DNA, 20 bp, Artificial Sequence
  chemically synthesized
ataaatattaaatgtatgcg

SEQ ID NO: 27937 - DNA, 20 bp, Artificial Sequence
  chemically synthesized
taaatgtatgcgtggacata

SEQ ID NO: 27938 - DNA, 20 bp, Artificial Sequence
  chemically synthesized
cgtggacatatagatacata

SEQ ID NO: 27939 - DNA, 20 bp, Artificial Sequence
  chemically synthesized
tggacatatagatacataaa

SEQ ID NO: 27940 - DNA, 20 bp, Artificial Sequence
  chemically synthesized
ggacatatagatacataaag

SEQ ID NO: 27941 - DNA, 20 bp, Artificial Sequence
  chemically synthesized
gacatatagatacataaaga

SEQ ID NO: 27942 - DNA, 20 bp, Artificial Sequence
  chemically synthesized
tagatacataaagagggatc

SEQ ID NO: 27943 - DNA, 20 bp, Artificial Sequence
  chemically synthesized
gatacataaagagggatcca

SEQ ID NO: 27944 - DNA, 20 bp, Artificial Sequence
  chemically synthesized
aaagagggatccagagctaa

SEQ ID NO: 27945 - DNA, 20 bp, Artificial Sequence
  chemically synthesized
gagggatccagagctaacag

SEQ ID NO: 27946 - DNA, 20 bp, Artificial Sequence
  chemically synthesized
agaagttctcttcttgtctc

SEQ ID NO: 27947 - DNA, 20 bp, Artificial Sequence
  chemically synthesized
gaagttctcttcttgtctcg

SEQ ID NO: 27948 - DNA, 20 bp, Artificial Sequence
  chemically synthesized
gaactcctcctcttcacatt

SEQ ID NO: 27949 - DNA, 20 bp, Artificial Sequence
  chemically synthesized
ctcctcctcttcacattcag

SEQ ID NO: 27950 - DNA, 20 bp, Artificial Sequence
  chemically synthesized
ctcttcacattcagaagccc

SEQ ID NO: 27951 - DNA, 20 bp, Artificial Sequence
  chemically synthesized
ttcacattcagaagcccaag

SEQ ID NO: 27952 - DNA, 20 bp, Artificial Sequence
  chemically synthesized
ccaagaagacacctttctgc

SEQ ID NO: 27953 - DNA, 20 bp, Artificial Sequence
  chemically synthesized
cctttctgctggcatccatc

SEQ ID NO: 27954 - DNA, 20 bp, Artificial Sequence
  chemically synthesized
ctttctgctggcatccatca

SEQ ID NO: 27955 - DNA, 20 bp, Artificial Sequence
  chemically synthesized
tctgctggcatccatcaagg

SEQ ID NO: 27956 - DNA, 20 bp, Artificial Sequence
  chemically synthesized
gtggtatatcttcattgtcc

SEQ ID NO: 27957 - DNA, 20 bp, Artificial Sequence
  chemically synthesized
tgtcccagttctactttact

SEQ ID NO: 27958 - DNA, 20 bp, Artificial Sequence
  chemically synthesized
gtcccagttctactttactc

SEQ ID NO: 27959 - DNA, 20 bp, Artificial Sequence
  chemically synthesized
tctactttactcaggccctc

SEQ ID NO: 27960 - DNA, 20 bp, Artificial Sequence
  chemically synthesized
tcctcccacccattctccta

SEQ ID NO: 27961 - DNA, 20 bp, Artificial Sequence
  chemically synthesized
cctcccacccattctcctac

SEQ ID NO: 27962 - DNA, 20 bp, Artificial Sequence
  chemically synthesized
ctacaggttaaaattaccat

SEQ ID NO: 27963 - DNA, 20 bp, Artificial Sequence
  chemically synthesized
tacaggttaaaattaccatg

SEQ ID NO: 27964 - DNA, 20 bp, Artificial Sequence
  chemically synthesized
ggttaaaattaccatgaggc

SEQ ID NO: 27965 - DNA, 20 bp, Artificial Sequence
  chemically synthesized
gttaaaattaccatgaggcc

SEQ ID NO: 27966 - DNA, 20 bp, Artificial Sequence
  chemically synthesized
aattaccatgaggccaggca

SEQ ID NO: 27967 - DNA, 20 bp, Artificial Sequence
  chemically synthesized
taccatgaggccaggcacgg

SEQ ID NO: 27968 - DNA, 20 bp, Artificial Sequence
  chemically synthesized
ggtggcttatgctataatcc

SEQ ID NO: 27969 - DNA, 20 bp, Artificial Sequence
  chemically synthesized
atgctataatcccagcactt

SEQ ID NO: 27970 - DNA, 20 bp, Artificial Sequence
  chemically synthesized
tgctataatcccagcacttt

SEQ ID NO: 27971 - DNA, 20 bp, Artificial Sequence
  chemically synthesized
ctataatcccagcactttgg

SEQ ID NO: 27972 - DNA, 20 bp, Artificial Sequence
  chemically synthesized
tcccagcactttgggagacc

SEQ ID NO: 27973 - DNA, 20 bp, Artificial Sequence
  chemically synthesized
cccagcactttgggagacca

SEQ ID NO: 27974 - DNA, 20 bp, Artificial Sequence
  chemically synthesized
agcactttgggagaccaagg

SEQ ID NO: 27975 - DNA, 20 bp, Artificial Sequence
  chemically synthesized
gcactttgggagaccaaggt

SEQ ID NO: 27976 - DNA, 20 bp, Artificial Sequence
  chemically synthesized
actttgggagaccaaggtgg

SEQ ID NO: 27977 - DNA, 20 bp, Artificial Sequence
  chemically synthesized
ctttgggagaccaaggtggg

SEQ ID NO: 27978 - DNA, 20 bp, Artificial Sequence
  chemically synthesized
ccaaggtgggaggattgctg

SEQ ID NO: 27979 - DNA, 20 bp, Artificial Sequence
  chemically synthesized
caaggtgggaggattgctga

SEQ ID NO: 27980 - DNA, 20 bp, Artificial Sequence
  chemically synthesized
gtgggaggattgctgaaggc

SEQ ID NO: 27981 - DNA, 20 bp, Artificial Sequence
  chemically synthesized
tgggaggattgctgaaggcc

SEQ ID NO: 27982 - DNA, 20 bp, Artificial Sequence
  chemically synthesized
ggaggattgctgaaggccag

SEQ ID NO: 27983 - DNA, 20 bp, Artificial Sequence
  chemically synthesized
ttgctgaaggccaggagttt

SEQ ID NO: 27984 - DNA, 20 bp, Artificial Sequence
  chemically synthesized
caggagtttgagaccaactt

SEQ ID NO: 27985 - DNA, 20 bp, Artificial Sequence
  chemically synthesized
aggagtttgagaccaacttc

SEQ ID NO: 27986 - DNA, 20 bp, Artificial Sequence
  chemically synthesized
gtttgagaccaacttcaggc

SEQ ID NO: 27987 - DNA, 20 bp, Artificial Sequence
  chemically synthesized
tgagaccaacttcaggcaag

SEQ ID NO: 27988 - DNA, 20 bp, Artificial Sequence
  chemically synthesized
ttcaggcaagaagattactt

SEQ ID NO: 27989 - DNA, 20 bp, Artificial Sequence
  chemically synthesized
gcaagaagattacttgagtc

SEQ ID NO: 27990 - DNA, 20 bp, Artificial Sequence
  chemically synthesized
caagaagattacttgagtcc

SEQ ID NO: 27991 - DNA, 20 bp, Artificial Sequence
  chemically synthesized
agaagattacttgagtccag

SEQ ID NO: 27992 - DNA, 20 bp, Artificial Sequence
  chemically synthesized
ttacttgagtccaggagttt

SEQ ID NO: 27993 - DNA, 20 bp, Artificial Sequence
  chemically synthesized
tgagtccaggagtttgagac

SEQ ID NO: 27994 - DNA, 20 bp, Artificial Sequence
  chemically synthesized
tgagaccagcctgaacaata

SEQ ID NO: 27995 - DNA, 20 bp, Artificial Sequence
  chemically synthesized
accagcctgaacaatacagc

SEQ ID NO: 27996 - DNA, 20 bp, Artificial Sequence
  chemically synthesized
tctacaaaaaaaattaaaat

SEQ ID NO: 27997 - DNA, 20 bp, Artificial Sequence
  chemically synthesized
aaattaaaattagccatgtg

SEQ ID NO: 27998 - DNA, 20 bp, Artificial Sequence
  chemically synthesized
ttaaaattagccatgtgtgg

SEQ ID NO: 27999 - DNA, 20 bp, Artificial Sequence
  chemically synthesized
tgtgtggcggtgcacgtctg

SEQ ID NO: 28000 - DNA, 20 bp, Artificial Sequence
  chemically synthesized
gcggtgcacgtctgtagtct

SEQ ID NO: 28001 - DNA, 20 bp, Artificial Sequence
  chemically synthesized
cgtctgtagtctcagctacc

SEQ ID NO: 28002 - DNA, 20 bp, Artificial Sequence
  chemically synthesized
gtctgtagtctcagctacct

SEQ ID NO: 28003 - DNA, 20 bp, Artificial Sequence
  chemically synthesized
ctgtagtctcagctacctgg

SEQ ID NO: 28004 - DNA, 20 bp, Artificial Sequence
  chemically synthesized
tgtagtctcagctacctggg

SEQ ID NO: 28005 - DNA, 20 bp, Artificial Sequence
  chemically synthesized
tctcagctacctgggaggct

SEQ ID NO: 28006 - DNA, 20 bp, Artificial Sequence
  chemically synthesized
ctcagctacctgggaggctg

SEQ ID NO: 28007 - DNA, 20 bp, Artificial Sequence
  chemically synthesized
agctacctgggaggctgagg

SEQ ID NO: 28008 - DNA, 20 bp, Artificial Sequence
  chemically synthesized
gctacctgggaggctgaggt

SEQ ID NO: 28009 - DNA, 20 bp, Artificial Sequence
  chemically synthesized
acctgggaggctgaggtggg

SEQ ID NO: 28010 - DNA, 20 bp, Artificial Sequence
  chemically synthesized
ctgaggtgggaagaatgctt

SEQ ID NO: 28011 - DNA, 20 bp, Artificial Sequence
  chemically synthesized
gtgggaagaatgcttgagcc

SEQ ID NO: 28012 - DNA, 20 bp, Artificial Sequence
  chemically synthesized
tgggaagaatgcttgagccc

SEQ ID NO: 28013 - DNA, 20 bp, Artificial Sequence
  chemically synthesized
ggaagaatgcttgagcccag

SEQ ID NO: 28014 - DNA, 20 bp, Artificial Sequence
  chemically synthesized
gaagaatgcttgagcccagg

SEQ ID NO: 28015 - DNA, 20 bp, Artificial Sequence
  chemically synthesized
atgcttgagcccaggaggtt

SEQ ID NO: 28016 - DNA, 20 bp, Artificial Sequence
  chemically synthesized
tgcttgagcccaggaggttg

SEQ ID NO: 28017 - DNA, 20 bp, Artificial Sequence
  chemically synthesized
agcccaggaggttgaggctg

SEQ ID NO: 28018 - DNA, 20 bp, Artificial Sequence
  chemically synthesized
caggaggttgaggctgcagt

SEQ ID NO: 28019 - DNA, 20 bp, Artificial Sequence
  chemically synthesized
gccataatcacactactgcc

SEQ ID NO: 28020 - DNA, 20 bp, Artificial Sequence
  chemically synthesized
ccataatcacactactgcct

SEQ ID NO: 28021 - DNA, 20 bp, Artificial Sequence
  chemically synthesized
acactactgcctgggtgacc

SEQ ID NO: 28022 - DNA, 20 bp, Artificial Sequence
  chemically synthesized
tactgcctgggtgaccaagt

SEQ ID NO: 28023 - DNA, 20 bp, Artificial Sequence
  chemically synthesized
gaccccgattcaaaaataaa

SEQ ID NO: 28024 - DNA, 20 bp, Artificial Sequence
  chemically synthesized
accccgattcaaaaataaaa

SEQ ID NO: 28025 - DNA, 20 bp, Artificial Sequence
  chemically synthesized
ggaaaacaaacaaaattaca

SEQ ID NO: 28026 - DNA, 20 bp, Artificial Sequence
  chemically synthesized
ttacaaagcgaaatttaaaa

SEQ ID NO: 28027 - DNA, 20 bp, Artificial Sequence
  chemically synthesized
aatatgtatgtatgtttgtg

SEQ ID NO: 28028 - DNA, 20 bp, Artificial Sequence
  chemically synthesized
gtttcttgtgtatgtttgtg

SEQ ID NO: 28029 - DNA, 20 bp, Artificial Sequence
  chemically synthesized
gtatctcatgtttgtatgtg

SEQ ID NO: 28030 - DNA, 20 bp, Artificial Sequence
  chemically synthesized
tatctcatgtttgtatgtgt

SEQ ID NO: 28031 - DNA, 20 bp, Artificial Sequence
  chemically synthesized
tttgtatgtgtgggtgttat

SEQ ID NO: 28032 - DNA, 20 bp, Artificial Sequence
  chemically synthesized
tgtgggtgttatcagactct

SEQ ID NO: 28033 - DNA, 20 bp, Artificial Sequence
  chemically synthesized
gtgggtgttatcagactctc

SEQ ID NO: 28034 - DNA, 20 bp, Artificial Sequence
  chemically synthesized
tgttatcagactctcaggct

SEQ ID NO: 28035 - DNA, 20 bp, Artificial Sequence
  chemically synthesized
gttatcagactctcaggctt

SEQ ID NO: 28036 - DNA, 20 bp, Artificial Sequence
  chemically synthesized
tatcagactctcaggcttgg

SEQ ID NO: 28037 - DNA, 20 bp, Artificial Sequence
  chemically synthesized
ctcaggcttgggagcccctc

SEQ ID NO: 28038 - DNA, 20 bp, Artificial Sequence
  chemically synthesized
ttgggagcccctctggaacc

SEQ ID NO: 28039 - DNA, 20 bp, Artificial Sequence
  chemically synthesized
ggagcccctctggaacccag

SEQ ID NO: 28040 - DNA, 20 bp, Artificial Sequence
  chemically synthesized
ctggaacccagcagtttctg

SEQ ID NO: 28041 - DNA, 20 bp, Artificial Sequence
  chemically synthesized
cagcagtttctgcagcctta

SEQ ID NO: 28042 - DNA, 20 bp, Artificial Sequence
  chemically synthesized
agcagtttctgcagccttac

SEQ ID NO: 28043 - DNA, 20 bp, Artificial Sequence
  chemically synthesized
gtttctgcagccttacaggc

SEQ ID NO: 28044 - DNA, 20 bp, Artificial Sequence
  chemically synthesized
aggctggcactccttaaaca

SEQ ID NO: 28045 - DNA, 20 bp, Artificial Sequence
  chemically synthesized
ggctggcactccttaaacat

SEQ ID NO: 28046 - DNA, 20 bp, Artificial Sequence
  chemically synthesized
aactttaatttacatccaca

SEQ ID NO: 28047 - DNA, 20 bp, Artificial Sequence
  chemically synthesized
tttaatttacatccacatag

SEQ ID NO: 28048 - DNA, 20 bp, Artificial Sequence
  chemically synthesized
ttaatttacatccacatagt

SEQ ID NO: 28049 - DNA, 20 bp, Artificial Sequence
  chemically synthesized
tagtaggccacattactcaa

SEQ ID NO: 28050 - DNA, 20 bp, Artificial Sequence
  chemically synthesized
taggccacattactcaatag

SEQ ID NO: 28051 - DNA, 20 bp, Artificial Sequence
  chemically synthesized
cattactcaatagcagttcc

SEQ ID NO: 28052 - DNA, 20 bp, Artificial Sequence
  chemically synthesized
tcaatagcagttccgagact

SEQ ID NO: 28053 - DNA, 20 bp, Artificial Sequence
  chemically synthesized
agaatattcttctccatgtt

SEQ ID NO: 28054 - DNA, 20 bp, Artificial Sequence
  chemically synthesized
aatattcttctccatgttga

SEQ ID NO: 28055 - DNA, 20 bp, Artificial Sequence
  chemically synthesized
atattcttctccatgttgag

SEQ ID NO: 28056 - DNA, 20 bp, Artificial Sequence
  chemically synthesized
gagaggaaattcctattcta

SEQ ID NO: 28057 - DNA, 20 bp, Artificial Sequence
  chemically synthesized
cctattctatagatctcatt

SEQ ID NO: 28058 - DNA, 20 bp, Artificial Sequence
  chemically synthesized
attctatagatctcatttgg

SEQ ID NO: 28059 - DNA, 20 bp, Artificial Sequence
  chemically synthesized
atagatctcatttggtagaa

SEQ ID NO: 28060 - DNA, 20 bp, Artificial Sequence
  chemically synthesized
tagatctcatttggtagaat

SEQ ID NO: 28061 - DNA, 20 bp, Artificial Sequence
  chemically synthesized
agatctcatttggtagaatg

SEQ ID NO: 28062 - DNA, 20 bp, Artificial Sequence
  chemically synthesized
agaatggggtacaaaaaatt

SEQ ID NO: 28063 - DNA, 20 bp, Artificial Sequence
  chemically synthesized
gaatggggtacaaaaaattt

SEQ ID NO: 28064 - DNA, 20 bp, Artificial Sequence
  chemically synthesized
ggtacaaaaaatttaggatt

SEQ ID NO: 28065 - DNA, 20 bp, Artificial Sequence
  chemically synthesized
aaaaatttaggatttggatt

SEQ ID NO: 28066 - DNA, 20 bp, Artificial Sequence
  chemically synthesized
tttaggatttggatttagat

SEQ ID NO: 28067 - DNA, 20 bp, Artificial Sequence
  chemically synthesized
ttggatttagattagcactg

SEQ ID NO: 28068 - DNA, 20 bp, Artificial Sequence
  chemically synthesized
ttttgcctcttattaacaaa

SEQ ID NO: 28069 - DNA, 20 bp, Artificial Sequence
  chemically synthesized
tctaaatttcattttcaaat

SEQ ID NO: 28070 - DNA, 20 bp, Artificial Sequence
  chemically synthesized
ctaaatttcattttcaaatt

SEQ ID NO: 28071 - DNA, 20 bp, Artificial Sequence
  chemically synthesized
ttcaaattaggaaatacgta

SEQ ID NO: 28072 - DNA, 20 bp, Artificial Sequence
  chemically synthesized
tcaaattaggaaatacgtac

SEQ ID NO: 28073 - DNA, 20 bp, Artificial Sequence
  chemically synthesized
ttgttactaaacgaatattg

SEQ ID NO: 28074 - DNA, 20 bp, Artificial Sequence
  chemically synthesized
actaaacgaatattgaagaa

SEQ ID NO: 28075 - DNA, 20 bp, Artificial Sequence
  chemically synthesized
taaacgaatattgaagaata

SEQ ID NO: 28076 - DNA, 20 bp, Artificial Sequence
  chemically synthesized
tagagttaacaatcaatatc

SEQ ID NO: 28077 - DNA, 20 bp, Artificial Sequence
  chemically synthesized
gttaacaatcaatatctggc

SEQ ID NO: 28078 - DNA, 20 bp, Artificial Sequence
  chemically synthesized
ttaacaatcaatatctggct

SEQ ID NO: 28079 - DNA, 20 bp, Artificial Sequence
  chemically synthesized
aatcaatatctggctgggcg

SEQ ID NO: 28080 - DNA, 20 bp, Artificial Sequence
  chemically synthesized
caatatctggctgggcgcgg

SEQ ID NO: 28081 - DNA, 20 bp, Artificial Sequence
  chemically synthesized
gtggctcacgcctgtaatcc

SEQ ID NO: 28082 - DNA, 20 bp, Artificial Sequence
  chemically synthesized
cgcctgtaatcccagcactc

SEQ ID NO: 28083 - DNA, 20 bp, Artificial Sequence
  chemically synthesized
gcctgtaatcccagcactct

SEQ ID NO: 28084 - DNA, 20 bp, Artificial Sequence
  chemically synthesized
ctgtaatcccagcactctgg

SEQ ID NO: 28085 - DNA, 20 bp, Artificial Sequence
  chemically synthesized
tgtaatcccagcactctggg

SEQ ID NO: 28086 - DNA, 20 bp, Artificial Sequence
  chemically synthesized
tcccagcactctgggaggcc

SEQ ID NO: 28087 - DNA, 20 bp, Artificial Sequence
  chemically synthesized
cccagcactctgggaggccg

SEQ ID NO: 28088 - DNA, 20 bp, Artificial Sequence
  chemically synthesized
agcactctgggaggccgagg

SEQ ID NO: 28089 - DNA, 20 bp, Artificial Sequence
  chemically synthesized
gcactctgggaggccgaggc

SEQ ID NO: 28090 - DNA, 20 bp, Artificial Sequence
  chemically synthesized
ctctgggaggccgaggcggg

SEQ ID NO: 28091 - DNA, 20 bp, Artificial Sequence
  chemically synthesized
ggccgaggcgggtggatcac

SEQ ID NO: 28092 - DNA, 20 bp, Artificial Sequence
  chemically synthesized
gccgaggcgggtggatcacg

SEQ ID NO: 28093 - DNA, 20 bp, Artificial Sequence
  chemically synthesized
aggcgggtggatcacgaggt

SEQ ID NO: 28094 - DNA, 20 bp, Artificial Sequence
  chemically synthesized
ggcgggtggatcacgaggtc

SEQ ID NO: 28095 - DNA, 20 bp, Artificial Sequence
  chemically synthesized
cgggtggatcacgaggtcag

SEQ ID NO: 28096 - DNA, 20 bp, Artificial Sequence
  chemically synthesized
gatcacgaggtcaggagatc

SEQ ID NO: 28097 - DNA, 20 bp, Artificial Sequence
  chemically synthesized
tcaggagatcgagaccatcc

SEQ ID NO: 28098 - DNA, 20 bp, Artificial Sequence
  chemically synthesized
cgagaccatcctggctaaca

SEQ ID NO: 28099 - DNA, 20 bp, Artificial Sequence
  chemically synthesized
gaccatcctggctaacacgg

SEQ ID NO: 28100 - DNA, 20 bp, Artificial Sequence
  chemically synthesized
ctggctaacacggtggaacc

SEQ ID NO: 28101 - DNA, 20 bp, Artificial Sequence
  chemically synthesized
gtctctactaaaaatacaaa

SEQ ID NO: 28102 - DNA, 20 bp, Artificial Sequence
  chemically synthesized
ctactaaaaatacaaaaagt

SEQ ID NO: 28103 - DNA, 20 bp, Artificial Sequence
  chemically synthesized
taaaaatacaaaaagttagc

SEQ ID NO: 28104 - DNA, 20 bp, Artificial Sequence
  chemically synthesized
aaaaatacaaaaagttagcc

SEQ ID NO: 28105 - DNA, 20 bp, Artificial Sequence
  chemically synthesized
tacaaaaagttagccgggca

SEQ ID NO: 28106 - DNA, 20 bp, Artificial Sequence
  chemically synthesized
aaaaagttagccgggcatgg

SEQ ID NO: 28107 - DNA, 20 bp, Artificial Sequence
  chemically synthesized
aagttagccgggcatggtgg

SEQ ID NO: 28108 - DNA, 20 bp, Artificial Sequence
  chemically synthesized
agttagccgggcatggtggt

SEQ ID NO: 28109 - DNA, 20 bp, Artificial Sequence
  chemically synthesized
ggcatggtggtgggcacctg

SEQ ID NO: 28110 - DNA, 20 bp, Artificial Sequence
  chemically synthesized
gtggtgggcacctgtagtcc

SEQ ID NO: 28111 - DNA, 20 bp, Artificial Sequence
  chemically synthesized
cacctgtagtcccagctact

SEQ ID NO: 28112 - DNA, 20 bp, Artificial Sequence
  chemically synthesized
acctgtagtcccagctactc

SEQ ID NO: 28113 - DNA, 20 bp, Artificial Sequence
  chemically synthesized
ctgtagtcccagctactcag

SEQ ID NO: 28114 - DNA, 20 bp, Artificial Sequence
  chemically synthesized
tgtagtcccagctactcagg

SEQ ID NO: 28115 - DNA, 20 bp, Artificial Sequence
  chemically synthesized
gtcccagctactcaggaggc

SEQ ID NO: 28116 - DNA, 20 bp, Artificial Sequence
  chemically synthesized
tcccagctactcaggaggct

SEQ ID NO: 28117 - DNA, 20 bp, Artificial Sequence
  chemically synthesized
cccagctactcaggaggctg

SEQ ID NO: 28118 - DNA, 20 bp, Artificial Sequence
  chemically synthesized
agctactcaggaggctgggg

SEQ ID NO: 28119 - DNA, 20 bp, Artificial Sequence
  chemically synthesized
tactcaggaggctggggcag

SEQ ID NO: 28120 - DNA, 20 bp, Artificial Sequence
  chemically synthesized
aggaggctggggcagcagaa

SEQ ID NO: 28121 - DNA, 20 bp, Artificial Sequence
  chemically synthesized
gcagcagaatggcgtgaacc

SEQ ID NO: 28122 - DNA, 20 bp, Artificial Sequence
  chemically synthesized
cagcagaatggcgtgaaccc

SEQ ID NO: 28123 - DNA, 20 bp, Artificial Sequence
  chemically synthesized
gcagaatggcgtgaacccag

SEQ ID NO: 28124 - DNA, 20 bp, Artificial Sequence
  chemically synthesized
cagaatggcgtgaacccagg

SEQ ID NO: 28125 - DNA, 20 bp, Artificial Sequence
  chemically synthesized
aatggcgtgaacccaggagg

SEQ ID NO: 28126 - DNA, 20 bp, Artificial Sequence
  chemically synthesized
tggcgtgaacccaggaggtg

SEQ ID NO: 28127 - DNA, 20 bp, Artificial Sequence
  chemically synthesized
aacccaggaggtggagcttg

SEQ ID NO: 28128 - DNA, 20 bp, Artificial Sequence
  chemically synthesized
caggaggtggagcttgcagt

SEQ ID NO: 28129 - DNA, 20 bp, Artificial Sequence
  chemically synthesized
ggtggagcttgcagtgagcc

SEQ ID NO: 28130 - DNA, 20 bp, Artificial Sequence
  chemically synthesized
gagatcgtgccactgcactc

SEQ ID NO: 28131 - DNA, 20 bp, Artificial Sequence
  chemically synthesized
cgtgccactgcactccagcc

SEQ ID NO: 28132 - DNA, 20 bp, Artificial Sequence
  chemically synthesized
gtgccactgcactccagcct

SEQ ID NO: 28133 - DNA, 20 bp, Artificial Sequence
  chemically synthesized
ctgcactccagcctgggcaa

SEQ ID NO: 28134 - DNA, 20 bp, Artificial Sequence
  chemically synthesized
gcactccagcctgggcaaca

SEQ ID NO: 28135 - DNA, 20 bp, Artificial Sequence
  chemically synthesized
tccagcctgggcaacagagc

SEQ ID NO: 28136 - DNA, 20 bp, Artificial Sequence
  chemically synthesized
ccttctcaaaaacaaaaaaa

SEQ ID NO: 28137 - DNA, 20 bp, Artificial Sequence
  chemically synthesized
aaataaatatctgtgctgtt

SEQ ID NO: 28138 - DNA, 20 bp, Artificial Sequence
  chemically synthesized
tatctgtgctgttaagtatg

SEQ ID NO: 28139 - DNA, 20 bp, Artificial Sequence
  chemically synthesized
tgctgttaagtatgtggtaa

SEQ ID NO: 28140 - DNA, 20 bp, Artificial Sequence
  chemically synthesized
ctgttaagtatgtggtaaaa

SEQ ID NO: 28141 - DNA, 20 bp, Artificial Sequence
  chemically synthesized
tgttaagtatgtggtaaaag

SEQ ID NO: 28142 - DNA, 20 bp, Artificial Sequence
  chemically synthesized
aaagaggtattttcacatac

SEQ ID NO: 28143 - DNA, 20 bp, Artificial Sequence
  chemically synthesized
taaaaaacaaaatacatcaa

SEQ ID NO: 28144 - DNA, 20 bp, Artificial Sequence
  chemically synthesized
aatattcatgctctgtgtct

SEQ ID NO: 28145 - DNA, 20 bp, Artificial Sequence
  chemically synthesized
taaatgataaattaaaaatt

SEQ ID NO: 28146 - DNA, 20 bp, Artificial Sequence
  chemically synthesized
aaatgataaattaaaaattt

SEQ ID NO: 28147 - DNA, 20 bp, Artificial Sequence
  chemically synthesized
aaattaaaaatttaggatgt

SEQ ID NO: 28148 - DNA, 20 bp, Artificial Sequence
  chemically synthesized
tttaggatgtaagctgtttg

SEQ ID NO: 28149 - DNA, 20 bp, Artificial Sequence
  chemically synthesized
atttttttcctgtttgctca

SEQ ID NO: 28150 - DNA, 20 bp, Artificial Sequence
  chemically synthesized
acagttctaaatccatctcc

SEQ ID NO: 28151 - DNA, 20 bp, Artificial Sequence
  chemically synthesized
cagttctaaatccatctcct

SEQ ID NO: 28152 - DNA, 20 bp, Artificial Sequence
  chemically synthesized
tctaaatccatctcctaggt

SEQ ID NO: 28153 - DNA, 20 bp, Artificial Sequence
  chemically synthesized
tatgtgttgaactatttaat

SEQ ID NO: 28154 - DNA, 20 bp, Artificial Sequence
  chemically synthesized
gtgttattgttcataatttt

SEQ ID NO: 28155 - DNA, 20 bp, Artificial Sequence
  chemically synthesized
gttcataattttaagaatgt

SEQ ID NO: 28156 - DNA, 20 bp, Artificial Sequence
  chemically synthesized
atgtaagcatacaaaatgtc

SEQ ID NO: 28157 - DNA, 20 bp, Artificial Sequence
  chemically synthesized
taaaaatattacataaatca

SEQ ID NO: 28158 - DNA, 20 bp, Artificial Sequence
  chemically synthesized
taaaatgacatttaaatgct

SEQ ID NO: 28159 - DNA, 20 bp, Artificial Sequence
  chemically synthesized
aaaatgacatttaaatgctt

SEQ ID NO: 28160 - DNA, 20 bp, Artificial Sequence
  chemically synthesized
ttaaatgcttaggaaactgt

SEQ ID NO: 28161 - DNA, 20 bp, Artificial Sequence
  chemically synthesized
gcaaaatattaaataaaaat

SEQ ID NO: 28162 - DNA, 20 bp, Artificial Sequence
  chemically synthesized
taaataaaaataagcaaaat

SEQ ID NO: 28163 - DNA, 20 bp, Artificial Sequence
  chemically synthesized
aaataaaaataagcaaaatt

SEQ ID NO: 28164 - DNA, 20 bp, Artificial Sequence
  chemically synthesized
aaaataagcaaaattaggta

SEQ ID NO: 28165 - DNA, 20 bp, Artificial Sequence
  chemically synthesized
acagaacaatcactatgtaa

SEQ ID NO: 28166 - DNA, 20 bp, Artificial Sequence
  chemically synthesized
cagaacaatcactatgtaaa

SEQ ID NO: 28167 - DNA, 20 bp, Artificial Sequence
  chemically synthesized
gctataaatatttgtatcaa

SEQ ID NO: 28168 - DNA, 20 bp, Artificial Sequence
  chemically synthesized
tatttgtatcaaaagaaaaa

SEQ ID NO: 28169 - DNA, 20 bp, Artificial Sequence
  chemically synthesized
atataatcttattttctata

SEQ ID NO: 28170 - DNA, 20 bp, Artificial Sequence
  chemically synthesized
tgccgtatacaaattttctg

SEQ ID NO: 28171 - DNA, 20 bp, Artificial Sequence
  chemically synthesized
cgtatacaaattttctgaag

SEQ ID NO: 28172 - DNA, 20 bp, Artificial Sequence
  chemically synthesized
attttctgaagaagacattt

SEQ ID NO: 28173 - DNA, 20 bp, Artificial Sequence
  chemically synthesized
tttcggttttataatctaaa

SEQ ID NO: 28174 - DNA, 20 bp, Artificial Sequence
  chemically synthesized
tcggttttataatctaaaaa

SEQ ID NO: 28175 - DNA, 20 bp, Artificial Sequence
  chemically synthesized
cattttacaatgactataaa

SEQ ID NO: 28176 - DNA, 20 bp, Artificial Sequence
  chemically synthesized
agttatatacgattatgctg

SEQ ID NO: 28177 - DNA, 20 bp, Artificial Sequence
  chemically synthesized
ttatgctgaagatgacaatg

SEQ ID NO: 28178 - DNA, 20 bp, Artificial Sequence
  chemically synthesized
gataaatgctaatgtttatt

SEQ ID NO: 28179 - DNA, 20 bp, Artificial Sequence
  chemically synthesized
tttattaagcatttaactca

SEQ ID NO: 28180 - DNA, 20 bp, Artificial Sequence
  chemically synthesized
attaagcatttaactcacgg

SEQ ID NO: 28181 - DNA, 20 bp, Artificial Sequence
  chemically synthesized
taagcatttaactcacggta

SEQ ID NO: 28182 - DNA, 20 bp, Artificial Sequence
  chemically synthesized
agcatttaactcacggtaga

SEQ ID NO: 28183 - DNA, 20 bp, Artificial Sequence
  chemically synthesized
gcatttaactcacggtagag

SEQ ID NO: 28184 - DNA, 20 bp, Artificial Sequence
  chemically synthesized
catttaactcacggtagaga

SEQ ID NO: 28185 - DNA, 20 bp, Artificial Sequence
  chemically synthesized
aactcacggtagagagggct

SEQ ID NO: 28186 - DNA, 20 bp, Artificial Sequence
  chemically synthesized
attttctcaccaaacctgtg

SEQ ID NO: 28187 - DNA, 20 bp, Artificial Sequence
  chemically synthesized
ttctcaccaaacctgtgaag

SEQ ID NO: 28188 - DNA, 20 bp, Artificial Sequence
  chemically synthesized
tctcaccaaacctgtgaagt

SEQ ID NO: 28189 - DNA, 20 bp, Artificial Sequence
  chemically synthesized
ctcaccaaacctgtgaagta

SEQ ID NO: 28190 - DNA, 20 bp, Artificial Sequence
  chemically synthesized
caccaaacctgtgaagtagg

SEQ ID NO: 28191 - DNA, 20 bp, Artificial Sequence
  chemically synthesized
accaaacctgtgaagtaggg

SEQ ID NO: 28192 - DNA, 20 bp, Artificial Sequence
  chemically synthesized
tattttcaatgttttaaaat

SEQ ID NO: 28193 - DNA, 20 bp, Artificial Sequence
  chemically synthesized
attttcaatgttttaaaatt

SEQ ID NO: 28194 - DNA, 20 bp, Artificial Sequence
  chemically synthesized
tgttttaaaattaggaaact

SEQ ID NO: 28195 - DNA, 20 bp, Artificial Sequence
  chemically synthesized
gttttaaaattaggaaactg

SEQ ID NO: 28196 - DNA, 20 bp, Artificial Sequence
  chemically synthesized
aattaggaaactgaggctca

SEQ ID NO: 28197 - DNA, 20 bp, Artificial Sequence
  chemically synthesized
ttaggaaactgaggctcaca

SEQ ID NO: 28198 - DNA, 20 bp, Artificial Sequence
  chemically synthesized
taggaaactgaggctcacag

SEQ ID NO: 28199 - DNA, 20 bp, Artificial Sequence
  chemically synthesized
aaactgaggctcacagagga

SEQ ID NO: 28200 - DNA, 20 bp, Artificial Sequence
  chemically synthesized
cagaggaaagcaactttcct

SEQ ID NO: 28201 - DNA, 20 bp, Artificial Sequence
  chemically synthesized
cttagttaaatcattaatgt

SEQ ID NO: 28202 - DNA, 20 bp, Artificial Sequence
  chemically synthesized
gttaaatcattaatgtaagt

SEQ ID NO: 28203 - DNA, 20 bp, Artificial Sequence
  chemically synthesized
cagaactgaaattcaatatc

SEQ ID NO: 28204 - DNA, 20 bp, Artificial Sequence
  chemically synthesized
attttcttaaaccattatgc

SEQ ID NO: 28205 - DNA, 20 bp, Artificial Sequence
  chemically synthesized
atgctggactcctctccaaa

SEQ ID NO: 28206 - DNA, 20 bp, Artificial Sequence
  chemically synthesized
tgctggactcctctccaaac

SEQ ID NO: 28207 - DNA, 20 bp, Artificial Sequence
  chemically synthesized
ccaaacaggaccactcgttt

SEQ ID NO: 28208 - DNA, 20 bp, Artificial Sequence
  chemically synthesized
caaacaggaccactcgtttc

SEQ ID NO: 28209 - DNA, 20 bp, Artificial Sequence
  chemically synthesized
aaacaggaccactcgtttca

SEQ ID NO: 28210 - DNA, 20 bp, Artificial Sequence
  chemically synthesized
atgttttccatgttatactg

SEQ ID NO: 28211 - DNA, 20 bp, Artificial Sequence
  chemically synthesized
tgttttccatgttatactga

SEQ ID NO: 28212 - DNA, 20 bp, Artificial Sequence
  chemically synthesized
tttccatgttatactgaagg

SEQ ID NO: 28213 - DNA, 20 bp, Artificial Sequence
  chemically synthesized
actgaaggaagtcccatcat

SEQ ID NO: 28214 - DNA, 20 bp, Artificial Sequence
  chemically synthesized
taactttttgttccctttcc

SEQ ID NO: 28215 - DNA, 20 bp, Artificial Sequence
  chemically synthesized
atgttatctatttttccatt

SEQ ID NO: 28216 - DNA, 20 bp, Artificial Sequence
  chemically synthesized
tctatttttccatttagtat

SEQ ID NO: 28217 - DNA, 20 bp, Artificial Sequence
  chemically synthesized
ctatttttccatttagtatc

SEQ ID NO: 28218 - DNA, 20 bp, Artificial Sequence
  chemically synthesized
tttccatttagtatcaggaa

SEQ ID NO: 28219 - DNA, 20 bp, Artificial Sequence
  chemically synthesized
catttagtatcaggaaaaga

SEQ ID NO: 28220 - DNA, 20 bp, Artificial Sequence
  chemically synthesized
gtatcaggaaaagatagcaa

SEQ ID NO: 28221 - DNA, 20 bp, Artificial Sequence
  chemically synthesized
gaaaagatagcaacagaaaa

SEQ ID NO: 28222 - DNA, 20 bp, Artificial Sequence
  chemically synthesized
ttgtattaaatactttttaa

SEQ ID NO: 28223 - DNA, 20 bp, Artificial Sequence
  chemically synthesized
tttttaatagacttgatttt

SEQ ID NO: 28224 - DNA, 20 bp, Artificial Sequence
  chemically synthesized
tttaatagacttgattttaa

SEQ ID NO: 28225 - DNA, 20 bp, Artificial Sequence
  chemically synthesized
agacttgattttaagagtta

SEQ ID NO: 28226 - DNA, 20 bp, Artificial Sequence
  chemically synthesized
ttttaagagttatagattca

SEQ ID NO: 28227 - DNA, 20 bp, Artificial Sequence
  chemically synthesized
tatagattcacagaaaaact

SEQ ID NO: 28228 - DNA, 20 bp, Artificial Sequence
  chemically synthesized
agattcacagaaaaactcag

SEQ ID NO: 28229 - DNA, 20 bp, Artificial Sequence
  chemically synthesized
ttcacagaaaaactcagtag

SEQ ID NO: 28230 - DNA, 20 bp, Artificial Sequence
  chemically synthesized
tcacagaaaaactcagtaga

SEQ ID NO: 28231 - DNA, 20 bp, Artificial Sequence
  chemically synthesized
aaaactcagtagaaggtact

SEQ ID NO: 28232 - DNA, 20 bp, Artificial Sequence
  chemically synthesized
accttctattttgcatatca

SEQ ID NO: 28233 - DNA, 20 bp, Artificial Sequence
  chemically synthesized
tttgcatatcatggtttttt

SEQ ID NO: 28234 - DNA, 20 bp, Artificial Sequence
  chemically synthesized
tttaagcacatattataacc

SEQ ID NO: 28235 - DNA, 20 bp, Artificial Sequence
  chemically synthesized
ttaagcacatattataacct

SEQ ID NO: 28236 - DNA, 20 bp, Artificial Sequence
  chemically synthesized
tataacctaggtattattct

SEQ ID NO: 28237 - DNA, 20 bp, Artificial Sequence
  chemically synthesized
ataacctaggtattattcta

SEQ ID NO: 28238 - DNA, 20 bp, Artificial Sequence
  chemically synthesized
taacctaggtattattctaa

SEQ ID NO: 28239 - DNA, 20 bp, Artificial Sequence
  chemically synthesized
ctaagggcataatacactat

SEQ ID NO: 28240 - DNA, 20 bp, Artificial Sequence
  chemically synthesized
tatcttgacaataaccttat

SEQ ID NO: 28241 - DNA, 20 bp, Artificial Sequence
  chemically synthesized
ttgacaataaccttatgaga

SEQ ID NO: 28242 - DNA, 20 bp, Artificial Sequence
  chemically synthesized
ccttatgagatggatactac

SEQ ID NO: 28243 - DNA, 20 bp, Artificial Sequence
  chemically synthesized
ctactagattacccatttta

SEQ ID NO: 28244 - DNA, 20 bp, Artificial Sequence
  chemically synthesized
agattacccattttacagat

SEQ ID NO: 28245 - DNA, 20 bp, Artificial Sequence
  chemically synthesized
attttacagataagtacact

SEQ ID NO: 28246 - DNA, 20 bp, Artificial Sequence
  chemically synthesized
ttttacagataagtacactg

SEQ ID NO: 28247 - DNA, 20 bp, Artificial Sequence
  chemically synthesized
cagataagtacactgaggct

SEQ ID NO: 28248 - DNA, 20 bp, Artificial Sequence
  chemically synthesized
gataagtacactgaggctca

SEQ ID NO: 28249 - DNA, 20 bp, Artificial Sequence
  chemically synthesized
atcttgcccaatattatacc

SEQ ID NO: 28250 - DNA, 20 bp, Artificial Sequence
  chemically synthesized
caatattataccaagtttga

SEQ ID NO: 28251 - DNA, 20 bp, Artificial Sequence
  chemically synthesized
aagtttgacagttctgactg

SEQ ID NO: 28252 - DNA, 20 bp, Artificial Sequence
  chemically synthesized
agttctgactgtggtgcttg

SEQ ID NO: 28253 - DNA, 20 bp, Artificial Sequence
  chemically synthesized
aaccaaaaaaaacataaaat

SEQ ID NO: 28254 - DNA, 20 bp, Artificial Sequence
  chemically synthesized
aaaaaacataaaatcagcca

SEQ ID NO: 28255 - DNA, 20 bp, Artificial Sequence
  chemically synthesized
gtacatattcctgctaatga

SEQ ID NO: 28256 - DNA, 20 bp, Artificial Sequence
  chemically synthesized
agtatctgctttaaatcatc

SEQ ID NO: 28257 - DNA, 20 bp, Artificial Sequence
  chemically synthesized
aaatcatctggcccattcct

SEQ ID NO: 28258 - DNA, 20 bp, Artificial Sequence
  chemically synthesized
tctggcccattcctcagcac

SEQ ID NO: 28259 - DNA, 20 bp, Artificial Sequence
  chemically synthesized
agcacaagcctatattcctg

SEQ ID NO: 28260 - DNA, 20 bp, Artificial Sequence
  chemically synthesized
gcacaagcctatattcctgc

SEQ ID NO: 28261 - DNA, 20 bp, Artificial Sequence
  chemically synthesized
tcccgttatttaatatccac

SEQ ID NO: 28262 - DNA, 20 bp, Artificial Sequence
  chemically synthesized
taatatccacaagcctctct

SEQ ID NO: 28263 - DNA, 20 bp, Artificial Sequence
  chemically synthesized
gatactgtatttgtaaaaca

SEQ ID NO: 28264 - DNA, 20 bp, Artificial Sequence
  chemically synthesized
ctgtatttgtaaaacacaga

SEQ ID NO: 28265 - DNA, 20 bp, Artificial Sequence
  chemically synthesized
acagatggctcatgtaattg

SEQ ID NO: 28266 - DNA, 20 bp, Artificial Sequence
  chemically synthesized
gctcatgtaattgaagttca

SEQ ID NO: 28267 - DNA, 20 bp, Artificial Sequence
  chemically synthesized
ttttgctttgtgacaactct

SEQ ID NO: 28268 - DNA, 20 bp, Artificial Sequence
  chemically synthesized
atgttacctattttgaatga

SEQ ID NO: 28269 - DNA, 20 bp, Artificial Sequence
  chemically synthesized
acctattttgaatgatagtg

SEQ ID NO: 28270 - DNA, 20 bp, Artificial Sequence
  chemically synthesized
ttgaatgatagtgcagacat

SEQ ID NO: 28271 - DNA, 20 bp, Artificial Sequence
  chemically synthesized
atgatagtgcagacattagt

SEQ ID NO: 28272 - DNA, 20 bp, Artificial Sequence
  chemically synthesized
tgatagtgcagacattagta

SEQ ID NO: 28273 - DNA, 20 bp, Artificial Sequence
  chemically synthesized
agtgcagacattagtaagga

SEQ ID NO: 28274 - DNA, 20 bp, Artificial Sequence
  chemically synthesized
tgctaaatatttgtatcacc

SEQ ID NO: 28275 - DNA, 20 bp, Artificial Sequence
  chemically synthesized
gctaaatatttgtatcacct

SEQ ID NO: 28276 - DNA, 20 bp, Artificial Sequence
  chemically synthesized
aaatatttgtatcacctggg

SEQ ID NO: 28277 - DNA, 20 bp, Artificial Sequence
  chemically synthesized
gaagcctgtttttgcttcat

SEQ ID NO: 28278 - DNA, 20 bp, Artificial Sequence
  chemically synthesized
aagcctgtttttgcttcatc

SEQ ID NO: 28279 - DNA, 20 bp, Artificial Sequence
  chemically synthesized
agcctgtttttgcttcatca

SEQ ID NO: 28280 - DNA, 20 bp, Artificial Sequence
  chemically synthesized
gcctgtttttgcttcatcag

SEQ ID NO: 28281 - DNA, 20 bp, Artificial Sequence
  chemically synthesized
tttgcttcatcaggggacgt

SEQ ID NO: 28282 - DNA, 20 bp, Artificial Sequence
  chemically synthesized
tttttcacatcaacctcctg

SEQ ID NO: 28283 - DNA, 20 bp, Artificial Sequence
  chemically synthesized
ttcacatcaacctcctgcag

SEQ ID NO: 28284 - DNA, 20 bp, Artificial Sequence
  chemically synthesized
cagaagacaatgctttctga

SEQ ID NO: 28285 - DNA, 20 bp, Artificial Sequence
  chemically synthesized
agacaatgctttctgaaaga

SEQ ID NO: 28286 - DNA, 20 bp, Artificial Sequence
  chemically synthesized
acaatgctttctgaaagaca

SEQ ID NO: 28287 - DNA, 20 bp, Artificial Sequence
  chemically synthesized
gcattcaaatatctgaccca

SEQ ID NO: 28288 - DNA, 20 bp, Artificial Sequence
  chemically synthesized
gtgatctttacatacttgct

SEQ ID NO: 28289 - DNA, 20 bp, Artificial Sequence
  chemically synthesized
catacttgctcagtgaatga

SEQ ID NO: 28290 - DNA, 20 bp, Artificial Sequence
  chemically synthesized
aatgacagtgaataactacc

SEQ ID NO: 28291 - DNA, 20 bp, Artificial Sequence
  chemically synthesized
tgaataactacctggttgta

SEQ ID NO: 28292 - DNA, 20 bp, Artificial Sequence
  chemically synthesized
ctggttgtaaagactgtctc

SEQ ID NO: 28293 - DNA, 20 bp, Artificial Sequence
  chemically synthesized
tggttgtaaagactgtctca

SEQ ID NO: 28294 - DNA, 20 bp, Artificial Sequence
  chemically synthesized
ggttgtaaagactgtctcaa

SEQ ID NO: 28295 - DNA, 20 bp, Artificial Sequence
  chemically synthesized
gttgtaaagactgtctcaag

SEQ ID NO: 28296 - DNA, 20 bp, Artificial Sequence
  chemically synthesized
gtctcaaggggacttttgtc

SEQ ID NO: 28297 - DNA, 20 bp, Artificial Sequence
  chemically synthesized
tctcaaggggacttttgtct

SEQ ID NO: 28298 - DNA, 20 bp, Artificial Sequence
  chemically synthesized
aggggacttttgtctgggaa

SEQ ID NO: 28299 - DNA, 20 bp, Artificial Sequence
  chemically synthesized
acttttgtctgggaaaagaa

SEQ ID NO: 28300 - DNA, 20 bp, Artificial Sequence
  chemically synthesized
ttgtctgggaaaagaaaaga

SEQ ID NO: 28301 - DNA, 20 bp, Artificial Sequence
  chemically synthesized
aaaagaaaagaaagacaaaa

SEQ ID NO: 28302 - DNA, 20 bp, Artificial Sequence
  chemically synthesized
aagaaaagaaagacaaaaaa

SEQ ID NO: 28303 - DNA, 20 bp, Artificial Sequence
  chemically synthesized
agaaaagaaagacaaaaaag

SEQ ID NO: 28304 - DNA, 20 bp, Artificial Sequence
  chemically synthesized
gaaagacaaaaaagaggatt

SEQ ID NO: 28305 - DNA, 20 bp, Artificial Sequence
  chemically synthesized
agacaaaaaagaggattgag

SEQ ID NO: 28306 - DNA, 20 bp, Artificial Sequence
  chemically synthesized
acccaataaattttcttatg

SEQ ID NO: 28307 - DNA, 20 bp, Artificial Sequence
  chemically synthesized
aataaattttcttatgaagt

SEQ ID NO: 28308 - DNA, 20 bp, Artificial Sequence
  chemically synthesized
aaattttcttatgaagttgg

SEQ ID NO: 28309 - DNA, 20 bp, Artificial Sequence
  chemically synthesized
tttcttatgaagttggcagc

SEQ ID NO: 28310 - DNA, 20 bp, Artificial Sequence
  chemically synthesized
ttcttatgaagttggcagct

SEQ ID NO: 28311 - DNA, 20 bp, Artificial Sequence
  chemically synthesized
tcttatgaagttggcagctg

SEQ ID NO: 28312 - DNA, 20 bp, Artificial Sequence
  chemically synthesized
ttatgaagttggcagctggg

SEQ ID NO: 28313 - DNA, 20 bp, Artificial Sequence
  chemically synthesized
atgaagttggcagctgggga

SEQ ID NO: 28314 - DNA, 20 bp, Artificial Sequence
  chemically synthesized
aagttggcagctggggagag

SEQ ID NO: 28315 - DNA, 20 bp, Artificial Sequence
  chemically synthesized
tggcagctggggagagaaga

SEQ ID NO: 28316 - DNA, 20 bp, Artificial Sequence
  chemically synthesized
gctggggagagaagacagtc

SEQ ID NO: 28317 - DNA, 20 bp, Artificial Sequence
  chemically synthesized
ctggggagagaagacagtca

SEQ ID NO: 28318 - DNA, 20 bp, Artificial Sequence
  chemically synthesized
gaagacagtcaaggatcctc

SEQ ID NO: 28319 - DNA, 20 bp, Artificial Sequence
  chemically synthesized
tggctcactgaaatacctcc

SEQ ID NO: 28320 - DNA, 20 bp, Artificial Sequence
  chemically synthesized
gctcactgaaatacctccta

SEQ ID NO: 28321 - DNA, 20 bp, Artificial Sequence
  chemically synthesized
ctcactgaaatacctcctag

SEQ ID NO: 28322 - DNA, 20 bp, Artificial Sequence
  chemically synthesized
atacctcctagaggtactca

SEQ ID NO: 28323 - DNA, 20 bp, Artificial Sequence
  chemically synthesized
ggttcactaaatttccattt

SEQ ID NO: 28324 - DNA, 20 bp, Artificial Sequence
  chemically synthesized
aaatttccatttaagataac

SEQ ID NO: 28325 - DNA, 20 bp, Artificial Sequence
  chemically synthesized
aatttccatttaagataact

SEQ ID NO: 28326 - DNA, 20 bp, Artificial Sequence
  chemically synthesized
actgggcatctcaaatgctt

SEQ ID NO: 28327 - DNA, 20 bp, Artificial Sequence
  chemically synthesized
gcatctcaaatgctttggtc

SEQ ID NO: 28328 - DNA, 20 bp, Artificial Sequence
  chemically synthesized
catctcaaatgctttggtct

SEQ ID NO: 28329 - DNA, 20 bp, Artificial Sequence
  chemically synthesized
tctcaaatgctttggtctag

SEQ ID NO: 28330 - DNA, 20 bp, Artificial Sequence
  chemically synthesized
ctcaaatgctttggtctagg

SEQ ID NO: 28331 - DNA, 20 bp, Artificial Sequence
  chemically synthesized
atccctctttgacattcatc

SEQ ID NO: 28332 - DNA, 20 bp, Artificial Sequence
  chemically synthesized
tcatcaagtctgcgtccatc

SEQ ID NO: 28333 - DNA, 20 bp, Artificial Sequence
  chemically synthesized
catcaagtctgcgtccatct

SEQ ID NO: 28334 - DNA, 20 bp, Artificial Sequence
  chemically synthesized
atcaagtctgcgtccatcta

SEQ ID NO: 28335 - DNA, 20 bp, Artificial Sequence
  chemically synthesized
caagtctgcgtccatctagg

SEQ ID NO: 28336 - DNA, 20 bp, Artificial Sequence
  chemically synthesized
ccatctagggagattccttt

SEQ ID NO: 28337 - DNA, 20 bp, Artificial Sequence
  chemically synthesized
catctagggagattcctttg

SEQ ID NO: 28338 - DNA, 20 bp, Artificial Sequence
  chemically synthesized
atctagggagattcctttga

SEQ ID NO: 28339 - DNA, 20 bp, Artificial Sequence
  chemically synthesized
ggagattcctttgagggcca

SEQ ID NO: 28340 - DNA, 20 bp, Artificial Sequence
  chemically synthesized
cctttgagggccaaagaccc

SEQ ID NO: 28341 - DNA, 20 bp, Artificial Sequence
  chemically synthesized
ctttgagggccaaagaccca

SEQ ID NO: 28342 - DNA, 20 bp, Artificial Sequence
  chemically synthesized
tgagggccaaagacccaagg

SEQ ID NO: 28343 - DNA, 20 bp, Artificial Sequence
  chemically synthesized
agggccaaagacccaaggaa

SEQ ID NO: 28344 - DNA, 20 bp, Artificial Sequence
  chemically synthesized
ggccaaagacccaaggaaga

SEQ ID NO: 28345 - DNA, 20 bp, Artificial Sequence
  chemically synthesized
aaagacccaaggaagagaga

SEQ ID NO: 28346 - DNA, 20 bp, Artificial Sequence
  chemically synthesized
aggaagagagacagctttat

SEQ ID NO: 28347 - DNA, 20 bp, Artificial Sequence
  chemically synthesized
agagacagctttataagtgc

SEQ ID NO: 28348 - DNA, 20 bp, Artificial Sequence
  chemically synthesized
cagctttataagtgccagtg

SEQ ID NO: 28349 - DNA, 20 bp, Artificial Sequence
  chemically synthesized
aagtgccagtgcagcccacg

SEQ ID NO: 28350 - DNA, 20 bp, Artificial Sequence
  chemically synthesized
ccagtgcagcccacgtagaa

SEQ ID NO: 28351 - DNA, 20 bp, Artificial Sequence
  chemically synthesized
cccacgtagaacagcatcct

SEQ ID NO: 28352 - DNA, 20 bp, Artificial Sequence
  chemically synthesized
gaacagcatcctgagtcaaa

SEQ ID NO: 28353 - DNA, 20 bp, Artificial Sequence
  chemically synthesized
cagcatcctgagtcaaatgg

SEQ ID NO: 28354 - DNA, 20 bp, Artificial Sequence
  chemically synthesized
ctgagtcaaatggaagatgc

SEQ ID NO: 28355 - DNA, 20 bp, Artificial Sequence
  chemically synthesized
tcaaatggaagatgctggca

SEQ ID NO: 28356 - DNA, 20 bp, Artificial Sequence
  chemically synthesized
aaatggaagatgctggcatg

SEQ ID NO: 28357 - DNA, 20 bp, Artificial Sequence
  chemically synthesized
tggaagatgctggcatggag

SEQ ID NO: 28358 - DNA, 20 bp, Artificial Sequence
  chemically synthesized
aagatgctggcatggagtgg

SEQ ID NO: 28359 - DNA, 20 bp, Artificial Sequence
  chemically synthesized
agatgctggcatggagtgga

SEQ ID NO: 28360 - DNA, 20 bp, Artificial Sequence
  chemically synthesized
gatgctggcatggagtggaa

SEQ ID NO: 28361 - DNA, 20 bp, Artificial Sequence
  chemically synthesized
atggagtggaagggctgcat

SEQ ID NO: 28362 - DNA, 20 bp, Artificial Sequence
  chemically synthesized
agtggaagggctgcatgaga

SEQ ID NO: 28363 - DNA, 20 bp, Artificial Sequence
  chemically synthesized
ggaagggctgcatgagaaag

SEQ ID NO: 28364 - DNA, 20 bp, Artificial Sequence
  chemically synthesized
gctgcatgagaaagaagcta

SEQ ID NO: 28365 - DNA, 20 bp, Artificial Sequence
  chemically synthesized
tgcatgagaaagaagctaca

SEQ ID NO: 28366 - DNA, 20 bp, Artificial Sequence
  chemically synthesized
atgagaaagaagctacagag

SEQ ID NO: 28367 - DNA, 20 bp, Artificial Sequence
  chemically synthesized
gaaagaagctacagagaaga

SEQ ID NO: 28368 - DNA, 20 bp, Artificial Sequence
  chemically synthesized
aaagaagctacagagaagaa

SEQ ID NO: 28369 - DNA, 20 bp, Artificial Sequence
  chemically synthesized
agctacagagaagaaaggac

SEQ ID NO: 28370 - DNA, 20 bp, Artificial Sequence
  chemically synthesized
acagagaagaaaggaccagt

SEQ ID NO: 28371 - DNA, 20 bp, Artificial Sequence
  chemically synthesized
aaaggaccagtaagttgctg

SEQ ID NO: 28372 - DNA, 20 bp, Artificial Sequence
  chemically synthesized
aaggaccagtaagttgctga

SEQ ID NO: 28373 - DNA, 20 bp, Artificial Sequence
  chemically synthesized
gctgaaggtcctttgttttg

SEQ ID NO: 28374 - DNA, 20 bp, Artificial Sequence
  chemically synthesized
ggtcctttgttttgtggata

SEQ ID NO: 28375 - DNA, 20 bp, Artificial Sequence
  chemically synthesized
gtcctttgttttgtggataa

SEQ ID NO: 28376 - DNA, 20 bp, Artificial Sequence
  chemically synthesized
ctttgttttgtggataaagg

SEQ ID NO: 28377 - DNA, 20 bp, Artificial Sequence
  chemically synthesized
ttgtggataaaggaagtcat

SEQ ID NO: 28378 - DNA, 20 bp, Artificial Sequence
  chemically synthesized
gtggataaaggaagtcattg

SEQ ID NO: 28379 - DNA, 20 bp, Artificial Sequence
  chemically synthesized
cctctctaatatcccttatc

SEQ ID NO: 28380 - DNA, 20 bp, Artificial Sequence
  chemically synthesized
ttatctagcatgactatatg

SEQ ID NO: 28381 - DNA, 20 bp, Artificial Sequence
  chemically synthesized
tatctagcatgactatatgc

SEQ ID NO: 28382 - DNA, 20 bp, Artificial Sequence
  chemically synthesized
atctagcatgactatatgca

SEQ ID NO: 28383 - DNA, 20 bp, Artificial Sequence
  chemically synthesized
catgactatatgcagggtta

SEQ ID NO: 28384 - DNA, 20 bp, Artificial Sequence
  chemically synthesized
ctatatgcagggttatggaa

SEQ ID NO: 28385 - DNA, 20 bp, Artificial Sequence
  chemically synthesized
tatatgcagggttatggaat

SEQ ID NO: 28386 - DNA, 20 bp, Artificial Sequence
  chemically synthesized
atatgcagggttatggaata

SEQ ID NO: 28387 - DNA, 20 bp, Artificial Sequence
  chemically synthesized
tgcagggttatggaataggg

SEQ ID NO: 28388 - DNA, 20 bp, Artificial Sequence
  chemically synthesized
ttatggaatagggcagcttc

SEQ ID NO: 28389 - DNA, 20 bp, Artificial Sequence
  chemically synthesized
tatggaatagggcagcttcc

SEQ ID NO: 28390 - DNA, 20 bp, Artificial Sequence
  chemically synthesized
ggaatagggcagcttccagg

SEQ ID NO: 28391 - DNA, 20 bp, Artificial Sequence
  chemically synthesized
tagggcagcttccaggaaga

SEQ ID NO: 28392 - DNA, 20 bp, Artificial Sequence
  chemically synthesized
gaagatggccaatctgttgt

SEQ ID NO: 28393 - DNA, 20 bp, Artificial Sequence
  chemically synthesized
aagatggccaatctgttgtt

SEQ ID NO: 28394 - DNA, 20 bp, Artificial Sequence
  chemically synthesized
agatggccaatctgttgtta

SEQ ID NO: 28395 - DNA, 20 bp, Artificial Sequence
  chemically synthesized
atctcccgtgatgtttttga

SEQ ID NO: 28396 - DNA, 20 bp, Artificial Sequence
  chemically synthesized
tctcccgtgatgtttttgat

SEQ ID NO: 28397 - DNA, 20 bp, Artificial Sequence
  chemically synthesized
ctcccgtgatgtttttgatg

SEQ ID NO: 28398 - DNA, 20 bp, Artificial Sequence
  chemically synthesized
ccgtgatgtttttgatgggg

SEQ ID NO: 28399 - DNA, 20 bp, Artificial Sequence
  chemically synthesized
gatgtttttgatggggaaga

SEQ ID NO: 28400 - DNA, 20 bp, Artificial Sequence
  chemically synthesized
tttgatggggaagacagatc

SEQ ID NO: 28401 - DNA, 20 bp, Artificial Sequence
  chemically synthesized
gacagatctggacttgttac

SEQ ID NO: 28402 - DNA, 20 bp, Artificial Sequence
  chemically synthesized
acagatctggacttgttact

SEQ ID NO: 28403 - DNA, 20 bp, Artificial Sequence
  chemically synthesized
tgttactgggctatgccttg

SEQ ID NO: 28404 - DNA, 20 bp, Artificial Sequence
  chemically synthesized
ttactgggctatgccttgta

SEQ ID NO: 28405 - DNA, 20 bp, Artificial Sequence
  chemically synthesized
atgccttgtagagaatgata

SEQ ID NO: 28406 - DNA, 20 bp, Artificial Sequence
  chemically synthesized
tgccttgtagagaatgatac

SEQ ID NO: 28407 - DNA, 20 bp, Artificial Sequence
  chemically synthesized
gccttgtagagaatgataca

SEQ ID NO: 28408 - DNA, 20 bp, Artificial Sequence
  chemically synthesized
tagagaatgatacagggttg

SEQ ID NO: 28409 - DNA, 20 bp, Artificial Sequence
  chemically synthesized
agaatgatacagggttgtgg

SEQ ID NO: 28410 - DNA, 20 bp, Artificial Sequence
  chemically synthesized
gaatgatacagggttgtggc

SEQ ID NO: 28411 - DNA, 20 bp, Artificial Sequence
  chemically synthesized
gatacagggttgtggcaggc

SEQ ID NO: 28412 - DNA, 20 bp, Artificial Sequence
  chemically synthesized
atacagggttgtggcaggca

SEQ ID NO: 28413 - DNA, 20 bp, Artificial Sequence
  chemically synthesized
caggcaaggaaacataatct

SEQ ID NO: 28414 - DNA, 20 bp, Artificial Sequence
  chemically synthesized
agcaattgctccaattgatg

SEQ ID NO: 28415 - DNA, 20 bp, Artificial Sequence
  chemically synthesized
tgatgaagcttctaacattt

SEQ ID NO: 28416 - DNA, 20 bp, Artificial Sequence
  chemically synthesized
atgaagcttctaacatttca

SEQ ID NO: 28417 - DNA, 20 bp, Artificial Sequence
  chemically synthesized
tttcagagtgctttcctcca

SEQ ID NO: 28418 - DNA, 20 bp, Artificial Sequence
  chemically synthesized
acctaatcatttctctcgaa

SEQ ID NO: 28419 - DNA, 20 bp, Artificial Sequence
  chemically synthesized
ctaatcatttctctcgaaaa

SEQ ID NO: 28420 - DNA, 20 bp, Artificial Sequence
  chemically synthesized
taatcatttctctcgaaaag

SEQ ID NO: 28421 - DNA, 20 bp, Artificial Sequence
  chemically synthesized
tcatttctctcgaaaagagg

SEQ ID NO: 28422 - DNA, 20 bp, Artificial Sequence
  chemically synthesized
catttctctcgaaaagaggc

SEQ ID NO: 28423 - DNA, 20 bp, Artificial Sequence
  chemically synthesized
atttctctcgaaaagaggca

SEQ ID NO: 28424 - DNA, 20 bp, Artificial Sequence
  chemically synthesized
gaaaagaggcagggcccatg

SEQ ID NO: 28425 - DNA, 20 bp, Artificial Sequence
  chemically synthesized
catgtggaaatctttcaaca

SEQ ID NO: 28426 - DNA, 20 bp, Artificial Sequence
  chemically synthesized
aatctttcaacatagtaaaa

SEQ ID NO: 28427 - DNA, 20 bp, Artificial Sequence
  chemically synthesized
ttcaacatagtaaaaaagct

SEQ ID NO: 28428 - DNA, 20 bp, Artificial Sequence
  chemically synthesized
tcaacatagtaaaaaagcta

SEQ ID NO: 28429 - DNA, 20 bp, Artificial Sequence
  chemically synthesized
atagtaaaaaagctaaggtt

SEQ ID NO: 28430 - DNA, 20 bp, Artificial Sequence
  chemically synthesized
taaaaaagctaaggtttaga

SEQ ID NO: 28431 - DNA, 20 bp, Artificial Sequence
  chemically synthesized
agctaaggtttagaaagatt

SEQ ID NO: 28432 - DNA, 20 bp, Artificial Sequence
  chemically synthesized
aagattcagtaactttgcca

SEQ ID NO: 28433 - DNA, 20 bp, Artificial Sequence
  chemically synthesized
gtaactttgccaaagccata

SEQ ID NO: 28434 - DNA, 20 bp, Artificial Sequence
  chemically synthesized
actttgccaaagccatatgg

SEQ ID NO: 28435 - DNA, 20 bp, Artificial Sequence
  chemically synthesized
ctttgccaaagccatatgga

SEQ ID NO: 28436 - DNA, 20 bp, Artificial Sequence
  chemically synthesized
gattgtccaaaaacctgtgc

SEQ ID NO: 28437 - DNA, 20 bp, Artificial Sequence
  chemically synthesized
ttgtccaaaaacctgtgcaa

SEQ ID NO: 28438 - DNA, 20 bp, Artificial Sequence
  chemically synthesized
aaaacctgtgcaagagctca

SEQ ID NO: 28439 - DNA, 20 bp, Artificial Sequence
  chemically synthesized
accttacgcttcattgttgt

SEQ ID NO: 28440 - DNA, 20 bp, Artificial Sequence
  chemically synthesized
attatttttcaatcttttct

SEQ ID NO: 28441 - DNA, 20 bp, Artificial Sequence
  chemically synthesized
tatttttcaatcttttctta

SEQ ID NO: 28442 - DNA, 20 bp, Artificial Sequence
  chemically synthesized
ctcactgcaacattgctcac

SEQ ID NO: 28443 - DNA, 20 bp, Artificial Sequence
  chemically synthesized
aacattgctcactggaatgc

SEQ ID NO: 28444 - DNA, 20 bp, Artificial Sequence
  chemically synthesized
ttgctcactggaatgctgga

SEQ ID NO: 28445 - DNA, 20 bp, Artificial Sequence
  chemically synthesized
actaataaaatgtgtctatt

SEQ ID NO: 28446 - DNA, 20 bp, Artificial Sequence
  chemically synthesized
catttaaaattgcatatgaa

SEQ ID NO: 28447 - DNA, 20 bp, Artificial Sequence
  chemically synthesized
atgaatggctctctaatcta

SEQ ID NO: 28448 - DNA, 20 bp, Artificial Sequence
  chemically synthesized
gaatggctctctaatctatg

SEQ ID NO: 28449 - DNA, 20 bp, Artificial Sequence
  chemically synthesized
tggctctctaatctatggag

SEQ ID NO: 28450 - DNA, 20 bp, Artificial Sequence
  chemically synthesized
ggctctctaatctatggagt

SEQ ID NO: 28451 - DNA, 20 bp, Artificial Sequence
  chemically synthesized
tctctaatctatggagtagg

SEQ ID NO: 28452 - DNA, 20 bp, Artificial Sequence
  chemically synthesized
gtagaattgtctcaattttt

SEQ ID NO: 28453 - DNA, 20 bp, Artificial Sequence
  chemically synthesized
ttgtctcaatttttcagatg

SEQ ID NO: 28454 - DNA, 20 bp, Artificial Sequence
  chemically synthesized
atttttcagatgaagaaact

SEQ ID NO: 28455 - DNA, 20 bp, Artificial Sequence
  chemically synthesized
atgaagaaactaagattaat

SEQ ID NO: 28456 - DNA, 20 bp, Artificial Sequence
  chemically synthesized
tcagatactttgcacaatca

SEQ ID NO: 28457 - DNA, 20 bp, Artificial Sequence
  chemically synthesized
agatactttgcacaatcata

SEQ ID NO: 28458 - DNA, 20 bp, Artificial Sequence
  chemically synthesized
ctttgcacaatcatagagtg

SEQ ID NO: 28459 - DNA, 20 bp, Artificial Sequence
  chemically synthesized
ttgcacaatcatagagtgaa

SEQ ID NO: 28460 - DNA, 20 bp, Artificial Sequence
  chemically synthesized
catagagtgaagagctattg

SEQ ID NO: 28461 - DNA, 20 bp, Artificial Sequence
  chemically synthesized
ttgaagttatgattgtaata

SEQ ID NO: 28462 - DNA, 20 bp, Artificial Sequence
  chemically synthesized
ttatgattgtaatacagatc

SEQ ID NO: 28463 - DNA, 20 bp, Artificial Sequence
  chemically synthesized
ttgtaatacagatctggtcc

SEQ ID NO: 28464 - DNA, 20 bp, Artificial Sequence
  chemically synthesized
gtaatacagatctggtccca

SEQ ID NO: 28465 - DNA, 20 bp, Artificial Sequence
  chemically synthesized
ctgcctaatgaaaatgtgcc

SEQ ID NO: 28466 - DNA, 20 bp, Artificial Sequence
  chemically synthesized
tgcctaatgaaaatgtgcct

SEQ ID NO: 28467 - DNA, 20 bp, Artificial Sequence
  chemically synthesized
tgaaaatgtgcctaggctgc

SEQ ID NO: 28468 - DNA, 20 bp, Artificial Sequence
  chemically synthesized
aatgtgcctaggctgcaaga

SEQ ID NO: 28469 - DNA, 20 bp, Artificial Sequence
  chemically synthesized
atgtgcctaggctgcaagac

SEQ ID NO: 28470 - DNA, 20 bp, Artificial Sequence
  chemically synthesized
tgtgcctaggctgcaagaca

SEQ ID NO: 28471 - DNA, 20 bp, Artificial Sequence
  chemically synthesized
ctcaccactcctattcaaca

SEQ ID NO: 28472 - DNA, 20 bp, Artificial Sequence
  chemically synthesized
actcctattcaacatagtgt

SEQ ID NO: 28473 - DNA, 20 bp, Artificial Sequence
  chemically synthesized
cctattcaacatagtgttgg

SEQ ID NO: 28474 - DNA, 20 bp, Artificial Sequence
  chemically synthesized
caacatagtgttggaagttc

SEQ ID NO: 28475 - DNA, 20 bp, Artificial Sequence
  chemically synthesized
tagtgttggaagttctggcc

SEQ ID NO: 28476 - DNA, 20 bp, Artificial Sequence
  chemically synthesized
agtgttggaagttctggccc

SEQ ID NO: 28477 - DNA, 20 bp, Artificial Sequence
  chemically synthesized
gaagttctggcccgggcaat

SEQ ID NO: 28478 - DNA, 20 bp, Artificial Sequence
  chemically synthesized
aagttctggcccgggcaatc

SEQ ID NO: 28479 - DNA, 20 bp, Artificial Sequence
  chemically synthesized
ttctggcccgggcaatcggg

SEQ ID NO: 28480 - DNA, 20 bp, Artificial Sequence
  chemically synthesized
tctggcccgggcaatcgggc

SEQ ID NO: 28481 - DNA, 20 bp, Artificial Sequence
  chemically synthesized
tggcccgggcaatcgggcag

SEQ ID NO: 28482 - DNA, 20 bp, Artificial Sequence
  chemically synthesized
cccgggcaatcgggcaggag

SEQ ID NO: 28483 - DNA, 20 bp, Artificial Sequence
  chemically synthesized
ccgggcaatcgggcaggaga

SEQ ID NO: 28484 - DNA, 20 bp, Artificial Sequence
  chemically synthesized
cgggcaggagaaggaaataa

SEQ ID NO: 28485 - DNA, 20 bp, Artificial Sequence
  chemically synthesized
gggcaggagaaggaaataaa

SEQ ID NO: 28486 - DNA, 20 bp, Artificial Sequence
  chemically synthesized
aaaaggcattcaattatgta

SEQ ID NO: 28487 - DNA, 20 bp, Artificial Sequence
  chemically synthesized
aaggcattcaattatgtaaa

SEQ ID NO: 28488 - DNA, 20 bp, Artificial Sequence
  chemically synthesized
cattcaattatgtaaagaga

SEQ ID NO: 28489 - DNA, 20 bp, Artificial Sequence
  chemically synthesized
agtcaaattgtccctgtttg

SEQ ID NO: 28490 - DNA, 20 bp, Artificial Sequence
  chemically synthesized
agatgacgtgattgcatatc

SEQ ID NO: 28491 - DNA, 20 bp, Artificial Sequence
  chemically synthesized
tctagaaaaccccattgtct

SEQ ID NO: 28492 - DNA, 20 bp, Artificial Sequence
  chemically synthesized
tctcagcccaaaatcccctt

SEQ ID NO: 28493 - DNA, 20 bp, Artificial Sequence
  chemically synthesized
caaaatccccttaagctgat

SEQ ID NO: 28494 - DNA, 20 bp, Artificial Sequence
  chemically synthesized
cttaagctgataagcaactt

SEQ ID NO: 28495 - DNA, 20 bp, Artificial Sequence
  chemically synthesized
gctgataagcaacttcagca

SEQ ID NO: 28496 - DNA, 20 bp, Artificial Sequence
  chemically synthesized
aagcaacttcagcaaagtct

SEQ ID NO: 28497 - DNA, 20 bp, Artificial Sequence
  chemically synthesized
agcaacttcagcaaagtctc

SEQ ID NO: 28498 - DNA, 20 bp, Artificial Sequence
  chemically synthesized
aatcaatgtgcaaaaatcac

SEQ ID NO: 28499 - DNA, 20 bp, Artificial Sequence
  chemically synthesized
gcattcttatacaccaataa

SEQ ID NO: 28500 - DNA, 20 bp, Artificial Sequence
  chemically synthesized
atacaccaataacagacaaa

SEQ ID NO: 28501 - DNA, 20 bp, Artificial Sequence
  chemically synthesized
accaataacagacaaacagt

SEQ ID NO: 28502 - DNA, 20 bp, Artificial Sequence
  chemically synthesized
actcccattcacaattgctt

SEQ ID NO: 28503 - DNA, 20 bp, Artificial Sequence
  chemically synthesized
tcccattcacaattgcttca

SEQ ID NO: 28504 - DNA, 20 bp, Artificial Sequence
  chemically synthesized
ccattcacaattgcttcaga

SEQ ID NO: 28505 - DNA, 20 bp, Artificial Sequence
  chemically synthesized
ttcagagagaatataatacc

SEQ ID NO: 28506 - DNA, 20 bp, Artificial Sequence
  chemically synthesized
tcagagagaatataatacct

SEQ ID NO: 28507 - DNA, 20 bp, Artificial Sequence
  chemically synthesized
tacctaggaatccaacttac

SEQ ID NO: 28508 - DNA, 20 bp, Artificial Sequence
  chemically synthesized
acctaggaatccaacttaca

SEQ ID NO: 28509 - DNA, 20 bp, Artificial Sequence
  chemically synthesized
cctaggaatccaacttacaa

SEQ ID NO: 28510 - DNA, 20 bp, Artificial Sequence
  chemically synthesized
tccaacttacaagggatgtg

SEQ ID NO: 28511 - DNA, 20 bp, Artificial Sequence
  chemically synthesized
ccaacttacaagggatgtga

SEQ ID NO: 28512 - DNA, 20 bp, Artificial Sequence
  chemically synthesized
gggatgtgaaggacctcttc

SEQ ID NO: 28513 - DNA, 20 bp, Artificial Sequence
  chemically synthesized
ggatgtgaaggacctcttca

SEQ ID NO: 28514 - DNA, 20 bp, Artificial Sequence
  chemically synthesized
atgtgaaggacctcttcaag

SEQ ID NO: 28515 - DNA, 20 bp, Artificial Sequence
  chemically synthesized
agaactacaaaccactgctc

SEQ ID NO: 28516 - DNA, 20 bp, Artificial Sequence
  chemically synthesized
gaactacaaaccactgctca

SEQ ID NO: 28517 - DNA, 20 bp, Artificial Sequence
  chemically synthesized
aaaccactgctcaaggaaat

SEQ ID NO: 28518 - DNA, 20 bp, Artificial Sequence
  chemically synthesized
ggaaataagatacaaacaaa

SEQ ID NO: 28519 - DNA, 20 bp, Artificial Sequence
  chemically synthesized
aataagatacaaacaaatgg

SEQ ID NO: 28520 - DNA, 20 bp, Artificial Sequence
  chemically synthesized
ggaagaacattccatgctca

SEQ ID NO: 28521 - DNA, 20 bp, Artificial Sequence
  chemically synthesized
gaacattccatgctcatgga

SEQ ID NO: 28522 - DNA, 20 bp, Artificial Sequence
  chemically synthesized
aacattccatgctcatggat

SEQ ID NO: 28523 - DNA, 20 bp, Artificial Sequence
  chemically synthesized
attccatgctcatggatagg

SEQ ID NO: 28524 - DNA, 20 bp, Artificial Sequence
  chemically synthesized
aagaaacaatatcgtgaaaa

SEQ ID NO: 28525 - DNA, 20 bp, Artificial Sequence
  chemically synthesized
tgaaaatggccatactgccc

SEQ ID NO: 28526 - DNA, 20 bp, Artificial Sequence
  chemically synthesized
gaaaatggccatactgccca

SEQ ID NO: 28527 - DNA, 20 bp, Artificial Sequence
  chemically synthesized
atactgcccaaggtaattta

SEQ ID NO: 28528 - DNA, 20 bp, Artificial Sequence
  chemically synthesized
gattcaatgccatccccatc

SEQ ID NO: 28529 - DNA, 20 bp, Artificial Sequence
  chemically synthesized
gctaccaatgactttcttca

SEQ ID NO: 28530 - DNA, 20 bp, Artificial Sequence
  chemically synthesized
aatgactttcttcacagaat

SEQ ID NO: 28531 - DNA, 20 bp, Artificial Sequence
  chemically synthesized
aattggaaaaaactacttta

SEQ ID NO: 28532 - DNA, 20 bp, Artificial Sequence
  chemically synthesized
aaactactttaaagttcata

SEQ ID NO: 28533 - DNA, 20 bp, Artificial Sequence
  chemically synthesized
aagttcatatggaaccaaaa

SEQ ID NO: 28534 - DNA, 20 bp, Artificial Sequence
  chemically synthesized
gttcatatggaaccaaaaaa

SEQ ID NO: 28535 - DNA, 20 bp, Artificial Sequence
  chemically synthesized
aaaaaagagcccgcatcgcc

SEQ ID NO: 28536 - DNA, 20 bp, Artificial Sequence
  chemically synthesized
cgcatcgccaagtcaatcct

SEQ ID NO: 28537 - DNA, 20 bp, Artificial Sequence
  chemically synthesized
ccaagtcaatcctaagccaa

SEQ ID NO: 28538 - DNA, 20 bp, Artificial Sequence
  chemically synthesized
aatcctaagccaaaagaaca

SEQ ID NO: 28539 - DNA, 20 bp, Artificial Sequence
  chemically synthesized
ctaagccaaaagaacaaagc

SEQ ID NO: 28540 - DNA, 20 bp, Artificial Sequence
  chemically synthesized
aagccaaaagaacaaagctg

SEQ ID NO: 28541 - DNA, 20 bp, Artificial Sequence
  chemically synthesized
agccaaaagaacaaagctgg

SEQ ID NO: 28542 - DNA, 20 bp, Artificial Sequence
  chemically synthesized
ctgatttcaaactatactac

SEQ ID NO: 28543 - DNA, 20 bp, Artificial Sequence
  chemically synthesized
tgatttcaaactatactaca

SEQ ID NO: 28544 - DNA, 20 bp, Artificial Sequence
  chemically synthesized
caaactatactacaaggcta

SEQ ID NO: 28545 - DNA, 20 bp, Artificial Sequence
  chemically synthesized
caaggctacagtaaccaaaa

SEQ ID NO: 28546 - DNA, 20 bp, Artificial Sequence
  chemically synthesized
ctacagtaaccaaaacagca

SEQ ID NO: 28547 - DNA, 20 bp, Artificial Sequence
  chemically synthesized
taaccaaaacagcatagtac

SEQ ID NO: 28548 - DNA, 20 bp, Artificial Sequence
  chemically synthesized
gcatagtactggtaccaaaa

SEQ ID NO: 28549 - DNA, 20 bp, Artificial Sequence
  chemically synthesized
atagtactggtaccaaaaca

SEQ ID NO: 28550 - DNA, 20 bp, Artificial Sequence
  chemically synthesized
ctggtaccaaaacagagata

SEQ ID NO: 28551 - DNA, 20 bp, Artificial Sequence
  chemically synthesized
aaaacagagatatagaccaa

SEQ ID NO: 28552 - DNA, 20 bp, Artificial Sequence
  chemically synthesized
tatagaccaatggaacaaaa

SEQ ID NO: 28553 - DNA, 20 bp, Artificial Sequence
  chemically synthesized
tagaccaatggaacaaaaca

SEQ ID NO: 28554 - DNA, 20 bp, Artificial Sequence
  chemically synthesized
atggaacaaaacagagccct

SEQ ID NO: 28555 - DNA, 20 bp, Artificial Sequence
  chemically synthesized
atctgatctttgacaaacct

SEQ ID NO: 28556 - DNA, 20 bp, Artificial Sequence
  chemically synthesized
ttgacaaacctgagaaaaac

SEQ ID NO: 28557 - DNA, 20 bp, Artificial Sequence
  chemically synthesized
aacctgagaaaaacaagaaa

SEQ ID NO: 28558 - DNA, 20 bp, Artificial Sequence
  chemically synthesized
acctgagaaaaacaagaaat

SEQ ID NO: 28559 - DNA, 20 bp, Artificial Sequence
  chemically synthesized
cctgagaaaaacaagaaatg

SEQ ID NO: 28560 - DNA, 20 bp, Artificial Sequence
  chemically synthesized
agaaaaacaagaaatgggga

SEQ ID NO: 28561 - DNA, 20 bp, Artificial Sequence
  chemically synthesized
gaaaaacaagaaatggggaa

SEQ ID NO: 28562 - DNA, 20 bp, Artificial Sequence
  chemically synthesized
aggattccctgtttaataaa

SEQ ID NO: 28563 - DNA, 20 bp, Artificial Sequence
  chemically synthesized
ccctgtttaataaatggtgc

SEQ ID NO: 28564 - DNA, 20 bp, Artificial Sequence
  chemically synthesized
cctgtttaataaatggtgct

SEQ ID NO: 28565 - DNA, 20 bp, Artificial Sequence
  chemically synthesized
ataaatggtgctgggaaaac

SEQ ID NO: 28566 - DNA, 20 bp, Artificial Sequence
  chemically synthesized
atggtgctgggaaaactggc

SEQ ID NO: 28567 - DNA, 20 bp, Artificial Sequence
  chemically synthesized
gaaaactggctagccaaatg

SEQ ID NO: 28568 - DNA, 20 bp, Artificial Sequence
  chemically synthesized
aaaactggctagccaaatgt

SEQ ID NO: 28569 - DNA, 20 bp, Artificial Sequence
  chemically synthesized
actggctagccaaatgtagg

SEQ ID NO: 28570 - DNA, 20 bp, Artificial Sequence
  chemically synthesized
caaatgtaggaagctgaaac

SEQ ID NO: 28571 - DNA, 20 bp, Artificial Sequence
  chemically synthesized
ccttatacaaaaattaactc

SEQ ID NO: 28572 - DNA, 20 bp, Artificial Sequence
  chemically synthesized
atacaaaaattaactcaaga

SEQ ID NO: 28573 - DNA, 20 bp, Artificial Sequence
  chemically synthesized
aattaactcaagatggatta

SEQ ID NO: 28574 - DNA, 20 bp, Artificial Sequence
  chemically synthesized
tggattaaagacttaaatgt

SEQ ID NO: 28575 - DNA, 20 bp, Artificial Sequence
  chemically synthesized
acctaaaaccataaaaactc

SEQ ID NO: 28576 - DNA, 20 bp, Artificial Sequence
  chemically synthesized
taaaaccataaaaactctag

SEQ ID NO: 28577 - DNA, 20 bp, Artificial Sequence
  chemically synthesized
aaaactctagaagaaaacct

SEQ ID NO: 28578 - DNA, 20 bp, Artificial Sequence
  chemically synthesized
aaaacctaagcaataccatt

SEQ ID NO: 28579 - DNA, 20 bp, Artificial Sequence
  chemically synthesized
aaacctaagcaataccattc

SEQ ID NO: 28580 - DNA, 20 bp, Artificial Sequence
  chemically synthesized
aagcaataccattcaggaca

SEQ ID NO: 28581 - DNA, 20 bp, Artificial Sequence
  chemically synthesized
agcaataccattcaggacat

SEQ ID NO: 28582 - DNA, 20 bp, Artificial Sequence
  chemically synthesized
taccattcaggacataggca

SEQ ID NO: 28583 - DNA, 20 bp, Artificial Sequence
  chemically synthesized
accattcaggacataggcat

SEQ ID NO: 28584 - DNA, 20 bp, Artificial Sequence
  chemically synthesized
tcaggacataggcatgggca

SEQ ID NO: 28585 - DNA, 20 bp, Artificial Sequence
  chemically synthesized
cttcatgtctaaaacaccaa

SEQ ID NO: 28586 - DNA, 20 bp, Artificial Sequence
  chemically synthesized
gtctaaaacaccaaaagcaa

SEQ ID NO: 28587 - DNA, 20 bp, Artificial Sequence
  chemically synthesized
accaaaagcaatggcaacaa

SEQ ID NO: 28588 - DNA, 20 bp, Artificial Sequence
  chemically synthesized
caaaagccaaaattcactaa

SEQ ID NO: 28589 - DNA, 20 bp, Artificial Sequence
  chemically synthesized
aaaagccaaaattcactaat

SEQ ID NO: 28590 - DNA, 20 bp, Artificial Sequence
  chemically synthesized
aatgggatctaattaaacta

SEQ ID NO: 28591 - DNA, 20 bp, Artificial Sequence
  chemically synthesized
taaactaaagatcttctgca

SEQ ID NO: 28592 - DNA, 20 bp, Artificial Sequence
  chemically synthesized
aaagatcttctgcacagcaa

SEQ ID NO: 28593 - DNA, 20 bp, Artificial Sequence
  chemically synthesized
acagcaaaagaaactaccat

SEQ ID NO: 28594 - DNA, 20 bp, Artificial Sequence
  chemically synthesized
agcaaaagaaactaccatca

SEQ ID NO: 28595 - DNA, 20 bp, Artificial Sequence
  chemically synthesized
gaaactaccatcagagtgaa

SEQ ID NO: 28596 - DNA, 20 bp, Artificial Sequence
  chemically synthesized
aaactaccatcagagtgaac

SEQ ID NO: 28597 - DNA, 20 bp, Artificial Sequence
  chemically synthesized
tgaacaggcaacctacacaa

SEQ ID NO: 28598 - DNA, 20 bp, Artificial Sequence
  chemically synthesized
gaacaggcaacctacacaat

SEQ ID NO: 28599 - DNA, 20 bp, Artificial Sequence
  chemically synthesized
acaggcaacctacacaatgg

SEQ ID NO: 28600 - DNA, 20 bp, Artificial Sequence
  chemically synthesized
tgcaatctactcatctgaca

SEQ ID NO: 28601 - DNA, 20 bp, Artificial Sequence
  chemically synthesized
gcaatctactcatctgacaa

SEQ ID NO: 28602 - DNA, 20 bp, Artificial Sequence
  chemically synthesized
caatctactcatctgacaaa

SEQ ID NO: 28603 - DNA, 20 bp, Artificial Sequence
  chemically synthesized
tctgacaaagggctaatatc

SEQ ID NO: 28604 - DNA, 20 bp, Artificial Sequence
  chemically synthesized
atgaactcaaacaaatttac

SEQ ID NO: 28605 - DNA, 20 bp, Artificial Sequence
  chemically synthesized
gaactcaaacaaatttacaa

SEQ ID NO: 28606 - DNA, 20 bp, Artificial Sequence
  chemically synthesized
agaaaaaaaaccccatcaaa

SEQ ID NO: 28607 - DNA, 20 bp, Artificial Sequence
  chemically synthesized
aaaaaaaccccatcaaaaag

SEQ ID NO: 28608 - DNA, 20 bp, Artificial Sequence
  chemically synthesized
aaaaaaccccatcaaaaagt

SEQ ID NO: 28609 - DNA, 20 bp, Artificial Sequence
  chemically synthesized
accccatcaaaaagtgggca

SEQ ID NO: 28610 - DNA, 20 bp, Artificial Sequence
  chemically synthesized
ccccatcaaaaagtgggcaa

SEQ ID NO: 28611 - DNA, 20 bp, Artificial Sequence
  chemically synthesized
aagtgggcaaaggatatgaa

SEQ ID NO: 28612 - DNA, 20 bp, Artificial Sequence
  chemically synthesized
tatgaacagacacttctcaa

SEQ ID NO: 28613 - DNA, 20 bp, Artificial Sequence
  chemically synthesized
gaacagacacttctcaaaag

SEQ ID NO: 28614 - DNA, 20 bp, Artificial Sequence
  chemically synthesized
ctcaaaagaagacatttatg

SEQ ID NO: 28615 - DNA, 20 bp, Artificial Sequence
  chemically synthesized
gaagacatttatgcagccaa

SEQ ID NO: 28616 - DNA, 20 bp, Artificial Sequence
  chemically synthesized
gaaaaaatgctcatcatcac

SEQ ID NO: 28617 - DNA, 20 bp, Artificial Sequence
  chemically synthesized
tgctcatcatcactggccat

SEQ ID NO: 28618 - DNA, 20 bp, Artificial Sequence
  chemically synthesized
ctcatcatcactggccatca

SEQ ID NO: 28619 - DNA, 20 bp, Artificial Sequence
  chemically synthesized
atgcaaatcaaaaccacaat

SEQ ID NO: 28620 - DNA, 20 bp, Artificial Sequence
  chemically synthesized
aatgagataccatctcacac

SEQ ID NO: 28621 - DNA, 20 bp, Artificial Sequence
  chemically synthesized
agataccatctcacaccagt

SEQ ID NO: 28622 - DNA, 20 bp, Artificial Sequence
  chemically synthesized
ccatctcacaccagttagaa

SEQ ID NO: 28623 - DNA, 20 bp, Artificial Sequence
  chemically synthesized
ttagaatggcaatcattaaa

SEQ ID NO: 28624 - DNA, 20 bp, Artificial Sequence
  chemically synthesized
aatggcaatcattaaaaagt

SEQ ID NO: 28625 - DNA, 20 bp, Artificial Sequence
  chemically synthesized
atggcaatcattaaaaagtc

SEQ ID NO: 28626 - DNA, 20 bp, Artificial Sequence
  chemically synthesized
attaaaaagtcaggaaacaa

SEQ ID NO: 28627 - DNA, 20 bp, Artificial Sequence
  chemically synthesized
ttaaaaagtcaggaaacaac

SEQ ID NO: 28628 - DNA, 20 bp, Artificial Sequence
  chemically synthesized
agtcaggaaacaacaggtgc

SEQ ID NO: 28629 - DNA, 20 bp, Artificial Sequence
  chemically synthesized
tcaggaaacaacaggtgctg

SEQ ID NO: 28630 - DNA, 20 bp, Artificial Sequence
  chemically synthesized
aggaaacaacaggtgctgga

SEQ ID NO: 28631 - DNA, 20 bp, Artificial Sequence
  chemically synthesized
ggaaacaacaggtgctggag

SEQ ID NO: 28632 - DNA, 20 bp, Artificial Sequence
  chemically synthesized
aacaggtgctggagaggatg

SEQ ID NO: 28633 - DNA, 20 bp, Artificial Sequence
  chemically synthesized
caggtgctggagaggatgtg

SEQ ID NO: 28634 - DNA, 20 bp, Artificial Sequence
  chemically synthesized
ctggagaggatgtggagaaa

SEQ ID NO: 28635 - DNA, 20 bp, Artificial Sequence
  chemically synthesized
tggagaggatgtggagaaat

SEQ ID NO: 28636 - DNA, 20 bp, Artificial Sequence
  chemically synthesized
taggaacacttttacactgt

SEQ ID NO: 28637 - DNA, 20 bp, Artificial Sequence
  chemically synthesized
gaacacttttacactgttgg

SEQ ID NO: 28638 - DNA, 20 bp, Artificial Sequence
  chemically synthesized
aacacttttacactgttggt

SEQ ID NO: 28639 - DNA, 20 bp, Artificial Sequence
  chemically synthesized
ctgttggtgggactgtaaac

SEQ ID NO: 28640 - DNA, 20 bp, Artificial Sequence
  chemically synthesized
gtaaactagttcaaacattg

SEQ ID NO: 28641 - DNA, 20 bp, Artificial Sequence
  chemically synthesized
aactagttcaaacattgtgg

SEQ ID NO: 28642 - DNA, 20 bp, Artificial Sequence
  chemically synthesized
agttcaaacattgtggaagt

SEQ ID NO: 28643 - DNA, 20 bp, Artificial Sequence
  chemically synthesized
aaacattgtggaagtcagtg

SEQ ID NO: 28644 - DNA, 20 bp, Artificial Sequence
  chemically synthesized
aagtcagtgtggtgattcct

SEQ ID NO: 28645 - DNA, 20 bp, Artificial Sequence
  chemically synthesized
agtcagtgtggtgattcctc

SEQ ID NO: 28646 - DNA, 20 bp, Artificial Sequence
  chemically synthesized
gtcagtgtggtgattcctca

SEQ ID NO: 28647 - DNA, 20 bp, Artificial Sequence
  chemically synthesized
gtggtgattcctcagggatc

SEQ ID NO: 28648 - DNA, 20 bp, Artificial Sequence
  chemically synthesized
attcctcagggatctagaac

SEQ ID NO: 28649 - DNA, 20 bp, Artificial Sequence
  chemically synthesized
actagaaataccatttgacc

SEQ ID NO: 28650 - DNA, 20 bp, Artificial Sequence
  chemically synthesized
tgacccagccatcccattac

SEQ ID NO: 28651 - DNA, 20 bp, Artificial Sequence
  chemically synthesized
gacccagccatcccattact

SEQ ID NO: 28652 - DNA, 20 bp, Artificial Sequence
  chemically synthesized
cattactgggtatacaccca

SEQ ID NO: 28653 - DNA, 20 bp, Artificial Sequence
  chemically synthesized
attactgggtatacacccaa

SEQ ID NO: 28654 - DNA, 20 bp, Artificial Sequence
  chemically synthesized
ttataaatcatgctgctata

SEQ ID NO: 28655 - DNA, 20 bp, Artificial Sequence
  chemically synthesized
atgcacacgtatgtttattg

SEQ ID NO: 28656 - DNA, 20 bp, Artificial Sequence
  chemically synthesized
tattgcggcactattcacaa

SEQ ID NO: 28657 - DNA, 20 bp, Artificial Sequence
  chemically synthesized
cggcactattcacaatagca

SEQ ID NO: 28658 - DNA, 20 bp, Artificial Sequence
  chemically synthesized
tattcacaatagcaaagact

SEQ ID NO: 28659 - DNA, 20 bp, Artificial Sequence
  chemically synthesized
acccaaatgtccaacaatga

SEQ ID NO: 28660 - DNA, 20 bp, Artificial Sequence
  chemically synthesized
aatgtccaacaatgatagac

SEQ ID NO: 28661 - DNA, 20 bp, Artificial Sequence
  chemically synthesized
caacaatgatagactggatt

SEQ ID NO: 28662 - DNA, 20 bp, Artificial Sequence
  chemically synthesized
tagactggattaagaaaatg

SEQ ID NO: 28663 - DNA, 20 bp, Artificial Sequence
  chemically synthesized
aatgtggcacatatacacca

SEQ ID NO: 28664 - DNA, 20 bp, Artificial Sequence
  chemically synthesized
atacaccatggaatactatg

SEQ ID NO: 28665 - DNA, 20 bp, Artificial Sequence
  chemically synthesized
atgcagccataaaaaatgat

SEQ ID NO: 28666 - DNA, 20 bp, Artificial Sequence
  chemically synthesized
tgatgagttcatgtcctttg

SEQ ID NO: 28667 - DNA, 20 bp, Artificial Sequence
  chemically synthesized
gatgagttcatgtcctttgt

SEQ ID NO: 28668 - DNA, 20 bp, Artificial Sequence
  chemically synthesized
atgagttcatgtcctttgta

SEQ ID NO: 28669 - DNA, 20 bp, Artificial Sequence
  chemically synthesized
tcatgtcctttgtagggaca

SEQ ID NO: 28670 - DNA, 20 bp, Artificial Sequence
  chemically synthesized
cctttgtagggacatggatg

SEQ ID NO: 28671 - DNA, 20 bp, Artificial Sequence
  chemically synthesized
tgtagggacatggatgaagc

SEQ ID NO: 28672 - DNA, 20 bp, Artificial Sequence
  chemically synthesized
aagctggaaaccatcattct

SEQ ID NO: 28673 - DNA, 20 bp, Artificial Sequence
  chemically synthesized
cattctcagcaaactatcac

SEQ ID NO: 28674 - DNA, 20 bp, Artificial Sequence
  chemically synthesized
attctcagcaaactatcaca

SEQ ID NO: 28675 - DNA, 20 bp, Artificial Sequence
  chemically synthesized
caaactatcacaaggacaaa

SEQ ID NO: 28676 - DNA, 20 bp, Artificial Sequence
  chemically synthesized
acaccacatgttctcactca

SEQ ID NO: 28677 - DNA, 20 bp, Artificial Sequence
  chemically synthesized
caccacatgttctcactcat

SEQ ID NO: 28678 - DNA, 20 bp, Artificial Sequence
  chemically synthesized
cacatgttctcactcatagg

SEQ ID NO: 28679 - DNA, 20 bp, Artificial Sequence
  chemically synthesized
acatgttctcactcataggt

SEQ ID NO: 28680 - DNA, 20 bp, Artificial Sequence
  chemically synthesized
ataggtgggaactgaacaat

SEQ ID NO: 28681 - DNA, 20 bp, Artificial Sequence
  chemically synthesized
aactgaacaatgagaacaca

SEQ ID NO: 28682 - DNA, 20 bp, Artificial Sequence
  chemically synthesized
acaatgagaacacatggaca

SEQ ID NO: 28683 - DNA, 20 bp, Artificial Sequence
  chemically synthesized
caatgagaacacatggacac

SEQ ID NO: 28684 - DNA, 20 bp, Artificial Sequence
  chemically synthesized
tgagaacacatggacacagg

SEQ ID NO: 28685 - DNA, 20 bp, Artificial Sequence
  chemically synthesized
gagaacacatggacacagga

SEQ ID NO: 28686 - DNA, 20 bp, Artificial Sequence
  chemically synthesized
agaacacatggacacaggaa

SEQ ID NO: 28687 - DNA, 20 bp, Artificial Sequence
  chemically synthesized
gaacacatggacacaggaag

SEQ ID NO: 28688 - DNA, 20 bp, Artificial Sequence
  chemically synthesized
ggaaggggaacatcacacac

SEQ ID NO: 28689 - DNA, 20 bp, Artificial Sequence
  chemically synthesized
gaaggggaacatcacacacc

SEQ ID NO: 28690 - DNA, 20 bp, Artificial Sequence
  chemically synthesized
aaggggaacatcacacaccg

SEQ ID NO: 28691 - DNA, 20 bp, Artificial Sequence
  chemically synthesized
tcacacaccggggcctgttg

SEQ ID NO: 28692 - DNA, 20 bp, Artificial Sequence
  chemically synthesized
cacacaccggggcctgttgt

SEQ ID NO: 28693 - DNA, 20 bp, Artificial Sequence
  chemically synthesized
acacaccggggcctgttgtg

SEQ ID NO: 28694 - DNA, 20 bp, Artificial Sequence
  chemically synthesized
caccggggcctgttgtgggg

SEQ ID NO: 28695 - DNA, 20 bp, Artificial Sequence
  chemically synthesized
accggggcctgttgtggggt

SEQ ID NO: 28696 - DNA, 20 bp, Artificial Sequence
  chemically synthesized
cggggcctgttgtggggtgg

SEQ ID NO: 28697 - DNA, 20 bp, Artificial Sequence
  chemically synthesized
ggggcctgttgtggggtggg

SEQ ID NO: 28698 - DNA, 20 bp, Artificial Sequence
  chemically synthesized
ggcctgttgtggggtgggag

SEQ ID NO: 28699 - DNA, 20 bp, Artificial Sequence
  chemically synthesized
gcctgttgtggggtgggagg

SEQ ID NO: 28700 - DNA, 20 bp, Artificial Sequence
  chemically synthesized
cctgttgtggggtgggagga

SEQ ID NO: 28701 - DNA, 20 bp, Artificial Sequence
  chemically synthesized
ctgttgtggggtgggaggag

SEQ ID NO: 28702 - DNA, 20 bp, Artificial Sequence
  chemically synthesized
tgttgtggggtgggaggagg

SEQ ID NO: 28703 - DNA, 20 bp, Artificial Sequence
  chemically synthesized
tgtggggtgggaggaggggg

SEQ ID NO: 28704 - DNA, 20 bp, Artificial Sequence
  chemically synthesized
gtggggtgggaggagggggc

SEQ ID NO: 28705 - DNA, 20 bp, Artificial Sequence
  chemically synthesized
tggggtgggaggagggggca

SEQ ID NO: 28706 - DNA, 20 bp, Artificial Sequence
  chemically synthesized
gtgggaggagggggcaggga

SEQ ID NO: 28707 - DNA, 20 bp, Artificial Sequence
  chemically synthesized
ggagggggcagggatagcat

SEQ ID NO: 28708 - DNA, 20 bp, Artificial Sequence
  chemically synthesized
gagggggcagggatagcatt

SEQ ID NO: 28709 - DNA, 20 bp, Artificial Sequence
  chemically synthesized
gggggcagggatagcattag

SEQ ID NO: 28710 - DNA, 20 bp, Artificial Sequence
  chemically synthesized
gagatatacctaatgttaaa

SEQ ID NO: 28711 - DNA, 20 bp, Artificial Sequence
  chemically synthesized
tatacctaatgttaaatggt

SEQ ID NO: 28712 - DNA, 20 bp, Artificial Sequence
  chemically synthesized
aatgttaaatggtgagttaa

SEQ ID NO: 28713 - DNA, 20 bp, Artificial Sequence
  chemically synthesized
atgttaaatggtgagttaat

SEQ ID NO: 28714 - DNA, 20 bp, Artificial Sequence
  chemically synthesized
aaatggtgagttaatgggtg

SEQ ID NO: 28715 - DNA, 20 bp, Artificial Sequence
  chemically synthesized
atgggtgcagcacaccaaca

SEQ ID NO: 28716 - DNA, 20 bp, Artificial Sequence
  chemically synthesized
acatgtaccctaaaacttaa

SEQ ID NO: 28717 - DNA, 20 bp, Artificial Sequence
  chemically synthesized
ttaaaagtataacaaaaaat

SEQ ID NO: 28718 - DNA, 20 bp, Artificial Sequence
  chemically synthesized
aagtataacaaaaaataagt

SEQ ID NO: 28719 - DNA, 20 bp, Artificial Sequence
  chemically synthesized
acaaaaaataagttagaaaa

SEQ ID NO: 28720 - DNA, 20 bp, Artificial Sequence
  chemically synthesized
aaaaagaaatttacatatat

SEQ ID NO: 28721 - DNA, 20 bp, Artificial Sequence
  chemically synthesized
tattagttatttaaatatgc

SEQ ID NO: 28722 - DNA, 20 bp, Artificial Sequence
  chemically synthesized
actattacactcatttcaca

SEQ ID NO: 28723 - DNA, 20 bp, Artificial Sequence
  chemically synthesized
atatctttgcttgtttccct

SEQ ID NO: 28724 - DNA, 20 bp, Artificial Sequence
  chemically synthesized
tatctttgcttgtttccctt

SEQ ID NO: 28725 - DNA, 20 bp, Artificial Sequence
  chemically synthesized
cttgtttcccttaggttctc

SEQ ID NO: 28726 - DNA, 20 bp, Artificial Sequence
  chemically synthesized
ccttaggttctctggatatt

SEQ ID NO: 28727 - DNA, 20 bp, Artificial Sequence
  chemically synthesized
ttaggttctctggatattga

SEQ ID NO: 28728 - DNA, 20 bp, Artificial Sequence
  chemically synthesized
aggttctctggatattgaga

SEQ ID NO: 28729 - DNA, 20 bp, Artificial Sequence
  chemically synthesized
ggttctctggatattgagag

SEQ ID NO: 28730 - DNA, 20 bp, Artificial Sequence
  chemically synthesized
gagaggctaatgtaattacc

SEQ ID NO: 28731 - DNA, 20 bp, Artificial Sequence
  chemically synthesized
agaggctaatgtaattacct

SEQ ID NO: 28732 - DNA, 20 bp, Artificial Sequence
  chemically synthesized
ttacctgggtaattgctcct

SEQ ID NO: 28733 - DNA, 20 bp, Artificial Sequence
  chemically synthesized
tacctgggtaattgctcctc

SEQ ID NO: 28734 - DNA, 20 bp, Artificial Sequence
  chemically synthesized
acctgggtaattgctcctca

SEQ ID NO: 28735 - DNA, 20 bp, Artificial Sequence
  chemically synthesized
tctccccattactctactcc

SEQ ID NO: 28736 - DNA, 20 bp, Artificial Sequence
  chemically synthesized
tccccattactctactccta

SEQ ID NO: 28737 - DNA, 20 bp, Artificial Sequence
  chemically synthesized
ctactcctagagactctgat

SEQ ID NO: 28738 - DNA, 20 bp, Artificial Sequence
  chemically synthesized
tgatcagctttttcaaaaaa

SEQ ID NO: 28739 - DNA, 20 bp, Artificial Sequence
  chemically synthesized
gatcagctttttcaaaaaat

SEQ ID NO: 28740 - DNA, 20 bp, Artificial Sequence
  chemically synthesized
cagctttttcaaaaaatggg

SEQ ID NO: 28741 - DNA, 20 bp, Artificial Sequence
  chemically synthesized
tcaaaaaatgggcagcattc

SEQ ID NO: 28742 - DNA, 20 bp, Artificial Sequence
  chemically synthesized
aatgggcagcattccagccc

SEQ ID NO: 28743 - DNA, 20 bp, Artificial Sequence
  chemically synthesized
atgggcagcattccagcccc

SEQ ID NO: 28744 - DNA, 20 bp, Artificial Sequence
  chemically synthesized
agcattccagccccaggact

SEQ ID NO: 28745 - DNA, 20 bp, Artificial Sequence
  chemically synthesized
attccagccccaggactaag

SEQ ID NO: 28746 - DNA, 20 bp, Artificial Sequence
  chemically synthesized
ctaagaagatatgaatgcca

SEQ ID NO: 28747 - DNA, 20 bp, Artificial Sequence
  chemically synthesized
agaagatatgaatgccacag

SEQ ID NO: 28748 - DNA, 20 bp, Artificial Sequence
  chemically synthesized
agatatgaatgccacagtgg

SEQ ID NO: 28749 - DNA, 20 bp, Artificial Sequence
  chemically synthesized
gatatgaatgccacagtggc

SEQ ID NO: 28750 - DNA, 20 bp, Artificial Sequence
  chemically synthesized
atatgaatgccacagtggca

SEQ ID NO: 28751 - DNA, 20 bp, Artificial Sequence
  chemically synthesized
acagtggcagggacttgctg

SEQ ID NO: 28752 - DNA, 20 bp, Artificial Sequence
  chemically synthesized
tggcagggacttgctgaagt

SEQ ID NO: 28753 - DNA, 20 bp, Artificial Sequence
  chemically synthesized
tgagcttccccatcccacct

SEQ ID NO: 28754 - DNA, 20 bp, Artificial Sequence
  chemically synthesized
gagcttccccatcccacctg

SEQ ID NO: 28755 - DNA, 20 bp, Artificial Sequence
  chemically synthesized
tccccatcccacctgaggct

SEQ ID NO: 28756 - DNA, 20 bp, Artificial Sequence
  chemically synthesized
cccatcccacctgaggctca

SEQ ID NO: 28757 - DNA, 20 bp, Artificial Sequence
  chemically synthesized
ccatcccacctgaggctcag

SEQ ID NO: 28758 - DNA, 20 bp, Artificial Sequence
  chemically synthesized
cccacctgaggctcagaggc

SEQ ID NO: 28759 - DNA, 20 bp, Artificial Sequence
  chemically synthesized
tcagaggccagtttcacttg

SEQ ID NO: 28760 - DNA, 20 bp, Artificial Sequence
  chemically synthesized
aggccagtttcacttgtggt

SEQ ID NO: 28761 - DNA, 20 bp, Artificial Sequence
  chemically synthesized
ttcacttgtggtgagtgcac

SEQ ID NO: 28762 - DNA, 20 bp, Artificial Sequence
  chemically synthesized
caagcccatgatccctgata

SEQ ID NO: 28763 - DNA, 20 bp, Artificial Sequence
  chemically synthesized
ccatgatccctgatatggct

SEQ ID NO: 28764 - DNA, 20 bp, Artificial Sequence
  chemically synthesized
tccccataatccctatatgt

SEQ ID NO: 28765 - DNA, 20 bp, Artificial Sequence
  chemically synthesized
ccccataatccctatatgtc

SEQ ID NO: 28766 - DNA, 20 bp, Artificial Sequence
  chemically synthesized
cccataatccctatatgtcg

SEQ ID NO: 28767 - DNA, 20 bp, Artificial Sequence
  chemically synthesized
ccataatccctatatgtcgg

SEQ ID NO: 28768 - DNA, 20 bp, Artificial Sequence
  chemically synthesized
ataatccctatatgtcgggg

SEQ ID NO: 28769 - DNA, 20 bp, Artificial Sequence
  chemically synthesized
taatccctatatgtcggggg

SEQ ID NO: 28770 - DNA, 20 bp, Artificial Sequence
  chemically synthesized
aatccctatatgtcggggga

SEQ ID NO: 28771 - DNA, 20 bp, Artificial Sequence
  chemically synthesized
ctatatgtcgggggagggac

SEQ ID NO: 28772 - DNA, 20 bp, Artificial Sequence
  chemically synthesized
tatatgtcgggggagggacc

SEQ ID NO: 28773 - DNA, 20 bp, Artificial Sequence
  chemically synthesized
atgtcgggggagggaccagg

SEQ ID NO: 28774 - DNA, 20 bp, Artificial Sequence
  chemically synthesized
tgtcgggggagggaccaggt

SEQ ID NO: 28775 - DNA, 20 bp, Artificial Sequence
  chemically synthesized
tcgggggagggaccaggtgg

SEQ ID NO: 28776 - DNA, 20 bp, Artificial Sequence
  chemically synthesized
gggaccaggtgggagattat

SEQ ID NO: 28777 - DNA, 20 bp, Artificial Sequence
  chemically synthesized
ggtgggagattattggatca

SEQ ID NO: 28778 - DNA, 20 bp, Artificial Sequence
  chemically synthesized
gtgggagattattggatcat

SEQ ID NO: 28779 - DNA, 20 bp, Artificial Sequence
  chemically synthesized
gggagattattggatcatgg

SEQ ID NO: 28780 - DNA, 20 bp, Artificial Sequence
  chemically synthesized
agattattggatcatgggag

SEQ ID NO: 28781 - DNA, 20 bp, Artificial Sequence
  chemically synthesized
tgggagcagtttcccccatg

SEQ ID NO: 28782 - DNA, 20 bp, Artificial Sequence
  chemically synthesized
catgcagttctcgtgatact

SEQ ID NO: 28783 - DNA, 20 bp, Artificial Sequence
  chemically synthesized
cagttctcgtgatactgagt

SEQ ID NO: 28784 - DNA, 20 bp, Artificial Sequence
  chemically synthesized
gatactgagtgagttttcat

SEQ ID NO: 28785 - DNA, 20 bp, Artificial Sequence
  chemically synthesized
tgagttttcatgagatctga

SEQ ID NO: 28786 - DNA, 20 bp, Artificial Sequence
  chemically synthesized
atgagatctgatggttttat

SEQ ID NO: 28787 - DNA, 20 bp, Artificial Sequence
  chemically synthesized
tgagatctgatggttttata

SEQ ID NO: 28788 - DNA, 20 bp, Artificial Sequence
  chemically synthesized
gatctgatggttttataagg

SEQ ID NO: 28789 - DNA, 20 bp, Artificial Sequence
  chemically synthesized
actctctcttgcctgccacc

SEQ ID NO: 28790 - DNA, 20 bp, Artificial Sequence
  chemically synthesized
tctcttgcctgccaccaagt

SEQ ID NO: 28791 - DNA, 20 bp, Artificial Sequence
  chemically synthesized
tctccttctgccataattgt

SEQ ID NO: 28792 - DNA, 20 bp, Artificial Sequence
  chemically synthesized
gccataattgtaagtttcct

SEQ ID NO: 28793 - DNA, 20 bp, Artificial Sequence
  chemically synthesized
ccataattgtaagtttcctg

SEQ ID NO: 28794 - DNA, 20 bp, Artificial Sequence
  chemically synthesized
taagtttcctgaggcctccc

SEQ ID NO: 28795 - DNA, 20 bp, Artificial Sequence
  chemically synthesized
ctgaggcctccccagctatg

SEQ ID NO: 28796 - DNA, 20 bp, Artificial Sequence
  chemically synthesized
ccccagctatgtggaaatgt

SEQ ID NO: 28797 - DNA, 20 bp, Artificial Sequence
  chemically synthesized
tcctttgttaataaattacc

SEQ ID NO: 28798 - DNA, 20 bp, Artificial Sequence
  chemically synthesized
gttaataaattacccagtct

SEQ ID NO: 28799 - DNA, 20 bp, Artificial Sequence
  chemically synthesized
ttaataaattacccagtctc

SEQ ID NO: 28800 - DNA, 20 bp, Artificial Sequence
  chemically synthesized
ataaattacccagtctcagg

SEQ ID NO: 28801 - DNA, 20 bp, Artificial Sequence
  chemically synthesized
ccagtctcaggtagtatctt

SEQ ID NO: 28802 - DNA, 20 bp, Artificial Sequence
  chemically synthesized
agtctcaggtagtatcttta

SEQ ID NO: 28803 - DNA, 20 bp, Artificial Sequence
  chemically synthesized
ctcaggtagtatctttagag

SEQ ID NO: 28804 - DNA, 20 bp, Artificial Sequence
  chemically synthesized
tagtatctttagagcagtgt

SEQ ID NO: 28805 - DNA, 20 bp, Artificial Sequence
  chemically synthesized
aatgaactaatacaatcccc

SEQ ID NO: 28806 - DNA, 20 bp, Artificial Sequence
  chemically synthesized
tccccaagccctgccttctg

SEQ ID NO: 28807 - DNA, 20 bp, Artificial Sequence
  chemically synthesized
ccaagccctgccttctgaag

SEQ ID NO: 28808 - DNA, 20 bp, Artificial Sequence
  chemically synthesized
ctgccttctgaagcagcatt

SEQ ID NO: 28809 - DNA, 20 bp, Artificial Sequence
  chemically synthesized
tgccttctgaagcagcattc

SEQ ID NO: 28810 - DNA, 20 bp, Artificial Sequence
  chemically synthesized
ggactcccaaccccatgtca

SEQ ID NO: 28811 - DNA, 20 bp, Artificial Sequence
  chemically synthesized
caaccccatgtcacagtgtg

SEQ ID NO: 28812 - DNA, 20 bp, Artificial Sequence
  chemically synthesized
atgtcacagtgtgaagccct

SEQ ID NO: 28813 - DNA, 20 bp, Artificial Sequence
  chemically synthesized
aagcccttagcatttttcct

SEQ ID NO: 28814 - DNA, 20 bp, Artificial Sequence
  chemically synthesized
ccttagcatttttcctaaga

SEQ ID NO: 28815 - DNA, 20 bp, Artificial Sequence
  chemically synthesized
tagcatttttcctaagacag

SEQ ID NO: 28816 - DNA, 20 bp, Artificial Sequence
  chemically synthesized
taagacagtagtcacctccc

SEQ ID NO: 28817 - DNA, 20 bp, Artificial Sequence
  chemically synthesized
cctagcttcttgaacctgtc

SEQ ID NO: 28818 - DNA, 20 bp, Artificial Sequence
  chemically synthesized
agcttcttgaacctgtctgg

SEQ ID NO: 28819 - DNA, 20 bp, Artificial Sequence
  chemically synthesized
ttcttgaacctgtctggcag

SEQ ID NO: 28820 - DNA, 20 bp, Artificial Sequence
  chemically synthesized
tcttgaacctgtctggcaga

SEQ ID NO: 28821 - DNA, 20 bp, Artificial Sequence
  chemically synthesized
ttgaacctgtctggcagaag

SEQ ID NO: 28822 - DNA, 20 bp, Artificial Sequence
  chemically synthesized
gaacctgtctggcagaagga

SEQ ID NO: 28823 - DNA, 20 bp, Artificial Sequence
  chemically synthesized
aacctgtctggcagaaggag

SEQ ID NO: 28824 - DNA, 20 bp, Artificial Sequence
  chemically synthesized
agaggaatcacatcctaaat

SEQ ID NO: 28825 - DNA, 20 bp, Artificial Sequence
  chemically synthesized
ggaatcacatcctaaattgg

SEQ ID NO: 28826 - DNA, 20 bp, Artificial Sequence
  chemically synthesized
atcacatcctaaattggtgg

SEQ ID NO: 28827 - DNA, 20 bp, Artificial Sequence
  chemically synthesized
catcctaaattggtggcaga

SEQ ID NO: 28828 - DNA, 20 bp, Artificial Sequence
  chemically synthesized
ggaaaacaaaacaaaaacac

SEQ ID NO: 28829 - DNA, 20 bp, Artificial Sequence
  chemically synthesized
aaaacaaaacaaaaacacca

SEQ ID NO: 28830 - DNA, 20 bp, Artificial Sequence
  chemically synthesized
cacatcatgaattcttgaaa

SEQ ID NO: 28831 - DNA, 20 bp, Artificial Sequence
  chemically synthesized
gttttgccatcatattatct

SEQ ID NO: 28832 - DNA, 20 bp, Artificial Sequence
  chemically synthesized
ttttgccatcatattatctt

SEQ ID NO: 28833 - DNA, 20 bp, Artificial Sequence
  chemically synthesized
actcacaaaatgcttatgtc

SEQ ID NO: 28834 - DNA, 20 bp, Artificial Sequence
  chemically synthesized
ggtttatatgctcatctatt

SEQ ID NO: 28835 - DNA, 20 bp, Artificial Sequence
  chemically synthesized
ttatatgctcatctattaag

SEQ ID NO: 28836 - DNA, 20 bp, Artificial Sequence
  chemically synthesized
tatatgctcatctattaagt

SEQ ID NO: 28837 - DNA, 20 bp, Artificial Sequence
  chemically synthesized
ttgtctccttgtttacctca

SEQ ID NO: 28838 - DNA, 20 bp, Artificial Sequence
  chemically synthesized
ccttgtttacctcacagatg

SEQ ID NO: 28839 - DNA, 20 bp, Artificial Sequence
  chemically synthesized
ttacctcacagatgtggtct

SEQ ID NO: 28840 - DNA, 20 bp, Artificial Sequence
  chemically synthesized
cacagatgtggtctgagtat

SEQ ID NO: 28841 - DNA, 20 bp, Artificial Sequence
  chemically synthesized
gatgtggtctgagtatcagt

SEQ ID NO: 28842 - DNA, 20 bp, Artificial Sequence
  chemically synthesized
agtatcagtgagccaataac

SEQ ID NO: 28843 - DNA, 20 bp, Artificial Sequence
  chemically synthesized
gtatcagtgagccaataaca

SEQ ID NO: 28844 - DNA, 20 bp, Artificial Sequence
  chemically synthesized
cagtgagccaataacaagga

SEQ ID NO: 28845 - DNA, 20 bp, Artificial Sequence
  chemically synthesized
gaaagacaattattaataaa

SEQ ID NO: 28846 - DNA, 20 bp, Artificial Sequence
  chemically synthesized
gacaattattaataaaaagt

SEQ ID NO: 28847 - DNA, 20 bp, Artificial Sequence
  chemically synthesized
attaataaaaagttggaaat

SEQ ID NO: 28848 - DNA, 20 bp, Artificial Sequence
  chemically synthesized
gctgactgtgattgactcct

SEQ ID NO: 28849 - DNA, 20 bp, Artificial Sequence
  chemically synthesized
tgactcctgagaattcctga

SEQ ID NO: 28850 - DNA, 20 bp, Artificial Sequence
  chemically synthesized
actcctgagaattcctgaaa

SEQ ID NO: 28851 - DNA, 20 bp, Artificial Sequence
  chemically synthesized
gagaattcctgaaagagata

SEQ ID NO: 28852 - DNA, 20 bp, Artificial Sequence
  chemically synthesized
gaattcctgaaagagatata

SEQ ID NO: 28853 - DNA, 20 bp, Artificial Sequence
  chemically synthesized
ttcctgaaagagatatagag

SEQ ID NO: 28854 - DNA, 20 bp, Artificial Sequence
  chemically synthesized
cctgaaagagatatagagtg

SEQ ID NO: 28855 - DNA, 20 bp, Artificial Sequence
  chemically synthesized
tgaaagagatatagagtgga

SEQ ID NO: 28856 - DNA, 20 bp, Artificial Sequence
  chemically synthesized
gagagaatattaacattcac

SEQ ID NO: 28857 - DNA, 20 bp, Artificial Sequence
  chemically synthesized
ttaacattcactggttgcta

SEQ ID NO: 28858 - DNA, 20 bp, Artificial Sequence
  chemically synthesized
taacattcactggttgctaa

SEQ ID NO: 28859 - DNA, 20 bp, Artificial Sequence
  chemically synthesized
aaaggctcacattaaatatt

SEQ ID NO: 28860 - DNA, 20 bp, Artificial Sequence
  chemically synthesized
aggctcacattaaatattta

SEQ ID NO: 28861 - DNA, 20 bp, Artificial Sequence
  chemically synthesized
tcacattaaatatttagagc

SEQ ID NO: 28862 - DNA, 20 bp, Artificial Sequence
  chemically synthesized
aatatttagagccagtccct

SEQ ID NO: 28863 - DNA, 20 bp, Artificial Sequence
  chemically synthesized
atatttagagccagtccctg

SEQ ID NO: 28864 - DNA, 20 bp, Artificial Sequence
  chemically synthesized
ttagagccagtccctgaggt

SEQ ID NO: 28865 - DNA, 20 bp, Artificial Sequence
  chemically synthesized
catctttatctttaaaaaca

SEQ ID NO: 28866 - DNA, 20 bp, Artificial Sequence
  chemically synthesized
caaagatactaatgtgcaca

SEQ ID NO: 28867 - DNA, 20 bp, Artificial Sequence
  chemically synthesized
aaagatactaatgtgcacaa

SEQ ID NO: 28868 - DNA, 20 bp, Artificial Sequence
  chemically synthesized
tactaatgtgcacaaaggta

SEQ ID NO: 28869 - DNA, 20 bp, Artificial Sequence
  chemically synthesized
gcacaaaggtaaagtacgta

SEQ ID NO: 28870 - DNA, 20 bp, Artificial Sequence
  chemically synthesized
cgtaaagttataccgaacat

SEQ ID NO: 28871 - DNA, 20 bp, Artificial Sequence
  chemically synthesized
gattcacctccaattctgtc

SEQ ID NO: 28872 - DNA, 20 bp, Artificial Sequence
  chemically synthesized
cctccaattctgtccagctc

SEQ ID NO: 28873 - DNA, 20 bp, Artificial Sequence
  chemically synthesized
ctccaattctgtccagctcc

SEQ ID NO: 28874 - DNA, 20 bp, Artificial Sequence
  chemically synthesized
tccaattctgtccagctcca

SEQ ID NO: 28875 - DNA, 20 bp, Artificial Sequence
  chemically synthesized
ccaattctgtccagctccag

SEQ ID NO: 28876 - DNA, 20 bp, Artificial Sequence
  chemically synthesized
tctgtccagctccaggggta

SEQ ID NO: 28877 - DNA, 20 bp, Artificial Sequence
  chemically synthesized
tttgttgtgtcctattatac

SEQ ID NO: 28878 - DNA, 20 bp, Artificial Sequence
  chemically synthesized
ttgttgtgtcctattatact

SEQ ID NO: 28879 - DNA, 20 bp, Artificial Sequence
  chemically synthesized
tgtcctattatactgggcta

SEQ ID NO: 28880 - DNA, 20 bp, Artificial Sequence
  chemically synthesized
gatcccttttgtaacctttc

SEQ ID NO: 28881 - DNA, 20 bp, Artificial Sequence
  chemically synthesized
tgtcaaacaaatcctaaact

SEQ ID NO: 28882 - DNA, 20 bp, Artificial Sequence
  chemically synthesized
gtcaaacaaatcctaaactc

SEQ ID NO: 28883 - DNA, 20 bp, Artificial Sequence
  chemically synthesized
caaacaaatcctaaactcag

SEQ ID NO: 28884 - DNA, 20 bp, Artificial Sequence
  chemically synthesized
caggagaatgattgtgtttt

SEQ ID NO: 28885 - DNA, 20 bp, Artificial Sequence
  chemically synthesized
tgtgttttaagatctctttc

SEQ ID NO: 28886 - DNA, 20 bp, Artificial Sequence
  chemically synthesized
gtgttttaagatctctttca

SEQ ID NO: 28887 - DNA, 20 bp, Artificial Sequence
  chemically synthesized
gttttaagatctctttcaag

SEQ ID NO: 28888 - DNA, 20 bp, Artificial Sequence
  chemically synthesized
aaggagatctgacccttatc

SEQ ID NO: 28889 - DNA, 20 bp, Artificial Sequence
  chemically synthesized
gagatctgacccttatctgg

SEQ ID NO: 28890 - DNA, 20 bp, Artificial Sequence
  chemically synthesized
atctgacccttatctggcgg

SEQ ID NO: 28891 - DNA, 20 bp, Artificial Sequence
  chemically synthesized
ctgacccttatctggcggta

SEQ ID NO: 28892 - DNA, 20 bp, Artificial Sequence
  chemically synthesized
ttatctggcggtagagactc

SEQ ID NO: 28893 - DNA, 20 bp, Artificial Sequence
  chemically synthesized
atctggcggtagagactctg

SEQ ID NO: 28894 - DNA, 20 bp, Artificial Sequence
  chemically synthesized
ggcggtagagactctggaga

SEQ ID NO: 28895 - DNA, 20 bp, Artificial Sequence
  chemically synthesized
agactctggagatggaaact

SEQ ID NO: 28896 - DNA, 20 bp, Artificial Sequence
  chemically synthesized
ctctggagatggaaactgag

SEQ ID NO: 28897 - DNA, 20 bp, Artificial Sequence
  chemically synthesized
tctggagatggaaactgaga

SEQ ID NO: 28898 - DNA, 20 bp, Artificial Sequence
  chemically synthesized
atgcaaaaaaaaaaaaatgc

SEQ ID NO: 28899 - DNA, 20 bp, Artificial Sequence
  chemically synthesized
aaaaaaaaaaaaatgcaaga

SEQ ID NO: 28900 - DNA, 20 bp, Artificial Sequence
  chemically synthesized
aaatgcaagaaagaaaaaaa

SEQ ID NO: 28901 - DNA, 20 bp, Artificial Sequence
  chemically synthesized
aatgcaagaaagaaaaaaaa

SEQ ID NO: 28902 - DNA, 20 bp, Artificial Sequence
  chemically synthesized
gcaagaaagaaaaaaaaagg

SEQ ID NO: 28903 - DNA, 20 bp, Artificial Sequence
  chemically synthesized
aaaaaaaaggaagaaaacaa

SEQ ID NO: 28904 - DNA, 20 bp, Artificial Sequence
  chemically synthesized
aaaaaaggaagaaaacaaaa

SEQ ID NO: 28905 - DNA, 20 bp, Artificial Sequence
  chemically synthesized
gaagaaaacaaaagagacca

SEQ ID NO: 28906 - DNA, 20 bp, Artificial Sequence
  chemically synthesized
aaaacaaaagagaccacaga

SEQ ID NO: 28907 - DNA, 20 bp, Artificial Sequence
  chemically synthesized
aaacaaaagagaccacagac

SEQ ID NO: 28908 - DNA, 20 bp, Artificial Sequence
  chemically synthesized
caaaagagaccacagacagg

SEQ ID NO: 28909 - DNA, 20 bp, Artificial Sequence
  chemically synthesized
aaagagaccacagacaggca

SEQ ID NO: 28910 - DNA, 20 bp, Artificial Sequence
  chemically synthesized
gagaccacagacaggcagag

SEQ ID NO: 28911 - DNA, 20 bp, Artificial Sequence
  chemically synthesized
agaccacagacaggcagaga

SEQ ID NO: 28912 - DNA, 20 bp, Artificial Sequence
  chemically synthesized
ccacagacaggcagagaagg

SEQ ID NO: 28913 - DNA, 20 bp, Artificial Sequence
  chemically synthesized
acagacaggcagagaaggca

SEQ ID NO: 28914 - DNA, 20 bp, Artificial Sequence
  chemically synthesized
cagacaggcagagaaggcag

SEQ ID NO: 28915 - DNA, 20 bp, Artificial Sequence
  chemically synthesized
gacaggcagagaaggcagag

SEQ ID NO: 28916 - DNA, 20 bp, Artificial Sequence
  chemically synthesized
acaggcagagaaggcagagg

SEQ ID NO: 28917 - DNA, 20 bp, Artificial Sequence
  chemically synthesized
aggcagagaaggcagaggag

SEQ ID NO: 28918 - DNA, 20 bp, Artificial Sequence
  chemically synthesized
gcagagaaggcagaggagga

SEQ ID NO: 28919 - DNA, 20 bp, Artificial Sequence
  chemically synthesized
aggcagaggaggagagactc

SEQ ID NO: 28920 - DNA, 20 bp, Artificial Sequence
  chemically synthesized
ggaggagagactctagtttc

SEQ ID NO: 28921 - DNA, 20 bp, Artificial Sequence
  chemically synthesized
gagactctagtttcaagtat

SEQ ID NO: 28922 - DNA, 20 bp, Artificial Sequence
  chemically synthesized
tctagtttcaagtatcagtc

SEQ ID NO: 28923 - DNA, 20 bp, Artificial Sequence
  chemically synthesized
gatttgtttcttccaatatc

SEQ ID NO: 28924 - DNA, 20 bp, Artificial Sequence
  chemically synthesized
cttccaatatccggttattt

SEQ ID NO: 28925 - DNA, 20 bp, Artificial Sequence
  chemically synthesized
ttccaatatccggttatttg

SEQ ID NO: 28926 - DNA, 20 bp, Artificial Sequence
  chemically synthesized
atatccggttatttgaggtg

SEQ ID NO: 28927 - DNA, 20 bp, Artificial Sequence
  chemically synthesized
tccggttatttgaggtgtgg

SEQ ID NO: 28928 - DNA, 20 bp, Artificial Sequence
  chemically synthesized
ccggttatttgaggtgtggc

SEQ ID NO: 28929 - DNA, 20 bp, Artificial Sequence
  chemically synthesized
ttatttgaggtgtggcaggc

SEQ ID NO: 28930 - DNA, 20 bp, Artificial Sequence
  chemically synthesized
gaggtgtggcaggcaagata

SEQ ID NO: 28931 - DNA, 20 bp, Artificial Sequence
  chemically synthesized
aggtgtggcaggcaagatac

SEQ ID NO: 28932 - DNA, 20 bp, Artificial Sequence
  chemically synthesized
ggtgtggcaggcaagataca

SEQ ID NO: 28933 - DNA, 20 bp, Artificial Sequence
  chemically synthesized
ggcaggcaagatacagggtg

SEQ ID NO: 28934 - DNA, 20 bp, Artificial Sequence
  chemically synthesized
aggcaagatacagggtgcag

SEQ ID NO: 28935 - DNA, 20 bp, Artificial Sequence
  chemically synthesized
ggcaagatacagggtgcagt

SEQ ID NO: 28936 - DNA, 20 bp, Artificial Sequence
  chemically synthesized
atacagggtgcagtgggatc

SEQ ID NO: 28937 - DNA, 20 bp, Artificial Sequence
  chemically synthesized
tacagggtgcagtgggatca

SEQ ID NO: 28938 - DNA, 20 bp, Artificial Sequence
  chemically synthesized
gtgcagtgggatcaaggatt

SEQ ID NO: 28939 - DNA, 20 bp, Artificial Sequence
  chemically synthesized
agtgggatcaaggattcagt

SEQ ID NO: 28940 - DNA, 20 bp, Artificial Sequence
  chemically synthesized
gtgggatcaaggattcagta

SEQ ID NO: 28941 - DNA, 20 bp, Artificial Sequence
  chemically synthesized
ggatcaaggattcagtaagg

SEQ ID NO: 28942 - DNA, 20 bp, Artificial Sequence
  chemically synthesized
ggattcagtaaggcagcaca

SEQ ID NO: 28943 - DNA, 20 bp, Artificial Sequence
  chemically synthesized
gattcagtaaggcagcacac

SEQ ID NO: 28944 - DNA, 20 bp, Artificial Sequence
  chemically synthesized
tcagtaaggcagcacacggg

SEQ ID NO: 28945 - DNA, 20 bp, Artificial Sequence
  chemically synthesized
aaggcagcacacgggaagaa

SEQ ID NO: 28946 - DNA, 20 bp, Artificial Sequence
  chemically synthesized
ggaagaacagctgctcaatc

SEQ ID NO: 28947 - DNA, 20 bp, Artificial Sequence
  chemically synthesized
aagaacagctgctcaatcca

SEQ ID NO: 28948 - DNA, 20 bp, Artificial Sequence
  chemically synthesized
agaacagctgctcaatccag

SEQ ID NO: 28949 - DNA, 20 bp, Artificial Sequence
  chemically synthesized
acagctgctcaatccagagg

SEQ ID NO: 28950 - DNA, 20 bp, Artificial Sequence
  chemically synthesized
tattgatctgcctctggatt

SEQ ID NO: 28951 - DNA, 20 bp, Artificial Sequence
  chemically synthesized
tgatctgcctctggattgag

SEQ ID NO: 28952 - DNA, 20 bp, Artificial Sequence
  chemically synthesized
cctgccacacctcaaataac

SEQ ID NO: 28953 - DNA, 20 bp, Artificial Sequence
  chemically synthesized
cacctcaaataaccggatat

SEQ ID NO: 28954 - DNA, 20 bp, Artificial Sequence
  chemically synthesized
ctcaaataaccggatattgg

SEQ ID NO: 28955 - DNA, 20 bp, Artificial Sequence
  chemically synthesized
tcttgactgatacttgaaac

SEQ ID NO: 28956 - DNA, 20 bp, Artificial Sequence
  chemically synthesized
ttgactgatacttgaaacta

SEQ ID NO: 28957 - DNA, 20 bp, Artificial Sequence
  chemically synthesized
ctgccttctctgcctgtctg

SEQ ID NO: 28958 - DNA, 20 bp, Artificial Sequence
  chemically synthesized
ttttttttttgcatccttct

SEQ ID NO: 28959 - DNA, 20 bp, Artificial Sequence
  chemically synthesized
tccttctcagtttccatctc

SEQ ID NO: 28960 - DNA, 20 bp, Artificial Sequence
  chemically synthesized
cttctcagtttccatctcca

SEQ ID NO: 28961 - DNA, 20 bp, Artificial Sequence
  chemically synthesized
atctccagagtctctaccgc

SEQ ID NO: 28962 - DNA, 20 bp, Artificial Sequence
  chemically synthesized
cagagtctctaccgccagat

SEQ ID NO: 28963 - DNA, 20 bp, Artificial Sequence
  chemically synthesized
agagtctctaccgccagata

SEQ ID NO: 28964 - DNA, 20 bp, Artificial Sequence
  chemically synthesized
gagtctctaccgccagataa

SEQ ID NO: 28965 - DNA, 20 bp, Artificial Sequence
  chemically synthesized
ctctaccgccagataagggt

SEQ ID NO: 28966 - DNA, 20 bp, Artificial Sequence
  chemically synthesized
taagggtcagatctccttga

SEQ ID NO: 28967 - DNA, 20 bp, Artificial Sequence
  chemically synthesized
agggtcagatctccttgaaa

SEQ ID NO: 28968 - DNA, 20 bp, Artificial Sequence
  chemically synthesized
taaaacacaatcattctcct

SEQ ID NO: 28969 - DNA, 20 bp, Artificial Sequence
  chemically synthesized
cacaatcattctcctgagtt

SEQ ID NO: 28970 - DNA, 20 bp, Artificial Sequence
  chemically synthesized
acaatcattctcctgagttt

SEQ ID NO: 28971 - DNA, 20 bp, Artificial Sequence
  chemically synthesized
gagtttaggatttgtttgac

SEQ ID NO: 28972 - DNA, 20 bp, Artificial Sequence
  chemically synthesized
gtttaggatttgtttgacaa

SEQ ID NO: 28973 - DNA, 20 bp, Artificial Sequence
  chemically synthesized
tttgtttgacaagagcattt

SEQ ID NO: 28974 - DNA, 20 bp, Artificial Sequence
  chemically synthesized
acaagagcattttagcttga

SEQ ID NO: 28975 - DNA, 20 bp, Artificial Sequence
  chemically synthesized
caagagcattttagcttgaa

SEQ ID NO: 28976 - DNA, 20 bp, Artificial Sequence
  chemically synthesized
tttagcttgaaaggttacaa

SEQ ID NO: 28977 - DNA, 20 bp, Artificial Sequence
  chemically synthesized
ttagcttgaaaggttacaaa

SEQ ID NO: 28978 - DNA, 20 bp, Artificial Sequence
  chemically synthesized
tagcttgaaaggttacaaaa

SEQ ID NO: 28979 - DNA, 20 bp, Artificial Sequence
  chemically synthesized
aggttacaaaagggatcatg

SEQ ID NO: 28980 - DNA, 20 bp, Artificial Sequence
  chemically synthesized
aaaagggatcatgtagtcta

SEQ ID NO: 28981 - DNA, 20 bp, Artificial Sequence
  chemically synthesized
ggatcatgtagtctatagcc

SEQ ID NO: 28982 - DNA, 20 bp, Artificial Sequence
  chemically synthesized
tagtctatagcccagtataa

SEQ ID NO: 28983 - DNA, 20 bp, Artificial Sequence
  chemically synthesized
agtctatagcccagtataat

SEQ ID NO: 28984 - DNA, 20 bp, Artificial Sequence
  chemically synthesized
tataataggacacaacaaat

SEQ ID NO: 28985 - DNA, 20 bp, Artificial Sequence
  chemically synthesized
gacacaacaaatcagaaaaa

SEQ ID NO: 28986 - DNA, 20 bp, Artificial Sequence
  chemically synthesized
acaacaaatcagaaaaaaag

SEQ ID NO: 28987 - DNA, 20 bp, Artificial Sequence
  chemically synthesized
atcagaaaaaaagtagaatg

SEQ ID NO: 28988 - DNA, 20 bp, Artificial Sequence
  chemically synthesized
tcagaaaaaaagtagaatgt

SEQ ID NO: 28989 - DNA, 20 bp, Artificial Sequence
  chemically synthesized
aaaaaaagtagaatgtggga

SEQ ID NO: 28990 - DNA, 20 bp, Artificial Sequence
  chemically synthesized
gacagtgatgactgtacccc

SEQ ID NO: 28991 - DNA, 20 bp, Artificial Sequence
  chemically synthesized
cagtgatgactgtacccctg

SEQ ID NO: 28992 - DNA, 20 bp, Artificial Sequence
  chemically synthesized
gatgactgtacccctggagc

SEQ ID NO: 28993 - DNA, 20 bp, Artificial Sequence
  chemically synthesized
actgtacccctggagctgga

SEQ ID NO: 28994 - DNA, 20 bp, Artificial Sequence
  chemically synthesized
cccctggagctggacagaat

SEQ ID NO: 28995 - DNA, 20 bp, Artificial Sequence
  chemically synthesized
cctggagctggacagaattg

SEQ ID NO: 28996 - DNA, 20 bp, Artificial Sequence
  chemically synthesized
ctggagctggacagaattgg

SEQ ID NO: 28997 - DNA, 20 bp, Artificial Sequence
  chemically synthesized
ttggaggtgaatcttatgtt

SEQ ID NO: 28998 - DNA, 20 bp, Artificial Sequence
  chemically synthesized
tactttacctttgtgcacat

SEQ ID NO: 28999 - DNA, 20 bp, Artificial Sequence
  chemically synthesized
cattagtatctttgttttta

SEQ ID NO: 29000 - DNA, 20 bp, Artificial Sequence
  chemically synthesized
tatctttgtttttaaagata

SEQ ID NO: 29001 - DNA, 20 bp, Artificial Sequence
  chemically synthesized
aaagatgttaatacttacct

SEQ ID NO: 29002 - DNA, 20 bp, Artificial Sequence
  chemically synthesized
aagatgttaatacttacctc

SEQ ID NO: 29003 - DNA, 20 bp, Artificial Sequence
  chemically synthesized
agatgttaatacttacctca

SEQ ID NO: 29004 - DNA, 20 bp, Artificial Sequence
  chemically synthesized
ttaatacttacctcagggac

SEQ ID NO: 29005 - DNA, 20 bp, Artificial Sequence
  chemically synthesized
tggctctaaatatttaatgt

SEQ ID NO: 29006 - DNA, 20 bp, Artificial Sequence
  chemically synthesized
aaatatttaatgtgagcctt

SEQ ID NO: 29007 - DNA, 20 bp, Artificial Sequence
  chemically synthesized
taatgtgagcctttagcaac

SEQ ID NO: 29008 - DNA, 20 bp, Artificial Sequence
  chemically synthesized
tctccactctatatctcttt

SEQ ID NO: 29009 - DNA, 20 bp, Artificial Sequence
  chemically synthesized
ctccactctatatctctttc

SEQ ID NO: 29010 - DNA, 20 bp, Artificial Sequence
  chemically synthesized
atatctctttcaggaattct

SEQ ID NO: 29011 - DNA, 20 bp, Artificial Sequence
  chemically synthesized
tatctctttcaggaattctc

SEQ ID NO: 29012 - DNA, 20 bp, Artificial Sequence
  chemically synthesized
tctctttcaggaattctcag

SEQ ID NO: 29013 - DNA, 20 bp, Artificial Sequence
  chemically synthesized
gaattctcaggagtcaatca

SEQ ID NO: 29014 - DNA, 20 bp, Artificial Sequence
  chemically synthesized
tctcaggagtcaatcacagt

SEQ ID NO: 29015 - DNA, 20 bp, Artificial Sequence
  chemically synthesized
taattgtctttccttgttat

SEQ ID NO: 29016 - DNA, 20 bp, Artificial Sequence
  chemically synthesized
gttattggctcactgatact

SEQ ID NO: 29017 - DNA, 20 bp, Artificial Sequence
  chemically synthesized
gatactcagaccacatctgt

SEQ ID NO: 29018 - DNA, 20 bp, Artificial Sequence
  chemically synthesized
atactcagaccacatctgtg

SEQ ID NO: 29019 - DNA, 20 bp, Artificial Sequence
  chemically synthesized
accacatctgtgaggtaaac

SEQ ID NO: 29020 - DNA, 20 bp, Artificial Sequence
  chemically synthesized
ccacatctgtgaggtaaaca

SEQ ID NO: 29021 - DNA, 20 bp, Artificial Sequence
  chemically synthesized
acatctgtgaggtaaacaag

SEQ ID NO: 29022 - DNA, 20 bp, Artificial Sequence
  chemically synthesized
tgtgaggtaaacaaggagac

SEQ ID NO: 29023 - DNA, 20 bp, Artificial Sequence
  chemically synthesized
gacaagaatttcccacttaa

SEQ ID NO: 29024 - DNA, 20 bp, Artificial Sequence
  chemically synthesized
gaatttcccacttaatagat

SEQ ID NO: 29025 - DNA, 20 bp, Artificial Sequence
  chemically synthesized
taatagatgagcatataaac

SEQ ID NO: 29026 - DNA, 20 bp, Artificial Sequence
  chemically synthesized
tgagcatataaaccagacat

SEQ ID NO: 29027 - DNA, 20 bp, Artificial Sequence
  chemically synthesized
accagacataagcattttgt

SEQ ID NO: 29028 - DNA, 20 bp, Artificial Sequence
  chemically synthesized
aagcattttgtgagtaaccc

SEQ ID NO: 29029 - DNA, 20 bp, Artificial Sequence
  chemically synthesized
agtaacccaagataatatga

SEQ ID NO: 29030 - DNA, 20 bp, Artificial Sequence
  chemically synthesized
tatgatggcaaaactatttc

SEQ ID NO: 29031 - DNA, 20 bp, Artificial Sequence
  chemically synthesized
caagaattcatgatgtgctc

SEQ ID NO: 29032 - DNA, 20 bp, Artificial Sequence
  chemically synthesized
ttttccatctgccaccaatt

SEQ ID NO: 29033 - DNA, 20 bp, Artificial Sequence
  chemically synthesized
tttccatctgccaccaattt

SEQ ID NO: 29034 - DNA, 20 bp, Artificial Sequence
  chemically synthesized
tgtgattcctctccttctgc

SEQ ID NO: 29035 - DNA, 20 bp, Artificial Sequence
  chemically synthesized
attcctctccttctgccaga

SEQ ID NO: 29036 - DNA, 20 bp, Artificial Sequence
  chemically synthesized
ttcctctccttctgccagac

SEQ ID NO: 29037 - DNA, 20 bp, Artificial Sequence
  chemically synthesized
tccttctgccagacaggttc

SEQ ID NO: 29038 - DNA, 20 bp, Artificial Sequence
  chemically synthesized
ttctgccagacaggttcaag

SEQ ID NO: 29039 - DNA, 20 bp, Artificial Sequence
  chemically synthesized
gccagacaggttcaagaagc

SEQ ID NO: 29040 - DNA, 20 bp, Artificial Sequence
  chemically synthesized
ccagacaggttcaagaagct

SEQ ID NO: 29041 - DNA, 20 bp, Artificial Sequence
  chemically synthesized
cagacaggttcaagaagcta

SEQ ID NO: 29042 - DNA, 20 bp, Artificial Sequence
  chemically synthesized
gacaggttcaagaagctagg

SEQ ID NO: 29043 - DNA, 20 bp, Artificial Sequence
  chemically synthesized
acaggttcaagaagctaggg

SEQ ID NO: 29044 - DNA, 20 bp, Artificial Sequence
  chemically synthesized
tagggaggtgactactgtct

SEQ ID NO: 29045 - DNA, 20 bp, Artificial Sequence
  chemically synthesized
agggaggtgactactgtctt

SEQ ID NO: 29046 - DNA, 20 bp, Artificial Sequence
  chemically synthesized
actgtcttaggaaaaatgct

SEQ ID NO: 29047 - DNA, 20 bp, Artificial Sequence
  chemically synthesized
ctgtcttaggaaaaatgcta

SEQ ID NO: 29048 - DNA, 20 bp, Artificial Sequence
  chemically synthesized
tgtcttaggaaaaatgctaa

SEQ ID NO: 29049 - DNA, 20 bp, Artificial Sequence
  chemically synthesized
aagggcttcacactgtgaca

SEQ ID NO: 29050 - DNA, 20 bp, Artificial Sequence
  chemically synthesized
agggcttcacactgtgacat

SEQ ID NO: 29051 - DNA, 20 bp, Artificial Sequence
  chemically synthesized
gggcttcacactgtgacatg

SEQ ID NO: 29052 - DNA, 20 bp, Artificial Sequence
  chemically synthesized
ttcacactgtgacatggggt

SEQ ID NO: 29053 - DNA, 20 bp, Artificial Sequence
  chemically synthesized
tcacactgtgacatggggtt

SEQ ID NO: 29054 - DNA, 20 bp, Artificial Sequence
  chemically synthesized
acactgtgacatggggttgg

SEQ ID NO: 29055 - DNA, 20 bp, Artificial Sequence
  chemically synthesized
gggagtcctgaatgctgctt

SEQ ID NO: 29056 - DNA, 20 bp, Artificial Sequence
  chemically synthesized
agtcctgaatgctgcttcag

SEQ ID NO: 29057 - DNA, 20 bp, Artificial Sequence
  chemically synthesized
gtcctgaatgctgcttcaga

SEQ ID NO: 29058 - DNA, 20 bp, Artificial Sequence
  chemically synthesized
ctgaatgctgcttcagaagg

SEQ ID NO: 29059 - DNA, 20 bp, Artificial Sequence
  chemically synthesized
tgaatgctgcttcagaaggc

SEQ ID NO: 29060 - DNA, 20 bp, Artificial Sequence
  chemically synthesized
gaatgctgcttcagaaggca

SEQ ID NO: 29061 - DNA, 20 bp, Artificial Sequence
  chemically synthesized
ctgcttcagaaggcagggct

SEQ ID NO: 29062 - DNA, 20 bp, Artificial Sequence
  chemically synthesized
tgcttcagaaggcagggctt

SEQ ID NO: 29063 - DNA, 20 bp, Artificial Sequence
  chemically synthesized
gcttcagaaggcagggcttg

SEQ ID NO: 29064 - DNA, 20 bp, Artificial Sequence
  chemically synthesized
gcagggcttggggattgtat

SEQ ID NO: 29065 - DNA, 20 bp, Artificial Sequence
  chemically synthesized
ttcattctcacactgctcta

SEQ ID NO: 29066 - DNA, 20 bp, Artificial Sequence
  chemically synthesized
ctgctctaaagatactacct

SEQ ID NO: 29067 - DNA, 20 bp, Artificial Sequence
  chemically synthesized
ctaaagatactacctgagac

SEQ ID NO: 29068 - DNA, 20 bp, Artificial Sequence
  chemically synthesized
taaagatactacctgagact

SEQ ID NO: 29069 - DNA, 20 bp, Artificial Sequence
  chemically synthesized
gactgggtaatttattaaca

SEQ ID NO: 29070 - DNA, 20 bp, Artificial Sequence
  chemically synthesized
actgggtaatttattaacaa

SEQ ID NO: 29071 - DNA, 20 bp, Artificial Sequence
  chemically synthesized
tgggtaatttattaacaaag

SEQ ID NO: 29072 - DNA, 20 bp, Artificial Sequence
  chemically synthesized
gggtaatttattaacaaagg

SEQ ID NO: 29073 - DNA, 20 bp, Artificial Sequence
  chemically synthesized
aattgactcacatttccaca

SEQ ID NO: 29074 - DNA, 20 bp, Artificial Sequence
  chemically synthesized
gactcacatttccacatagc

SEQ ID NO: 29075 - DNA, 20 bp, Artificial Sequence
  chemically synthesized
actcacatttccacatagct

SEQ ID NO: 29076 - DNA, 20 bp, Artificial Sequence
  chemically synthesized
ctcacatttccacatagctg

SEQ ID NO: 29077 - DNA, 20 bp, Artificial Sequence
  chemically synthesized
cacatttccacatagctggg

SEQ ID NO: 29078 - DNA, 20 bp, Artificial Sequence
  chemically synthesized
acatttccacatagctgggg

SEQ ID NO: 29079 - DNA, 20 bp, Artificial Sequence
  chemically synthesized
ccacatagctggggaggcct

SEQ ID NO: 29080 - DNA, 20 bp, Artificial Sequence
  chemically synthesized
cacatagctggggaggcctc

SEQ ID NO: 29081 - DNA, 20 bp, Artificial Sequence
  chemically synthesized
cctcaggaaacttacaatta

SEQ ID NO: 29082 - DNA, 20 bp, Artificial Sequence
  chemically synthesized
caggaaacttacaattatgg

SEQ ID NO: 29083 - DNA, 20 bp, Artificial Sequence
  chemically synthesized
gaaacttacaattatggcag

SEQ ID NO: 29084 - DNA, 20 bp, Artificial Sequence
  chemically synthesized
aaacttacaattatggcaga

SEQ ID NO: 29085 - DNA, 20 bp, Artificial Sequence
  chemically synthesized
acttacaattatggcagaag

SEQ ID NO: 29086 - DNA, 20 bp, Artificial Sequence
  chemically synthesized
tacaattatggcagaaggag

SEQ ID NO: 29087 - DNA, 20 bp, Artificial Sequence
  chemically synthesized
aattatggcagaaggagaag

SEQ ID NO: 29088 - DNA, 20 bp, Artificial Sequence
  chemically synthesized
attatggcagaaggagaagc

SEQ ID NO: 29089 - DNA, 20 bp, Artificial Sequence
  chemically synthesized
agaagcaggcacatcttact

SEQ ID NO: 29090 - DNA, 20 bp, Artificial Sequence
  chemically synthesized
agcaggcacatcttacttgg

SEQ ID NO: 29091 - DNA, 20 bp, Artificial Sequence
  chemically synthesized
aggcacatcttacttggtgg

SEQ ID NO: 29092 - DNA, 20 bp, Artificial Sequence
  chemically synthesized
ggcacatcttacttggtggc

SEQ ID NO: 29093 - DNA, 20 bp, Artificial Sequence
  chemically synthesized
catcttacttggtggcaggc

SEQ ID NO: 29094 - DNA, 20 bp, Artificial Sequence
  chemically synthesized
tcttacttggtggcaggcaa

SEQ ID NO: 29095 - DNA, 20 bp, Artificial Sequence
  chemically synthesized
ttacttggtggcaggcaaga

SEQ ID NO: 29096 - DNA, 20 bp, Artificial Sequence
  chemically synthesized
acttggtggcaggcaagaga

SEQ ID NO: 29097 - DNA, 20 bp, Artificial Sequence
  chemically synthesized
ggtggcaggcaagagagagt

SEQ ID NO: 29098 - DNA, 20 bp, Artificial Sequence
  chemically synthesized
gcaggcaagagagagtgagc

SEQ ID NO: 29099 - DNA, 20 bp, Artificial Sequence
  chemically synthesized
ggcaagagagagtgagcaag

SEQ ID NO: 29100 - DNA, 20 bp, Artificial Sequence
  chemically synthesized
caagagagagtgagcaagaa

SEQ ID NO: 29101 - DNA, 20 bp, Artificial Sequence
  chemically synthesized
aagagagagtgagcaagaag

SEQ ID NO: 29102 - DNA, 20 bp, Artificial Sequence
  chemically synthesized
agagagagtgagcaagaaga

SEQ ID NO: 29103 - DNA, 20 bp, Artificial Sequence
  chemically synthesized
aaactgccttataaaaccat

SEQ ID NO: 29104 - DNA, 20 bp, Artificial Sequence
  chemically synthesized
agatctcatgaaaactcact

SEQ ID NO: 29105 - DNA, 20 bp, Artificial Sequence
  chemically synthesized
gaaaactcactcagtatcac

SEQ ID NO: 29106 - DNA, 20 bp, Artificial Sequence
  chemically synthesized
tcagtatcacgagaactgca

SEQ ID NO: 29107 - DNA, 20 bp, Artificial Sequence
  chemically synthesized
cagtatcacgagaactgcat

SEQ ID NO: 29108 - DNA, 20 bp, Artificial Sequence
  chemically synthesized
agtatcacgagaactgcatg

SEQ ID NO: 29109 - DNA, 20 bp, Artificial Sequence
  chemically synthesized
gtatcacgagaactgcatgg

SEQ ID NO: 29110 - DNA, 20 bp, Artificial Sequence
  chemically synthesized
tgatccaataatctcccacc

SEQ ID NO: 29111 - DNA, 20 bp, Artificial Sequence
  chemically synthesized
ctggtccctcccccgacata

SEQ ID NO: 29112 - DNA, 20 bp, Artificial Sequence
  chemically synthesized
tggtccctcccccgacatat

SEQ ID NO: 29113 - DNA, 20 bp, Artificial Sequence
  chemically synthesized
ggtccctcccccgacatata

SEQ ID NO: 29114 - DNA, 20 bp, Artificial Sequence
  chemically synthesized
cccccgacatatagggatta

SEQ ID NO: 29115 - DNA, 20 bp, Artificial Sequence
  chemically synthesized
ccccgacatatagggattat

SEQ ID NO: 29116 - DNA, 20 bp, Artificial Sequence
  chemically synthesized
cccgacatatagggattatg

SEQ ID NO: 29117 - DNA, 20 bp, Artificial Sequence
  chemically synthesized
ttacaattcaatatgaaatt

SEQ ID NO: 29118 - DNA, 20 bp, Artificial Sequence
  chemically synthesized
tacaattcaatatgaaattt

SEQ ID NO: 29119 - DNA, 20 bp, Artificial Sequence
  chemically synthesized
aattcaatatgaaatttggg

SEQ ID NO: 29120 - DNA, 20 bp, Artificial Sequence
  chemically synthesized
ttcaatatgaaatttgggtg

SEQ ID NO: 29121 - DNA, 20 bp, Artificial Sequence
  chemically synthesized
atgaaatttgggtggagaca

SEQ ID NO: 29122 - DNA, 20 bp, Artificial Sequence
  chemically synthesized
gaaatttgggtggagacaca

SEQ ID NO: 29123 - DNA, 20 bp, Artificial Sequence
  chemically synthesized
ttgggtggagacacagagcc

SEQ ID NO: 29124 - DNA, 20 bp, Artificial Sequence
  chemically synthesized
gacacagagccaagccatat

SEQ ID NO: 29125 - DNA, 20 bp, Artificial Sequence
  chemically synthesized
acacagagccaagccatatc

SEQ ID NO: 29126 - DNA, 20 bp, Artificial Sequence
  chemically synthesized
cacagagccaagccatatca

SEQ ID NO: 29127 - DNA, 20 bp, Artificial Sequence
  chemically synthesized
ccaagccatatcagggatca

SEQ ID NO: 29128 - DNA, 20 bp, Artificial Sequence
  chemically synthesized
caagccatatcagggatcat

SEQ ID NO: 29129 - DNA, 20 bp, Artificial Sequence
  chemically synthesized
tgggcttgtgcactcaccac

SEQ ID NO: 29130 - DNA, 20 bp, Artificial Sequence
  chemically synthesized
gcactcaccacaagtgaaac

SEQ ID NO: 29131 - DNA, 20 bp, Artificial Sequence
  chemically synthesized
cacaagtgaaactggcctct

SEQ ID NO: 29132 - DNA, 20 bp, Artificial Sequence
  chemically synthesized
tgaaactggcctctgagcct

SEQ ID NO: 29133 - DNA, 20 bp, Artificial Sequence
  chemically synthesized
gaaactggcctctgagcctc

SEQ ID NO: 29134 - DNA, 20 bp, Artificial Sequence
  chemically synthesized
actggcctctgagcctcagg

SEQ ID NO: 29135 - DNA, 20 bp, Artificial Sequence
  chemically synthesized
ctggcctctgagcctcaggt

SEQ ID NO: 29136 - DNA, 20 bp, Artificial Sequence
  chemically synthesized
cctctgagcctcaggtggga

SEQ ID NO: 29137 - DNA, 20 bp, Artificial Sequence
  chemically synthesized
ctctgagcctcaggtgggat

SEQ ID NO: 29138 - DNA, 20 bp, Artificial Sequence
  chemically synthesized
tctgagcctcaggtgggatg

SEQ ID NO: 29139 - DNA, 20 bp, Artificial Sequence
  chemically synthesized
gagcctcaggtgggatgggg

SEQ ID NO: 29140 - DNA, 20 bp, Artificial Sequence
  chemically synthesized
tgggatggggaagctcactt

SEQ ID NO: 29141 - DNA, 20 bp, Artificial Sequence
  chemically synthesized
atggggaagctcacttcagc

SEQ ID NO: 29142 - DNA, 20 bp, Artificial Sequence
  chemically synthesized
tcagcaagtccctgccactg

SEQ ID NO: 29143 - DNA, 20 bp, Artificial Sequence
  chemically synthesized
ctgtggcattcatatcttct

SEQ ID NO: 29144 - DNA, 20 bp, Artificial Sequence
  chemically synthesized
cattcatatcttcttagtcc

SEQ ID NO: 29145 - DNA, 20 bp, Artificial Sequence
  chemically synthesized
attcatatcttcttagtcct

SEQ ID NO: 29146 - DNA, 20 bp, Artificial Sequence
  chemically synthesized
ttcatatcttcttagtcctg

SEQ ID NO: 29147 - DNA, 20 bp, Artificial Sequence
  chemically synthesized
tatcttcttagtcctggggc

SEQ ID NO: 29148 - DNA, 20 bp, Artificial Sequence
  chemically synthesized
atgctgcccattttttgaaa

SEQ ID NO: 29149 - DNA, 20 bp, Artificial Sequence
  chemically synthesized
cattttttgaaaaagctgat

SEQ ID NO: 29150 - DNA, 20 bp, Artificial Sequence
  chemically synthesized
ttttttgaaaaagctgatca

SEQ ID NO: 29151 - DNA, 20 bp, Artificial Sequence
  chemically synthesized
aaaaagctgatcagagtctc

SEQ ID NO: 29152 - DNA, 20 bp, Artificial Sequence
  chemically synthesized
aaaagctgatcagagtctct

SEQ ID NO: 29153 - DNA, 20 bp, Artificial Sequence
  chemically synthesized
aagctgatcagagtctctag

SEQ ID NO: 29154 - DNA, 20 bp, Artificial Sequence
  chemically synthesized
ctgatcagagtctctaggag

SEQ ID NO: 29155 - DNA, 20 bp, Artificial Sequence
  chemically synthesized
gatcagagtctctaggagta

SEQ ID NO: 29156 - DNA, 20 bp, Artificial Sequence
  chemically synthesized
agtctctaggagtagagtaa

SEQ ID NO: 29157 - DNA, 20 bp, Artificial Sequence
  chemically synthesized
gtctctaggagtagagtaat

SEQ ID NO: 29158 - DNA, 20 bp, Artificial Sequence
  chemically synthesized
tctctaggagtagagtaatg

SEQ ID NO: 29159 - DNA, 20 bp, Artificial Sequence
  chemically synthesized
tctaggagtagagtaatggg

SEQ ID NO: 29160 - DNA, 20 bp, Artificial Sequence
  chemically synthesized
ggagtagagtaatggggaga

SEQ ID NO: 29161 - DNA, 20 bp, Artificial Sequence
  chemically synthesized
tagagtaatggggagaaagt

SEQ ID NO: 29162 - DNA, 20 bp, Artificial Sequence
  chemically synthesized
agagtaatggggagaaagtt

SEQ ID NO: 29163 - DNA, 20 bp, Artificial Sequence
  chemically synthesized
gggagaaagttaggttccct

SEQ ID NO: 29164 - DNA, 20 bp, Artificial Sequence
  chemically synthesized
ggagaaagttaggttccctg

SEQ ID NO: 29165 - DNA, 20 bp, Artificial Sequence
  chemically synthesized
agaaagttaggttccctgag

SEQ ID NO: 29166 - DNA, 20 bp, Artificial Sequence
  chemically synthesized
ttccctgaggagcaattacc

SEQ ID NO: 29167 - DNA, 20 bp, Artificial Sequence
  chemically synthesized
tccctgaggagcaattaccc

SEQ ID NO: 29168 - DNA, 20 bp, Artificial Sequence
  chemically synthesized
aattacccaggtaattacat

SEQ ID NO: 29169 - DNA, 20 bp, Artificial Sequence
  chemically synthesized
cattagcctctctcaatatc

SEQ ID NO: 29170 - DNA, 20 bp, Artificial Sequence
  chemically synthesized
ttagcctctctcaatatcca

SEQ ID NO: 29171 - DNA, 20 bp, Artificial Sequence
  chemically synthesized
tctcaatatccagagaacct

SEQ ID NO: 29172 - DNA, 20 bp, Artificial Sequence
  chemically synthesized
ctcaatatccagagaaccta

SEQ ID NO: 29173 - DNA, 20 bp, Artificial Sequence
  chemically synthesized
tcaatatccagagaacctaa

SEQ ID NO: 29174 - DNA, 20 bp, Artificial Sequence
  chemically synthesized
ccagagaacctaagggaaac

SEQ ID NO: 29175 - DNA, 20 bp, Artificial Sequence
  chemically synthesized
gaacctaagggaaacaagca

SEQ ID NO: 29176 - DNA, 20 bp, Artificial Sequence
  chemically synthesized
aagggaaacaagcaaagata

SEQ ID NO: 29177 - DNA, 20 bp, Artificial Sequence
  chemically synthesized
gggaaacaagcaaagatata

SEQ ID NO: 29178 - DNA, 20 bp, Artificial Sequence
  chemically synthesized
aacaagcaaagatatagagt

SEQ ID NO: 29179 - DNA, 20 bp, Artificial Sequence
  chemically synthesized
agtcagtatctttgtgaaat

SEQ ID NO: 29180 - DNA, 20 bp, Artificial Sequence
  chemically synthesized
tctttgtgaaatgagtgtaa

SEQ ID NO: 29181 - DNA, 20 bp, Artificial Sequence
  chemically synthesized
tgagtgtaatagtatttatc

SEQ ID NO: 29182 - DNA, 20 bp, Artificial Sequence
  chemically synthesized
ttattttttgttatactttt

SEQ ID NO: 29183 - DNA, 20 bp, Artificial Sequence
  chemically synthesized
tttgttatacttttaagttt

SEQ ID NO: 29184 - DNA, 20 bp, Artificial Sequence
  chemically synthesized
ttgttatacttttaagtttt

SEQ ID NO: 29185 - DNA, 20 bp, Artificial Sequence
  chemically synthesized
tgttatacttttaagtttta

SEQ ID NO: 29186 - DNA, 20 bp, Artificial Sequence
  chemically synthesized
gttttagggtacatgtgcac

SEQ ID NO: 29187 - DNA, 20 bp, Artificial Sequence
  chemically synthesized
ttttagggtacatgtgcaca

SEQ ID NO: 29188 - DNA, 20 bp, Artificial Sequence
  chemically synthesized
gggtacatgtgcacaaggtg

SEQ ID NO: 29189 - DNA, 20 bp, Artificial Sequence
  chemically synthesized
ggtacatgtgcacaaggtgc

SEQ ID NO: 29190 - DNA, 20 bp, Artificial Sequence
  chemically synthesized
catgtgcacaaggtgcaggt

SEQ ID NO: 29191 - DNA, 20 bp, Artificial Sequence
  chemically synthesized
tatgtatacatgtgccatgt

SEQ ID NO: 29192 - DNA, 20 bp, Artificial Sequence
  chemically synthesized
attaactcaccatttaacat

SEQ ID NO: 29193 - DNA, 20 bp, Artificial Sequence
  chemically synthesized
ttaactcaccatttaacatt

SEQ ID NO: 29194 - DNA, 20 bp, Artificial Sequence
  chemically synthesized
cccctcctcccaccccacaa

SEQ ID NO: 29195 - DNA, 20 bp, Artificial Sequence
  chemically synthesized
ccctcctcccaccccacaac

SEQ ID NO: 29196 - DNA, 20 bp, Artificial Sequence
  chemically synthesized
tcccaccccacaacaggccc

SEQ ID NO: 29197 - DNA, 20 bp, Artificial Sequence
  chemically synthesized
gtccatgtgttctcattgtt

SEQ ID NO: 29198 - DNA, 20 bp, Artificial Sequence
  chemically synthesized
attgttcagttcccacctat

SEQ ID NO: 29199 - DNA, 20 bp, Artificial Sequence
  chemically synthesized
ttcagttcccacctatgagt

SEQ ID NO: 29200 - DNA, 20 bp, Artificial Sequence
  chemically synthesized
cacctatgagtgagaacatg

SEQ ID NO: 29201 - DNA, 20 bp, Artificial Sequence
  chemically synthesized
gagtgagaacatgtggtgtt

SEQ ID NO: 29202 - DNA, 20 bp, Artificial Sequence
  chemically synthesized
ttggctttttgtccttgtga

SEQ ID NO: 29203 - DNA, 20 bp, Artificial Sequence
  chemically synthesized
tgtccttgtgatagtttgct

SEQ ID NO: 29204 - DNA, 20 bp, Artificial Sequence
  chemically synthesized
tgatagtttgctgagaatga

SEQ ID NO: 29205 - DNA, 20 bp, Artificial Sequence
  chemically synthesized
ttgctgagaatgatggtttc

SEQ ID NO: 29206 - DNA, 20 bp, Artificial Sequence
  chemically synthesized
gcttcatccatgtccctaca

SEQ ID NO: 29207 - DNA, 20 bp, Artificial Sequence
  chemically synthesized
cttcatccatgtccctacaa

SEQ ID NO: 29208 - DNA, 20 bp, Artificial Sequence
  chemically synthesized
catgaactcatcatttttta

SEQ ID NO: 29209 - DNA, 20 bp, Artificial Sequence
  chemically synthesized
catcattttttatggctgca

SEQ ID NO: 29210 - DNA, 20 bp, Artificial Sequence
  chemically synthesized
tatggctgcatagtattcca

SEQ ID NO: 29211 - DNA, 20 bp, Artificial Sequence
  chemically synthesized
tgtgccacattttcttaatc

SEQ ID NO: 29212 - DNA, 20 bp, Artificial Sequence
  chemically synthesized
ttaatccagtctatcattgt

SEQ ID NO: 29213 - DNA, 20 bp, Artificial Sequence
  chemically synthesized
gtctatcattgttggacatt

SEQ ID NO: 29214 - DNA, 20 bp, Artificial Sequence
  chemically synthesized
tctatcattgttggacattt

SEQ ID NO: 29215 - DNA, 20 bp, Artificial Sequence
  chemically synthesized
tcattgttggacatttgggt

SEQ ID NO: 29216 - DNA, 20 bp, Artificial Sequence
  chemically synthesized
tggacatttgggttggttcc

SEQ ID NO: 29217 - DNA, 20 bp, Artificial Sequence
  chemically synthesized
caagtctttgctattgtgaa

SEQ ID NO: 29218 - DNA, 20 bp, Artificial Sequence
  chemically synthesized
tacgtgtgcatgtgtcttta

SEQ ID NO: 29219 - DNA, 20 bp, Artificial Sequence
  chemically synthesized
gtgtgcatgtgtctttatag

SEQ ID NO: 29220 - DNA, 20 bp, Artificial Sequence
  chemically synthesized
cagcatgatttataatcctt

SEQ ID NO: 29221 - DNA, 20 bp, Artificial Sequence
  chemically synthesized
agcatgatttataatccttt

SEQ ID NO: 29222 - DNA, 20 bp, Artificial Sequence
  chemically synthesized
taatcctttgggtgtatacc

SEQ ID NO: 29223 - DNA, 20 bp, Artificial Sequence
  chemically synthesized
tttgggtgtatacccagtaa

SEQ ID NO: 29224 - DNA, 20 bp, Artificial Sequence
  chemically synthesized
ttgggtgtatacccagtaat

SEQ ID NO: 29225 - DNA, 20 bp, Artificial Sequence
  chemically synthesized
gtgtatacccagtaatggga

SEQ ID NO: 29226 - DNA, 20 bp, Artificial Sequence
  chemically synthesized
atacccagtaatgggatggc

SEQ ID NO: 29227 - DNA, 20 bp, Artificial Sequence
  chemically synthesized
tacccagtaatgggatggct

SEQ ID NO: 29228 - DNA, 20 bp, Artificial Sequence
  chemically synthesized
aatgggatggctgggtcaaa

SEQ ID NO: 29229 - DNA, 20 bp, Artificial Sequence
  chemically synthesized
gctgggtcaaatggtatttc

SEQ ID NO: 29230 - DNA, 20 bp, Artificial Sequence
  chemically synthesized
tcaaatggtatttctagttc

SEQ ID NO: 29231 - DNA, 20 bp, Artificial Sequence
  chemically synthesized
atttctagttctagatccct

SEQ ID NO: 29232 - DNA, 20 bp, Artificial Sequence
  chemically synthesized
tttctagttctagatccctg

SEQ ID NO: 29233 - DNA, 20 bp, Artificial Sequence
  chemically synthesized
gacttccacaatgtttgaac

SEQ ID NO: 29234 - DNA, 20 bp, Artificial Sequence
  chemically synthesized
acaatgtttgaactagttta

SEQ ID NO: 29235 - DNA, 20 bp, Artificial Sequence
  chemically synthesized
ctagtttacagtcccaccaa

SEQ ID NO: 29236 - DNA, 20 bp, Artificial Sequence
  chemically synthesized
cagtcccaccaacagtgtaa

SEQ ID NO: 29237 - DNA, 20 bp, Artificial Sequence
  chemically synthesized
ctatttctccacatcctctc

SEQ ID NO: 29238 - DNA, 20 bp, Artificial Sequence
  chemically synthesized
ttaatgattgccattctaac

SEQ ID NO: 29239 - DNA, 20 bp, Artificial Sequence
  chemically synthesized
attgccattctaactggtgt

SEQ ID NO: 29240 - DNA, 20 bp, Artificial Sequence
  chemically synthesized
ccattctaactggtgtgaga

SEQ ID NO: 29241 - DNA, 20 bp, Artificial Sequence
  chemically synthesized
tgtgagatggtatctcattg

SEQ ID NO: 29242 - DNA, 20 bp, Artificial Sequence
  chemically synthesized
tttgatttgcatttctctga

SEQ ID NO: 29243 - DNA, 20 bp, Artificial Sequence
  chemically synthesized
atttgcatttctctgatggc

SEQ ID NO: 29244 - DNA, 20 bp, Artificial Sequence
  chemically synthesized
ctctgatggccagtgatgat

SEQ ID NO: 29245 - DNA, 20 bp, Artificial Sequence
  chemically synthesized
gcattttttcatgtgtcttt

SEQ ID NO: 29246 - DNA, 20 bp, Artificial Sequence
  chemically synthesized
ctgcataaatgtcttctttt

SEQ ID NO: 29247 - DNA, 20 bp, Artificial Sequence
  chemically synthesized
cataaatgtcttcttttgag

SEQ ID NO: 29248 - DNA, 20 bp, Artificial Sequence
  chemically synthesized
atcctttgcccactttttga

SEQ ID NO: 29249 - DNA, 20 bp, Artificial Sequence
  chemically synthesized
tcctttgcccactttttgat

SEQ ID NO: 29250 - DNA, 20 bp, Artificial Sequence
  chemically synthesized
cctttgcccactttttgatg

SEQ ID NO: 29251 - DNA, 20 bp, Artificial Sequence
  chemically synthesized
tttctcttgtaaatttgttt

SEQ ID NO: 29252 - DNA, 20 bp, Artificial Sequence
  chemically synthesized
aaatttgtttgagttcattg

SEQ ID NO: 29253 - DNA, 20 bp, Artificial Sequence
  chemically synthesized
tttgagttcattgtagattc

SEQ ID NO: 29254 - DNA, 20 bp, Artificial Sequence
  chemically synthesized
tcattgtagattctggatat

SEQ ID NO: 29255 - DNA, 20 bp, Artificial Sequence
  chemically synthesized
tctggatattagccctttgt

SEQ ID NO: 29256 - DNA, 20 bp, Artificial Sequence
  chemically synthesized
atattagccctttgtcagat

SEQ ID NO: 29257 - DNA, 20 bp, Artificial Sequence
  chemically synthesized
ttagccctttgtcagatgag

SEQ ID NO: 29258 - DNA, 20 bp, Artificial Sequence
  chemically synthesized
aaaaattttctcccattgtg

SEQ ID NO: 29259 - DNA, 20 bp, Artificial Sequence
  chemically synthesized
aaaattttctcccattgtgt

SEQ ID NO: 29260 - DNA, 20 bp, Artificial Sequence
  chemically synthesized
aggttgcctgttcactctga

SEQ ID NO: 29261 - DNA, 20 bp, Artificial Sequence
  chemically synthesized
ttgcctgttcactctgatgg

SEQ ID NO: 29262 - DNA, 20 bp, Artificial Sequence
  chemically synthesized
tggtagtttcttttgctgtg

SEQ ID NO: 29263 - DNA, 20 bp, Artificial Sequence
  chemically synthesized
tagtttcttttgctgtgcag

SEQ ID NO: 29264 - DNA, 20 bp, Artificial Sequence
  chemically synthesized
tttgctgtgcagaagatctt

SEQ ID NO: 29265 - DNA, 20 bp, Artificial Sequence
  chemically synthesized
cagaagatctttagtttaat

SEQ ID NO: 29266 - DNA, 20 bp, Artificial Sequence
  chemically synthesized
ttagtttaattagatcccat

SEQ ID NO: 29267 - DNA, 20 bp, Artificial Sequence
  chemically synthesized
tagatcccattagtgaattt

SEQ ID NO: 29268 - DNA, 20 bp, Artificial Sequence
  chemically synthesized
gcttttgttgccattgcttt

SEQ ID NO: 29269 - DNA, 20 bp, Artificial Sequence
  chemically synthesized
tgccattgcttttggtgttt

SEQ ID NO: 29270 - DNA, 20 bp, Artificial Sequence
  chemically synthesized
cttttggtgttttagacatg

SEQ ID NO: 29271 - DNA, 20 bp, Artificial Sequence
  chemically synthesized
gcccatgcctatgtcctgaa

SEQ ID NO: 29272 - DNA, 20 bp, Artificial Sequence
  chemically synthesized
atgtcctgaatggtattgct

SEQ ID NO: 29273 - DNA, 20 bp, Artificial Sequence
  chemically synthesized
tgtcctgaatggtattgctt

SEQ ID NO: 29274 - DNA, 20 bp, Artificial Sequence
  chemically synthesized
gtattgcttaggttttcttc

SEQ ID NO: 29275 - DNA, 20 bp, Artificial Sequence
  chemically synthesized
attgcttaggttttcttcta

SEQ ID NO: 29276 - DNA, 20 bp, Artificial Sequence
  chemically synthesized
gttttcttctagagttttta

SEQ ID NO: 29277 - DNA, 20 bp, Artificial Sequence
  chemically synthesized
ttctagagtttttatggttt

SEQ ID NO: 29278 - DNA, 20 bp, Artificial Sequence
  chemically synthesized
tctagagtttttatggtttt

SEQ ID NO: 29279 - DNA, 20 bp, Artificial Sequence
  chemically synthesized
tggttttaggtctaacattt

SEQ ID NO: 29280 - DNA, 20 bp, Artificial Sequence
  chemically synthesized
ttaagtctttaatccatctt

SEQ ID NO: 29281 - DNA, 20 bp, Artificial Sequence
  chemically synthesized
tcttgagttaatttttgtat

SEQ ID NO: 29282 - DNA, 20 bp, Artificial Sequence
  chemically synthesized
cttgagttaatttttgtata

SEQ ID NO: 29283 - DNA, 20 bp, Artificial Sequence
  chemically synthesized
ttaatttttgtataaggtgt

SEQ ID NO: 29284 - DNA, 20 bp, Artificial Sequence
  chemically synthesized
taatttttgtataaggtgta

SEQ ID NO: 29285 - DNA, 20 bp, Artificial Sequence
  chemically synthesized
tttttgtataaggtgtaagg

SEQ ID NO: 29286 - DNA, 20 bp, Artificial Sequence
  chemically synthesized
ttttgtataaggtgtaagga

SEQ ID NO: 29287 - DNA, 20 bp, Artificial Sequence
  chemically synthesized
tttgtataaggtgtaaggaa

SEQ ID NO: 29288 - DNA, 20 bp, Artificial Sequence
  chemically synthesized
taaggtgtaaggaagggatc

SEQ ID NO: 29289 - DNA, 20 bp, Artificial Sequence
  chemically synthesized
gtaaggaagggatccagttt

SEQ ID NO: 29290 - DNA, 20 bp, Artificial Sequence
  chemically synthesized
cagtttcagcttcctacatt

SEQ ID NO: 29291 - DNA, 20 bp, Artificial Sequence
  chemically synthesized
ttcagcttcctacatttggc

SEQ ID NO: 29292 - DNA, 20 bp, Artificial Sequence
  chemically synthesized
gcttcctacatttggctagc

SEQ ID NO: 29293 - DNA, 20 bp, Artificial Sequence
  chemically synthesized
atttggctagccagttttcc

SEQ ID NO: 29294 - DNA, 20 bp, Artificial Sequence
  chemically synthesized
tcccagcaccatttattaaa

SEQ ID NO: 29295 - DNA, 20 bp, Artificial Sequence
  chemically synthesized
cccagcaccatttattaaac

SEQ ID NO: 29296 - DNA, 20 bp, Artificial Sequence
  chemically synthesized
ccagcaccatttattaaaca

SEQ ID NO: 29297 - DNA, 20 bp, Artificial Sequence
  chemically synthesized
tccccatttcttgtttttct

SEQ ID NO: 29298 - DNA, 20 bp, Artificial Sequence
  chemically synthesized
ccccatttcttgtttttctc

SEQ ID NO: 29299 - DNA, 20 bp, Artificial Sequence
  chemically synthesized
tgtttttctcaggtttgtca

SEQ ID NO: 29300 - DNA, 20 bp, Artificial Sequence
  chemically synthesized
ttctcaggtttgtcaaagat

SEQ ID NO: 29301 - DNA, 20 bp, Artificial Sequence
  chemically synthesized
caggtttgtcaaagatcaga

SEQ ID NO: 29302 - DNA, 20 bp, Artificial Sequence
  chemically synthesized
tgtcaaagatcagatagttg

SEQ ID NO: 29303 - DNA, 20 bp, Artificial Sequence
  chemically synthesized
aaagatcagatagttgtaga

SEQ ID NO: 29304 - DNA, 20 bp, Artificial Sequence
  chemically synthesized
atcagatagttgtagataga

SEQ ID NO: 29305 - DNA, 20 bp, Artificial Sequence
  chemically synthesized
agatagacagcattatttct

SEQ ID NO: 29306 - DNA, 20 bp, Artificial Sequence
  chemically synthesized
gatagacagcattatttctg

SEQ ID NO: 29307 - DNA, 20 bp, Artificial Sequence
  chemically synthesized
atagacagcattatttctga

SEQ ID NO: 29308 - DNA, 20 bp, Artificial Sequence
  chemically synthesized
agggctctgttttgttccat

SEQ ID NO: 29309 - DNA, 20 bp, Artificial Sequence
  chemically synthesized
attggtctatatctctgttt

SEQ ID NO: 29310 - DNA, 20 bp, Artificial Sequence
  chemically synthesized
ctatatctctgttttggtac

SEQ ID NO: 29311 - DNA, 20 bp, Artificial Sequence
  chemically synthesized
gtaccagtactatgctgttt

SEQ ID NO: 29312 - DNA, 20 bp, Artificial Sequence
  chemically synthesized
ctatgctgttttggttactg

SEQ ID NO: 29313 - DNA, 20 bp, Artificial Sequence
  chemically synthesized
ttttggttactgtagccttg

SEQ ID NO: 29314 - DNA, 20 bp, Artificial Sequence
  chemically synthesized
gttactgtagccttgtagta

SEQ ID NO: 29315 - DNA, 20 bp, Artificial Sequence
  chemically synthesized
cttgtagtatagtttgaaat

SEQ ID NO: 29316 - DNA, 20 bp, Artificial Sequence
  chemically synthesized
ttgtagtatagtttgaaatc

SEQ ID NO: 29317 - DNA, 20 bp, Artificial Sequence
  chemically synthesized
tagtatagtttgaaatcagg

SEQ ID NO: 29318 - DNA, 20 bp, Artificial Sequence
  chemically synthesized
atcaggtagtgtgatgcctc

SEQ ID NO: 29319 - DNA, 20 bp, Artificial Sequence
  chemically synthesized
tgcctccagctttgttcttt

SEQ ID NO: 29320 - DNA, 20 bp, Artificial Sequence
  chemically synthesized
ccagctttgttcttttggct

SEQ ID NO: 29321 - DNA, 20 bp, Artificial Sequence
  chemically synthesized
cagctttgttcttttggctt

SEQ ID NO: 29322 - DNA, 20 bp, Artificial Sequence
  chemically synthesized
cttttggcttaggattgact

SEQ ID NO: 29323 - DNA, 20 bp, Artificial Sequence
  chemically synthesized
ttaggattgacttggcgatg

SEQ ID NO: 29324 - DNA, 20 bp, Artificial Sequence
  chemically synthesized
taggattgacttggcgatgc

SEQ ID NO: 29325 - DNA, 20 bp, Artificial Sequence
  chemically synthesized
tggcgatgcgggctcttttt

SEQ ID NO: 29326 - DNA, 20 bp, Artificial Sequence
  chemically synthesized
ttggttccatatgaacttta

SEQ ID NO: 29327 - DNA, 20 bp, Artificial Sequence
  chemically synthesized
gttccatatgaactttaaag

SEQ ID NO: 29328 - DNA, 20 bp, Artificial Sequence
  chemically synthesized
tagttttttccaattctgtg

SEQ ID NO: 29329 - DNA, 20 bp, Artificial Sequence
  chemically synthesized
tttttccaattctgtgaaga

SEQ ID NO: 29330 - DNA, 20 bp, Artificial Sequence
  chemically synthesized
aattctgtgaagaaagtcat

SEQ ID NO: 29331 - DNA, 20 bp, Artificial Sequence
  chemically synthesized
tctgtgaagaaagtcattgg

SEQ ID NO: 29332 - DNA, 20 bp, Artificial Sequence
  chemically synthesized
gaaagtcattggtagcttga

SEQ ID NO: 29333 - DNA, 20 bp, Artificial Sequence
  chemically synthesized
aaagtcattggtagcttgat

SEQ ID NO: 29334 - DNA, 20 bp, Artificial Sequence
  chemically synthesized
aagtcattggtagcttgatg

SEQ ID NO: 29335 - DNA, 20 bp, Artificial Sequence
  chemically synthesized
cattggtagcttgatgggga

SEQ ID NO: 29336 - DNA, 20 bp, Artificial Sequence
  chemically synthesized
attgaatctataaattacct

SEQ ID NO: 29337 - DNA, 20 bp, Artificial Sequence
  chemically synthesized
ttgaatctataaattacctt

SEQ ID NO: 29338 - DNA, 20 bp, Artificial Sequence
  chemically synthesized
aatctataaattaccttggg

SEQ ID NO: 29339 - DNA, 20 bp, Artificial Sequence
  chemically synthesized
ataaattaccttgggcagta

SEQ ID NO: 29340 - DNA, 20 bp, Artificial Sequence
  chemically synthesized
tattgtttcttcctatccat

SEQ ID NO: 29341 - DNA, 20 bp, Artificial Sequence
  chemically synthesized
tttcttcctatccatgagca

SEQ ID NO: 29342 - DNA, 20 bp, Artificial Sequence
  chemically synthesized
tgtttgtatcttatttcctt

SEQ ID NO: 29343 - DNA, 20 bp, Artificial Sequence
  chemically synthesized
ttgtatcttatttccttgag

SEQ ID NO: 29344 - DNA, 20 bp, Artificial Sequence
  chemically synthesized
tatcttatttccttgagcag

SEQ ID NO: 29345 - DNA, 20 bp, Artificial Sequence
  chemically synthesized
tttccttgagcagtggtttg

SEQ ID NO: 29346 - DNA, 20 bp, Artificial Sequence
  chemically synthesized
gtggtttgtagttctccttg

SEQ ID NO: 29347 - DNA, 20 bp, Artificial Sequence
  chemically synthesized
ggtttgtagttctccttgaa

SEQ ID NO: 29348 - DNA, 20 bp, Artificial Sequence
  chemically synthesized
gtttgtagttctccttgaag

SEQ ID NO: 29349 - DNA, 20 bp, Artificial Sequence
  chemically synthesized
aggtccttcacatcccttgt

SEQ ID NO: 29350 - DNA, 20 bp, Artificial Sequence
  chemically synthesized
ccttcacatcccttgtaagt

SEQ ID NO: 29351 - DNA, 20 bp, Artificial Sequence
  chemically synthesized
tcccttgtaagttggattcc

SEQ ID NO: 29352 - DNA, 20 bp, Artificial Sequence
  chemically synthesized
cccttgtaagttggattcct

SEQ ID NO: 29353 - DNA, 20 bp, Artificial Sequence
  chemically synthesized
taggtattatattctctctg

SEQ ID NO: 29354 - DNA, 20 bp, Artificial Sequence
  chemically synthesized
ctctctgaagcaattgtgaa

SEQ ID NO: 29355 - DNA, 20 bp, Artificial Sequence
  chemically synthesized
tctctgaagcaattgtgaat

SEQ ID NO: 29356 - DNA, 20 bp, Artificial Sequence
  chemically synthesized
tctgaagcaattgtgaatgg

SEQ ID NO: 29357 - DNA, 20 bp, Artificial Sequence
  chemically synthesized
actcactgtttgtctgttat

SEQ ID NO: 29358 - DNA, 20 bp, Artificial Sequence
  chemically synthesized
tttgtctgttattggtgtat

SEQ ID NO: 29359 - DNA, 20 bp, Artificial Sequence
  chemically synthesized
gcacattgattttgtatcct

SEQ ID NO: 29360 - DNA, 20 bp, Artificial Sequence
  chemically synthesized
tgtatcctgagactttgctg

SEQ ID NO: 29361 - DNA, 20 bp, Artificial Sequence
  chemically synthesized
actttgctgaagttgcttat

SEQ ID NO: 29362 - DNA, 20 bp, Artificial Sequence
  chemically synthesized
ctgaagttgcttatcagctt

SEQ ID NO: 29363 - DNA, 20 bp, Artificial Sequence
  chemically synthesized
tgaagttgcttatcagctta

SEQ ID NO: 29364 - DNA, 20 bp, Artificial Sequence
  chemically synthesized
gaagttgcttatcagcttaa

SEQ ID NO: 29365 - DNA, 20 bp, Artificial Sequence
  chemically synthesized
aagttgcttatcagcttaag

SEQ ID NO: 29366 - DNA, 20 bp, Artificial Sequence
  chemically synthesized
ttatcagcttaaggggattt

SEQ ID NO: 29367 - DNA, 20 bp, Artificial Sequence
  chemically synthesized
tatcagcttaaggggatttt

SEQ ID NO: 29368 - DNA, 20 bp, Artificial Sequence
  chemically synthesized
gcttaaggggattttgggct

SEQ ID NO: 29369 - DNA, 20 bp, Artificial Sequence
  chemically synthesized
gggattttgggctgagacaa

SEQ ID NO: 29370 - DNA, 20 bp, Artificial Sequence
  chemically synthesized
ggattttgggctgagacaat

SEQ ID NO: 29371 - DNA, 20 bp, Artificial Sequence
  chemically synthesized
gattttgggctgagacaatg

SEQ ID NO: 29372 - DNA, 20 bp, Artificial Sequence
  chemically synthesized
gctgagacaatggggttttc

SEQ ID NO: 29373 - DNA, 20 bp, Artificial Sequence
  chemically synthesized
gcaatcacgtcatctgcaaa

SEQ ID NO: 29374 - DNA, 20 bp, Artificial Sequence
  chemically synthesized
caatcacgtcatctgcaaac

SEQ ID NO: 29375 - DNA, 20 bp, Artificial Sequence
  chemically synthesized
aatcacgtcatctgcaaaca

SEQ ID NO: 29376 - DNA, 20 bp, Artificial Sequence
  chemically synthesized
ccttctcctgcccgattgcc

SEQ ID NO: 29377 - DNA, 20 bp, Artificial Sequence
  chemically synthesized
cttctcctgcccgattgccc

SEQ ID NO: 29378 - DNA, 20 bp, Artificial Sequence
  chemically synthesized
tcctgcccgattgcccgggc

SEQ ID NO: 29379 - DNA, 20 bp, Artificial Sequence
  chemically synthesized
acttccaacactatgttgaa

SEQ ID NO: 29380 - DNA, 20 bp, Artificial Sequence
  chemically synthesized
cttccaacactatgttgaat

SEQ ID NO: 29381 - DNA, 20 bp, Artificial Sequence
  chemically synthesized
tccaacactatgttgaatag

SEQ ID NO: 29382 - DNA, 20 bp, Artificial Sequence
  chemically synthesized
aacactatgttgaataggag

SEQ ID NO: 29383 - DNA, 20 bp, Artificial Sequence
  chemically synthesized
ctatgttgaataggagtggt

SEQ ID NO: 29384 - DNA, 20 bp, Artificial Sequence
  chemically synthesized
atgttgaataggagtggtga

SEQ ID NO: 29385 - DNA, 20 bp, Artificial Sequence
  chemically synthesized
gttgaataggagtggtgaga

SEQ ID NO: 29386 - DNA, 20 bp, Artificial Sequence
  chemically synthesized
ttgaataggagtggtgagag

SEQ ID NO: 29387 - DNA, 20 bp, Artificial Sequence
  chemically synthesized
tgaataggagtggtgagaga

SEQ ID NO: 29388 - DNA, 20 bp, Artificial Sequence
  chemically synthesized
gagagggcatccctgtcttg

SEQ ID NO: 29389 - DNA, 20 bp, Artificial Sequence
  chemically synthesized
ggcatccctgtcttgcagcc

SEQ ID NO: 29390 - DNA, 20 bp, Artificial Sequence
  chemically synthesized
gcatccctgtcttgcagcct

SEQ ID NO: 29391 - DNA, 20 bp, Artificial Sequence
  chemically synthesized
cagcctaggcacattttcat

SEQ ID NO: 29392 - DNA, 20 bp, Artificial Sequence
  chemically synthesized
agcctaggcacattttcatt

SEQ ID NO: 29393 - DNA, 20 bp, Artificial Sequence
  chemically synthesized
ctaggcacattttcattagg

SEQ ID NO: 29394 - DNA, 20 bp, Artificial Sequence
  chemically synthesized
cacattttcattaggcagtg

SEQ ID NO: 29395 - DNA, 20 bp, Artificial Sequence
  chemically synthesized
tttcattaggcagtgcagtg

SEQ ID NO: 29396 - DNA, 20 bp, Artificial Sequence
  chemically synthesized
ttaggcagtgcagtgtggtt

SEQ ID NO: 29397 - DNA, 20 bp, Artificial Sequence
  chemically synthesized
aggcagtgcagtgtggttaa

SEQ ID NO: 29398 - DNA, 20 bp, Artificial Sequence
  chemically synthesized
cagtgcagtgtggttaagag

SEQ ID NO: 29399 - DNA, 20 bp, Artificial Sequence
  chemically synthesized
gtggttaagagcagtgtctc

SEQ ID NO: 29400 - DNA, 20 bp, Artificial Sequence
  chemically synthesized
tggttaagagcagtgtctct

SEQ ID NO: 29401 - DNA, 20 bp, Artificial Sequence
  chemically synthesized
aagagcagtgtctctgggac

SEQ ID NO: 29402 - DNA, 20 bp, Artificial Sequence
  chemically synthesized
tattacaatcataacttcaa

SEQ ID NO: 29403 - DNA, 20 bp, Artificial Sequence
  chemically synthesized
cttcactctatgattgtgca

SEQ ID NO: 29404 - DNA, 20 bp, Artificial Sequence
  chemically synthesized
gcaaagtatctgattaatct

SEQ ID NO: 29405 - DNA, 20 bp, Artificial Sequence
  chemically synthesized
gtttcttcatctgaaaaatt

SEQ ID NO: 29406 - DNA, 20 bp, Artificial Sequence
  chemically synthesized
agacaattctacctactcca

SEQ ID NO: 29407 - DNA, 20 bp, Artificial Sequence
  chemically synthesized
attctacctactccatagat

SEQ ID NO: 29408 - DNA, 20 bp, Artificial Sequence
  chemically synthesized
tctacctactccatagatta

SEQ ID NO: 29409 - DNA, 20 bp, Artificial Sequence
  chemically synthesized
tacctactccatagattaga

SEQ ID NO: 29410 - DNA, 20 bp, Artificial Sequence
  chemically synthesized
cattcatatgcaattttaaa

SEQ ID NO: 29411 - DNA, 20 bp, Artificial Sequence
  chemically synthesized
ttcatatgcaattttaaatg

SEQ ID NO: 29412 - DNA, 20 bp, Artificial Sequence
  chemically synthesized
atgcaattttaaatggagta

SEQ ID NO: 29413 - DNA, 20 bp, Artificial Sequence
  chemically synthesized
aattttaaatggagtacagt

SEQ ID NO: 29414 - DNA, 20 bp, Artificial Sequence
  chemically synthesized
tttaaatggagtacagttag

SEQ ID NO: 29415 - DNA, 20 bp, Artificial Sequence
  chemically synthesized
agttagaagcaaatactcaa

SEQ ID NO: 29416 - DNA, 20 bp, Artificial Sequence
  chemically synthesized
actcaatagacacattttat

SEQ ID NO: 29417 - DNA, 20 bp, Artificial Sequence
  chemically synthesized
attttattagttgtactttc

SEQ ID NO: 29418 - DNA, 20 bp, Artificial Sequence
  chemically synthesized
agttgtactttccagcattc

SEQ ID NO: 29419 - DNA, 20 bp, Artificial Sequence
  chemically synthesized
gtactttccagcattccagt

SEQ ID NO: 29420 - DNA, 20 bp, Artificial Sequence
  chemically synthesized
cattccagtgagcaatgttg

SEQ ID NO: 29421 - DNA, 20 bp, Artificial Sequence
  chemically synthesized
ccagtgagcaatgttgcagt

SEQ ID NO: 29422 - DNA, 20 bp, Artificial Sequence
  chemically synthesized
gcaatgttgcagtgagctct

SEQ ID NO: 29423 - DNA, 20 bp, Artificial Sequence
  chemically synthesized
gttgcagtgagctctaagaa

SEQ ID NO: 29424 - DNA, 20 bp, Artificial Sequence
  chemically synthesized
aaaataatctgacaacaatg

SEQ ID NO: 29425 - DNA, 20 bp, Artificial Sequence
  chemically synthesized
atctgacaacaatgaagcgt

SEQ ID NO: 29426 - DNA, 20 bp, Artificial Sequence
  chemically synthesized
tctgacaacaatgaagcgta

SEQ ID NO: 29427 - DNA, 20 bp, Artificial Sequence
  chemically synthesized
acaatgaagcgtaaggtatt

SEQ ID NO: 29428 - DNA, 20 bp, Artificial Sequence
  chemically synthesized
aatgaagcgtaaggtatttg

SEQ ID NO: 29429 - DNA, 20 bp, Artificial Sequence
  chemically synthesized
gaagcgtaaggtatttggag

SEQ ID NO: 29430 - DNA, 20 bp, Artificial Sequence
  chemically synthesized
aagcgtaaggtatttggagt

SEQ ID NO: 29431 - DNA, 20 bp, Artificial Sequence
  chemically synthesized
cgtaaggtatttggagtggg

SEQ ID NO: 29432 - DNA, 20 bp, Artificial Sequence
  chemically synthesized
tatttggagtgggaagccat

SEQ ID NO: 29433 - DNA, 20 bp, Artificial Sequence
  chemically synthesized
ggaagccatgagctcttgca

SEQ ID NO: 29434 - DNA, 20 bp, Artificial Sequence
  chemically synthesized
gaagccatgagctcttgcac

SEQ ID NO: 29435 - DNA, 20 bp, Artificial Sequence
  chemically synthesized
tgagctcttgcacaggtttt

SEQ ID NO: 29436 - DNA, 20 bp, Artificial Sequence
  chemically synthesized
ttttggacaatccttccata

SEQ ID NO: 29437 - DNA, 20 bp, Artificial Sequence
  chemically synthesized
acaatccttccatatggctt

SEQ ID NO: 29438 - DNA, 20 bp, Artificial Sequence
  chemically synthesized
ccttccatatggctttggca

SEQ ID NO: 29439 - DNA, 20 bp, Artificial Sequence
  chemically synthesized
tactgaatctttctaaacct

SEQ ID NO: 29440 - DNA, 20 bp, Artificial Sequence
  chemically synthesized
tagcttttttactatgttga

SEQ ID NO: 29441 - DNA, 20 bp, Artificial Sequence
  chemically synthesized
tatgttgaaagatttccaca

SEQ ID NO: 29442 - DNA, 20 bp, Artificial Sequence
  chemically synthesized
atgttgaaagatttccacat

SEQ ID NO: 29443 - DNA, 20 bp, Artificial Sequence
  chemically synthesized
catgggccctgcctcttttc

SEQ ID NO: 29444 - DNA, 20 bp, Artificial Sequence
  chemically synthesized
tgggccctgcctcttttcga

SEQ ID NO: 29445 - DNA, 20 bp, Artificial Sequence
  chemically synthesized
ctcttttcgagagaaatgat

SEQ ID NO: 29446 - DNA, 20 bp, Artificial Sequence
  chemically synthesized
tcttttcgagagaaatgatt

SEQ ID NO: 29447 - DNA, 20 bp, Artificial Sequence
  chemically synthesized
agagaaatgattaggtttaa

SEQ ID NO: 29448 - DNA, 20 bp, Artificial Sequence
  chemically synthesized
gagaaatgattaggtttaat

SEQ ID NO: 29449 - DNA, 20 bp, Artificial Sequence
  chemically synthesized
agaaatgattaggtttaatg

SEQ ID NO: 29450 - DNA, 20 bp, Artificial Sequence
  chemically synthesized
gattaggtttaatggggctg

SEQ ID NO: 29451 - DNA, 20 bp, Artificial Sequence
  chemically synthesized
ttaggtttaatggggctgtg

SEQ ID NO: 29452 - DNA, 20 bp, Artificial Sequence
  chemically synthesized
taggtttaatggggctgtgg

SEQ ID NO: 29453 - DNA, 20 bp, Artificial Sequence
  chemically synthesized
tttaatggggctgtggagga

SEQ ID NO: 29454 - DNA, 20 bp, Artificial Sequence
  chemically synthesized
aggaaagcactctgaaatgt

SEQ ID NO: 29455 - DNA, 20 bp, Artificial Sequence
  chemically synthesized
aaagcactctgaaatgttag

SEQ ID NO: 29456 - DNA, 20 bp, Artificial Sequence
  chemically synthesized
atgttagaagcttcatcaat

SEQ ID NO: 29457 - DNA, 20 bp, Artificial Sequence
  chemically synthesized
gttagaagcttcatcaattg

SEQ ID NO: 29458 - DNA, 20 bp, Artificial Sequence
  chemically synthesized
catcaattggagcaattgct

SEQ ID NO: 29459 - DNA, 20 bp, Artificial Sequence
  chemically synthesized
aaccctgtatcattctctac

SEQ ID NO: 29460 - DNA, 20 bp, Artificial Sequence
  chemically synthesized
accctgtatcattctctaca

SEQ ID NO: 29461 - DNA, 20 bp, Artificial Sequence
  chemically synthesized
gtatcattctctacaaggca

SEQ ID NO: 29462 - DNA, 20 bp, Artificial Sequence
  chemically synthesized
attctctacaaggcatagcc

SEQ ID NO: 29463 - DNA, 20 bp, Artificial Sequence
  chemically synthesized
acaaggcatagcccagtaac

SEQ ID NO: 29464 - DNA, 20 bp, Artificial Sequence
  chemically synthesized
gcatagcccagtaacaagtc

SEQ ID NO: 29465 - DNA, 20 bp, Artificial Sequence
  chemically synthesized
cttccccatcaaaaacatca

SEQ ID NO: 29466 - DNA, 20 bp, Artificial Sequence
  chemically synthesized
ttccccatcaaaaacatcac

SEQ ID NO: 29467 - DNA, 20 bp, Artificial Sequence
  chemically synthesized
ccccatcaaaaacatcacgg

SEQ ID NO: 29468 - DNA, 20 bp, Artificial Sequence
  chemically synthesized
aaacatcacgggagatatga

SEQ ID NO: 29469 - DNA, 20 bp, Artificial Sequence
  chemically synthesized
tcacgggagatatgatagaa

SEQ ID NO: 29470 - DNA, 20 bp, Artificial Sequence
  chemically synthesized
cgggagatatgatagaacag

SEQ ID NO: 29471 - DNA, 20 bp, Artificial Sequence
  chemically synthesized
tagaacagcagccctaacaa

SEQ ID NO: 29472 - DNA, 20 bp, Artificial Sequence
  chemically synthesized
cagcagccctaacaacagat

SEQ ID NO: 29473 - DNA, 20 bp, Artificial Sequence
  chemically synthesized
caacagattggccatcttcc

SEQ ID NO: 29474 - DNA, 20 bp, Artificial Sequence
  chemically synthesized
cagattggccatcttcctgg

SEQ ID NO: 29475 - DNA, 20 bp, Artificial Sequence
  chemically synthesized
ctattccataaccctgcata

SEQ ID NO: 29476 - DNA, 20 bp, Artificial Sequence
  chemically synthesized
aaccctgcatatagtcatgc

SEQ ID NO: 29477 - DNA, 20 bp, Artificial Sequence
  chemically synthesized
tgcatatagtcatgctagat

SEQ ID NO: 29478 - DNA, 20 bp, Artificial Sequence
  chemically synthesized
gcatatagtcatgctagata

SEQ ID NO: 29479 - DNA, 20 bp, Artificial Sequence
  chemically synthesized
catatagtcatgctagataa

SEQ ID NO: 29480 - DNA, 20 bp, Artificial Sequence
  chemically synthesized
tcatgctagataagggatat

SEQ ID NO: 29481 - DNA, 20 bp, Artificial Sequence
  chemically synthesized
atgctagataagggatatta

SEQ ID NO: 29482 - DNA, 20 bp, Artificial Sequence
  chemically synthesized
gctagataagggatattaga

SEQ ID NO: 29483 - DNA, 20 bp, Artificial Sequence
  chemically synthesized
ctagataagggatattagag

SEQ ID NO: 29484 - DNA, 20 bp, Artificial Sequence
  chemically synthesized
cttcctttatccacaaaaca

SEQ ID NO: 29485 - DNA, 20 bp, Artificial Sequence
  chemically synthesized
ttcctttatccacaaaacaa

SEQ ID NO: 29486 - DNA, 20 bp, Artificial Sequence
  chemically synthesized
tccacaaaacaaaggacctt

SEQ ID NO: 29487 - DNA, 20 bp, Artificial Sequence
  chemically synthesized
aaggaccttcagcaacttac

SEQ ID NO: 29488 - DNA, 20 bp, Artificial Sequence
  chemically synthesized
tactggtcctttcttctctg

SEQ ID NO: 29489 - DNA, 20 bp, Artificial Sequence
  chemically synthesized
tctgtagcttctttctcatg

SEQ ID NO: 29490 - DNA, 20 bp, Artificial Sequence
  chemically synthesized
gcagcccttccactccatgc

SEQ ID NO: 29491 - DNA, 20 bp, Artificial Sequence
  chemically synthesized
ccagcatcttccatttgact

SEQ ID NO: 29492 - DNA, 20 bp, Artificial Sequence
  chemically synthesized
cagcatcttccatttgactc

SEQ ID NO: 29493 - DNA, 20 bp, Artificial Sequence
  chemically synthesized
actcaggatgctgttctacg

SEQ ID NO: 29494 - DNA, 20 bp, Artificial Sequence
  chemically synthesized
ctcaggatgctgttctacgt

SEQ ID NO: 29495 - DNA, 20 bp, Artificial Sequence
  chemically synthesized
ctgttctacgtgggctgcac

SEQ ID NO: 29496 - DNA, 20 bp, Artificial Sequence
  chemically synthesized
gggctgcactggcacttata

SEQ ID NO: 29497 - DNA, 20 bp, Artificial Sequence
  chemically synthesized
ataaagctgtctctcttcct

SEQ ID NO: 29498 - DNA, 20 bp, Artificial Sequence
  chemically synthesized
taaagctgtctctcttcctt

SEQ ID NO: 29499 - DNA, 20 bp, Artificial Sequence
  chemically synthesized
gtctctcttccttgggtctt

SEQ ID NO: 29500 - DNA, 20 bp, Artificial Sequence
  chemically synthesized
ccttgggtctttggccctca

SEQ ID NO: 29501 - DNA, 20 bp, Artificial Sequence
  chemically synthesized
cttgggtctttggccctcaa

SEQ ID NO: 29502 - DNA, 20 bp, Artificial Sequence
  chemically synthesized
ggccctcaaaggaatctccc

SEQ ID NO: 29503 - DNA, 20 bp, Artificial Sequence
  chemically synthesized
ctcaaaggaatctccctaga

SEQ ID NO: 29504 - DNA, 20 bp, Artificial Sequence
  chemically synthesized
ggaatctccctagatggacg

SEQ ID NO: 29505 - DNA, 20 bp, Artificial Sequence
  chemically synthesized
cgcagacttgatgaatgtca

SEQ ID NO: 29506 - DNA, 20 bp, Artificial Sequence
  chemically synthesized
cagacttgatgaatgtcaaa

SEQ ID NO: 29507 - DNA, 20 bp, Artificial Sequence
  chemically synthesized
agacttgatgaatgtcaaag

SEQ ID NO: 29508 - DNA, 20 bp, Artificial Sequence
  chemically synthesized
gacttgatgaatgtcaaaga

SEQ ID NO: 29509 - DNA, 20 bp, Artificial Sequence
  chemically synthesized
gatgaatgtcaaagagggat

SEQ ID NO: 29510 - DNA, 20 bp, Artificial Sequence
  chemically synthesized
aagagggattagcatcctcc

SEQ ID NO: 29511 - DNA, 20 bp, Artificial Sequence
  chemically synthesized
attagcatcctcctagacca

SEQ ID NO: 29512 - DNA, 20 bp, Artificial Sequence
  chemically synthesized
cctcctagaccaaagcattt

SEQ ID NO: 29513 - DNA, 20 bp, Artificial Sequence
  chemically synthesized
accaaagcatttgagatgcc

SEQ ID NO: 29514 - DNA, 20 bp, Artificial Sequence
  chemically synthesized
agatgcccagttatcttaaa

SEQ ID NO: 29515 - DNA, 20 bp, Artificial Sequence
  chemically synthesized
agttatcttaaatggaaatt

SEQ ID NO: 29516 - DNA, 20 bp, Artificial Sequence
  chemically synthesized
atggaaatttagtgaaccat

SEQ ID NO: 29517 - DNA, 20 bp, Artificial Sequence
  chemically synthesized
tagtgaaccatgagtacctc

SEQ ID NO: 29518 - DNA, 20 bp, Artificial Sequence
  chemically synthesized
agtgaaccatgagtacctct

SEQ ID NO: 29519 - DNA, 20 bp, Artificial Sequence
  chemically synthesized
tgaaccatgagtacctctag

SEQ ID NO: 29520 - DNA, 20 bp, Artificial Sequence
  chemically synthesized
gaaccatgagtacctctagg

SEQ ID NO: 29521 - DNA, 20 bp, Artificial Sequence
  chemically synthesized
agtacctctaggaggtattt

SEQ ID NO: 29522 - DNA, 20 bp, Artificial Sequence
  chemically synthesized
cctctaggaggtatttcagt

SEQ ID NO: 29523 - DNA, 20 bp, Artificial Sequence
  chemically synthesized
taggaggtatttcagtgagc

SEQ ID NO: 29524 - DNA, 20 bp, Artificial Sequence
  chemically synthesized
ggaggtatttcagtgagcca

SEQ ID NO: 29525 - DNA, 20 bp, Artificial Sequence
  chemically synthesized
gaggtatttcagtgagccag

SEQ ID NO: 29526 - DNA, 20 bp, Artificial Sequence
  chemically synthesized
ccttgactgtcttctctccc

SEQ ID NO: 29527 - DNA, 20 bp, Artificial Sequence
  chemically synthesized
tccccagctgccaacttcat

SEQ ID NO: 29528 - DNA, 20 bp, Artificial Sequence
  chemically synthesized
aacttcataagaaaatttat

SEQ ID NO: 29529 - DNA, 20 bp, Artificial Sequence
  chemically synthesized
acttcataagaaaatttatt

SEQ ID NO: 29530 - DNA, 20 bp, Artificial Sequence
  chemically synthesized
ttgtctttcttttcttttcc

SEQ ID NO: 29531 - DNA, 20 bp, Artificial Sequence
  chemically synthesized
tcttttcttttcccagacaa

SEQ ID NO: 29532 - DNA, 20 bp, Artificial Sequence
  chemically synthesized
tcccagacaaaagtcccctt

SEQ ID NO: 29533 - DNA, 20 bp, Artificial Sequence
  chemically synthesized
agacaaaagtccccttgaga

SEQ ID NO: 29534 - DNA, 20 bp, Artificial Sequence
  chemically synthesized
cttgagacagtctttacaac

SEQ ID NO: 29535 - DNA, 20 bp, Artificial Sequence
  chemically synthesized
ttgagacagtctttacaacc

SEQ ID NO: 29536 - DNA, 20 bp, Artificial Sequence
  chemically synthesized
agacagtctttacaaccagg

SEQ ID NO: 29537 - DNA, 20 bp, Artificial Sequence
  chemically synthesized
gttattcactgtcattcact

SEQ ID NO: 29538 - DNA, 20 bp, Artificial Sequence
  chemically synthesized
ttcactgtcattcactgagc

SEQ ID NO: 29539 - DNA, 20 bp, Artificial Sequence
  chemically synthesized
attcactgagcaagtatgta

SEQ ID NO: 29540 - DNA, 20 bp, Artificial Sequence
  chemically synthesized
agcaagtatgtaaagatcac

SEQ ID NO: 29541 - DNA, 20 bp, Artificial Sequence
  chemically synthesized
tatgtaaagatcacaagctt

SEQ ID NO: 29542 - DNA, 20 bp, Artificial Sequence
  chemically synthesized
atgtaaagatcacaagcttt

SEQ ID NO: 29543 - DNA, 20 bp, Artificial Sequence
  chemically synthesized
aaagatcacaagctttgggt

SEQ ID NO: 29544 - DNA, 20 bp, Artificial Sequence
  chemically synthesized
tgggtcagatatttgaatgc

SEQ ID NO: 29545 - DNA, 20 bp, Artificial Sequence
  chemically synthesized
atttgaatgcaagcattaat

SEQ ID NO: 29546 - DNA, 20 bp, Artificial Sequence
  chemically synthesized
aagacacaaactctgtcttt

SEQ ID NO: 29547 - DNA, 20 bp, Artificial Sequence
  chemically synthesized
cacaaactctgtctttcaga

SEQ ID NO: 29548 - DNA, 20 bp, Artificial Sequence
  chemically synthesized
tcagaaagcattgtcttctg

SEQ ID NO: 29549 - DNA, 20 bp, Artificial Sequence
  chemically synthesized
cagaaagcattgtcttctgc

SEQ ID NO: 29550 - DNA, 20 bp, Artificial Sequence
  chemically synthesized
gaaagcattgtcttctgcag

SEQ ID NO: 29551 - DNA, 20 bp, Artificial Sequence
  chemically synthesized
aaagcattgtcttctgcagg

SEQ ID NO: 29552 - DNA, 20 bp, Artificial Sequence
  chemically synthesized
aaaactaacgtcccctgatg

SEQ ID NO: 29553 - DNA, 20 bp, Artificial Sequence
  chemically synthesized
gtcccctgatgaagcaaaaa

SEQ ID NO: 29554 - DNA, 20 bp, Artificial Sequence
  chemically synthesized
tcccctgatgaagcaaaaac

SEQ ID NO: 29555 - DNA, 20 bp, Artificial Sequence
  chemically synthesized
tgaagcaaaaacaggcttcc

SEQ ID NO: 29556 - DNA, 20 bp, Artificial Sequence
  chemically synthesized
gaagcaaaaacaggcttccc

SEQ ID NO: 29557 - DNA, 20 bp, Artificial Sequence
  chemically synthesized
tcccaggtgatacaaatatt

SEQ ID NO: 29558 - DNA, 20 bp, Artificial Sequence
  chemically synthesized
aggtgatacaaatatttagc

SEQ ID NO: 29559 - DNA, 20 bp, Artificial Sequence
  chemically synthesized
gtctgcactatcattcaaaa

SEQ ID NO: 29560 - DNA, 20 bp, Artificial Sequence
  chemically synthesized
tctgcactatcattcaaaat

SEQ ID NO: 29561 - DNA, 20 bp, Artificial Sequence
  chemically synthesized
attcaaaataggtaacattt

SEQ ID NO: 29562 - DNA, 20 bp, Artificial Sequence
  chemically synthesized
aaaataggtaacattttaga

SEQ ID NO: 29563 - DNA, 20 bp, Artificial Sequence
  chemically synthesized
aataggtaacattttagata

SEQ ID NO: 29564 - DNA, 20 bp, Artificial Sequence
  chemically synthesized
ataggtaacattttagatag

SEQ ID NO: 29565 - DNA, 20 bp, Artificial Sequence
  chemically synthesized
taggtaacattttagataga

SEQ ID NO: 29566 - DNA, 20 bp, Artificial Sequence
  chemically synthesized
aggtaacattttagatagag

SEQ ID NO: 29567 - DNA, 20 bp, Artificial Sequence
  chemically synthesized
tagaggggaaaacatgtaca

SEQ ID NO: 29568 - DNA, 20 bp, Artificial Sequence
  chemically synthesized
agaggggaaaacatgtacaa

SEQ ID NO: 29569 - DNA, 20 bp, Artificial Sequence
  chemically synthesized
ggaaaacatgtacaaaggct

SEQ ID NO: 29570 - DNA, 20 bp, Artificial Sequence
  chemically synthesized
aaaacatgtacaaaggctca

SEQ ID NO: 29571 - DNA, 20 bp, Artificial Sequence
  chemically synthesized
aaaggctcagagttgtcaca

SEQ ID NO: 29572 - DNA, 20 bp, Artificial Sequence
  chemically synthesized
tctgtgaacttcaattacat

SEQ ID NO: 29573 - DNA, 20 bp, Artificial Sequence
  chemically synthesized
ccatctgtgttttacaaata

SEQ ID NO: 29574 - DNA, 20 bp, Artificial Sequence
  chemically synthesized
caaatacagtatcaatttca

SEQ ID NO: 29575 - DNA, 20 bp, Artificial Sequence
  chemically synthesized
aaatacagtatcaatttcaa

SEQ ID NO: 29576 - DNA, 20 bp, Artificial Sequence
  chemically synthesized
cagtatcaatttcaaaggct

SEQ ID NO: 29577 - DNA, 20 bp, Artificial Sequence
  chemically synthesized
gtatcaatttcaaaggctta

SEQ ID NO: 29578 - DNA, 20 bp, Artificial Sequence
  chemically synthesized
atcaatttcaaaggcttaga

SEQ ID NO: 29579 - DNA, 20 bp, Artificial Sequence
  chemically synthesized
tcaatttcaaaggcttagag

SEQ ID NO: 29580 - DNA, 20 bp, Artificial Sequence
  chemically synthesized
caaaggcttagagaggcttg

SEQ ID NO: 29581 - DNA, 20 bp, Artificial Sequence
  chemically synthesized
ggcttgtggatattaaataa

SEQ ID NO: 29582 - DNA, 20 bp, Artificial Sequence
  chemically synthesized
gcttgtggatattaaataac

SEQ ID NO: 29583 - DNA, 20 bp, Artificial Sequence
  chemically synthesized
gtggatattaaataacggga

SEQ ID NO: 29584 - DNA, 20 bp, Artificial Sequence
  chemically synthesized
taaataacgggatagttgta

SEQ ID NO: 29585 - DNA, 20 bp, Artificial Sequence
  chemically synthesized
gttgtaaagatttttgcctg

SEQ ID NO: 29586 - DNA, 20 bp, Artificial Sequence
  chemically synthesized
ttgtaaagatttttgcctgc

SEQ ID NO: 29587 - DNA, 20 bp, Artificial Sequence
  chemically synthesized
gatttttgcctgcaggaata

SEQ ID NO: 29588 - DNA, 20 bp, Artificial Sequence
  chemically synthesized
atttttgcctgcaggaatat

SEQ ID NO: 29589 - DNA, 20 bp, Artificial Sequence
  chemically synthesized
caggaatataggcttgtgct

SEQ ID NO: 29590 - DNA, 20 bp, Artificial Sequence
  chemically synthesized
aggaatataggcttgtgctg

SEQ ID NO: 29591 - DNA, 20 bp, Artificial Sequence
  chemically synthesized
tataggcttgtgctgaggaa

SEQ ID NO: 29592 - DNA, 20 bp, Artificial Sequence
  chemically synthesized
ataggcttgtgctgaggaat

SEQ ID NO: 29593 - DNA, 20 bp, Artificial Sequence
  chemically synthesized
gcttgtgctgaggaatgggc

SEQ ID NO: 29594 - DNA, 20 bp, Artificial Sequence
  chemically synthesized
ggaatgggccagatgattta

SEQ ID NO: 29595 - DNA, 20 bp, Artificial Sequence
  chemically synthesized
atgggccagatgatttaaag

SEQ ID NO: 29596 - DNA, 20 bp, Artificial Sequence
  chemically synthesized
tttaaagcagatactgtcat

SEQ ID NO: 29597 - DNA, 20 bp, Artificial Sequence
  chemically synthesized
aaagcagatactgtcattag

SEQ ID NO: 29598 - DNA, 20 bp, Artificial Sequence
  chemically synthesized
aagcagatactgtcattagc

SEQ ID NO: 29599 - DNA, 20 bp, Artificial Sequence
  chemically synthesized
gtcattagcaggaatatgta

SEQ ID NO: 29600 - DNA, 20 bp, Artificial Sequence
  chemically synthesized
agcaggaatatgtacagctt

SEQ ID NO: 29601 - DNA, 20 bp, Artificial Sequence
  chemically synthesized
ggctgattttatgttttttt

SEQ ID NO: 29602 - DNA, 20 bp, Artificial Sequence
  chemically synthesized
gtttgttgttgttgttgaat

SEQ ID NO: 29603 - DNA, 20 bp, Artificial Sequence
  chemically synthesized
tgttgttgttgttgaatcag

SEQ ID NO: 29604 - DNA, 20 bp, Artificial Sequence
  chemically synthesized
ttgttgttgttgaatcagtg

SEQ ID NO: 29605 - DNA, 20 bp, Artificial Sequence
  chemically synthesized
gttgttgaatcagtggagca

SEQ ID NO: 29606 - DNA, 20 bp, Artificial Sequence
  chemically synthesized
tggagcatagttaaaactac

SEQ ID NO: 29607 - DNA, 20 bp, Artificial Sequence
  chemically synthesized
agttaaaactacaagcacca

SEQ ID NO: 29608 - DNA, 20 bp, Artificial Sequence
  chemically synthesized
aaaactacaagcaccacagt

SEQ ID NO: 29609 - DNA, 20 bp, Artificial Sequence
  chemically synthesized
acagtcagaactgtcaaact

SEQ ID NO: 29610 - DNA, 20 bp, Artificial Sequence
  chemically synthesized
tgtcaaacttggtataatat

SEQ ID NO: 29611 - DNA, 20 bp, Artificial Sequence
  chemically synthesized
gtcaaacttggtataatatt

SEQ ID NO: 29612 - DNA, 20 bp, Artificial Sequence
  chemically synthesized
aacttggtataatattgggc

SEQ ID NO: 29613 - DNA, 20 bp, Artificial Sequence
  chemically synthesized
gggcaagatattttgtctct

SEQ ID NO: 29614 - DNA, 20 bp, Artificial Sequence
  chemically synthesized
gatattttgtctctgagcct

SEQ ID NO: 29615 - DNA, 20 bp, Artificial Sequence
  chemically synthesized
cagtgtacttatctgtaaaa

SEQ ID NO: 29616 - DNA, 20 bp, Artificial Sequence
  chemically synthesized
agtgtacttatctgtaaaat

SEQ ID NO: 29617 - DNA, 20 bp, Artificial Sequence
  chemically synthesized
tatctgtaaaatgggtaatc

SEQ ID NO: 29618 - DNA, 20 bp, Artificial Sequence
  chemically synthesized
ctgtaaaatgggtaatctag

SEQ ID NO: 29619 - DNA, 20 bp, Artificial Sequence
  chemically synthesized
tctagtagtatccatctcat

SEQ ID NO: 29620 - DNA, 20 bp, Artificial Sequence
  chemically synthesized
ctagtagtatccatctcata

SEQ ID NO: 29621 - DNA, 20 bp, Artificial Sequence
  chemically synthesized
catctcataaggttattgtc

SEQ ID NO: 29622 - DNA, 20 bp, Artificial Sequence
  chemically synthesized
ataaggttattgtcaagata

SEQ ID NO: 29623 - DNA, 20 bp, Artificial Sequence
  chemically synthesized
tgtcaagataaagtgactta

SEQ ID NO: 29624 - DNA, 20 bp, Artificial Sequence
  chemically synthesized
cttatagtgtattatgccct

SEQ ID NO: 29625 - DNA, 20 bp, Artificial Sequence
  chemically synthesized
tatgcccttagaataatacc

SEQ ID NO: 29626 - DNA, 20 bp, Artificial Sequence
  chemically synthesized
atgcccttagaataatacct

SEQ ID NO: 29627 - DNA, 20 bp, Artificial Sequence
  chemically synthesized
aaaaaccatgatatgcaaaa

SEQ ID NO: 29628 - DNA, 20 bp, Artificial Sequence
  chemically synthesized
aaccatgatatgcaaaatag

SEQ ID NO: 29629 - DNA, 20 bp, Artificial Sequence
  chemically synthesized
accatgatatgcaaaataga

SEQ ID NO: 29630 - DNA, 20 bp, Artificial Sequence
  chemically synthesized
tatgcaaaatagaaggtact

SEQ ID NO: 29631 - DNA, 20 bp, Artificial Sequence
  chemically synthesized
ggtactcagtaccttctact

SEQ ID NO: 29632 - DNA, 20 bp, Artificial Sequence
  chemically synthesized
aatctataactcttaaaatc

SEQ ID NO: 29633 - DNA, 20 bp, Artificial Sequence
  chemically synthesized
ttaaaatcaagtctattaaa

SEQ ID NO: 29634 - DNA, 20 bp, Artificial Sequence
  chemically synthesized
tatcttttcctgatactaaa

SEQ ID NO: 29635 - DNA, 20 bp, Artificial Sequence
  chemically synthesized
cctgatactaaatggaaaaa

SEQ ID NO: 29636 - DNA, 20 bp, Artificial Sequence
  chemically synthesized
gaaaaatagataacatattc

SEQ ID NO: 29637 - DNA, 20 bp, Artificial Sequence
  chemically synthesized
aaaaatagataacatattct

SEQ ID NO: 29638 - DNA, 20 bp, Artificial Sequence
  chemically synthesized
atagataacatattctagga

SEQ ID NO: 29639 - DNA, 20 bp, Artificial Sequence
  chemically synthesized
tagataacatattctaggaa

SEQ ID NO: 29640 - DNA, 20 bp, Artificial Sequence
  chemically synthesized
agataacatattctaggaaa

SEQ ID NO: 29641 - DNA, 20 bp, Artificial Sequence
  chemically synthesized
attctaggaaagggaacaaa

SEQ ID NO: 29642 - DNA, 20 bp, Artificial Sequence
  chemically synthesized
taggaaagggaacaaaaagt

SEQ ID NO: 29643 - DNA, 20 bp, Artificial Sequence
  chemically synthesized
aggaaagggaacaaaaagtt

SEQ ID NO: 29644 - DNA, 20 bp, Artificial Sequence
  chemically synthesized
ggaaagggaacaaaaagtta

SEQ ID NO: 29645 - DNA, 20 bp, Artificial Sequence
  chemically synthesized
aaagggaacaaaaagttagg

SEQ ID NO: 29646 - DNA, 20 bp, Artificial Sequence
  chemically synthesized
gggaacaaaaagttagggag

SEQ ID NO: 29647 - DNA, 20 bp, Artificial Sequence
  chemically synthesized
agttagggagaagccaatga

SEQ ID NO: 29648 - DNA, 20 bp, Artificial Sequence
  chemically synthesized
gttagggagaagccaatgat

SEQ ID NO: 29649 - DNA, 20 bp, Artificial Sequence
  chemically synthesized
gccaatgatgggacttcctt

SEQ ID NO: 29650 - DNA, 20 bp, Artificial Sequence
  chemically synthesized
ggacttccttcagtataaca

SEQ ID NO: 29651 - DNA, 20 bp, Artificial Sequence
  chemically synthesized
tcagtataacatggaaaaca

SEQ ID NO: 29652 - DNA, 20 bp, Artificial Sequence
  chemically synthesized
ggaaaacatggccctgaaac

SEQ ID NO: 29653 - DNA, 20 bp, Artificial Sequence
  chemically synthesized
aaacatggccctgaaacgag

SEQ ID NO: 29654 - DNA, 20 bp, Artificial Sequence
  chemically synthesized
ctgaaacgagtggtcctgtt

SEQ ID NO: 29655 - DNA, 20 bp, Artificial Sequence
  chemically synthesized
gaaacgagtggtcctgtttg

SEQ ID NO: 29656 - DNA, 20 bp, Artificial Sequence
  chemically synthesized
aacgagtggtcctgtttgga

SEQ ID NO: 29657 - DNA, 20 bp, Artificial Sequence
  chemically synthesized
acgagtggtcctgtttggag

SEQ ID NO: 29658 - DNA, 20 bp, Artificial Sequence
  chemically synthesized
gagtggtcctgtttggagag

SEQ ID NO: 29659 - DNA, 20 bp, Artificial Sequence
  chemically synthesized
gtcctgtttggagaggagtc

SEQ ID NO: 29660 - DNA, 20 bp, Artificial Sequence
  chemically synthesized
tggagaggagtccagcataa

SEQ ID NO: 29661 - DNA, 20 bp, Artificial Sequence
  chemically synthesized
ggagtccagcataatggttt

SEQ ID NO: 29662 - DNA, 20 bp, Artificial Sequence
  chemically synthesized
gcataatggtttaagaaaat

SEQ ID NO: 29663 - DNA, 20 bp, Artificial Sequence
  chemically synthesized
atgcgcttgatattgaattt

SEQ ID NO: 29664 - DNA, 20 bp, Artificial Sequence
  chemically synthesized
cttacattaatgatttaact

SEQ ID NO: 29665 - DNA, 20 bp, Artificial Sequence
  chemically synthesized
ttacattaatgatttaacta

SEQ ID NO: 29666 - DNA, 20 bp, Artificial Sequence
  chemically synthesized
attaatgatttaactaagga

SEQ ID NO: 29667 - DNA, 20 bp, Artificial Sequence
  chemically synthesized
ggaaagttgctttcctctgt

SEQ ID NO: 29668 - DNA, 20 bp, Artificial Sequence
  chemically synthesized
ttgctttcctctgtgagcct

SEQ ID NO: 29669 - DNA, 20 bp, Artificial Sequence
  chemically synthesized
aataatacctccctacttca

SEQ ID NO: 29670 - DNA, 20 bp, Artificial Sequence
  chemically synthesized
ataatacctccctacttcac

SEQ ID NO: 29671 - DNA, 20 bp, Artificial Sequence
  chemically synthesized
acctccctacttcacaggtt

SEQ ID NO: 29672 - DNA, 20 bp, Artificial Sequence
  chemically synthesized
ccctacttcacaggtttggt

SEQ ID NO: 29673 - DNA, 20 bp, Artificial Sequence
  chemically synthesized
tgtaaaataatgaaaataaa

SEQ ID NO: 29674 - DNA, 20 bp, Artificial Sequence
  chemically synthesized
taatgaaaataaaaagtact

SEQ ID NO: 29675 - DNA, 20 bp, Artificial Sequence
  chemically synthesized
tactcagccctctctaccgt

SEQ ID NO: 29676 - DNA, 20 bp, Artificial Sequence
  chemically synthesized
gttaaatgcttaataaacat

SEQ ID NO: 29677 - DNA, 20 bp, Artificial Sequence
  chemically synthesized
atcatcttcattgtcatctt

SEQ ID NO: 29678 - DNA, 20 bp, Artificial Sequence
  chemically synthesized
taatcgtatataacttttta

SEQ ID NO: 29679 - DNA, 20 bp, Artificial Sequence
  chemically synthesized
tcattgtaaaatgctctttt

SEQ ID NO: 29680 - DNA, 20 bp, Artificial Sequence
  chemically synthesized
taaaaccgaaatgtcttctt

SEQ ID NO: 29681 - DNA, 20 bp, Artificial Sequence
  chemically synthesized
ttcttcagaaaatttgtata

SEQ ID NO: 29682 - DNA, 20 bp, Artificial Sequence
  chemically synthesized
cagaaaatttgtatacggca

SEQ ID NO: 29683 - DNA, 20 bp, Artificial Sequence
  chemically synthesized
aaatttgtatacggcaaaga

SEQ ID NO: 29684 - DNA, 20 bp, Artificial Sequence
  chemically synthesized
atttgtatacggcaaagata

SEQ ID NO: 29685 - DNA, 20 bp, Artificial Sequence
  chemically synthesized
caaagatagagaaatctata

SEQ ID NO: 29686 - DNA, 20 bp, Artificial Sequence
  chemically synthesized
gagaaatctatatagaaaat

SEQ ID NO: 29687 - DNA, 20 bp, Artificial Sequence
  chemically synthesized
gaaaataagattatatataa

SEQ ID NO: 29688 - DNA, 20 bp, Artificial Sequence
  chemically synthesized
tcttttgatacaaatattta

SEQ ID NO: 29689 - DNA, 20 bp, Artificial Sequence
  chemically synthesized
aatatttatagccttttaca

SEQ ID NO: 29690 - DNA, 20 bp, Artificial Sequence
  chemically synthesized
tttatttaatattttgccaa

SEQ ID NO: 29691 - DNA, 20 bp, Artificial Sequence
  chemically synthesized
tattttgccaacagtttcct

SEQ ID NO: 29692 - DNA, 20 bp, Artificial Sequence
  chemically synthesized
tttaaatgtcattttaataa

SEQ ID NO: 29693 - DNA, 20 bp, Artificial Sequence
  chemically synthesized
tttatgtaatatttttattc

SEQ ID NO: 29694 - DNA, 20 bp, Artificial Sequence
  chemically synthesized
tataatattcacttattaaa

SEQ ID NO: 29695 - DNA, 20 bp, Artificial Sequence
  chemically synthesized
atatttattgatcactgacc

SEQ ID NO: 29696 - DNA, 20 bp, Artificial Sequence
  chemically synthesized
tatttattgatcactgacct

SEQ ID NO: 29697 - DNA, 20 bp, Artificial Sequence
  chemically synthesized
tttattgatcactgacctag

SEQ ID NO: 29698 - DNA, 20 bp, Artificial Sequence
  chemically synthesized
ttgatcactgacctaggaga

SEQ ID NO: 29699 - DNA, 20 bp, Artificial Sequence
  chemically synthesized
actgacctaggagatggatt

SEQ ID NO: 29700 - DNA, 20 bp, Artificial Sequence
  chemically synthesized
ggagatggatttagaactgt

SEQ ID NO: 29701 - DNA, 20 bp, Artificial Sequence
  chemically synthesized
gatttagaactgtgagcaaa

SEQ ID NO: 29702 - DNA, 20 bp, Artificial Sequence
  chemically synthesized
atttagaactgtgagcaaac

SEQ ID NO: 29703 - DNA, 20 bp, Artificial Sequence
  chemically synthesized
gaaaaaaattttgccacaaa

SEQ ID NO: 29704 - DNA, 20 bp, Artificial Sequence
  chemically synthesized
tttttaatttatcatttatt

SEQ ID NO: 29705 - DNA, 20 bp, Artificial Sequence
  chemically synthesized
ttttaatttatcatttattt

SEQ ID NO: 29706 - DNA, 20 bp, Artificial Sequence
  chemically synthesized
aatttatcatttatttagga

SEQ ID NO: 29707 - DNA, 20 bp, Artificial Sequence
  chemically synthesized
atttatttaggacagatttt

SEQ ID NO: 29708 - DNA, 20 bp, Artificial Sequence
  chemically synthesized
tatttaggacagatttttag

SEQ ID NO: 29709 - DNA, 20 bp, Artificial Sequence
  chemically synthesized
ttaggacagatttttagaag

SEQ ID NO: 29710 - DNA, 20 bp, Artificial Sequence
  chemically synthesized
tttttagaagtggcatttct

SEQ ID NO: 29711 - DNA, 20 bp, Artificial Sequence
  chemically synthesized
gaagtggcatttctgagaca

SEQ ID NO: 29712 - DNA, 20 bp, Artificial Sequence
  chemically synthesized
agtggcatttctgagacaca

SEQ ID NO: 29713 - DNA, 20 bp, Artificial Sequence
  chemically synthesized
cacagagcatgaatattttc

SEQ ID NO: 29714 - DNA, 20 bp, Artificial Sequence
  chemically synthesized
atgtattttgttttttataa

SEQ ID NO: 29715 - DNA, 20 bp, Artificial Sequence
  chemically synthesized
tgtattttgttttttataaa

SEQ ID NO: 29716 - DNA, 20 bp, Artificial Sequence
  chemically synthesized
attaaattatgttttcattc

SEQ ID NO: 29717 - DNA, 20 bp, Artificial Sequence
  chemically synthesized
ctcttttaccacatacttaa

SEQ ID NO: 29718 - DNA, 20 bp, Artificial Sequence
  chemically synthesized
ttaccacatacttaacagca

SEQ ID NO: 29719 - DNA, 20 bp, Artificial Sequence
  chemically synthesized
ttttctttttttttgttttt

SEQ ID NO: 29720 - DNA, 20 bp, Artificial Sequence
  chemically synthesized
tctttttttttgtttttgag

SEQ ID NO: 29721 - DNA, 20 bp, Artificial Sequence
  chemically synthesized
ctttttttttgtttttgaga

SEQ ID NO: 29722 - DNA, 20 bp, Artificial Sequence
  chemically synthesized
ttttttttgtttttgagaag

SEQ ID NO: 29723 - DNA, 20 bp, Artificial Sequence
  chemically synthesized
aggagtcttgctctgttgcc

SEQ ID NO: 29724 - DNA, 20 bp, Artificial Sequence
  chemically synthesized
ggagtcttgctctgttgccc

SEQ ID NO: 29725 - DNA, 20 bp, Artificial Sequence
  chemically synthesized
tcttgctctgttgcccaggc

SEQ ID NO: 29726 - DNA, 20 bp, Artificial Sequence
  chemically synthesized
ttgctctgttgcccaggctg

SEQ ID NO: 29727 - DNA, 20 bp, Artificial Sequence
  chemically synthesized
ctgttgcccaggctggagtg

SEQ ID NO: 29728 - DNA, 20 bp, Artificial Sequence
  chemically synthesized
ttgcccaggctggagtgcag

SEQ ID NO: 29729 - DNA, 20 bp, Artificial Sequence
  chemically synthesized
ggagtgcagtggcacgatct

SEQ ID NO: 29730 - DNA, 20 bp, Artificial Sequence
  chemically synthesized
gcacgatctcggctcactgc

SEQ ID NO: 29731 - DNA, 20 bp, Artificial Sequence
  chemically synthesized
tcactgcaagctccacctcc

SEQ ID NO: 29732 - DNA, 20 bp, Artificial Sequence
  chemically synthesized
cactgcaagctccacctcct

SEQ ID NO: 29733 - DNA, 20 bp, Artificial Sequence
  chemically synthesized
ttcacgccattctgctgccc

SEQ ID NO: 29734 - DNA, 20 bp, Artificial Sequence
  chemically synthesized
ttctgctgccccagcctcct

SEQ ID NO: 29735 - DNA, 20 bp, Artificial Sequence
  chemically synthesized
tgctgccccagcctcctgag

SEQ ID NO: 29736 - DNA, 20 bp, Artificial Sequence
  chemically synthesized
gccccagcctcctgagtagc

SEQ ID NO: 29737 - DNA, 20 bp, Artificial Sequence
  chemically synthesized
ccccagcctcctgagtagct

SEQ ID NO: 29738 - DNA, 20 bp, Artificial Sequence
  chemically synthesized
ctcctgagtagctgggacta

SEQ ID NO: 29739 - DNA, 20 bp, Artificial Sequence
  chemically synthesized
tcctgagtagctgggactac

SEQ ID NO: 29740 - DNA, 20 bp, Artificial Sequence
  chemically synthesized
caggtgcccaccaccatgcc

SEQ ID NO: 29741 - DNA, 20 bp, Artificial Sequence
  chemically synthesized
cggctaactttttgtatttt

SEQ ID NO: 29742 - DNA, 20 bp, Artificial Sequence
  chemically synthesized
ctaactttttgtatttttag

SEQ ID NO: 29743 - DNA, 20 bp, Artificial Sequence
  chemically synthesized
aactttttgtatttttagta

SEQ ID NO: 29744 - DNA, 20 bp, Artificial Sequence
  chemically synthesized
tttgtatttttagtagagac

SEQ ID NO: 29745 - DNA, 20 bp, Artificial Sequence
  chemically synthesized
ttgtatttttagtagagact

SEQ ID NO: 29746 - DNA, 20 bp, Artificial Sequence
  chemically synthesized
gagactgggttccaccgtgt

SEQ ID NO: 29747 - DNA, 20 bp, Artificial Sequence
  chemically synthesized
ctgggttccaccgtgttagc

SEQ ID NO: 29748 - DNA, 20 bp, Artificial Sequence
  chemically synthesized
tgggttccaccgtgttagcc

SEQ ID NO: 29749 - DNA, 20 bp, Artificial Sequence
  chemically synthesized
ttccaccgtgttagccagga

SEQ ID NO: 29750 - DNA, 20 bp, Artificial Sequence
  chemically synthesized
acctcgtgatccacccgcct

SEQ ID NO: 29751 - DNA, 20 bp, Artificial Sequence
  chemically synthesized
atccacccgcctcggcctcc

SEQ ID NO: 29752 - DNA, 20 bp, Artificial Sequence
  chemically synthesized
ccacccgcctcggcctccca

SEQ ID NO: 29753 - DNA, 20 bp, Artificial Sequence
  chemically synthesized
gcctcggcctcccagagtgc

SEQ ID NO: 29754 - DNA, 20 bp, Artificial Sequence
  chemically synthesized
cctcggcctcccagagtgct

SEQ ID NO: 29755 - DNA, 20 bp, Artificial Sequence
  chemically synthesized
ctcccagagtgctgggatta

SEQ ID NO: 29756 - DNA, 20 bp, Artificial Sequence
  chemically synthesized
tcccagagtgctgggattac

SEQ ID NO: 29757 - DNA, 20 bp, Artificial Sequence
  chemically synthesized
agtgctgggattacaggcgt

SEQ ID NO: 29758 - DNA, 20 bp, Artificial Sequence
  chemically synthesized
caggcgtgagccaccgcgcc

SEQ ID NO: 29759 - DNA, 20 bp, Artificial Sequence
  chemically synthesized
cgtgagccaccgcgcccagc

SEQ ID NO: 29760 - DNA, 20 bp, Artificial Sequence
  chemically synthesized
tctattcttcaatattcgtt

SEQ ID NO: 29761 - DNA, 20 bp, Artificial Sequence
  chemically synthesized
tattcgtttagtaacaaatt

SEQ ID NO: 29762 - DNA, 20 bp, Artificial Sequence
  chemically synthesized
ttaatttgcattttaaattt

SEQ ID NO: 29763 - DNA, 20 bp, Artificial Sequence
  chemically synthesized
tttgcattttaaatttgagt

SEQ ID NO: 29764 - DNA, 20 bp, Artificial Sequence
  chemically synthesized
ttgcattttaaatttgagta

SEQ ID NO: 29765 - DNA, 20 bp, Artificial Sequence
  chemically synthesized
cattttaaatttgagtaagg

SEQ ID NO: 29766 - DNA, 20 bp, Artificial Sequence
  chemically synthesized
tttaaatttgagtaaggtag

SEQ ID NO: 29767 - DNA, 20 bp, Artificial Sequence
  chemically synthesized
cctaatttgaaaatgaaatt

SEQ ID NO: 29768 - DNA, 20 bp, Artificial Sequence
  chemically synthesized
tgaaaatgaaatttagatgt

SEQ ID NO: 29769 - DNA, 20 bp, Artificial Sequence
  chemically synthesized
aaatgaaatttagatgtcag

SEQ ID NO: 29770 - DNA, 20 bp, Artificial Sequence
  chemically synthesized
tcagtggtctatttgttaat

SEQ ID NO: 29771 - DNA, 20 bp, Artificial Sequence
  chemically synthesized
agtggtctatttgttaataa

SEQ ID NO: 29772 - DNA, 20 bp, Artificial Sequence
  chemically synthesized
gtggtctatttgttaataag

SEQ ID NO: 29773 - DNA, 20 bp, Artificial Sequence
  chemically synthesized
tttgttaataagaggcaaaa

SEQ ID NO: 29774 - DNA, 20 bp, Artificial Sequence
  chemically synthesized
ttgttaataagaggcaaaat

SEQ ID NO: 29775 - DNA, 20 bp, Artificial Sequence
  chemically synthesized
taagaggcaaaatgggactt

SEQ ID NO: 29776 - DNA, 20 bp, Artificial Sequence
  chemically synthesized
tgtaccccattctaccaaat

SEQ ID NO: 29777 - DNA, 20 bp, Artificial Sequence
  chemically synthesized
attctaccaaatgagatcta

SEQ ID NO: 29778 - DNA, 20 bp, Artificial Sequence
  chemically synthesized
accaaatgagatctatagaa

SEQ ID NO: 29779 - DNA, 20 bp, Artificial Sequence
  chemically synthesized
ccaaatgagatctatagaat

SEQ ID NO: 29780 - DNA, 20 bp, Artificial Sequence
  chemically synthesized
ataggaatttcctctcaaca

SEQ ID NO: 29781 - DNA, 20 bp, Artificial Sequence
  chemically synthesized
aggaatttcctctcaacatg

SEQ ID NO: 29782 - DNA, 20 bp, Artificial Sequence
  chemically synthesized
aatttcctctcaacatggag

SEQ ID NO: 29783 - DNA, 20 bp, Artificial Sequence
  chemically synthesized
aacatggagaagaatattct

SEQ ID NO: 29784 - DNA, 20 bp, Artificial Sequence
  chemically synthesized
gagaagaatattctaagtct

SEQ ID NO: 29785 - DNA, 20 bp, Artificial Sequence
  chemically synthesized
taagtctcggaactgctatt

SEQ ID NO: 29786 - DNA, 20 bp, Artificial Sequence
  chemically synthesized
ggaactgctattgagtaatg

SEQ ID NO: 29787 - DNA, 20 bp, Artificial Sequence
  chemically synthesized
gagtaatgtggcctactatg

SEQ ID NO: 29788 - DNA, 20 bp, Artificial Sequence
  chemically synthesized
tactatgtggatgtaaatta

SEQ ID NO: 29789 - DNA, 20 bp, Artificial Sequence
  chemically synthesized
tgtggatgtaaattaaagtt

SEQ ID NO: 29790 - DNA, 20 bp, Artificial Sequence
  chemically synthesized
atgtaaattaaagtttagaa

SEQ ID NO: 29791 - DNA, 20 bp, Artificial Sequence
  chemically synthesized
ttagaatggaacctatgttt

SEQ ID NO: 29792 - DNA, 20 bp, Artificial Sequence
  chemically synthesized
tagaatggaacctatgttta

SEQ ID NO: 29793 - DNA, 20 bp, Artificial Sequence
  chemically synthesized
gaatggaacctatgtttaag

SEQ ID NO: 29794 - DNA, 20 bp, Artificial Sequence
  chemically synthesized
aacctatgtttaaggagtgc

SEQ ID NO: 29795 - DNA, 20 bp, Artificial Sequence
  chemically synthesized
tttaaggagtgccagcctgt

SEQ ID NO: 29796 - DNA, 20 bp, Artificial Sequence
  chemically synthesized
ttaaggagtgccagcctgta

SEQ ID NO: 29797 - DNA, 20 bp, Artificial Sequence
  chemically synthesized
agtgccagcctgtaaggctg

SEQ ID NO: 29798 - DNA, 20 bp, Artificial Sequence
  chemically synthesized
tgtaaggctgcagaaactgc

SEQ ID NO: 29799 - DNA, 20 bp, Artificial Sequence
  chemically synthesized
gtaaggctgcagaaactgct

SEQ ID NO: 29800 - DNA, 20 bp, Artificial Sequence
  chemically synthesized
ctgcagaaactgctgggttc

SEQ ID NO: 29801 - DNA, 20 bp, Artificial Sequence
  chemically synthesized
gcagaaactgctgggttcca

SEQ ID NO: 29802 - DNA, 20 bp, Artificial Sequence
  chemically synthesized
cagaaactgctgggttccag

SEQ ID NO: 29803 - DNA, 20 bp, Artificial Sequence
  chemically synthesized
agaaactgctgggttccaga

SEQ ID NO: 29804 - DNA, 20 bp, Artificial Sequence
  chemically synthesized
gaaactgctgggttccagag

SEQ ID NO: 29805 - DNA, 20 bp, Artificial Sequence
  chemically synthesized
tgggttccagaggggctccc

SEQ ID NO: 29806 - DNA, 20 bp, Artificial Sequence
  chemically synthesized
ccagaggggctcccaagcct

SEQ ID NO: 29807 - DNA, 20 bp, Artificial Sequence
  chemically synthesized
agaggggctcccaagcctga

SEQ ID NO: 29808 - DNA, 20 bp, Artificial Sequence
  chemically synthesized
acacccacacatacaaacat

SEQ ID NO: 29809 - DNA, 20 bp, Artificial Sequence
  chemically synthesized
gataccacacaaacatacac

SEQ ID NO: 29810 - DNA, 20 bp, Artificial Sequence
  chemically synthesized
caaacatacatacatatttt

SEQ ID NO: 29811 - DNA, 20 bp, Artificial Sequence
  chemically synthesized
aacatacatacatattttta

SEQ ID NO: 29812 - DNA, 20 bp, Artificial Sequence
  chemically synthesized
acatacatatttttagagtt

SEQ ID NO: 29813 - DNA, 20 bp, Artificial Sequence
  chemically synthesized
tttcctttttatttttgaat

SEQ ID NO: 29814 - DNA, 20 bp, Artificial Sequence
  chemically synthesized
ttcctttttatttttgaatc

SEQ ID NO: 29815 - DNA, 20 bp, Artificial Sequence
  chemically synthesized
tcctttttatttttgaatcg

SEQ ID NO: 29816 - DNA, 20 bp, Artificial Sequence
  chemically synthesized
ttttgaatcggggtctcact

SEQ ID NO: 29817 - DNA, 20 bp, Artificial Sequence
  chemically synthesized
cggggtctcacttggtcacc

SEQ ID NO: 29818 - DNA, 20 bp, Artificial Sequence
  chemically synthesized
ggggtctcacttggtcaccc

SEQ ID NO: 29819 - DNA, 20 bp, Artificial Sequence
  chemically synthesized
gtctcacttggtcacccagg

SEQ ID NO: 29820 - DNA, 20 bp, Artificial Sequence
  chemically synthesized
tcacttggtcacccaggcag

SEQ ID NO: 29821 - DNA, 20 bp, Artificial Sequence
  chemically synthesized
cccaggcagtagtgtgatta

SEQ ID NO: 29822 - DNA, 20 bp, Artificial Sequence
  chemically synthesized
agtgtgattatggctcactg

SEQ ID NO: 29823 - DNA, 20 bp, Artificial Sequence
  chemically synthesized
tcactgcagcctcaacctcc

SEQ ID NO: 29824 - DNA, 20 bp, Artificial Sequence
  chemically synthesized
cactgcagcctcaacctcct

SEQ ID NO: 29825 - DNA, 20 bp, Artificial Sequence
  chemically synthesized
agcctcaacctcctgggctc

SEQ ID NO: 29826 - DNA, 20 bp, Artificial Sequence
  chemically synthesized
ctcaagcattcttcccacct

SEQ ID NO: 29827 - DNA, 20 bp, Artificial Sequence
  chemically synthesized
ttcttcccacctcagcctcc

SEQ ID NO: 29828 - DNA, 20 bp, Artificial Sequence
  chemically synthesized
tcttcccacctcagcctccc

SEQ ID NO: 29829 - DNA, 20 bp, Artificial Sequence
  chemically synthesized
tcccacctcagcctcccagg

SEQ ID NO: 29830 - DNA, 20 bp, Artificial Sequence
  chemically synthesized
cctcagcctcccaggtagct

SEQ ID NO: 29831 - DNA, 20 bp, Artificial Sequence
  chemically synthesized
ctcccaggtagctgagacta

SEQ ID NO: 29832 - DNA, 20 bp, Artificial Sequence
  chemically synthesized
cagacgtgcaccgccacaca

SEQ ID NO: 29833 - DNA, 20 bp, Artificial Sequence
  chemically synthesized
gctaattttaattttttttg

SEQ ID NO: 29834 - DNA, 20 bp, Artificial Sequence
  chemically synthesized
taattttaattttttttgta

SEQ ID NO: 29835 - DNA, 20 bp, Artificial Sequence
  chemically synthesized
tttaattttttttgtagaga

SEQ ID NO: 29836 - DNA, 20 bp, Artificial Sequence
  chemically synthesized
ttaattttttttgtagagat

SEQ ID NO: 29837 - DNA, 20 bp, Artificial Sequence
  chemically synthesized
taattttttttgtagagata

SEQ ID NO: 29838 - DNA, 20 bp, Artificial Sequence
  chemically synthesized
tagggtcttgctgtattgtt

SEQ ID NO: 29839 - DNA, 20 bp, Artificial Sequence
  chemically synthesized
agggtcttgctgtattgttc

SEQ ID NO: 29840 - DNA, 20 bp, Artificial Sequence
  chemically synthesized
tcttgctgtattgttcaggc

SEQ ID NO: 29841 - DNA, 20 bp, Artificial Sequence
  chemically synthesized
tcaggctggtctcaaactcc

SEQ ID NO: 29842 - DNA, 20 bp, Artificial Sequence
  chemically synthesized
ggtctcaaactcctggactc

SEQ ID NO: 29843 - DNA, 20 bp, Artificial Sequence
  chemically synthesized
tcaagtaatcttcttgcctg

SEQ ID NO: 29844 - DNA, 20 bp, Artificial Sequence
  chemically synthesized
gtaatcttcttgcctgaagt

SEQ ID NO: 29845 - DNA, 20 bp, Artificial Sequence
  chemically synthesized
tgaagttggtctcaaactcc

SEQ ID NO: 29846 - DNA, 20 bp, Artificial Sequence
  chemically synthesized
ggtctcaaactcctggcctt

SEQ ID NO: 29847 - DNA, 20 bp, Artificial Sequence
  chemically synthesized
cttcagcaatcctcccacct

SEQ ID NO: 29848 - DNA, 20 bp, Artificial Sequence
  chemically synthesized
cctcccaccttggtctccca

SEQ ID NO: 29849 - DNA, 20 bp, Artificial Sequence
  chemically synthesized
accttggtctcccaaagtgc

SEQ ID NO: 29850 - DNA, 20 bp, Artificial Sequence
  chemically synthesized
ccttggtctcccaaagtgct

SEQ ID NO: 29851 - DNA, 20 bp, Artificial Sequence
  chemically synthesized
ctcccaaagtgctgggatta

SEQ ID NO: 29852 - DNA, 20 bp, Artificial Sequence
  chemically synthesized
aagtgctgggattatagcat

SEQ ID NO: 29853 - DNA, 20 bp, Artificial Sequence
  chemically synthesized
atagcataagccaccgtgcc

SEQ ID NO: 29854 - DNA, 20 bp, Artificial Sequence
  chemically synthesized
agccaccgtgcctggcctca

SEQ ID NO: 29855 - DNA, 20 bp, Artificial Sequence
  chemically synthesized
ctcatggtaattttaacctg

SEQ ID NO: 29856 - DNA, 20 bp, Artificial Sequence
  chemically synthesized
tcatggtaattttaacctgt

SEQ ID NO: 29857 - DNA, 20 bp, Artificial Sequence
  chemically synthesized
atggtaattttaacctgtag

SEQ ID NO: 29858 - DNA, 20 bp, Artificial Sequence
  chemically synthesized
aattttaacctgtaggagaa

SEQ ID NO: 29859 - DNA, 20 bp, Artificial Sequence
  chemically synthesized
attttaacctgtaggagaat

SEQ ID NO: 29860 - DNA, 20 bp, Artificial Sequence
  chemically synthesized
ttaacctgtaggagaatggg

SEQ ID NO: 29861 - DNA, 20 bp, Artificial Sequence
  chemically synthesized
taacctgtaggagaatgggt

SEQ ID NO: 29862 - DNA, 20 bp, Artificial Sequence
  chemically synthesized
acctgtaggagaatgggtgg

SEQ ID NO: 29863 - DNA, 20 bp, Artificial Sequence
  chemically synthesized
cctgtaggagaatgggtggg

SEQ ID NO: 29864 - DNA, 20 bp, Artificial Sequence
  chemically synthesized
ggagaatgggtgggaggatc

SEQ ID NO: 29865 - DNA, 20 bp, Artificial Sequence
  chemically synthesized
agaatgggtgggaggatcca

SEQ ID NO: 29866 - DNA, 20 bp, Artificial Sequence
  chemically synthesized
gaatgggtgggaggatccag

SEQ ID NO: 29867 - DNA, 20 bp, Artificial Sequence
  chemically synthesized
aatgggtgggaggatccaga

SEQ ID NO: 29868 - DNA, 20 bp, Artificial Sequence
  chemically synthesized
tgggaggatccagagggcct

SEQ ID NO: 29869 - DNA, 20 bp, Artificial Sequence
  chemically synthesized
ggatccagagggcctgagta

SEQ ID NO: 29870 - DNA, 20 bp, Artificial Sequence
  chemically synthesized
tccagagggcctgagtaaag

SEQ ID NO: 29871 - DNA, 20 bp, Artificial Sequence
  chemically synthesized
gggcctgagtaaagtagaac

SEQ ID NO: 29872 - DNA, 20 bp, Artificial Sequence
  chemically synthesized
ggcctgagtaaagtagaact

SEQ ID NO: 29873 - DNA, 20 bp, Artificial Sequence
  chemically synthesized
aaagtagaactgggacaatg

SEQ ID NO: 29874 - DNA, 20 bp, Artificial Sequence
  chemically synthesized
atgaagatataccaccttga

SEQ ID NO: 29875 - DNA, 20 bp, Artificial Sequence
  chemically synthesized
tataccaccttgatggatgc

SEQ ID NO: 29876 - DNA, 20 bp, Artificial Sequence
  chemically synthesized
accaccttgatggatgccag

SEQ ID NO: 29877 - DNA, 20 bp, Artificial Sequence
  chemically synthesized
ccttgatggatgccagcaga

SEQ ID NO: 29878 - DNA, 20 bp, Artificial Sequence
  chemically synthesized
cttgatggatgccagcagaa

SEQ ID NO: 29879 - DNA, 20 bp, Artificial Sequence
  chemically synthesized
ccagcagaaaggtgtcttct

SEQ ID NO: 29880 - DNA, 20 bp, Artificial Sequence
  chemically synthesized
cagcagaaaggtgtcttctt

SEQ ID NO: 29881 - DNA, 20 bp, Artificial Sequence
  chemically synthesized
ttcttgggcttctgaatgtg

SEQ ID NO: 29882 - DNA, 20 bp, Artificial Sequence
  chemically synthesized
cttgggcttctgaatgtgaa

SEQ ID NO: 29883 - DNA, 20 bp, Artificial Sequence
  chemically synthesized
ttgggcttctgaatgtgaag

SEQ ID NO: 29884 - DNA, 20 bp, Artificial Sequence
  chemically synthesized
gggcttctgaatgtgaagag

SEQ ID NO: 29885 - DNA, 20 bp, Artificial Sequence
  chemically synthesized
ggcttctgaatgtgaagagg

SEQ ID NO: 29886 - DNA, 20 bp, Artificial Sequence
  chemically synthesized
cttctgaatgtgaagaggag

SEQ ID NO: 29887 - DNA, 20 bp, Artificial Sequence
  chemically synthesized
gtgaagaggaggagttcctc

SEQ ID NO: 29888 - DNA, 20 bp, Artificial Sequence
  chemically synthesized
gaggaggagttcctcgagac

SEQ ID NO: 29889 - DNA, 20 bp, Artificial Sequence
  chemically synthesized
gaggagttcctcgagacaag

SEQ ID NO: 29890 - DNA, 20 bp, Artificial Sequence
  chemically synthesized
ggagttcctcgagacaagaa

SEQ ID NO: 29891 - DNA, 20 bp, Artificial Sequence
  chemically synthesized
gacaagaagagaacttctgt

SEQ ID NO: 29892 - DNA, 20 bp, Artificial Sequence
  chemically synthesized
aagagaacttctgttagctc

SEQ ID NO: 29893 - DNA, 20 bp, Artificial Sequence
  chemically synthesized
gcatacatttaatatttatt

SEQ ID NO: 29894 - DNA, 20 bp, Artificial Sequence
  chemically synthesized
tttaatatttattgagtata

SEQ ID NO: 29895 - DNA, 20 bp, Artificial Sequence
  chemically synthesized
attgagtatatggcatgtgc

SEQ ID NO: 29896 - DNA, 20 bp, Artificial Sequence
  chemically synthesized
ttgagtatatggcatgtgct

SEQ ID NO: 29897 - DNA, 20 bp, Artificial Sequence
  chemically synthesized
ttgtatttatatacatttac

SEQ ID NO: 29898 - DNA, 20 bp, Artificial Sequence
  chemically synthesized
atttatatacatttactggc

SEQ ID NO: 29899 - DNA, 20 bp, Artificial Sequence
  chemically synthesized
atatacatttactggcgagc

SEQ ID NO: 29900 - DNA, 20 bp, Artificial Sequence
  chemically synthesized
caagacatgcctaattcctc

SEQ ID NO: 29901 - DNA, 20 bp, Artificial Sequence
  chemically synthesized
aagacatgcctaattcctcc

SEQ ID NO: 29902 - DNA, 20 bp, Artificial Sequence
  chemically synthesized
agacatgcctaattcctcca

SEQ ID NO: 29903 - DNA, 20 bp, Artificial Sequence
  chemically synthesized
ttcctccagggatcttgatt

SEQ ID NO: 29904 - DNA, 20 bp, Artificial Sequence
  chemically synthesized
tcttgatttagtcattctaa

SEQ ID NO: 29905 - DNA, 20 bp, Artificial Sequence
  chemically synthesized
catgcacacaccttcataaa

SEQ ID NO: 29906 - DNA, 20 bp, Artificial Sequence
  chemically synthesized
atgcacacaccttcataaac

SEQ ID NO: 29907 - DNA, 20 bp, Artificial Sequence
  chemically synthesized
ctgtgtgacaaatgttacaa

SEQ ID NO: 29908 - DNA, 20 bp, Artificial Sequence
  chemically synthesized
tgtgtgacaaatgttacaac

SEQ ID NO: 29909 - DNA, 20 bp, Artificial Sequence
  chemically synthesized
aaatgttacaacgggaaatg

SEQ ID NO: 29910 - DNA, 20 bp, Artificial Sequence
  chemically synthesized
aatgttacaacgggaaatgc

SEQ ID NO: 29911 - DNA, 20 bp, Artificial Sequence
  chemically synthesized
atgttacaacgggaaatgca

SEQ ID NO: 29912 - DNA, 20 bp, Artificial Sequence
  chemically synthesized
acgggaaatgcagggcactg

SEQ ID NO: 29913 - DNA, 20 bp, Artificial Sequence
  chemically synthesized
ggaaatgcagggcactgtgg

SEQ ID NO: 29914 - DNA, 20 bp, Artificial Sequence
  chemically synthesized
gaaatgcagggcactgtgga

SEQ ID NO: 29915 - DNA, 20 bp, Artificial Sequence
  chemically synthesized
gcactgtggaaggaaaccga

SEQ ID NO: 29916 - DNA, 20 bp, Artificial Sequence
  chemically synthesized
actgtggaaggaaaccgatg

SEQ ID NO: 29917 - DNA, 20 bp, Artificial Sequence
  chemically synthesized
aaggaaaccgatggagcatt

SEQ ID NO: 29918 - DNA, 20 bp, Artificial Sequence
  chemically synthesized
agcatttggtgctttaccat

SEQ ID NO: 29919 - DNA, 20 bp, Artificial Sequence
  chemically synthesized
tttggtgctttaccattgga

SEQ ID NO: 29920 - DNA, 20 bp, Artificial Sequence
  chemically synthesized
ttggtgctttaccattggaa

SEQ ID NO: 29921 - DNA, 20 bp, Artificial Sequence
  chemically synthesized
tggtgctttaccattggaaa

SEQ ID NO: 29922 - DNA, 20 bp, Artificial Sequence
  chemically synthesized
gtgctttaccattggaaagg

SEQ ID NO: 29923 - DNA, 20 bp, Artificial Sequence
  chemically synthesized
tgctttaccattggaaaggg

SEQ ID NO: 29924 - DNA, 20 bp, Artificial Sequence
  chemically synthesized
ctttaccattggaaagggag

SEQ ID NO: 29925 - DNA, 20 bp, Artificial Sequence
  chemically synthesized
ctatctgtgaaaatgtcctt

SEQ ID NO: 29926 - DNA, 20 bp, Artificial Sequence
  chemically synthesized
tatctgtgaaaatgtccttg

SEQ ID NO: 29927 - DNA, 20 bp, Artificial Sequence
  chemically synthesized
ctgtgaaaatgtccttgagg

SEQ ID NO: 29928 - DNA, 20 bp, Artificial Sequence
  chemically synthesized
tccttgaggaagcaatttca

SEQ ID NO: 29929 - DNA, 20 bp, Artificial Sequence
  chemically synthesized
gaggaagcaatttcaaagct

SEQ ID NO: 29930 - DNA, 20 bp, Artificial Sequence
  chemically synthesized
ttcaaagctgagacccctgc

SEQ ID NO: 29931 - DNA, 20 bp, Artificial Sequence
  chemically synthesized
tcaaagctgagacccctgca

SEQ ID NO: 29932 - DNA, 20 bp, Artificial Sequence
  chemically synthesized
acccctgcaaggattgcatt

SEQ ID NO: 29933 - DNA, 20 bp, Artificial Sequence
  chemically synthesized
ggattgcatttagtcactcg

SEQ ID NO: 29934 - DNA, 20 bp, Artificial Sequence
  chemically synthesized
gattgcatttagtcactcgt

SEQ ID NO: 29935 - DNA, 20 bp, Artificial Sequence
  chemically synthesized
attgcatttagtcactcgta

SEQ ID NO: 29936 - DNA, 20 bp, Artificial Sequence
  chemically synthesized
catttagtcactcgtaggga

SEQ ID NO: 29937 - DNA, 20 bp, Artificial Sequence
  chemically synthesized
atttagtcactcgtagggac

SEQ ID NO: 29938 - DNA, 20 bp, Artificial Sequence
  chemically synthesized
actcgtagggacaggctgat

SEQ ID NO: 29939 - DNA, 20 bp, Artificial Sequence
  chemically synthesized
caggctgatcagccaatgta

SEQ ID NO: 29940 - DNA, 20 bp, Artificial Sequence
  chemically synthesized
tgtaaagtttatttcctcct

SEQ ID NO: 29941 - DNA, 20 bp, Artificial Sequence
  chemically synthesized
gtttatttcctcctgagcaa

SEQ ID NO: 29942 - DNA, 20 bp, Artificial Sequence
  chemically synthesized
tttatttcctcctgagcaat

SEQ ID NO: 29943 - DNA, 20 bp, Artificial Sequence
  chemically synthesized
tgacttcaatatgtttgtgt

SEQ ID NO: 29944 - DNA, 20 bp, Artificial Sequence
  chemically synthesized
tatgtttgtgtgagtttcct

SEQ ID NO: 29945 - DNA, 20 bp, Artificial Sequence
  chemically synthesized
tgtgtgagtttccttggctg

SEQ ID NO: 29946 - DNA, 20 bp, Artificial Sequence
  chemically synthesized
cacacaactaaaacacctac

SEQ ID NO: 29947 - DNA, 20 bp, Artificial Sequence
  chemically synthesized
ctacaagtaaatactgactg

SEQ ID NO: 29948 - DNA, 20 bp, Artificial Sequence
  chemically synthesized
tactgactgtagcttaatgt

SEQ ID NO: 29949 - DNA, 20 bp, Artificial Sequence
  chemically synthesized
tgtagcttaatgtcagactt

SEQ ID NO: 29950 - DNA, 20 bp, Artificial Sequence
  chemically synthesized
gtagcttaatgtcagacttg

SEQ ID NO: 29951 - DNA, 20 bp, Artificial Sequence
  chemically synthesized
aatgtcagacttgaggttgt

SEQ ID NO: 29952 - DNA, 20 bp, Artificial Sequence
  chemically synthesized
atgtcagacttgaggttgta

SEQ ID NO: 29953 - DNA, 20 bp, Artificial Sequence
  chemically synthesized
ttgaggttgtaaggtaaaat

SEQ ID NO: 29954 - DNA, 20 bp, Artificial Sequence
  chemically synthesized
gaggttgtaaggtaaaatca

SEQ ID NO: 29955 - DNA, 20 bp, Artificial Sequence
  chemically synthesized
tgtaaggtaaaatcagagat

SEQ ID NO: 29956 - DNA, 20 bp, Artificial Sequence
  chemically synthesized
taaggtaaaatcagagatga

SEQ ID NO: 29957 - DNA, 20 bp, Artificial Sequence
  chemically synthesized
aaggtaaaatcagagatgag

SEQ ID NO: 29958 - DNA, 20 bp, Artificial Sequence
  chemically synthesized
ggtaaaatcagagatgagag

SEQ ID NO: 29959 - DNA, 20 bp, Artificial Sequence
  chemically synthesized
aatcagagatgagaggagtc

SEQ ID NO: 29960 - DNA, 20 bp, Artificial Sequence
  chemically synthesized
atcagagatgagaggagtca

SEQ ID NO: 29961 - DNA, 20 bp, Artificial Sequence
  chemically synthesized
gagatgagaggagtcaagga

SEQ ID NO: 29962 - DNA, 20 bp, Artificial Sequence
  chemically synthesized
agatgagaggagtcaaggat

SEQ ID NO: 29963 - DNA, 20 bp, Artificial Sequence
  chemically synthesized
aggagtcaaggataggatca

SEQ ID NO: 29964 - DNA, 20 bp, Artificial Sequence
  chemically synthesized
aggatcaaagtctcttcttc

SEQ ID NO: 29965 - DNA, 20 bp, Artificial Sequence
  chemically synthesized
gatcaaagtctcttcttcta

SEQ ID NO: 29966 - DNA, 20 bp, Artificial Sequence
  chemically synthesized
atcaaagtctcttcttctag

SEQ ID NO: 29967 - DNA, 20 bp, Artificial Sequence
  chemically synthesized
tctcttcttctagaggaata

SEQ ID NO: 29968 - DNA, 20 bp, Artificial Sequence
  chemically synthesized
ttcttctagaggaatatggt

SEQ ID NO: 29969 - DNA, 20 bp, Artificial Sequence
  chemically synthesized
tcttctagaggaatatggtc

SEQ ID NO: 29970 - DNA, 20 bp, Artificial Sequence
  chemically synthesized
ttctagaggaatatggtcag

SEQ ID NO: 29971 - DNA, 20 bp, Artificial Sequence
  chemically synthesized
ctagaggaatatggtcagga

SEQ ID NO: 29972 - DNA, 20 bp, Artificial Sequence
  chemically synthesized
agaggaatatggtcaggaga

SEQ ID NO: 29973 - DNA, 20 bp, Artificial Sequence
  chemically synthesized
gtcaggagagagcacaacct

SEQ ID NO: 29974 - DNA, 20 bp, Artificial Sequence
  chemically synthesized
agagcacaaccttagaaatt

SEQ ID NO: 29975 - DNA, 20 bp, Artificial Sequence
  chemically synthesized
gagcacaaccttagaaattt

SEQ ID NO: 29976 - DNA, 20 bp, Artificial Sequence
  chemically synthesized
agcacaaccttagaaatttg

SEQ ID NO: 29977 - DNA, 20 bp, Artificial Sequence
  chemically synthesized
gcacaaccttagaaatttgg

SEQ ID NO: 29978 - DNA, 20 bp, Artificial Sequence
  chemically synthesized
cacaaccttagaaatttggg

SEQ ID NO: 29979 - DNA, 20 bp, Artificial Sequence
  chemically synthesized
acaaccttagaaatttgggg

SEQ ID NO: 29980 - DNA, 20 bp, Artificial Sequence
  chemically synthesized
tgggggggtgttgcttgaaa

SEQ ID NO: 29981 - DNA, 20 bp, Artificial Sequence
  chemically synthesized
gggggggtgttgcttgaaac

SEQ ID NO: 29982 - DNA, 20 bp, Artificial Sequence
  chemically synthesized
tgttgcttgaaacaggtgtt

SEQ ID NO: 29983 - DNA, 20 bp, Artificial Sequence
  chemically synthesized
gttgcttgaaacaggtgttg

SEQ ID NO: 29984 - DNA, 20 bp, Artificial Sequence
  chemically synthesized
gcttgaaacaggtgttgagg

SEQ ID NO: 29985 - DNA, 20 bp, Artificial Sequence
  chemically synthesized
acaggtgttgaggaagaatg

SEQ ID NO: 29986 - DNA, 20 bp, Artificial Sequence
  chemically synthesized
caggtgttgaggaagaatgc

SEQ ID NO: 29987 - DNA, 20 bp, Artificial Sequence
  chemically synthesized
ggtgttgaggaagaatgcag

SEQ ID NO: 29988 - DNA, 20 bp, Artificial Sequence
  chemically synthesized
aggaagaatgcaggagttct

SEQ ID NO: 29989 - DNA, 20 bp, Artificial Sequence
  chemically synthesized
ggaagaatgcaggagttctg

SEQ ID NO: 29990 - DNA, 20 bp, Artificial Sequence
  chemically synthesized
ctgaggtttctgatgtgact

SEQ ID NO: 29991 - DNA, 20 bp, Artificial Sequence
  chemically synthesized
tgaggtttctgatgtgactt

SEQ ID NO: 29992 - DNA, 20 bp, Artificial Sequence
  chemically synthesized
gaggtttctgatgtgacttg

SEQ ID NO: 29993 - DNA, 20 bp, Artificial Sequence
  chemically synthesized
aggtttctgatgtgacttgg

SEQ ID NO: 29994 - DNA, 20 bp, Artificial Sequence
  chemically synthesized
gatgtgacttgggggtctga

SEQ ID NO: 29995 - DNA, 20 bp, Artificial Sequence
  chemically synthesized
gtctgaaagttactgctgac

SEQ ID NO: 29996 - DNA, 20 bp, Artificial Sequence
  chemically synthesized
tctgaaagttactgctgacc

SEQ ID NO: 29997 - DNA, 20 bp, Artificial Sequence
  chemically synthesized
aaagttactgctgaccagga

SEQ ID NO: 29998 - DNA, 20 bp, Artificial Sequence
  chemically synthesized
actgctgaccaggatagaaa

SEQ ID NO: 29999 - DNA, 20 bp, Artificial Sequence
  chemically synthesized
tgaccaggatagaaaaagat

SEQ ID NO: 30000 - DNA, 20 bp, Artificial Sequence
  chemically synthesized
ccaggatagaaaaagatgag

SEQ ID NO: 30001 - DNA, 20 bp, Artificial Sequence
  chemically synthesized
gaaaaagatgagaagaaact

SEQ ID NO: 30002 - DNA, 20 bp, Artificial Sequence
  chemically synthesized
aagatgagaagaaacttggc

SEQ ID NO: 30003 - DNA, 20 bp, Artificial Sequence
  chemically synthesized
agatgagaagaaacttggcc

SEQ ID NO: 30004 - DNA, 20 bp, Artificial Sequence
  chemically synthesized
tgagaagaaacttggccagg

SEQ ID NO: 30005 - DNA, 20 bp, Artificial Sequence
  chemically synthesized
agaaacttggccaggtagat

SEQ ID NO: 30006 - DNA, 20 bp, Artificial Sequence
  chemically synthesized
acttggccaggtagataaga

SEQ ID NO: 30007 - DNA, 20 bp, Artificial Sequence
  chemically synthesized
tggccaggtagataagatgg

SEQ ID NO: 30008 - DNA, 20 bp, Artificial Sequence
  chemically synthesized
ccaggtagataagatggaag

SEQ ID NO: 30009 - DNA, 20 bp, Artificial Sequence
  chemically synthesized
gataagatggaagcagtccc

SEQ ID NO: 30010 - DNA, 20 bp, Artificial Sequence
  chemically synthesized
ataagatggaagcagtccca

SEQ ID NO: 30011 - DNA, 20 bp, Artificial Sequence
  chemically synthesized
gaagcagtcccaaggaacca

SEQ ID NO: 30012 - DNA, 20 bp, Artificial Sequence
  chemically synthesized
gcagtcccaaggaaccatgg

SEQ ID NO: 30013 - DNA, 20 bp, Artificial Sequence
  chemically synthesized
cagtcccaaggaaccatgga

SEQ ID NO: 30014 - DNA, 20 bp, Artificial Sequence
  chemically synthesized
gtcccaaggaaccatggaag

SEQ ID NO: 30015 - DNA, 20 bp, Artificial Sequence
  chemically synthesized
tcccaaggaaccatggaagg

SEQ ID NO: 30016 - DNA, 20 bp, Artificial Sequence
  chemically synthesized
catggaaggaggtgtatttc

SEQ ID NO: 30017 - DNA, 20 bp, Artificial Sequence
  chemically synthesized
tggaaggaggtgtatttccg

SEQ ID NO: 30018 - DNA, 20 bp, Artificial Sequence
  chemically synthesized
ggaaggaggtgtatttccgg

SEQ ID NO: 30019 - DNA, 20 bp, Artificial Sequence
  chemically synthesized
ggaggtgtatttccggaggt

SEQ ID NO: 30020 - DNA, 20 bp, Artificial Sequence
  chemically synthesized
gtgtatttccggaggtgagt

SEQ ID NO: 30021 - DNA, 20 bp, Artificial Sequence
  chemically synthesized
gtatttccggaggtgagtta

SEQ ID NO: 30022 - DNA, 20 bp, Artificial Sequence
  chemically synthesized
cggaggtgagttagagcaaa

SEQ ID NO: 30023 - DNA, 20 bp, Artificial Sequence
  chemically synthesized
tagagcaaatggcatttacc

SEQ ID NO: 30024 - DNA, 20 bp, Artificial Sequence
  chemically synthesized
ggcatttacctggtctctgc

SEQ ID NO: 30025 - DNA, 20 bp, Artificial Sequence
  chemically synthesized
gcatttacctggtctctgcc

SEQ ID NO: 30026 - DNA, 20 bp, Artificial Sequence
  chemically synthesized
gtctctgccaggctctcctc

SEQ ID NO: 30027 - DNA, 20 bp, Artificial Sequence
  chemically synthesized
tctctgccaggctctcctct

SEQ ID NO: 30028 - DNA, 20 bp, Artificial Sequence
  chemically synthesized
aggctctcctctgggtgctc

SEQ ID NO: 30029 - DNA, 20 bp, Artificial Sequence
  chemically synthesized
ctggtatttattgttctttt

SEQ ID NO: 30030 - DNA, 20 bp, Artificial Sequence
  chemically synthesized
tgttctttttagtttttatt

SEQ ID NO: 30031 - DNA, 20 bp, Artificial Sequence
  chemically synthesized
gtttttatttagtttcattt

SEQ ID NO: 30032 - DNA, 20 bp, Artificial Sequence
  chemically synthesized
atttagtttcattttagttt

SEQ ID NO: 30033 - DNA, 20 bp, Artificial Sequence
  chemically synthesized
attgatgatgaccttcaata

SEQ ID NO: 30034 - DNA, 20 bp, Artificial Sequence
  chemically synthesized
ccttcaataaagttgccttc

SEQ ID NO: 30035 - DNA, 20 bp, Artificial Sequence
  chemically synthesized
caataaagttgccttctgga

SEQ ID NO: 30036 - DNA, 20 bp, Artificial Sequence
  chemically synthesized
tttgatgctaccaaaaatgc

SEQ ID NO: 30037 - DNA, 20 bp, Artificial Sequence
  chemically synthesized
ctaccaaaaatgccagttct

SEQ ID NO: 30038 - DNA, 20 bp, Artificial Sequence
  chemically synthesized
aaaatgccagttctcagctg

SEQ ID NO: 30039 - DNA, 20 bp, Artificial Sequence
  chemically synthesized
aaatgccagttctcagctgt

SEQ ID NO: 30040 - DNA, 20 bp, Artificial Sequence
  chemically synthesized
atgccagttctcagctgtag

SEQ ID NO: 30041 - DNA, 20 bp, Artificial Sequence
  chemically synthesized
tgccagttctcagctgtagg

SEQ ID NO: 30042 - DNA, 20 bp, Artificial Sequence
  chemically synthesized
ccagttctcagctgtaggag

SEQ ID NO: 30043 - DNA, 20 bp, Artificial Sequence
  chemically synthesized
aggaggagccattaaaatct

SEQ ID NO: 30044 - DNA, 20 bp, Artificial Sequence
  chemically synthesized
ggagccattaaaatctaagc

SEQ ID NO: 30045 - DNA, 20 bp, Artificial Sequence
  chemically synthesized
agccattaaaatctaagcaa

SEQ ID NO: 30046 - DNA, 20 bp, Artificial Sequence
  chemically synthesized
cattaaaatctaagcaagag

SEQ ID NO: 30047 - DNA, 20 bp, Artificial Sequence
  chemically synthesized
aaatctaagcaagagaagtt

SEQ ID NO: 30048 - DNA, 20 bp, Artificial Sequence
  chemically synthesized
aagagaagttcagtttttta

SEQ ID NO: 30049 - DNA, 20 bp, Artificial Sequence
  chemically synthesized
gttttttaaagccacaactc

SEQ ID NO: 30050 - DNA, 20 bp, Artificial Sequence
  chemically synthesized
aaatttgcccatattttatt

SEQ ID NO: 30051 - DNA, 20 bp, Artificial Sequence
  chemically synthesized
aatttgcccatattttattt

SEQ ID NO: 30052 - DNA, 20 bp, Artificial Sequence
  chemically synthesized
tgcccatattttatttagga

SEQ ID NO: 30053 - DNA, 20 bp, Artificial Sequence
  chemically synthesized
gcccatattttatttaggac

SEQ ID NO: 30054 - DNA, 20 bp, Artificial Sequence
  chemically synthesized
cccatattttatttaggaca

SEQ ID NO: 30055 - DNA, 20 bp, Artificial Sequence
  chemically synthesized
ccatattttatttaggacag

SEQ ID NO: 30056 - DNA, 20 bp, Artificial Sequence
  chemically synthesized
gacaggggcaaaaaatcttt

SEQ ID NO: 30057 - DNA, 20 bp, Artificial Sequence
  chemically synthesized
caggggcaaaaaatctttaa

SEQ ID NO: 30058 - DNA, 20 bp, Artificial Sequence
  chemically synthesized
tactcaatactccaaatttt

SEQ ID NO: 30059 - DNA, 20 bp, Artificial Sequence
  chemically synthesized
tccaaattttcagtccaatt

SEQ ID NO: 30060 - DNA, 20 bp, Artificial Sequence
  chemically synthesized
ccaaattttcagtccaattt

SEQ ID NO: 30061 - DNA, 20 bp, Artificial Sequence
  chemically synthesized
caaattttcagtccaatttg

SEQ ID NO: 30062 - DNA, 20 bp, Artificial Sequence
  chemically synthesized
tccaatttggggccttctta

SEQ ID NO: 30063 - DNA, 20 bp, Artificial Sequence
  chemically synthesized
ccaatttggggccttcttat

SEQ ID NO: 30064 - DNA, 20 bp, Artificial Sequence
  chemically synthesized
ggggccttcttataggcctc

SEQ ID NO: 30065 - DNA, 20 bp, Artificial Sequence
  chemically synthesized
gggccttcttataggcctct

SEQ ID NO: 30066 - DNA, 20 bp, Artificial Sequence
  chemically synthesized
ggccttcttataggcctcta

SEQ ID NO: 30067 - DNA, 20 bp, Artificial Sequence
  chemically synthesized
gccttcttataggcctctag

SEQ ID NO: 30068 - DNA, 20 bp, Artificial Sequence
  chemically synthesized
ccttcttataggcctctagg

SEQ ID NO: 30069 - DNA, 20 bp, Artificial Sequence
  chemically synthesized
ttcttataggcctctagggg

SEQ ID NO: 30070 - DNA, 20 bp, Artificial Sequence
  chemically synthesized
taggcctctagggggagttt

SEQ ID NO: 30071 - DNA, 20 bp, Artificial Sequence
  chemically synthesized
tctagggggagttttagccc

SEQ ID NO: 30072 - DNA, 20 bp, Artificial Sequence
  chemically synthesized
ctagggggagttttagcccc

SEQ ID NO: 30073 - DNA, 20 bp, Artificial Sequence
  chemically synthesized
tagccccaggactcatttac

SEQ ID NO: 30074 - DNA, 20 bp, Artificial Sequence
  chemically synthesized
actcatttactggccttttt

SEQ ID NO: 30075 - DNA, 20 bp, Artificial Sequence
  chemically synthesized
ttactggcctttttaagacc

SEQ ID NO: 30076 - DNA, 20 bp, Artificial Sequence
  chemically synthesized
tactggcctttttaagacct

SEQ ID NO: 30077 - DNA, 20 bp, Artificial Sequence
  chemically synthesized
aagacctaggaacttgataa

SEQ ID NO: 30078 - DNA, 20 bp, Artificial Sequence
  chemically synthesized
ctaggaacttgataatggca

SEQ ID NO: 30079 - DNA, 20 bp, Artificial Sequence
  chemically synthesized
ggaacttgataatggcacgg

SEQ ID NO: 30080 - DNA, 20 bp, Artificial Sequence
  chemically synthesized
aatggcacggtggatctcct

SEQ ID NO: 30081 - DNA, 20 bp, Artificial Sequence
  chemically synthesized
gtcttaatgctgtatatgat

SEQ ID NO: 30082 - DNA, 20 bp, Artificial Sequence
  chemically synthesized
tcttaatgctgtatatgatt

SEQ ID NO: 30083 - DNA, 20 bp, Artificial Sequence
  chemically synthesized
atgctgtatatgattgggtt

SEQ ID NO: 30084 - DNA, 20 bp, Artificial Sequence
  chemically synthesized
gtatatgattgggttaagca

SEQ ID NO: 30085 - DNA, 20 bp, Artificial Sequence
  chemically synthesized
tatatgattgggttaagcat

SEQ ID NO: 30086 - DNA, 20 bp, Artificial Sequence
  chemically synthesized
tatgattgggttaagcatgg

SEQ ID NO: 30087 - DNA, 20 bp, Artificial Sequence
  chemically synthesized
atgattgggttaagcatggg

SEQ ID NO: 30088 - DNA, 20 bp, Artificial Sequence
  chemically synthesized
ttaagcatgggaggcacaaa

SEQ ID NO: 30089 - DNA, 20 bp, Artificial Sequence
  chemically synthesized
taagcatgggaggcacaaaa

SEQ ID NO: 30090 - DNA, 20 bp, Artificial Sequence
  chemically synthesized
gcatgggaggcacaaaaagg

SEQ ID NO: 30091 - DNA, 20 bp, Artificial Sequence
  chemically synthesized
aggcacaaaaaggtagacat

SEQ ID NO: 30092 - DNA, 20 bp, Artificial Sequence
  chemically synthesized
aaaaggtagacattggccat

SEQ ID NO: 30093 - DNA, 20 bp, Artificial Sequence
  chemically synthesized
aggtagacattggccataag

SEQ ID NO: 30094 - DNA, 20 bp, Artificial Sequence
  chemically synthesized
attggccataagaagatgaa

SEQ ID NO: 30095 - DNA, 20 bp, Artificial Sequence
  chemically synthesized
ggccataagaagatgaatag

SEQ ID NO: 30096 - DNA, 20 bp, Artificial Sequence
  chemically synthesized
gccataagaagatgaatagc

SEQ ID NO: 30097 - DNA, 20 bp, Artificial Sequence
  chemically synthesized
ataagaagatgaatagcagg

SEQ ID NO: 30098 - DNA, 20 bp, Artificial Sequence
  chemically synthesized
taagaagatgaatagcaggt

SEQ ID NO: 30099 - DNA, 20 bp, Artificial Sequence
  chemically synthesized
aagaagatgaatagcaggtg

SEQ ID NO: 30100 - DNA, 20 bp, Artificial Sequence
  chemically synthesized
gtggggcatgcttcccaaaa

SEQ ID NO: 30101 - DNA, 20 bp, Artificial Sequence
  chemically synthesized
tgcttcccaaaacggtgcac

SEQ ID NO: 30102 - DNA, 20 bp, Artificial Sequence
  chemically synthesized
gcttcccaaaacggtgcacc

SEQ ID NO: 30103 - DNA, 20 bp, Artificial Sequence
  chemically synthesized
cttcccaaaacggtgcacca

SEQ ID NO: 30104 - DNA, 20 bp, Artificial Sequence
  chemically synthesized
ccaaaacggtgcaccaggga

SEQ ID NO: 30105 - DNA, 20 bp, Artificial Sequence
  chemically synthesized
caccagggacagccccatca

SEQ ID NO: 30106 - DNA, 20 bp, Artificial Sequence
  chemically synthesized
accagggacagccccatcat

SEQ ID NO: 30107 - DNA, 20 bp, Artificial Sequence
  chemically synthesized
acagccccatcatgggcaca

SEQ ID NO: 30108 - DNA, 20 bp, Artificial Sequence
  chemically synthesized
atcatgggcacaaagaatac

SEQ ID NO: 30109 - DNA, 20 bp, Artificial Sequence
  chemically synthesized
gggcacaaagaatactagca

SEQ ID NO: 30110 - DNA, 20 bp, Artificial Sequence
  chemically synthesized
caaagaatactagcacagca

SEQ ID NO: 30111 - DNA, 20 bp, Artificial Sequence
  chemically synthesized
aagaatactagcacagcaca

SEQ ID NO: 30112 - DNA, 20 bp, Artificial Sequence
  chemically synthesized
gaatactagcacagcacaga

SEQ ID NO: 30113 - DNA, 20 bp, Artificial Sequence
  chemically synthesized
aatactagcacagcacagag

SEQ ID NO: 30114 - DNA, 20 bp, Artificial Sequence
  chemically synthesized
tactagcacagcacagagag

SEQ ID NO: 30115 - DNA, 20 bp, Artificial Sequence
  chemically synthesized
tagcacagcacagagaggag

SEQ ID NO: 30116 - DNA, 20 bp, Artificial Sequence
  chemically synthesized
gaggagcggtgcatgtctga

SEQ ID NO: 30117 - DNA, 20 bp, Artificial Sequence
  chemically synthesized
aggagcggtgcatgtctgaa

SEQ ID NO: 30118 - DNA, 20 bp, Artificial Sequence
  chemically synthesized
cggtgcatgtctgaaaggca

SEQ ID NO: 30119 - DNA, 20 bp, Artificial Sequence
  chemically synthesized
aggcacggcgctgctcctct

SEQ ID NO: 30120 - DNA, 20 bp, Artificial Sequence
  chemically synthesized
ggcacggcgctgctcctctt

SEQ ID NO: 30121 - DNA, 20 bp, Artificial Sequence
  chemically synthesized
cacggcgctgctcctcttgg

SEQ ID NO: 30122 - DNA, 20 bp, Artificial Sequence
  chemically synthesized
acggcgctgctcctcttggg

SEQ ID NO: 30123 - DNA, 20 bp, Artificial Sequence
  chemically synthesized
cgctgctcctcttgggaggc

SEQ ID NO: 30124 - DNA, 20 bp, Artificial Sequence
  chemically synthesized
gctgctcctcttgggaggcc

SEQ ID NO: 30125 - DNA, 20 bp, Artificial Sequence
  chemically synthesized
gccaggcctgctactgtgtg

SEQ ID NO: 30126 - DNA, 20 bp, Artificial Sequence
  chemically synthesized
ccaggcctgctactgtgtgc

SEQ ID NO: 30127 - DNA, 20 bp, Artificial Sequence
  chemically synthesized
cctgctactgtgtgcaggat

SEQ ID NO: 30128 - DNA, 20 bp, Artificial Sequence
  chemically synthesized
ctgtgtgcaggatgagtcca

SEQ ID NO: 30129 - DNA, 20 bp, Artificial Sequence
  chemically synthesized
tgtgtgcaggatgagtccat

SEQ ID NO: 30130 - DNA, 20 bp, Artificial Sequence
  chemically synthesized
tgcaggatgagtccatagga

SEQ ID NO: 30131 - DNA, 20 bp, Artificial Sequence
  chemically synthesized
agtccataggacagtgcgat

SEQ ID NO: 30132 - DNA, 20 bp, Artificial Sequence
  chemically synthesized
taggacagtgcgatgagcac

SEQ ID NO: 30133 - DNA, 20 bp, Artificial Sequence
  chemically synthesized
aggacagtgcgatgagcacc

SEQ ID NO: 30134 - DNA, 20 bp, Artificial Sequence
  chemically synthesized
agtgcgatgagcaccaggtc

SEQ ID NO: 30135 - DNA, 20 bp, Artificial Sequence
  chemically synthesized
gagcaccaggtccagcatca

SEQ ID NO: 30136 - DNA, 20 bp, Artificial Sequence
  chemically synthesized
acagtgaaaactaccaccat

SEQ ID NO: 30137 - DNA, 20 bp, Artificial Sequence
  chemically synthesized
actaccaccatcagtccata

SEQ ID NO: 30138 - DNA, 20 bp, Artificial Sequence
  chemically synthesized
tcagtccatacagattattg

SEQ ID NO: 30139 - DNA, 20 bp, Artificial Sequence
  chemically synthesized
cagtccatacagattattga

SEQ ID NO: 30140 - DNA, 20 bp, Artificial Sequence
  chemically synthesized
tattgaaggtgatatctgtg

SEQ ID NO: 30141 - DNA, 20 bp, Artificial Sequence
  chemically synthesized
attgaaggtgatatctgtgc

SEQ ID NO: 30142 - DNA, 20 bp, Artificial Sequence
  chemically synthesized
aaggtgatatctgtgcaggc

SEQ ID NO: 30143 - DNA, 20 bp, Artificial Sequence
  chemically synthesized
aggccagctgtatcacttcc

SEQ ID NO: 30144 - DNA, 20 bp, Artificial Sequence
  chemically synthesized
agctgtatcacttcctggtg

SEQ ID NO: 30145 - DNA, 20 bp, Artificial Sequence
  chemically synthesized
gctgtatcacttcctggtgc

SEQ ID NO: 30146 - DNA, 20 bp, Artificial Sequence
  chemically synthesized
cttcctggtgcaggcaaaat

SEQ ID NO: 30147 - DNA, 20 bp, Artificial Sequence
  chemically synthesized
cctggtgcaggcaaaatgag

SEQ ID NO: 30148 - DNA, 20 bp, Artificial Sequence
  chemically synthesized
ctggtgcaggcaaaatgagt

SEQ ID NO: 30149 - DNA, 20 bp, Artificial Sequence
  chemically synthesized
ggtgcaggcaaaatgagtgg

SEQ ID NO: 30150 - DNA, 20 bp, Artificial Sequence
  chemically synthesized
tgcaggcaaaatgagtggga

SEQ ID NO: 30151 - DNA, 20 bp, Artificial Sequence
  chemically synthesized
gcaggcaaaatgagtgggag

SEQ ID NO: 30152 - DNA, 20 bp, Artificial Sequence
  chemically synthesized
aaatgagtgggagaggacca

SEQ ID NO: 30153 - DNA, 20 bp, Artificial Sequence
  chemically synthesized
gggagaggaccacagatcca

SEQ ID NO: 30154 - DNA, 20 bp, Artificial Sequence
  chemically synthesized
agaggaccacagatccacag

SEQ ID NO: 30155 - DNA, 20 bp, Artificial Sequence
  chemically synthesized
gaggaccacagatccacagt

SEQ ID NO: 30156 - DNA, 20 bp, Artificial Sequence
  chemically synthesized
aggaccacagatccacagta

SEQ ID NO: 30157 - DNA, 20 bp, Artificial Sequence
  chemically synthesized
cacagatccacagtagggaa

SEQ ID NO: 30158 - DNA, 20 bp, Artificial Sequence
  chemically synthesized
ccacagtagggaaaagcctt

SEQ ID NO: 30159 - DNA, 20 bp, Artificial Sequence
  chemically synthesized
cacagtagggaaaagccttc

SEQ ID NO: 30160 - DNA, 20 bp, Artificial Sequence
  chemically synthesized
cagtagggaaaagccttcag

SEQ ID NO: 30161 - DNA, 20 bp, Artificial Sequence
  chemically synthesized
agtagggaaaagccttcagg

SEQ ID NO: 30162 - DNA, 20 bp, Artificial Sequence
  chemically synthesized
tagggaaaagccttcaggag

SEQ ID NO: 30163 - DNA, 20 bp, Artificial Sequence
  chemically synthesized
agggaaaagccttcaggagg

SEQ ID NO: 30164 - DNA, 20 bp, Artificial Sequence
  chemically synthesized
agccttcaggaggaggacaa

SEQ ID NO: 30165 - DNA, 20 bp, Artificial Sequence
  chemically synthesized
gccttcaggaggaggacaat

SEQ ID NO: 30166 - DNA, 20 bp, Artificial Sequence
  chemically synthesized
ccttcaggaggaggacaata

SEQ ID NO: 30167 - DNA, 20 bp, Artificial Sequence
  chemically synthesized
caggaggaggacaataggga

SEQ ID NO: 30168 - DNA, 20 bp, Artificial Sequence
  chemically synthesized
gaggaggacaatagggatag

SEQ ID NO: 30169 - DNA, 20 bp, Artificial Sequence
  chemically synthesized
gacaatagggatagtggcca

SEQ ID NO: 30170 - DNA, 20 bp, Artificial Sequence
  chemically synthesized
acaatagggatagtggccac

SEQ ID NO: 30171 - DNA, 20 bp, Artificial Sequence
  chemically synthesized
ggatagtggccacaggtccc

SEQ ID NO: 30172 - DNA, 20 bp, Artificial Sequence
  chemically synthesized
tagtggccacaggtccccgg

SEQ ID NO: 30173 - DNA, 20 bp, Artificial Sequence
  chemically synthesized
ggtccccggaagatgacaat

SEQ ID NO: 30174 - DNA, 20 bp, Artificial Sequence
  chemically synthesized
gtccccggaagatgacaatt

SEQ ID NO: 30175 - DNA, 20 bp, Artificial Sequence
  chemically synthesized
ggcctgctctgaccacttgc

SEQ ID NO: 30176 - DNA, 20 bp, Artificial Sequence
  chemically synthesized
tgctctgaccacttgctggc

SEQ ID NO: 30177 - DNA, 20 bp, Artificial Sequence
  chemically synthesized
gtgataatgaccgaatacct

SEQ ID NO: 30178 - DNA, 20 bp, Artificial Sequence
  chemically synthesized
gataatgaccgaatacctca

SEQ ID NO: 30179 - DNA, 20 bp, Artificial Sequence
  chemically synthesized
ataatgaccgaatacctcag

SEQ ID NO: 30180 - DNA, 20 bp, Artificial Sequence
  chemically synthesized
taatgaccgaatacctcaga

SEQ ID NO: 30181 - DNA, 20 bp, Artificial Sequence
  chemically synthesized
tgaccgaatacctcagaggg

SEQ ID NO: 30182 - DNA, 20 bp, Artificial Sequence
  chemically synthesized
ccgaatacctcagagggtgg

SEQ ID NO: 30183 - DNA, 20 bp, Artificial Sequence
  chemically synthesized
atacctcagagggtggcaga

SEQ ID NO: 30184 - DNA, 20 bp, Artificial Sequence
  chemically synthesized
agagggtggcagatggccac

SEQ ID NO: 30185 - DNA, 20 bp, Artificial Sequence
  chemically synthesized
gagggtggcagatggccaca

SEQ ID NO: 30186 - DNA, 20 bp, Artificial Sequence
  chemically synthesized
ggtggcagatggccacaagg

SEQ ID NO: 30187 - DNA, 20 bp, Artificial Sequence
  chemically synthesized
agatggccacaaggcggtca

SEQ ID NO: 30188 - DNA, 20 bp, Artificial Sequence
  chemically synthesized
gatggccacaaggcggtcaa

SEQ ID NO: 30189 - DNA, 20 bp, Artificial Sequence
  chemically synthesized
aggcggtcaaaggacatcat

SEQ ID NO: 30190 - DNA, 20 bp, Artificial Sequence
  chemically synthesized
ggcggtcaaaggacatcatg

SEQ ID NO: 30191 - DNA, 20 bp, Artificial Sequence
  chemically synthesized
cggtcaaaggacatcatgag

SEQ ID NO: 30192 - DNA, 20 bp, Artificial Sequence
  chemically synthesized
aggacatcatgaggagcact

SEQ ID NO: 30193 - DNA, 20 bp, Artificial Sequence
  chemically synthesized
ggacatcatgaggagcactg

SEQ ID NO: 30194 - DNA, 20 bp, Artificial Sequence
  chemically synthesized
ggagcactgaggactccatg

SEQ ID NO: 30195 - DNA, 20 bp, Artificial Sequence
  chemically synthesized
gagcactgaggactccatga

SEQ ID NO: 30196 - DNA, 20 bp, Artificial Sequence
  chemically synthesized
tgaggactccatgaaggaaa

SEQ ID NO: 30197 - DNA, 20 bp, Artificial Sequence
  chemically synthesized
aggactccatgaaggaaaaa

SEQ ID NO: 30198 - DNA, 20 bp, Artificial Sequence
  chemically synthesized
actccatgaaggaaaaagag

SEQ ID NO: 30199 - DNA, 20 bp, Artificial Sequence
  chemically synthesized
tgaaggaaaaagagtggatg

SEQ ID NO: 30200 - DNA, 20 bp, Artificial Sequence
  chemically synthesized
aagagtggatgcagaacatc

SEQ ID NO: 30201 - DNA, 20 bp, Artificial Sequence
  chemically synthesized
tctggatttgacacgctcca

SEQ ID NO: 30202 - DNA, 20 bp, Artificial Sequence
  chemically synthesized
ggatttgacacgctccaaag

SEQ ID NO: 30203 - DNA, 20 bp, Artificial Sequence
  chemically synthesized
acgctccaaagtagatacta

SEQ ID NO: 30204 - DNA, 20 bp, Artificial Sequence
  chemically synthesized
cgctccaaagtagatactat

SEQ ID NO: 30205 - DNA, 20 bp, Artificial Sequence
  chemically synthesized
ctccaaagtagatactatgg

SEQ ID NO: 30206 - DNA, 20 bp, Artificial Sequence
  chemically synthesized
agatactatgggagttaaac

SEQ ID NO: 30207 - DNA, 20 bp, Artificial Sequence
  chemically synthesized
tactatgggagttaaaccag

SEQ ID NO: 30208 - DNA, 20 bp, Artificial Sequence
  chemically synthesized
gttaaaccagaagatcccca

SEQ ID NO: 30209 - DNA, 20 bp, Artificial Sequence
  chemically synthesized
aaaccagaagatccccatag

SEQ ID NO: 30210 - DNA, 20 bp, Artificial Sequence
  chemically synthesized
ccagaagatccccatagtgg

SEQ ID NO: 30211 - DNA, 20 bp, Artificial Sequence
  chemically synthesized
cagaagatccccatagtggt

SEQ ID NO: 30212 - DNA, 20 bp, Artificial Sequence
  chemically synthesized
ccccatagtggtgggcaacg

SEQ ID NO: 30213 - DNA, 20 bp, Artificial Sequence
  chemically synthesized
gtgggcaacgtggacacaca

SEQ ID NO: 30214 - DNA, 20 bp, Artificial Sequence
  chemically synthesized
aacgtggacacacacagccc

SEQ ID NO: 30215 - DNA, 20 bp, Artificial Sequence
  chemically synthesized
acgtggacacacacagcccc

SEQ ID NO: 30216 - DNA, 20 bp, Artificial Sequence
  chemically synthesized
ggacacacacagccccaggt

SEQ ID NO: 30217 - DNA, 20 bp, Artificial Sequence
  chemically synthesized
acacacagccccaggtcagt

SEQ ID NO: 30218 - DNA, 20 bp, Artificial Sequence
  chemically synthesized
cacacagccccaggtcagtg

SEQ ID NO: 30219 - DNA, 20 bp, Artificial Sequence
  chemically synthesized
acacagccccaggtcagtga

SEQ ID NO: 30220 - DNA, 20 bp, Artificial Sequence
  chemically synthesized
agccccaggtcagtgagggc

SEQ ID NO: 30221 - DNA, 20 bp, Artificial Sequence
  chemically synthesized
ccaggtcagtgagggccagc

SEQ ID NO: 30222 - DNA, 20 bp, Artificial Sequence
  chemically synthesized
caggtcagtgagggccagca

SEQ ID NO: 30223 - DNA, 20 bp, Artificial Sequence
  chemically synthesized
tcagtgagggccagcaagga

SEQ ID NO: 30224 - DNA, 20 bp, Artificial Sequence
  chemically synthesized
gtgagggccagcaaggatag

SEQ ID NO: 30225 - DNA, 20 bp, Artificial Sequence
  chemically synthesized
gggccagcaaggatagtaga

SEQ ID NO: 30226 - DNA, 20 bp, Artificial Sequence
  chemically synthesized
caaggatagtagatagtaca

SEQ ID NO: 30227 - DNA, 20 bp, Artificial Sequence
  chemically synthesized
aaggatagtagatagtacat

SEQ ID NO: 30228 - DNA, 20 bp, Artificial Sequence
  chemically synthesized
agatagtacatgggtgtgtg

SEQ ID NO: 30229 - DNA, 20 bp, Artificial Sequence
  chemically synthesized
gtacatgggtgtgtgcagac

SEQ ID NO: 30230 - DNA, 20 bp, Artificial Sequence
  chemically synthesized
tacatgggtgtgtgcagacg

SEQ ID NO: 30231 - DNA, 20 bp, Artificial Sequence
  chemically synthesized
acatgggtgtgtgcagacga

SEQ ID NO: 30232 - DNA, 20 bp, Artificial Sequence
  chemically synthesized
gggtgtgtgcagacgagggt

SEQ ID NO: 30233 - DNA, 20 bp, Artificial Sequence
  chemically synthesized
gggttggtcttaataatgat

SEQ ID NO: 30234 - DNA, 20 bp, Artificial Sequence
  chemically synthesized
tcagaatgaaacaattgcct

SEQ ID NO: 30235 - DNA, 20 bp, Artificial Sequence
  chemically synthesized
aatgaaacaattgcctgaga

SEQ ID NO: 30236 - DNA, 20 bp, Artificial Sequence
  chemically synthesized
agatggcaaccatgtacata

SEQ ID NO: 30237 - DNA, 20 bp, Artificial Sequence
  chemically synthesized
caaccatgtacataaagaaa

SEQ ID NO: 30238 - DNA, 20 bp, Artificial Sequence
  chemically synthesized
aaccatgtacataaagaaaa

SEQ ID NO: 30239 - DNA, 20 bp, Artificial Sequence
  chemically synthesized
accatgtacataaagaaaaa

SEQ ID NO: 30240 - DNA, 20 bp, Artificial Sequence
  chemically synthesized
ccatgtacataaagaaaaag

SEQ ID NO: 30241 - DNA, 20 bp, Artificial Sequence
  chemically synthesized
agaaaaaggggatgaaaatc

SEQ ID NO: 30242 - DNA, 20 bp, Artificial Sequence
  chemically synthesized
gtgtttgatgccttccaatc

SEQ ID NO: 30243 - DNA, 20 bp, Artificial Sequence
  chemically synthesized
tgtttgatgccttccaatcc

SEQ ID NO: 30244 - DNA, 20 bp, Artificial Sequence
  chemically synthesized
tgatgccttccaatccagga

SEQ ID NO: 30245 - DNA, 20 bp, Artificial Sequence
  chemically synthesized
gccttccaatccaggaaagc

SEQ ID NO: 30246 - DNA, 20 bp, Artificial Sequence
  chemically synthesized
tccaatccaggaaagctggt

SEQ ID NO: 30247 - DNA, 20 bp, Artificial Sequence
  chemically synthesized
atccaggaaagctggtgaga

SEQ ID NO: 30248 - DNA, 20 bp, Artificial Sequence
  chemically synthesized
aaagctggtgagatagaata

SEQ ID NO: 30249 - DNA, 20 bp, Artificial Sequence
  chemically synthesized
aagctggtgagatagaatat

SEQ ID NO: 30250 - DNA, 20 bp, Artificial Sequence
  chemically synthesized
agctggtgagatagaatatg

SEQ ID NO: 30251 - DNA, 20 bp, Artificial Sequence
  chemically synthesized
atagaatatggggctaaact

SEQ ID NO: 30252 - DNA, 20 bp, Artificial Sequence
  chemically synthesized
ggggctaaactgagtaatgt

SEQ ID NO: 30253 - DNA, 20 bp, Artificial Sequence
  chemically synthesized
ctaaactgagtaatgttgga

SEQ ID NO: 30254 - DNA, 20 bp, Artificial Sequence
  chemically synthesized
aactgagtaatgttggatag

SEQ ID NO: 30255 - DNA, 20 bp, Artificial Sequence
  chemically synthesized
gttggatagcagcatgaatt

SEQ ID NO: 30256 - DNA, 20 bp, Artificial Sequence
  chemically synthesized
ttggatagcagcatgaattg

SEQ ID NO: 30257 - DNA, 20 bp, Artificial Sequence
  chemically synthesized
agcagcatgaattgaggact

SEQ ID NO: 30258 - DNA, 20 bp, Artificial Sequence
  chemically synthesized
attgaggactgagcgaatat

SEQ ID NO: 30259 - DNA, 20 bp, Artificial Sequence
  chemically synthesized
aatattggactgacattcct

SEQ ID NO: 30260 - DNA, 20 bp, Artificial Sequence
  chemically synthesized
atattggactgacattcctc

SEQ ID NO: 30261 - DNA, 20 bp, Artificial Sequence
  chemically synthesized
tattggactgacattcctcg

SEQ ID NO: 30262 - DNA, 20 bp, Artificial Sequence
  chemically synthesized
actgacattcctcggggatt

SEQ ID NO: 30263 - DNA, 20 bp, Artificial Sequence
  chemically synthesized
gggattgagctgaaaataaa

SEQ ID NO: 30264 - DNA, 20 bp, Artificial Sequence
  chemically synthesized
tgaaaataaatggatatttc

SEQ ID NO: 30265 - DNA, 20 bp, Artificial Sequence
  chemically synthesized
atttctggttattaattctt

SEQ ID NO: 30266 - DNA, 20 bp, Artificial Sequence
  chemically synthesized
actaacattcacaacatcac

SEQ ID NO: 30267 - DNA, 20 bp, Artificial Sequence
  chemically synthesized
aacattcacaacatcacaag

SEQ ID NO: 30268 - DNA, 20 bp, Artificial Sequence
  chemically synthesized
caacatcacaagcagtacca

SEQ ID NO: 30269 - DNA, 20 bp, Artificial Sequence
  chemically synthesized
accatggtcatcatcacctt

SEQ ID NO: 30270 - DNA, 20 bp, Artificial Sequence
  chemically synthesized
tttgataacctcgccctcac

SEQ ID NO: 30271 - DNA, 20 bp, Artificial Sequence
  chemically synthesized
cctctgtatttcaattattt

SEQ ID NO: 30272 - DNA, 20 bp, Artificial Sequence
  chemically synthesized
gttcctctctgcctctttgc

SEQ ID NO: 30273 - DNA, 20 bp, Artificial Sequence
  chemically synthesized
gcctttattgctcaaccctt

SEQ ID NO: 30274 - DNA, 20 bp, Artificial Sequence
  chemically synthesized
tattgctcaacccttaagta

SEQ ID NO: 30275 - DNA, 20 bp, Artificial Sequence
  chemically synthesized
agtatagttcttcccatcct

SEQ ID NO: 30276 - DNA, 20 bp, Artificial Sequence
  chemically synthesized
tcccatccttggcaatttcc

SEQ ID NO: 30277 - DNA, 20 bp, Artificial Sequence
  chemically synthesized
aaataacaaatatataattc

SEQ ID NO: 30278 - DNA, 20 bp, Artificial Sequence
  chemically synthesized
tctttctctcttttgatttc

SEQ ID NO: 30279 - DNA, 20 bp, Artificial Sequence
  chemically synthesized
ctcttttgatttccagactc

SEQ ID NO: 30280 - DNA, 20 bp, Artificial Sequence
  chemically synthesized
atctgtacttttcattatct

SEQ ID NO: 30281 - DNA, 20 bp, Artificial Sequence
  chemically synthesized
tgtacttttcattatctcag

SEQ ID NO: 30282 - DNA, 20 bp, Artificial Sequence
  chemically synthesized
tttcattatctcagtggctc

SEQ ID NO: 30283 - DNA, 20 bp, Artificial Sequence
  chemically synthesized
tcaaatgtcatgttttatgt

SEQ ID NO: 30284 - DNA, 20 bp, Artificial Sequence
  chemically synthesized
ctccatatcacatctctcca

SEQ ID NO: 30285 - DNA, 20 bp, Artificial Sequence
  chemically synthesized
tatctaatcaaccaatcacc

SEQ ID NO: 30286 - DNA, 20 bp, Artificial Sequence
  chemically synthesized
atcaaccaatcaccaagtcc

SEQ ID NO: 30287 - DNA, 20 bp, Artificial Sequence
  chemically synthesized
tcaaccaatcaccaagtcct

SEQ ID NO: 30288 - DNA, 20 bp, Artificial Sequence
  chemically synthesized
caaccaatcaccaagtccta

SEQ ID NO: 30289 - DNA, 20 bp, Artificial Sequence
  chemically synthesized
ttctgtttactgaatacctc

SEQ ID NO: 30290 - DNA, 20 bp, Artificial Sequence
  chemically synthesized
tcattgatgctattctaatt

SEQ ID NO: 30291 - DNA, 20 bp, Artificial Sequence
  chemically synthesized
tctaattcagatcactcttt

SEQ ID NO: 30292 - DNA, 20 bp, Artificial Sequence
  chemically synthesized
ctaattcagatcactctttc

SEQ ID NO: 30293 - DNA, 20 bp, Artificial Sequence
  chemically synthesized
tcactctttcaggactattc

SEQ ID NO: 30294 - DNA, 20 bp, Artificial Sequence
  chemically synthesized
atcttttgtactactgtatt

SEQ ID NO: 30295 - DNA, 20 bp, Artificial Sequence
  chemically synthesized
gtattcagttgactactata

SEQ ID NO: 30296 - DNA, 20 bp, Artificial Sequence
  chemically synthesized
tcagttgactactatatagc

SEQ ID NO: 30297 - DNA, 20 bp, Artificial Sequence
  chemically synthesized
agttgactactatatagcaa

SEQ ID NO: 30298 - DNA, 20 bp, Artificial Sequence
  chemically synthesized
ttgactactatatagcaaga

SEQ ID NO: 30299 - DNA, 20 bp, Artificial Sequence
  chemically synthesized
agagagacgtatacataaac

SEQ ID NO: 30300 - DNA, 20 bp, Artificial Sequence
  chemically synthesized
acataaacaagtttttaatg

SEQ ID NO: 30301 - DNA, 20 bp, Artificial Sequence
  chemically synthesized
aagtttttaatgaagtaaaa

SEQ ID NO: 30302 - DNA, 20 bp, Artificial Sequence
  chemically synthesized
agtttttaatgaagtaaaaa

SEQ ID NO: 30303 - DNA, 20 bp, Artificial Sequence
  chemically synthesized
aaaggtttaaaatgacattc

SEQ ID NO: 30304 - DNA, 20 bp, Artificial Sequence
  chemically synthesized
taatttcctctgtatattca

SEQ ID NO: 30305 - DNA, 20 bp, Artificial Sequence
  chemically synthesized
atgacactaaacaattcttc

SEQ ID NO: 30306 - DNA, 20 bp, Artificial Sequence
  chemically synthesized
aacaattcttccagtttatc

SEQ ID NO: 30307 - DNA, 20 bp, Artificial Sequence
  chemically synthesized
ttatctagtatgcttgctca

SEQ ID NO: 30308 - DNA, 20 bp, Artificial Sequence
  chemically synthesized
tatctagtatgcttgctcat

SEQ ID NO: 30309 - DNA, 20 bp, Artificial Sequence
  chemically synthesized
atttgtattttcattcttcc

SEQ ID NO: 30310 - DNA, 20 bp, Artificial Sequence
  chemically synthesized
aaaaacattttttcctgaaa

SEQ ID NO: 30311 - DNA, 20 bp, Artificial Sequence
  chemically synthesized
gctttcccttaatctttgtc

SEQ ID NO: 30312 - DNA, 20 bp, Artificial Sequence
  chemically synthesized
tctactaatataacccacct

SEQ ID NO: 30313 - DNA, 20 bp, Artificial Sequence
  chemically synthesized
taatataacccaccttagct

SEQ ID NO: 30314 - DNA, 20 bp, Artificial Sequence
  chemically synthesized
agcttagatatgatgtcctt

SEQ ID NO: 30315 - DNA, 20 bp, Artificial Sequence
  chemically synthesized
ttagatatgatgtccttcag

SEQ ID NO: 30316 - DNA, 20 bp, Artificial Sequence
  chemically synthesized
tagatatgatgtccttcaga

SEQ ID NO: 30317 - DNA, 20 bp, Artificial Sequence
  chemically synthesized
aaggccttcttaaattcccc

SEQ ID NO: 30318 - DNA, 20 bp, Artificial Sequence
  chemically synthesized
cttcttaaattccccaagtt

SEQ ID NO: 30319 - DNA, 20 bp, Artificial Sequence
  chemically synthesized
ccctctcctatgtgttcctg

SEQ ID NO: 30320 - DNA, 20 bp, Artificial Sequence
  chemically synthesized
ttaccatgatattttccctg

SEQ ID NO: 30321 - DNA, 20 bp, Artificial Sequence
  chemically synthesized
tctataatgtgaattccttg

SEQ ID NO: 30322 - DNA, 20 bp, Artificial Sequence
  chemically synthesized
ctcttttttaattttaatat

SEQ ID NO: 30323 - DNA, 20 bp, Artificial Sequence
  chemically synthesized
tttaattttaatattagctc

SEQ ID NO: 30324 - DNA, 20 bp, Artificial Sequence
  chemically synthesized
ttaattttaatattagctct

SEQ ID NO: 30325 - DNA, 20 bp, Artificial Sequence
  chemically synthesized
taattttaatattagctcta

SEQ ID NO: 30326 - DNA, 20 bp, Artificial Sequence
  chemically synthesized
gctctagggattgacttttt

SEQ ID NO: 30327 - DNA, 20 bp, Artificial Sequence
  chemically synthesized
ttttttagccaccatatcat

SEQ ID NO: 30328 - DNA, 20 bp, Artificial Sequence
  chemically synthesized
catattgaaattgtattaca

SEQ ID NO: 30329 - DNA, 20 bp, Artificial Sequence
  chemically synthesized
attgaaattgtattacatgg

SEQ ID NO: 30330 - DNA, 20 bp, Artificial Sequence
  chemically synthesized
catggcagacataattctat

SEQ ID NO: 30331 - DNA, 20 bp, Artificial Sequence
  chemically synthesized
atggcagacataattctatt

SEQ ID NO: 30332 - DNA, 20 bp, Artificial Sequence
  chemically synthesized
cagacataattctattaggt

SEQ ID NO: 30333 - DNA, 20 bp, Artificial Sequence
  chemically synthesized
attctattaggttggtgcaa

SEQ ID NO: 30334 - DNA, 20 bp, Artificial Sequence
  chemically synthesized
ggttggtgcaaaagtaattg

SEQ ID NO: 30335 - DNA, 20 bp, Artificial Sequence
  chemically synthesized
gtttttaccattactttcaa

SEQ ID NO: 30336 - DNA, 20 bp, Artificial Sequence
  chemically synthesized
ttaccattactttcaatggc

SEQ ID NO: 30337 - DNA, 20 bp, Artificial Sequence
  chemically synthesized
actgcaattacttttacacc

SEQ ID NO: 30338 - DNA, 20 bp, Artificial Sequence
  chemically synthesized
ctgcaattacttttacacct

SEQ ID NO: 30339 - DNA, 20 bp, Artificial Sequence
  chemically synthesized
ggtactgaaaatacaatgaa

SEQ ID NO: 30340 - DNA, 20 bp, Artificial Sequence
  chemically synthesized
gaaaatacaatgaacagaaa

SEQ ID NO: 30341 - DNA, 20 bp, Artificial Sequence
  chemically synthesized
tacaatgaacagaaacagaa

SEQ ID NO: 30342 - DNA, 20 bp, Artificial Sequence
  chemically synthesized
caatgaacagaaacagaaca

SEQ ID NO: 30343 - DNA, 20 bp, Artificial Sequence
  chemically synthesized
atacatacatactgcaatgc

SEQ ID NO: 30344 - DNA, 20 bp, Artificial Sequence
  chemically synthesized
tacatacatactgcaatgca

SEQ ID NO: 30345 - DNA, 20 bp, Artificial Sequence
  chemically synthesized
caaggtaatgtaatgcaata

SEQ ID NO: 30346 - DNA, 20 bp, Artificial Sequence
  chemically synthesized
ggtaatgtaatgcaataaag

SEQ ID NO: 30347 - DNA, 20 bp, Artificial Sequence
  chemically synthesized
aatgtaatgcaataaagaag

SEQ ID NO: 30348 - DNA, 20 bp, Artificial Sequence
  chemically synthesized
atgtaatgcaataaagaagt

SEQ ID NO: 30349 - DNA, 20 bp, Artificial Sequence
  chemically synthesized
tgtaatgcaataaagaagta

SEQ ID NO: 30350 - DNA, 20 bp, Artificial Sequence
  chemically synthesized
taatgcaataaagaagtagg

SEQ ID NO: 30351 - DNA, 20 bp, Artificial Sequence
  chemically synthesized
caataaagaagtagggagca

SEQ ID NO: 30352 - DNA, 20 bp, Artificial Sequence
  chemically synthesized
aataaagaagtagggagcaa

SEQ ID NO: 30353 - DNA, 20 bp, Artificial Sequence
  chemically synthesized
taaagaagtagggagcaaag

SEQ ID NO: 30354 - DNA, 20 bp, Artificial Sequence
  chemically synthesized
aaagaagtagggagcaaagg

SEQ ID NO: 30355 - DNA, 20 bp, Artificial Sequence
  chemically synthesized
gaagtagggagcaaaggagg

SEQ ID NO: 30356 - DNA, 20 bp, Artificial Sequence
  chemically synthesized
aagtagggagcaaaggagga

SEQ ID NO: 30357 - DNA, 20 bp, Artificial Sequence
  chemically synthesized
agggagcaaaggaggaaggt

SEQ ID NO: 30358 - DNA, 20 bp, Artificial Sequence
  chemically synthesized
ggagcaaaggaggaaggtaa

SEQ ID NO: 30359 - DNA, 20 bp, Artificial Sequence
  chemically synthesized
taagagtgatgcattttata

SEQ ID NO: 30360 - DNA, 20 bp, Artificial Sequence
  chemically synthesized
aagagtgatgcattttatat

SEQ ID NO: 30361 - DNA, 20 bp, Artificial Sequence
  chemically synthesized
agagtgatgcattttatata

SEQ ID NO: 30362 - DNA, 20 bp, Artificial Sequence
  chemically synthesized
gtgatgcattttatataggg

SEQ ID NO: 30363 - DNA, 20 bp, Artificial Sequence
  chemically synthesized
tgcattttatatagggtagt

SEQ ID NO: 30364 - DNA, 20 bp, Artificial Sequence
  chemically synthesized
cattttatatagggtagtca

SEQ ID NO: 30365 - DNA, 20 bp, Artificial Sequence
  chemically synthesized
tttatatagggtagtcagag

SEQ ID NO: 30366 - DNA, 20 bp, Artificial Sequence
  chemically synthesized
tagtcagagaagacctctct

SEQ ID NO: 30367 - DNA, 20 bp, Artificial Sequence
  chemically synthesized
tcagagaagacctctctgag

SEQ ID NO: 30368 - DNA, 20 bp, Artificial Sequence
  chemically synthesized
cagagaagacctctctgagt

SEQ ID NO: 30369 - DNA, 20 bp, Artificial Sequence
  chemically synthesized
cctctctgagtaggtaattt

SEQ ID NO: 30370 - DNA, 20 bp, Artificial Sequence
  chemically synthesized
tctctgagtaggtaatttta

SEQ ID NO: 30371 - DNA, 20 bp, Artificial Sequence
  chemically synthesized
ctgagtaggtaattttagag

SEQ ID NO: 30372 - DNA, 20 bp, Artificial Sequence
  chemically synthesized
tttagagaagaaatcaaaat

SEQ ID NO: 30373 - DNA, 20 bp, Artificial Sequence
  chemically synthesized
tagagaagaaatcaaaatca

SEQ ID NO: 30374 - DNA, 20 bp, Artificial Sequence
  chemically synthesized
agagaagaaatcaaaatcag

SEQ ID NO: 30375 - DNA, 20 bp, Artificial Sequence
  chemically synthesized
gagaagaaatcaaaatcaga

SEQ ID NO: 30376 - DNA, 20 bp, Artificial Sequence
  chemically synthesized
agaaatcaaaatcagagggc

SEQ ID NO: 30377 - DNA, 20 bp, Artificial Sequence
  chemically synthesized
aaaatcagagggcaagtgtg

SEQ ID NO: 30378 - DNA, 20 bp, Artificial Sequence
  chemically synthesized
gggcaagtgtgtggctatct

SEQ ID NO: 30379 - DNA, 20 bp, Artificial Sequence
  chemically synthesized
ggcaagtgtgtggctatctt

SEQ ID NO: 30380 - DNA, 20 bp, Artificial Sequence
  chemically synthesized
gcaagtgtgtggctatctta

SEQ ID NO: 30381 - DNA, 20 bp, Artificial Sequence
  chemically synthesized
tatcttagggaaaaacattc

SEQ ID NO: 30382 - DNA, 20 bp, Artificial Sequence
  chemically synthesized
atcttagggaaaaacattca

SEQ ID NO: 30383 - DNA, 20 bp, Artificial Sequence
  chemically synthesized
ttagggaaaaacattcaagg

SEQ ID NO: 30384 - DNA, 20 bp, Artificial Sequence
  chemically synthesized
tagggaaaaacattcaagga

SEQ ID NO: 30385 - DNA, 20 bp, Artificial Sequence
  chemically synthesized
gggaaaaacattcaaggaag

SEQ ID NO: 30386 - DNA, 20 bp, Artificial Sequence
  chemically synthesized
ggaaaaacattcaaggaagg

SEQ ID NO: 30387 - DNA, 20 bp, Artificial Sequence
  chemically synthesized
aaaacattcaaggaaggagg

SEQ ID NO: 30388 - DNA, 20 bp, Artificial Sequence
  chemically synthesized
ttcaaggaaggaggaagaac

SEQ ID NO: 30389 - DNA, 20 bp, Artificial Sequence
  chemically synthesized
gaaggaggaagaacaagtga

SEQ ID NO: 30390 - DNA, 20 bp, Artificial Sequence
  chemically synthesized
agaacaagtgaaagttcctg

SEQ ID NO: 30391 - DNA, 20 bp, Artificial Sequence
  chemically synthesized
acaagtgaaagttcctgaag

SEQ ID NO: 30392 - DNA, 20 bp, Artificial Sequence
  chemically synthesized
aagtgaaagttcctgaagca

SEQ ID NO: 30393 - DNA, 20 bp, Artificial Sequence
  chemically synthesized
gtgaaagttcctgaagcaga

SEQ ID NO: 30394 - DNA, 20 bp, Artificial Sequence
  chemically synthesized
aaagttcctgaagcagagag

SEQ ID NO: 30395 - DNA, 20 bp, Artificial Sequence
  chemically synthesized
gaagcagagagcagcttgac

SEQ ID NO: 30396 - DNA, 20 bp, Artificial Sequence
  chemically synthesized
gagcagcttgacaagtttaa

SEQ ID NO: 30397 - DNA, 20 bp, Artificial Sequence
  chemically synthesized
ttgacaagtttaaaagacaa

SEQ ID NO: 30398 - DNA, 20 bp, Artificial Sequence
  chemically synthesized
acaagtttaaaagacaaaag

SEQ ID NO: 30399 - DNA, 20 bp, Artificial Sequence
  chemically synthesized
caagtttaaaagacaaaaga

SEQ ID NO: 30400 - DNA, 20 bp, Artificial Sequence
  chemically synthesized
gaaggccaatgtatattcaa

SEQ ID NO: 30401 - DNA, 20 bp, Artificial Sequence
  chemically synthesized
aggccaatgtatattcaatg

SEQ ID NO: 30402 - DNA, 20 bp, Artificial Sequence
  chemically synthesized
ggccaatgtatattcaatgg

SEQ ID NO: 30403 - DNA, 20 bp, Artificial Sequence
  chemically synthesized
caatgtatattcaatggagg

SEQ ID NO: 30404 - DNA, 20 bp, Artificial Sequence
  chemically synthesized
gtatattcaatggaggaagc

SEQ ID NO: 30405 - DNA, 20 bp, Artificial Sequence
  chemically synthesized
tatattcaatggaggaagca

SEQ ID NO: 30406 - DNA, 20 bp, Artificial Sequence
  chemically synthesized
attcaatggaggaagcaagg

SEQ ID NO: 30407 - DNA, 20 bp, Artificial Sequence
  chemically synthesized
ttcaatggaggaagcaaggt

SEQ ID NO: 30408 - DNA, 20 bp, Artificial Sequence
  chemically synthesized
tcaatggaggaagcaaggtg

SEQ ID NO: 30409 - DNA, 20 bp, Artificial Sequence
  chemically synthesized
ggaggaagcaaggtggggaa

SEQ ID NO: 30410 - DNA, 20 bp, Artificial Sequence
  chemically synthesized
ggaagcaaggtggggaatgg

SEQ ID NO: 30411 - DNA, 20 bp, Artificial Sequence
  chemically synthesized
aatggtggcaaatccacttg

SEQ ID NO: 30412 - DNA, 20 bp, Artificial Sequence
  chemically synthesized
ggtggcaaatccacttgaag

SEQ ID NO: 30413 - DNA, 20 bp, Artificial Sequence
  chemically synthesized
ggcaaatccacttgaagtag

SEQ ID NO: 30414 - DNA, 20 bp, Artificial Sequence
  chemically synthesized
ctacgtcatgtatgatcttg

SEQ ID NO: 30415 - DNA, 20 bp, Artificial Sequence
  chemically synthesized
tacgtcatgtatgatcttgc

SEQ ID NO: 30416 - DNA, 20 bp, Artificial Sequence
  chemically synthesized
tatgatcttgcaggtcacgc

SEQ ID NO: 30417 - DNA, 20 bp, Artificial Sequence
  chemically synthesized
ttgaattttattatacttgt

SEQ ID NO: 30418 - DNA, 20 bp, Artificial Sequence
  chemically synthesized
ttattatacttgtgagcttc

SEQ ID NO: 30419 - DNA, 20 bp, Artificial Sequence
  chemically synthesized
atacttgtgagcttcgagtt

SEQ ID NO: 30420 - DNA, 20 bp, Artificial Sequence
  chemically synthesized
acttgtgagcttcgagttga

SEQ ID NO: 30421 - DNA, 20 bp, Artificial Sequence
  chemically synthesized
tgtgagcttcgagttgagag

SEQ ID NO: 30422 - DNA, 20 bp, Artificial Sequence
  chemically synthesized
tgagcttcgagttgagagca

SEQ ID NO: 30423 - DNA, 20 bp, Artificial Sequence
  chemically synthesized
gagcttcgagttgagagcag

SEQ ID NO: 30424 - DNA, 20 bp, Artificial Sequence
  chemically synthesized
ttgagagcagaggtgctgca

SEQ ID NO: 30425 - DNA, 20 bp, Artificial Sequence
  chemically synthesized
cagaggtgctgcatggatat

SEQ ID NO: 30426 - DNA, 20 bp, Artificial Sequence
  chemically synthesized
agaggtgctgcatggatata

SEQ ID NO: 30427 - DNA, 20 bp, Artificial Sequence
  chemically synthesized
atataaggcttacatcactt

SEQ ID NO: 30428 - DNA, 20 bp, Artificial Sequence
  chemically synthesized
aaggcttacatcactttggc

SEQ ID NO: 30429 - DNA, 20 bp, Artificial Sequence
  chemically synthesized
aggcttacatcactttggca

SEQ ID NO: 30430 - DNA, 20 bp, Artificial Sequence
  chemically synthesized
ggcttacatcactttggcaa

SEQ ID NO: 30431 - DNA, 20 bp, Artificial Sequence
  chemically synthesized
gcttacatcactttggcaag

SEQ ID NO: 30432 - DNA, 20 bp, Artificial Sequence
  chemically synthesized
ctttggcaaggggtaaaaaa

SEQ ID NO: 30433 - DNA, 20 bp, Artificial Sequence
  chemically synthesized
ttttccatttctttacttct

SEQ ID NO: 30434 - DNA, 20 bp, Artificial Sequence
  chemically synthesized
tgttttttttaaaacccact

SEQ ID NO: 30435 - DNA, 20 bp, Artificial Sequence
  chemically synthesized
ttttaaaacccacttagcta

SEQ ID NO: 30436 - DNA, 20 bp, Artificial Sequence
  chemically synthesized
gcaatgctccttaaattcac

SEQ ID NO: 30437 - DNA, 20 bp, Artificial Sequence
  chemically synthesized
ttaaattcaccagtgacttc

SEQ ID NO: 30438 - DNA, 20 bp, Artificial Sequence
  chemically synthesized
taaattcaccagtgacttct

SEQ ID NO: 30439 - DNA, 20 bp, Artificial Sequence
  chemically synthesized
aaattcaccagtgacttcta

SEQ ID NO: 30440 - DNA, 20 bp, Artificial Sequence
  chemically synthesized
aattcaccagtgacttctag

SEQ ID NO: 30441 - DNA, 20 bp, Artificial Sequence
  chemically synthesized
cttctaggggccaaatgcaa

SEQ ID NO: 30442 - DNA, 20 bp, Artificial Sequence
  chemically synthesized
tctaggggccaaatgcaatg

SEQ ID NO: 30443 - DNA, 20 bp, Artificial Sequence
  chemically synthesized
taggggccaaatgcaatgga

SEQ ID NO: 30444 - DNA, 20 bp, Artificial Sequence
  chemically synthesized
ttattgatttttttgtgcaa

SEQ ID NO: 30445 - DNA, 20 bp, Artificial Sequence
  chemically synthesized
tgtgcaatagttgtgtgctc

SEQ ID NO: 30446 - DNA, 20 bp, Artificial Sequence
  chemically synthesized
tctggccatgccttcctttt

SEQ ID NO: 30447 - DNA, 20 bp, Artificial Sequence
  chemically synthesized
tggccatgccttccttttta

SEQ ID NO: 30448 - DNA, 20 bp, Artificial Sequence
  chemically synthesized
ttcctttttagagctctctc

SEQ ID NO: 30449 - DNA, 20 bp, Artificial Sequence
  chemically synthesized
ctctagaaattcttaatgcc

SEQ ID NO: 30450 - DNA, 20 bp, Artificial Sequence
  chemically synthesized
ttcttaatgccaagatctgc

SEQ ID NO: 30451 - DNA, 20 bp, Artificial Sequence
  chemically synthesized
ttctcttctgatttttgtga

SEQ ID NO: 30452 - DNA, 20 bp, Artificial Sequence
  chemically synthesized
gctcaaatatttatgttatt

SEQ ID NO: 30453 - DNA, 20 bp, Artificial Sequence
  chemically synthesized
tattattattattacttata

SEQ ID NO: 30454 - DNA, 20 bp, Artificial Sequence
  chemically synthesized
tattattattacttatacag

SEQ ID NO: 30455 - DNA, 20 bp, Artificial Sequence
  chemically synthesized
tattattacttatacagtgg

SEQ ID NO: 30456 - DNA, 20 bp, Artificial Sequence
  chemically synthesized
acttatacagtggtggctct

SEQ ID NO: 30457 - DNA, 20 bp, Artificial Sequence
  chemically synthesized
ggctcttagacattaatctc

SEQ ID NO: 30458 - DNA, 20 bp, Artificial Sequence
  chemically synthesized
ttagacattaatctctagtc

SEQ ID NO: 30459 - DNA, 20 bp, Artificial Sequence
  chemically synthesized
cagataactccgttacatat

SEQ ID NO: 30460 - DNA, 20 bp, Artificial Sequence
  chemically synthesized
agataactccgttacatatc

SEQ ID NO: 30461 - DNA, 20 bp, Artificial Sequence
  chemically synthesized
ctccgttacatatcaggcct

SEQ ID NO: 30462 - DNA, 20 bp, Artificial Sequence
  chemically synthesized
ctgagtttctgccttctcac

SEQ ID NO: 30463 - DNA, 20 bp, Artificial Sequence
  chemically synthesized
tgagtttctgccttctcact

SEQ ID NO: 30464 - DNA, 20 bp, Artificial Sequence
  chemically synthesized
ttctcactaggtgtttccaa

SEQ ID NO: 30465 - DNA, 20 bp, Artificial Sequence
  chemically synthesized
tctcactaggtgtttccaaa

SEQ ID NO: 30466 - DNA, 20 bp, Artificial Sequence
  chemically synthesized
aactcaacacgtctaatatt

SEQ ID NO: 30467 - DNA, 20 bp, Artificial Sequence
  chemically synthesized
aacacgtctaatattgagcc

SEQ ID NO: 30468 - DNA, 20 bp, Artificial Sequence
  chemically synthesized
ttcaccatttcctgccattc

SEQ ID NO: 30469 - DNA, 20 bp, Artificial Sequence
  chemically synthesized
ccattcaagacaacattttt

SEQ ID NO: 30470 - DNA, 20 bp, Artificial Sequence
  chemically synthesized
tctgtatctaatttttaact

SEQ ID NO: 30471 - DNA, 20 bp, Artificial Sequence
  chemically synthesized
tctattcatcttcatctctg

SEQ ID NO: 30472 - DNA, 20 bp, Artificial Sequence
  chemically synthesized
gtagccaatgtccttgttct

SEQ ID NO: 30473 - DNA, 20 bp, Artificial Sequence
  chemically synthesized
gacctgtcattcaacatgca

SEQ ID NO: 30474 - DNA, 20 bp, Artificial Sequence
  chemically synthesized
tgtcattcaacatgcaaagc

SEQ ID NO: 30475 - DNA, 20 bp, Artificial Sequence
  chemically synthesized
gtcattcaacatgcaaagcc

SEQ ID NO: 30476 - DNA, 20 bp, Artificial Sequence
  chemically synthesized
agccaggctcctccttccct

SEQ ID NO: 30477 - DNA, 20 bp, Artificial Sequence
  chemically synthesized
ccttggtccatcctctactg

SEQ ID NO: 30478 - DNA, 20 bp, Artificial Sequence
  chemically synthesized
catcctctactgcagccacc

SEQ ID NO: 30479 - DNA, 20 bp, Artificial Sequence
  chemically synthesized
ctgcagccaccgagattatg

SEQ ID NO: 30480 - DNA, 20 bp, Artificial Sequence
  chemically synthesized
agccaccgagattatgcaga

SEQ ID NO: 30481 - DNA, 20 bp, Artificial Sequence
  chemically synthesized
atgaatcactgcactgtttt

SEQ ID NO: 30482 - DNA, 20 bp, Artificial Sequence
  chemically synthesized
ctgcactgttttcagtactt

SEQ ID NO: 30483 - DNA, 20 bp, Artificial Sequence
  chemically synthesized
cactgttttcagtacttcag

SEQ ID NO: 30484 - DNA, 20 bp, Artificial Sequence
  chemically synthesized
acttcagtagctcctatcat

SEQ ID NO: 30485 - DNA, 20 bp, Artificial Sequence
  chemically synthesized
tagctcctatcattagaata

SEQ ID NO: 30486 - DNA, 20 bp, Artificial Sequence
  chemically synthesized
aataaagttcaaacttgtaa

SEQ ID NO: 30487 - DNA, 20 bp, Artificial Sequence
  chemically synthesized
tcaaacttgtaaaagatctg

SEQ ID NO: 30488 - DNA, 20 bp, Artificial Sequence
  chemically synthesized
ttgtaaaagatctgtggtga

SEQ ID NO: 30489 - DNA, 20 bp, Artificial Sequence
  chemically synthesized
tggtgatagtccaatttatt

SEQ ID NO: 30490 - DNA, 20 bp, Artificial Sequence
  chemically synthesized
ggtgatagtccaatttattg

SEQ ID NO: 30491 - DNA, 20 bp, Artificial Sequence
  chemically synthesized
tattgaggccatacatgatt

SEQ ID NO: 30492 - DNA, 20 bp, Artificial Sequence
  chemically synthesized
catgatttagatgctgtgaa

SEQ ID NO: 30493 - DNA, 20 bp, Artificial Sequence
  chemically synthesized
acattttattactacttcac

SEQ ID NO: 30494 - DNA, 20 bp, Artificial Sequence
  chemically synthesized
cattttattactacttcaca

SEQ ID NO: 30495 - DNA, 20 bp, Artificial Sequence
  chemically synthesized
ttttattactacttcacaag

SEQ ID NO: 30496 - DNA, 20 bp, Artificial Sequence
  chemically synthesized
cacaaggagaaaactacaaa

SEQ ID NO: 30497 - DNA, 20 bp, Artificial Sequence
  chemically synthesized
acaaggagaaaactacaaaa

SEQ ID NO: 30498 - DNA, 20 bp, Artificial Sequence
  chemically synthesized
aaaaggtaaacaatcatccc

SEQ ID NO: 30499 - DNA, 20 bp, Artificial Sequence
  chemically synthesized
aaaggtaaacaatcatccca

SEQ ID NO: 30500 - DNA, 20 bp, Artificial Sequence
  chemically synthesized
taaacaatcatcccaaggcc

SEQ ID NO: 30501 - DNA, 20 bp, Artificial Sequence
  chemically synthesized
acaatcatcccaaggcctgg

SEQ ID NO: 30502 - DNA, 20 bp, Artificial Sequence
  chemically synthesized
tcatcccaaggcctggtagt

SEQ ID NO: 30503 - DNA, 20 bp, Artificial Sequence
  chemically synthesized
gcctggtagtgagcgaaaat

SEQ ID NO: 30504 - DNA, 20 bp, Artificial Sequence
  chemically synthesized
cctggtagtgagcgaaaatc

SEQ ID NO: 30505 - DNA, 20 bp, Artificial Sequence
  chemically synthesized
tagtgagcgaaaatcaggat

SEQ ID NO: 30506 - DNA, 20 bp, Artificial Sequence
  chemically synthesized
aacctttgtctctctatgca

SEQ ID NO: 30507 - DNA, 20 bp, Artificial Sequence
  chemically synthesized
tgtctctctatgcatggccc

SEQ ID NO: 30508 - DNA, 20 bp, Artificial Sequence
  chemically synthesized
ctctctatgcatggccctgg

SEQ ID NO: 30509 - DNA, 20 bp, Artificial Sequence
  chemically synthesized
acaccctgtaacaccatctt

SEQ ID NO: 30510 - DNA, 20 bp, Artificial Sequence
  chemically synthesized
ctgtaacaccatctttagcc

SEQ ID NO: 30511 - DNA, 20 bp, Artificial Sequence
  chemically synthesized
tagcccggtccttcttgttt

SEQ ID NO: 30512 - DNA, 20 bp, Artificial Sequence
  chemically synthesized
tttccaaacccatcttttcc

SEQ ID NO: 30513 - DNA, 20 bp, Artificial Sequence
  chemically synthesized
ttctatatttattgctttct

SEQ ID NO: 30514 - DNA, 20 bp, Artificial Sequence
  chemically synthesized
accacccctgtttttccaac

SEQ ID NO: 30515 - DNA, 20 bp, Artificial Sequence
  chemically synthesized
ttccaaccagtaaacacttg

SEQ ID NO: 30516 - DNA, 20 bp, Artificial Sequence
  chemically synthesized
taaacacttgcggatccttt

SEQ ID NO: 30517 - DNA, 20 bp, Artificial Sequence
  chemically synthesized
cttgcggatcctttaagact

SEQ ID NO: 30518 - DNA, 20 bp, Artificial Sequence
  chemically synthesized
tctctcctgacttccttctg

SEQ ID NO: 30519 - DNA, 20 bp, Artificial Sequence
  chemically synthesized
ctgacttccttctgtagcat

SEQ ID NO: 30520 - DNA, 20 bp, Artificial Sequence
  chemically synthesized
tgacttccttctgtagcatt

SEQ ID NO: 30521 - DNA, 20 bp, Artificial Sequence
  chemically synthesized
catctttctctgttctcacg

SEQ ID NO: 30522 - DNA, 20 bp, Artificial Sequence
  chemically synthesized
agtacctgtaatgtactatt

SEQ ID NO: 30523 - DNA, 20 bp, Artificial Sequence
  chemically synthesized
gtacctgtaatgtactatta

SEQ ID NO: 30524 - DNA, 20 bp, Artificial Sequence
  chemically synthesized
tatacttattgatatatata

SEQ ID NO: 30525 - DNA, 20 bp, Artificial Sequence
  chemically synthesized
acatacttatacatccatat

SEQ ID NO: 30526 - DNA, 20 bp, Artificial Sequence
  chemically synthesized
atataagtacacatatgtat

SEQ ID NO: 30527 - DNA, 20 bp, Artificial Sequence
  chemically synthesized
tataagtttaaataacatat

SEQ ID NO: 30528 - DNA, 20 bp, Artificial Sequence
  chemically synthesized
ttaaataacatataagtgta

SEQ ID NO: 30529 - DNA, 20 bp, Artificial Sequence
  chemically synthesized
atttactcataaatacttta

SEQ ID NO: 30530 - DNA, 20 bp, Artificial Sequence
  chemically synthesized
actttatagaatatacattt

SEQ ID NO: 30531 - DNA, 20 bp, Artificial Sequence
  chemically synthesized
tatattctttatatacttta

SEQ ID NO: 30532 - DNA, 20 bp, Artificial Sequence
  chemically synthesized
tttatagattttttatatat

SEQ ID NO: 30533 - DNA, 20 bp, Artificial Sequence
  chemically synthesized
agattttttatatataagta

SEQ ID NO: 30534 - DNA, 20 bp, Artificial Sequence
  chemically synthesized
gattttttatatataagtat

SEQ ID NO: 30535 - DNA, 20 bp, Artificial Sequence
  chemically synthesized
attttttatatataagtata

SEQ ID NO: 30536 - DNA, 20 bp, Artificial Sequence
  chemically synthesized
aaacaaatatacaaaaatat

SEQ ID NO: 30537 - DNA, 20 bp, Artificial Sequence
  chemically synthesized
tttgtacaacatatatatta

SEQ ID NO: 30538 - DNA, 20 bp, Artificial Sequence
  chemically synthesized
ttgtacaacatatatattat

SEQ ID NO: 30539 - DNA, 20 bp, Artificial Sequence
  chemically synthesized
tacaacatatatattatagg

SEQ ID NO: 30540 - DNA, 20 bp, Artificial Sequence
  chemically synthesized
tattctttattatacatgtt

SEQ ID NO: 30541 - DNA, 20 bp, Artificial Sequence
  chemically synthesized
tttagaacataaatttatat

SEQ ID NO: 30542 - DNA, 20 bp, Artificial Sequence
  chemically synthesized
aacctaataattcatttttt

SEQ ID NO: 30543 - DNA, 20 bp, Artificial Sequence
  chemically synthesized
aattcattttttaagttgat

SEQ ID NO: 30544 - DNA, 20 bp, Artificial Sequence
  chemically synthesized
attttttaagttgattagac

SEQ ID NO: 30545 - DNA, 20 bp, Artificial Sequence
  chemically synthesized
gattagactggaattctcta

SEQ ID NO: 30546 - DNA, 20 bp, Artificial Sequence
  chemically synthesized
attagactggaattctctaa

SEQ ID NO: 30547 - DNA, 20 bp, Artificial Sequence
  chemically synthesized
tggaattctctaaaggcccc

SEQ ID NO: 30548 - DNA, 20 bp, Artificial Sequence
  chemically synthesized
gaattctctaaaggcccctg

SEQ ID NO: 30549 - DNA, 20 bp, Artificial Sequence
  chemically synthesized
taaaggcccctggagcctga

SEQ ID NO: 30550 - DNA, 20 bp, Artificial Sequence
  chemically synthesized
cctggagcctgacagtgtct

SEQ ID NO: 30551 - DNA, 20 bp, Artificial Sequence
  chemically synthesized
gcctgacagtgtctaagatg

SEQ ID NO: 30552 - DNA, 20 bp, Artificial Sequence
  chemically synthesized
tgacagtgtctaagatgtgg

SEQ ID NO: 30553 - DNA, 20 bp, Artificial Sequence
  chemically synthesized
gacagtgtctaagatgtggt

SEQ ID NO: 30554 - DNA, 20 bp, Artificial Sequence
  chemically synthesized
tttttgcatgaaaaactaaa

SEQ ID NO: 30555 - DNA, 20 bp, Artificial Sequence
  chemically synthesized
ttttgcatgaaaaactaaat

SEQ ID NO: 30556 - DNA, 20 bp, Artificial Sequence
  chemically synthesized
actaaatgggtgaataaata

SEQ ID NO: 30557 - DNA, 20 bp, Artificial Sequence
  chemically synthesized
ttatcctgattctttgtgcc

SEQ ID NO: 30558 - DNA, 20 bp, Artificial Sequence
  chemically synthesized
tatcctgattctttgtgcct

SEQ ID NO: 30559 - DNA, 20 bp, Artificial Sequence
  chemically synthesized
atcctgattctttgtgcctg

SEQ ID NO: 30560 - DNA, 20 bp, Artificial Sequence
  chemically synthesized
tgtgcctggggttctgttgt

SEQ ID NO: 30561 - DNA, 20 bp, Artificial Sequence
  chemically synthesized
agctctgtgttcaccaactt

SEQ ID NO: 30562 - DNA, 20 bp, Artificial Sequence
  chemically synthesized
ctctgtgttcaccaacttca

SEQ ID NO: 30563 - DNA, 20 bp, Artificial Sequence
  chemically synthesized
ttcaccaacttcagagtgat

SEQ ID NO: 30564 - DNA, 20 bp, Artificial Sequence
  chemically synthesized
ccaacttcagagtgatgaga

SEQ ID NO: 30565 - DNA, 20 bp, Artificial Sequence
  chemically synthesized
cttcagagtgatgagatgga

SEQ ID NO: 30566 - DNA, 20 bp, Artificial Sequence
  chemically synthesized
ttcagagtgatgagatggac

SEQ ID NO: 30567 - DNA, 20 bp, Artificial Sequence
  chemically synthesized
tcagagtgatgagatggaca

SEQ ID NO: 30568 - DNA, 20 bp, Artificial Sequence
  chemically synthesized
agagtgatgagatggacagg

SEQ ID NO: 30569 - DNA, 20 bp, Artificial Sequence
  chemically synthesized
gtgatgagatggacagggag

SEQ ID NO: 30570 - DNA, 20 bp, Artificial Sequence
  chemically synthesized
tgatgagatggacagggaga

SEQ ID NO: 30571 - DNA, 20 bp, Artificial Sequence
  chemically synthesized
gatggacagggagaaggatc

SEQ ID NO: 30572 - DNA, 20 bp, Artificial Sequence
  chemically synthesized
ggacagggagaaggatctgg

SEQ ID NO: 30573 - DNA, 20 bp, Artificial Sequence
  chemically synthesized
gagaaggatctggtagaaac

SEQ ID NO: 30574 - DNA, 20 bp, Artificial Sequence
  chemically synthesized
gtagaaacaagatgtctata

SEQ ID NO: 30575 - DNA, 20 bp, Artificial Sequence
  chemically synthesized
agaaacaagatgtctataca

SEQ ID NO: 30576 - DNA, 20 bp, Artificial Sequence
  chemically synthesized
tgtctatacagagacaatga

SEQ ID NO: 30577 - DNA, 20 bp, Artificial Sequence
  chemically synthesized
gtctatacagagacaatgac

SEQ ID NO: 30578 - DNA, 20 bp, Artificial Sequence
  chemically synthesized
tctatacagagacaatgaca

SEQ ID NO: 30579 - DNA, 20 bp, Artificial Sequence
  chemically synthesized
tacagagacaatgacagggc

SEQ ID NO: 30580 - DNA, 20 bp, Artificial Sequence
  chemically synthesized
acagagacaatgacagggct

SEQ ID NO: 30581 - DNA, 20 bp, Artificial Sequence
  chemically synthesized
agggctgggattatttctct

SEQ ID NO: 30582 - DNA, 20 bp, Artificial Sequence
  chemically synthesized
ctgggattatttctcttgga

SEQ ID NO: 30583 - DNA, 20 bp, Artificial Sequence
  chemically synthesized
ttggaaagtatacttcctct

SEQ ID NO: 30584 - DNA, 20 bp, Artificial Sequence
  chemically synthesized
tggaaagtatacttcctctt

SEQ ID NO: 30585 - DNA, 20 bp, Artificial Sequence
  chemically synthesized
aaagtatacttcctcttggg

SEQ ID NO: 30586 - DNA, 20 bp, Artificial Sequence
  chemically synthesized
tatacttcctcttgggaaga

SEQ ID NO: 30587 - DNA, 20 bp, Artificial Sequence
  chemically synthesized
tcctcttgggaagaaagctt

SEQ ID NO: 30588 - DNA, 20 bp, Artificial Sequence
  chemically synthesized
cctcttgggaagaaagcttt

SEQ ID NO: 30589 - DNA, 20 bp, Artificial Sequence
  chemically synthesized
ctcttgggaagaaagcttta

SEQ ID NO: 30590 - DNA, 20 bp, Artificial Sequence
  chemically synthesized
tcttgggaagaaagctttag

SEQ ID NO: 30591 - DNA, 20 bp, Artificial Sequence
  chemically synthesized
aagctttaggggatttctcc

SEQ ID NO: 30592 - DNA, 20 bp, Artificial Sequence
  chemically synthesized
tttaggggatttctcctagc

SEQ ID NO: 30593 - DNA, 20 bp, Artificial Sequence
  chemically synthesized
taggggatttctcctagcaa

SEQ ID NO: 30594 - DNA, 20 bp, Artificial Sequence
  chemically synthesized
ggggatttctcctagcaaga

SEQ ID NO: 30595 - DNA, 20 bp, Artificial Sequence
  chemically synthesized
agagagataattatccatga

SEQ ID NO: 30596 - DNA, 20 bp, Artificial Sequence
  chemically synthesized
gagagataattatccatgat

SEQ ID NO: 30597 - DNA, 20 bp, Artificial Sequence
  chemically synthesized
gagataattatccatgatag

SEQ ID NO: 30598 - DNA, 20 bp, Artificial Sequence
  chemically synthesized
gataattatccatgatagga

SEQ ID NO: 30599 - DNA, 20 bp, Artificial Sequence
  chemically synthesized
tatccatgataggagagcaa

SEQ ID NO: 30600 - DNA, 20 bp, Artificial Sequence
  chemically synthesized
gtcattttttcatgtctact

SEQ ID NO: 30601 - DNA, 20 bp, Artificial Sequence
  chemically synthesized
ttttcatgtctactaagcaa

SEQ ID NO: 30602 - DNA, 20 bp, Artificial Sequence
  chemically synthesized
ttcatgtctactaagcaatg

SEQ ID NO: 30603 - DNA, 20 bp, Artificial Sequence
  chemically synthesized
tcatgtctactaagcaatgg

SEQ ID NO: 30604 - DNA, 20 bp, Artificial Sequence
  chemically synthesized
atgtctactaagcaatggag

SEQ ID NO: 30605 - DNA, 20 bp, Artificial Sequence
  chemically synthesized
aagcaatggaggagtccact

SEQ ID NO: 30606 - DNA, 20 bp, Artificial Sequence
  chemically synthesized
gcaatggaggagtccactca

SEQ ID NO: 30607 - DNA, 20 bp, Artificial Sequence
  chemically synthesized
atggaggagtccactcagag

SEQ ID NO: 30608 - DNA, 20 bp, Artificial Sequence
  chemically synthesized
aggagtccactcagagcagt

SEQ ID NO: 30609 - DNA, 20 bp, Artificial Sequence
  chemically synthesized
acaacataattaaaatattc

SEQ ID NO: 30610 - DNA, 20 bp, Artificial Sequence
  chemically synthesized
caacataattaaaatattca

SEQ ID NO: 30611 - DNA, 20 bp, Artificial Sequence
  chemically synthesized
cataattaaaatattcaagg

SEQ ID NO: 30612 - DNA, 20 bp, Artificial Sequence
  chemically synthesized
taattaaaatattcaaggca

SEQ ID NO: 30613 - DNA, 20 bp, Artificial Sequence
  chemically synthesized
ttaaaatattcaaggcagag

SEQ ID NO: 30614 - DNA, 20 bp, Artificial Sequence
  chemically synthesized
aaggcagagtagattcatct

SEQ ID NO: 30615 - DNA, 20 bp, Artificial Sequence
  chemically synthesized
agtagattcatcttagatca

SEQ ID NO: 30616 - DNA, 20 bp, Artificial Sequence
  chemically synthesized
gtagattcatcttagatcac

SEQ ID NO: 30617 - DNA, 20 bp, Artificial Sequence
  chemically synthesized
agattcatcttagatcacag

SEQ ID NO: 30618 - DNA, 20 bp, Artificial Sequence
  chemically synthesized
cacaggagaaaattcctgaa

SEQ ID NO: 30619 - DNA, 20 bp, Artificial Sequence
  chemically synthesized
caggagaaaattcctgaaaa

SEQ ID NO: 30620 - DNA, 20 bp, Artificial Sequence
  chemically synthesized
aattcctgaaaagagatttt

SEQ ID NO: 30621 - DNA, 20 bp, Artificial Sequence
  chemically synthesized
agagattttcagtatacaat

SEQ ID NO: 30622 - DNA, 20 bp, Artificial Sequence
  chemically synthesized
ttcagtatacaatgagtaat

SEQ ID NO: 30623 - DNA, 20 bp, Artificial Sequence
  chemically synthesized
cttttgtttgaatttaatat

SEQ ID NO: 30624 - DNA, 20 bp, Artificial Sequence
  chemically synthesized
tattttttaatgaactacat

SEQ ID NO: 30625 - DNA, 20 bp, Artificial Sequence
  chemically synthesized
tttttaatgaactacattgg

SEQ ID NO: 30626 - DNA, 20 bp, Artificial Sequence
  chemically synthesized
tttaatgaactacattggtg

SEQ ID NO: 30627 - DNA, 20 bp, Artificial Sequence
  chemically synthesized
ttaatgaactacattggtgg

SEQ ID NO: 30628 - DNA, 20 bp, Artificial Sequence
  chemically synthesized
aggatactgtttcttgtaaa

SEQ ID NO: 30629 - DNA, 20 bp, Artificial Sequence
  chemically synthesized
ggatactgtttcttgtaaat

SEQ ID NO: 30630 - DNA, 20 bp, Artificial Sequence
  chemically synthesized
atactgtttcttgtaaatag

SEQ ID NO: 30631 - DNA, 20 bp, Artificial Sequence
  chemically synthesized
gtaaataggagaatatgcaa

SEQ ID NO: 30632 - DNA, 20 bp, Artificial Sequence
  chemically synthesized
aagacgctgcacctaaacac

SEQ ID NO: 30633 - DNA, 20 bp, Artificial Sequence
  chemically synthesized
agacgctgcacctaaacaca

SEQ ID NO: 30634 - DNA, 20 bp, Artificial Sequence
  chemically synthesized
ctaaacacaaggacttgaac

SEQ ID NO: 30635 - DNA, 20 bp, Artificial Sequence
  chemically synthesized
attattcatttttgaacccc

SEQ ID NO: 30636 - DNA, 20 bp, Artificial Sequence
  chemically synthesized
tattcatttttgaaccccta

SEQ ID NO: 30637 - DNA, 20 bp, Artificial Sequence
  chemically synthesized
acccctagagaacatttcca

SEQ ID NO: 30638 - DNA, 20 bp, Artificial Sequence
  chemically synthesized
cctagagaacatttccacag

SEQ ID NO: 30639 - DNA, 20 bp, Artificial Sequence
  chemically synthesized
tctgtaaacatgcctgtttt

SEQ ID NO: 30640 - DNA, 20 bp, Artificial Sequence
  chemically synthesized
gtaaacatgcctgtttttag

SEQ ID NO: 30641 - DNA, 20 bp, Artificial Sequence
  chemically synthesized
taaacatgcctgtttttagt

SEQ ID NO: 30642 - DNA, 20 bp, Artificial Sequence
  chemically synthesized
catgcctgtttttagtagga

SEQ ID NO: 30643 - DNA, 20 bp, Artificial Sequence
  chemically synthesized
tgcctgtttttagtaggata

SEQ ID NO: 30644 - DNA, 20 bp, Artificial Sequence
  chemically synthesized
gcctgtttttagtaggatag

SEQ ID NO: 30645 - DNA, 20 bp, Artificial Sequence
  chemically synthesized
ctgtttttagtaggatagag

SEQ ID NO: 30646 - DNA, 20 bp, Artificial Sequence
  chemically synthesized
tgtttttagtaggatagagg

SEQ ID NO: 30647 - DNA, 20 bp, Artificial Sequence
  chemically synthesized
agtaggatagaggaggattt

SEQ ID NO: 30648 - DNA, 20 bp, Artificial Sequence
  chemically synthesized
aggatagaggaggattttgg

SEQ ID NO: 30649 - DNA, 20 bp, Artificial Sequence
  chemically synthesized
ggatagaggaggattttgga

SEQ ID NO: 30650 - DNA, 20 bp, Artificial Sequence
  chemically synthesized
gaggaggattttggaaggcg

SEQ ID NO: 30651 - DNA, 20 bp, Artificial Sequence
  chemically synthesized
aggaggattttggaaggcga

SEQ ID NO: 30652 - DNA, 20 bp, Artificial Sequence
  chemically synthesized
ggaaggcgaaggccatatcc

SEQ ID NO: 30653 - DNA, 20 bp, Artificial Sequence
  chemically synthesized
gaaggccatatcctggatac

SEQ ID NO: 30654 - DNA, 20 bp, Artificial Sequence
  chemically synthesized
aaggccatatcctggatact

SEQ ID NO: 30655 - DNA, 20 bp, Artificial Sequence
  chemically synthesized
aggccatatcctggatactg

SEQ ID NO: 30656 - DNA, 20 bp, Artificial Sequence
  chemically synthesized
ccatatcctggatactgggg

SEQ ID NO: 30657 - DNA, 20 bp, Artificial Sequence
  chemically synthesized
ctggatactggggaagttac

SEQ ID NO: 30658 - DNA, 20 bp, Artificial Sequence
  chemically synthesized
tggatactggggaagttaca

SEQ ID NO: 30659 - DNA, 20 bp, Artificial Sequence
  chemically synthesized
ggaagttacaaggtgttgtt

SEQ ID NO: 30660 - DNA, 20 bp, Artificial Sequence
  chemically synthesized
ggtgttgtttggattaaaat

SEQ ID NO: 30661 - DNA, 20 bp, Artificial Sequence
  chemically synthesized
gttgtttggattaaaataag

SEQ ID NO: 30662 - DNA, 20 bp, Artificial Sequence
  chemically synthesized
tggattaaaataagcagatt

SEQ ID NO: 30663 - DNA, 20 bp, Artificial Sequence
  chemically synthesized
ggattaaaataagcagattg

SEQ ID NO: 30664 - DNA, 20 bp, Artificial Sequence
  chemically synthesized
taaaataagcagattgagga

SEQ ID NO: 30665 - DNA, 20 bp, Artificial Sequence
  chemically synthesized
aaaataagcagattgaggat

SEQ ID NO: 30666 - DNA, 20 bp, Artificial Sequence
  chemically synthesized
aaataagcagattgaggatg

SEQ ID NO: 30667 - DNA, 20 bp, Artificial Sequence
  chemically synthesized
ggggtcttttctatgttaac

SEQ ID NO: 30668 - DNA, 20 bp, Artificial Sequence
  chemically synthesized
cttttctatgttaactggac

SEQ ID NO: 30669 - DNA, 20 bp, Artificial Sequence
  chemically synthesized
catttaataatttgttgaat

SEQ ID NO: 30670 - DNA, 20 bp, Artificial Sequence
  chemically synthesized
tgaatgactgtttttctgat

SEQ ID NO: 30671 - DNA, 20 bp, Artificial Sequence
  chemically synthesized
aatgactgtttttctgatga

SEQ ID NO: 30672 - DNA, 20 bp, Artificial Sequence
  chemically synthesized
actgtttttctgatgagagt

SEQ ID NO: 30673 - DNA, 20 bp, Artificial Sequence
  chemically synthesized
ctgtttttctgatgagagta

SEQ ID NO: 30674 - DNA, 20 bp, Artificial Sequence
  chemically synthesized
gtttttctgatgagagtaag

SEQ ID NO: 30675 - DNA, 20 bp, Artificial Sequence
  chemically synthesized
ttttctgatgagagtaagga

SEQ ID NO: 30676 - DNA, 20 bp, Artificial Sequence
  chemically synthesized
tttctgatgagagtaaggag

SEQ ID NO: 30677 - DNA, 20 bp, Artificial Sequence
  chemically synthesized
ttctgatgagagtaaggaga

SEQ ID NO: 30678 - DNA, 20 bp, Artificial Sequence
  chemically synthesized
taaggagagggtgtgtatac

SEQ ID NO: 30679 - DNA, 20 bp, Artificial Sequence
  chemically synthesized
gagagggtgtgtataccaga

SEQ ID NO: 30680 - DNA, 20 bp, Artificial Sequence
  chemically synthesized
ggtgtgtataccagatggct

SEQ ID NO: 30681 - DNA, 20 bp, Artificial Sequence
  chemically synthesized
gtgtataccagatggctcgg

SEQ ID NO: 30682 - DNA, 20 bp, Artificial Sequence
  chemically synthesized
tgtataccagatggctcggc

SEQ ID NO: 30683 - DNA, 20 bp, Artificial Sequence
  chemically synthesized
taccagatggctcggcagga

SEQ ID NO: 30684 - DNA, 20 bp, Artificial Sequence
  chemically synthesized
ccagatggctcggcaggaaa

SEQ ID NO: 30685 - DNA, 20 bp, Artificial Sequence
  chemically synthesized
tggctcggcaggaaagagta

SEQ ID NO: 30686 - DNA, 20 bp, Artificial Sequence
  chemically synthesized
gctcggcaggaaagagtata

SEQ ID NO: 30687 - DNA, 20 bp, Artificial Sequence
  chemically synthesized
gcaggaaagagtatagagac

SEQ ID NO: 30688 - DNA, 20 bp, Artificial Sequence
  chemically synthesized
aggaaagagtatagagacca

SEQ ID NO: 30689 - DNA, 20 bp, Artificial Sequence
  chemically synthesized
ggaaagagtatagagaccag

SEQ ID NO: 30690 - DNA, 20 bp, Artificial Sequence
  chemically synthesized
gaaagagtatagagaccaga

SEQ ID NO: 30691 - DNA, 20 bp, Artificial Sequence
  chemically synthesized
gcttctgccatcctgacttc

SEQ ID NO: 30692 - DNA, 20 bp, Artificial Sequence
  chemically synthesized
cctgacttctagacatgatc

SEQ ID NO: 30693 - DNA, 20 bp, Artificial Sequence
  chemically synthesized
ctgacttctagacatgatcc

SEQ ID NO: 30694 - DNA, 20 bp, Artificial Sequence
  chemically synthesized
tgacttctagacatgatcca

SEQ ID NO: 30695 - DNA, 20 bp, Artificial Sequence
  chemically synthesized
acttctagacatgatccagg

SEQ ID NO: 30696 - DNA, 20 bp, Artificial Sequence
  chemically synthesized
cttctagacatgatccaggg

SEQ ID NO: 30697 - DNA, 20 bp, Artificial Sequence
  chemically synthesized
ttctagacatgatccaggga

SEQ ID NO: 30698 - DNA, 20 bp, Artificial Sequence
  chemically synthesized
tctagacatgatccagggag

SEQ ID NO: 30699 - DNA, 20 bp, Artificial Sequence
  chemically synthesized
gacatgatccagggaggggc

SEQ ID NO: 30700 - DNA, 20 bp, Artificial Sequence
  chemically synthesized
gatccagggaggggctggcc

SEQ ID NO: 30701 - DNA, 20 bp, Artificial Sequence
  chemically synthesized
gaggggctggcctggccatg

SEQ ID NO: 30702 - DNA, 20 bp, Artificial Sequence
  chemically synthesized
aggggctggcctggccatgc

SEQ ID NO: 30703 - DNA, 20 bp, Artificial Sequence
  chemically synthesized
ctggccatgcaggcactcat

SEQ ID NO: 30704 - DNA, 20 bp, Artificial Sequence
  chemically synthesized
tggccatgcaggcactcatc

SEQ ID NO: 30705 - DNA, 20 bp, Artificial Sequence
  chemically synthesized
ggccatgcaggcactcatca

SEQ ID NO: 30706 - DNA, 20 bp, Artificial Sequence
  chemically synthesized
gccatgcaggcactcatcag

SEQ ID NO: 30707 - DNA, 20 bp, Artificial Sequence
  chemically synthesized
catgcaggcactcatcaggg

SEQ ID NO: 30708 - DNA, 20 bp, Artificial Sequence
  chemically synthesized
caggcactcatcaggggagt

SEQ ID NO: 30709 - DNA, 20 bp, Artificial Sequence
  chemically synthesized
aggcactcatcaggggagtg

SEQ ID NO: 30710 - DNA, 20 bp, Artificial Sequence
  chemically synthesized
cactcatcaggggagtgagg

SEQ ID NO: 30711 - DNA, 20 bp, Artificial Sequence
  chemically synthesized
agtgaggcagccctgcctcc

SEQ ID NO: 30712 - DNA, 20 bp, Artificial Sequence
  chemically synthesized
ctgcctcctggccttcctaa

SEQ ID NO: 30713 - DNA, 20 bp, Artificial Sequence
  chemically synthesized
gccttcctaacagaatactg

SEQ ID NO: 30714 - DNA, 20 bp, Artificial Sequence
  chemically synthesized
cctaacagaatactgcagat

SEQ ID NO: 30715 - DNA, 20 bp, Artificial Sequence
  chemically synthesized
agatgagctcgcctcttttc

SEQ ID NO: 30716 - DNA, 20 bp, Artificial Sequence
  chemically synthesized
gagctcgcctcttttccagc

SEQ ID NO: 30717 - DNA, 20 bp, Artificial Sequence
  chemically synthesized
gctcgcctcttttccagcaa

SEQ ID NO: 30718 - DNA, 20 bp, Artificial Sequence
  chemically synthesized
cgcctcttttccagcaagag

SEQ ID NO: 30719 - DNA, 20 bp, Artificial Sequence
  chemically synthesized
gcctcttttccagcaagaga

SEQ ID NO: 30720 - DNA, 20 bp, Artificial Sequence
  chemically synthesized
cctgttttctgttctttctc

SEQ ID NO: 30721 - DNA, 20 bp, Artificial Sequence
  chemically synthesized
ttctgttctttctctggctc

SEQ ID NO: 30722 - DNA, 20 bp, Artificial Sequence
  chemically synthesized
tctggctctggttctgtgca

SEQ ID NO: 30723 - DNA, 20 bp, Artificial Sequence
  chemically synthesized
tggttctgtgcatagactct

SEQ ID NO: 30724 - DNA, 20 bp, Artificial Sequence
  chemically synthesized
tgcatagactctgagaatat

SEQ ID NO: 30725 - DNA, 20 bp, Artificial Sequence
  chemically synthesized
atagactctgagaatatcag

SEQ ID NO: 30726 - DNA, 20 bp, Artificial Sequence
  chemically synthesized
agactctgagaatatcagaa

SEQ ID NO: 30727 - DNA, 20 bp, Artificial Sequence
  chemically synthesized
aatatcagaagagattctgt

SEQ ID NO: 30728 - DNA, 20 bp, Artificial Sequence
  chemically synthesized
aagagattctgtgagaaccc

SEQ ID NO: 30729 - DNA, 20 bp, Artificial Sequence
  chemically synthesized
ctgtgagaaccctggtttct

SEQ ID NO: 30730 - DNA, 20 bp, Artificial Sequence
  chemically synthesized
tttctaagacttcattttcc

SEQ ID NO: 30731 - DNA, 20 bp, Artificial Sequence
  chemically synthesized
attttccaagtgaaaaatct

SEQ ID NO: 30732 - DNA, 20 bp, Artificial Sequence
  chemically synthesized
ttttccaagtgaaaaatcta

SEQ ID NO: 30733 - DNA, 20 bp, Artificial Sequence
  chemically synthesized
caagtgaaaaatctaaggcc

SEQ ID NO: 30734 - DNA, 20 bp, Artificial Sequence
  chemically synthesized
aaggcccagactgctgtata

SEQ ID NO: 30735 - DNA, 20 bp, Artificial Sequence
  chemically synthesized
gcccagactgctgtatatgg

SEQ ID NO: 30736 - DNA, 20 bp, Artificial Sequence
  chemically synthesized
gtggttcacacttataatcc

SEQ ID NO: 30737 - DNA, 20 bp, Artificial Sequence
  chemically synthesized
cacttataatcctggcaact

SEQ ID NO: 30738 - DNA, 20 bp, Artificial Sequence
  chemically synthesized
ttataatcctggcaacttgg

SEQ ID NO: 30739 - DNA, 20 bp, Artificial Sequence
  chemically synthesized
tcctggcaacttggaagaat

SEQ ID NO: 30740 - DNA, 20 bp, Artificial Sequence
  chemically synthesized
cctggcaacttggaagaata

SEQ ID NO: 30741 - DNA, 20 bp, Artificial Sequence
  chemically synthesized
ggcaacttggaagaataagg

SEQ ID NO: 30742 - DNA, 20 bp, Artificial Sequence
  chemically synthesized
gcaacttggaagaataaggt

SEQ ID NO: 30743 - DNA, 20 bp, Artificial Sequence
  chemically synthesized
aacttggaagaataaggtgg

SEQ ID NO: 30744 - DNA, 20 bp, Artificial Sequence
  chemically synthesized
acttggaagaataaggtggg

SEQ ID NO: 30745 - DNA, 20 bp, Artificial Sequence
  chemically synthesized
gtgggaggattgcttgaatc

SEQ ID NO: 30746 - DNA, 20 bp, Artificial Sequence
  chemically synthesized
ggattgcttgaatccggttt

SEQ ID NO: 30747 - DNA, 20 bp, Artificial Sequence
  chemically synthesized
ttgaatccggtttgagttta

SEQ ID NO: 30748 - DNA, 20 bp, Artificial Sequence
  chemically synthesized
atccggtttgagtttacagt

SEQ ID NO: 30749 - DNA, 20 bp, Artificial Sequence
  chemically synthesized
atgattacaccactgcactg

SEQ ID NO: 30750 - DNA, 20 bp, Artificial Sequence
  chemically synthesized
tacaccactgcactgtagcc

SEQ ID NO: 30751 - DNA, 20 bp, Artificial Sequence
  chemically synthesized
acaccactgcactgtagcct

SEQ ID NO: 30752 - DNA, 20 bp, Artificial Sequence
  chemically synthesized
ctgcactgtagcctgggtaa

SEQ ID NO: 30753 - DNA, 20 bp, Artificial Sequence
  chemically synthesized
gcactgtagcctgggtaaca

SEQ ID NO: 30754 - DNA, 20 bp, Artificial Sequence
  chemically synthesized
tgtagcctgggtaacagagc

SEQ ID NO: 30755 - DNA, 20 bp, Artificial Sequence
  chemically synthesized
atttctaaaaacaacaaaca

SEQ ID NO: 30756 - DNA, 20 bp, Artificial Sequence
  chemically synthesized
aaacaaagaaacaacaacaa

SEQ ID NO: 30757 - DNA, 20 bp, Artificial Sequence
  chemically synthesized
aacaacaacaaaagaaaaca

SEQ ID NO: 30758 - DNA, 20 bp, Artificial Sequence
  chemically synthesized
caaagaaaaaaaaatcccat

SEQ ID NO: 30759 - DNA, 20 bp, Artificial Sequence
  chemically synthesized
aaagaaaaaaaaatcccatt

SEQ ID NO: 30760 - DNA, 20 bp, Artificial Sequence
  chemically synthesized
aaaaaaaatcccattaggct

SEQ ID NO: 30761 - DNA, 20 bp, Artificial Sequence
  chemically synthesized
aaatcccattaggcttagtg

SEQ ID NO: 30762 - DNA, 20 bp, Artificial Sequence
  chemically synthesized
aatcccattaggcttagtgc

SEQ ID NO: 30763 - DNA, 20 bp, Artificial Sequence
  chemically synthesized
atcccattaggcttagtgca

SEQ ID NO: 30764 - DNA, 20 bp, Artificial Sequence
  chemically synthesized
taggcttagtgcagggaatg

SEQ ID NO: 30765 - DNA, 20 bp, Artificial Sequence
  chemically synthesized
aggcttagtgcagggaatgt

SEQ ID NO: 30766 - DNA, 20 bp, Artificial Sequence
  chemically synthesized
ggcttagtgcagggaatgtg

SEQ ID NO: 30767 - DNA, 20 bp, Artificial Sequence
  chemically synthesized
gggaatgtggggaatccatt

SEQ ID NO: 30768 - DNA, 20 bp, Artificial Sequence
  chemically synthesized
tgtggggaatccatttggct

SEQ ID NO: 30769 - DNA, 20 bp, Artificial Sequence
  chemically synthesized
gtggggaatccatttggcta

SEQ ID NO: 30770 - DNA, 20 bp, Artificial Sequence
  chemically synthesized
gctaaggacattcaaacatt

SEQ ID NO: 30771 - DNA, 20 bp, Artificial Sequence
  chemically synthesized
ctaaggacattcaaacattt

SEQ ID NO: 30772 - DNA, 20 bp, Artificial Sequence
  chemically synthesized
taaggacattcaaacatttg

SEQ ID NO: 30773 - DNA, 20 bp, Artificial Sequence
  chemically synthesized
aaggacattcaaacatttgg

SEQ ID NO: 30774 - DNA, 20 bp, Artificial Sequence
  chemically synthesized
cattcaaacatttgggggaa

SEQ ID NO: 30775 - DNA, 20 bp, Artificial Sequence
  chemically synthesized
gaaaagccttaattgtaact

SEQ ID NO: 30776 - DNA, 20 bp, Artificial Sequence
  chemically synthesized
taactgagaccatgtctttt

SEQ ID NO: 30777 - DNA, 20 bp, Artificial Sequence
  chemically synthesized
aactgagaccatgtcttttt

SEQ ID NO: 30778 - DNA, 20 bp, Artificial Sequence
  chemically synthesized
attacccactcctgaaaccc

SEQ ID NO: 30779 - DNA, 20 bp, Artificial Sequence
  chemically synthesized
cactcctgaaaccccggcac

SEQ ID NO: 30780 - DNA, 20 bp, Artificial Sequence
  chemically synthesized
cctgaaaccccggcacaaga

SEQ ID NO: 30781 - DNA, 20 bp, Artificial Sequence
  chemically synthesized
gaaaccccggcacaagacag

SEQ ID NO: 30782 - DNA, 20 bp, Artificial Sequence
  chemically synthesized
ccccggcacaagacagtagt

SEQ ID NO: 30783 - DNA, 20 bp, Artificial Sequence
  chemically synthesized
aagacagtagtgagactcac

SEQ ID NO: 30784 - DNA, 20 bp, Artificial Sequence
  chemically synthesized
acagtagtgagactcaccag

SEQ ID NO: 30785 - DNA, 20 bp, Artificial Sequence
  chemically synthesized
cagtagtgagactcaccagc

SEQ ID NO: 30786 - DNA, 20 bp, Artificial Sequence
  chemically synthesized
caggtaataacaaaaatgtg

SEQ ID NO: 30787 - DNA, 20 bp, Artificial Sequence
  chemically synthesized
aacaaaaatgtgaagccaat

SEQ ID NO: 30788 - DNA, 20 bp, Artificial Sequence
  chemically synthesized
aaaaatgtgaagccaatgag

SEQ ID NO: 30789 - DNA, 20 bp, Artificial Sequence
  chemically synthesized
aaaatgtgaagccaatgagt

SEQ ID NO: 30790 - DNA, 20 bp, Artificial Sequence
  chemically synthesized
aagccaatgagtaggttcca

SEQ ID NO: 30791 - DNA, 20 bp, Artificial Sequence
  chemically synthesized
agccaatgagtaggttccaa

SEQ ID NO: 30792 - DNA, 20 bp, Artificial Sequence
  chemically synthesized
caatgagtaggttccaaagg

SEQ ID NO: 30793 - DNA, 20 bp, Artificial Sequence
  chemically synthesized
gagtaggttccaaaggaaga

SEQ ID NO: 30794 - DNA, 20 bp, Artificial Sequence
  chemically synthesized
taggttccaaaggaagaaag

SEQ ID NO: 30795 - DNA, 20 bp, Artificial Sequence
  chemically synthesized
ggttccaaaggaagaaagaa

SEQ ID NO: 30796 - DNA, 20 bp, Artificial Sequence
  chemically synthesized
caaaggaagaaagaagagta

SEQ ID NO: 30797 - DNA, 20 bp, Artificial Sequence
  chemically synthesized
gaagaaagaagagtatagat

SEQ ID NO: 30798 - DNA, 20 bp, Artificial Sequence
  chemically synthesized
aagaaagaagagtatagata

SEQ ID NO: 30799 - DNA, 20 bp, Artificial Sequence
  chemically synthesized
agtatagataaggatgacac

SEQ ID NO: 30800 - DNA, 20 bp, Artificial Sequence
  chemically synthesized
gtatagataaggatgacaca

SEQ ID NO: 30801 - DNA, 20 bp, Artificial Sequence
  chemically synthesized
tatagataaggatgacacaa

SEQ ID NO: 30802 - DNA, 20 bp, Artificial Sequence
  chemically synthesized
aggatgacacaagggtcact

SEQ ID NO: 30803 - DNA, 20 bp, Artificial Sequence
  chemically synthesized
gatgacacaagggtcactga

SEQ ID NO: 30804 - DNA, 20 bp, Artificial Sequence
  chemically synthesized
atgacacaagggtcactgag

SEQ ID NO: 30805 - DNA, 20 bp, Artificial Sequence
  chemically synthesized
caagggtcactgagaggcac

SEQ ID NO: 30806 - DNA, 20 bp, Artificial Sequence
  chemically synthesized
aagggtcactgagaggcaca

SEQ ID NO: 30807 - DNA, 20 bp, Artificial Sequence
  chemically synthesized
cactgagaggcacaaggctg

SEQ ID NO: 30808 - DNA, 20 bp, Artificial Sequence
  chemically synthesized
gcacaaggctgtggctgtca

SEQ ID NO: 30809 - DNA, 20 bp, Artificial Sequence
  chemically synthesized
caaggctgtggctgtcacag

SEQ ID NO: 30810 - DNA, 20 bp, Artificial Sequence
  chemically synthesized
aaggctgtggctgtcacaga

SEQ ID NO: 30811 - DNA, 20 bp, Artificial Sequence
  chemically synthesized
cagaaggatttatcctccta

SEQ ID NO: 30812 - DNA, 20 bp, Artificial Sequence
  chemically synthesized
atttatcctcctaaagacca

SEQ ID NO: 30813 - DNA, 20 bp, Artificial Sequence
  chemically synthesized
cctcctaaagaccatggctc

SEQ ID NO: 30814 - DNA, 20 bp, Artificial Sequence
  chemically synthesized
ctaaagaccatggctccagc

SEQ ID NO: 30815 - DNA, 20 bp, Artificial Sequence
  chemically synthesized
taaagaccatggctccagct

SEQ ID NO: 30816 - DNA, 20 bp, Artificial Sequence
  chemically synthesized
aagaccatggctccagctgg

SEQ ID NO: 30817 - DNA, 20 bp, Artificial Sequence
  chemically synthesized
ctccagctgggagaacttaa

SEQ ID NO: 30818 - DNA, 20 bp, Artificial Sequence
  chemically synthesized
ggagaacttaatggtaaaca

SEQ ID NO: 30819 - DNA, 20 bp, Artificial Sequence
  chemically synthesized
gagaacttaatggtaaacaa

SEQ ID NO: 30820 - DNA, 20 bp, Artificial Sequence
  chemically synthesized
agaacttaatggtaaacaaa

SEQ ID NO: 30821 - DNA, 20 bp, Artificial Sequence
  chemically synthesized
aatggtaaacaaagggtccc

SEQ ID NO: 30822 - DNA, 20 bp, Artificial Sequence
  chemically synthesized
atggtaaacaaagggtcccc

SEQ ID NO: 30823 - DNA, 20 bp, Artificial Sequence
  chemically synthesized
tggtaaacaaagggtcccca

SEQ ID NO: 30824 - DNA, 20 bp, Artificial Sequence
  chemically synthesized
aaacaaagggtccccagggc

SEQ ID NO: 30825 - DNA, 20 bp, Artificial Sequence
  chemically synthesized
aacaaagggtccccagggct

SEQ ID NO: 30826 - DNA, 20 bp, Artificial Sequence
  chemically synthesized
ccccagggctgggaatccta

SEQ ID NO: 30827 - DNA, 20 bp, Artificial Sequence
  chemically synthesized
cccagggctgggaatcctat

SEQ ID NO: 30828 - DNA, 20 bp, Artificial Sequence
  chemically synthesized
agggctgggaatcctatggg

SEQ ID NO: 30829 - DNA, 20 bp, Artificial Sequence
  chemically synthesized
gggctgggaatcctatgggc

SEQ ID NO: 30830 - DNA, 20 bp, Artificial Sequence
  chemically synthesized
atctccacccctgtctcctg

SEQ ID NO: 30831 - DNA, 20 bp, Artificial Sequence
  chemically synthesized
acccctgtctcctgaagctg

SEQ ID NO: 30832 - DNA, 20 bp, Artificial Sequence
  chemically synthesized
ccctgtctcctgaagctgaa

SEQ ID NO: 30833 - DNA, 20 bp, Artificial Sequence
  chemically synthesized
gctgaagagccctaactttt

SEQ ID NO: 30834 - DNA, 20 bp, Artificial Sequence
  chemically synthesized
agccctaactttttagcatt

SEQ ID NO: 30835 - DNA, 20 bp, Artificial Sequence
  chemically synthesized
actttttagcattcagtccc

SEQ ID NO: 30836 - DNA, 20 bp, Artificial Sequence
  chemically synthesized
ctttttagcattcagtcccc

SEQ ID NO: 30837 - DNA, 20 bp, Artificial Sequence
  chemically synthesized
agcattcagtccccaggttt

SEQ ID NO: 30838 - DNA, 20 bp, Artificial Sequence
  chemically synthesized
gtccccaggttttggctaca

SEQ ID NO: 30839 - DNA, 20 bp, Artificial Sequence
  chemically synthesized
acagacatctgctgcaacaa

SEQ ID NO: 30840 - DNA, 20 bp, Artificial Sequence
  chemically synthesized
tgtttatttttaatttcata

SEQ ID NO: 30841 - DNA, 20 bp, Artificial Sequence
  chemically synthesized
ttatttttaatttcataaag

SEQ ID NO: 30842 - DNA, 20 bp, Artificial Sequence
  chemically synthesized
tactgtcttctgttatccac

SEQ ID NO: 30843 - DNA, 20 bp, Artificial Sequence
  chemically synthesized
cttctgttatccactagtaa

SEQ ID NO: 30844 - DNA, 20 bp, Artificial Sequence
  chemically synthesized
gtaatggacccgtcgttttc

SEQ ID NO: 30845 - DNA, 20 bp, Artificial Sequence
  chemically synthesized
aatggacccgtcgttttcca

SEQ ID NO: 30846 - DNA, 20 bp, Artificial Sequence
  chemically synthesized
tggacccgtcgttttccaga

SEQ ID NO: 30847 - DNA, 20 bp, Artificial Sequence
  chemically synthesized
ggacccgtcgttttccagag

SEQ ID NO: 30848 - DNA, 20 bp, Artificial Sequence
  chemically synthesized
ccgtcgttttccagagaggt

SEQ ID NO: 30849 - DNA, 20 bp, Artificial Sequence
  chemically synthesized
ttttccagagaggtcggatg

SEQ ID NO: 30850 - DNA, 20 bp, Artificial Sequence
  chemically synthesized
gaggtcggatgtagtatatg

SEQ ID NO: 30851 - DNA, 20 bp, Artificial Sequence
  chemically synthesized
ggtcggatgtagtatatgaa

SEQ ID NO: 30852 - DNA, 20 bp, Artificial Sequence
  chemically synthesized
gtcggatgtagtatatgaag

SEQ ID NO: 30853 - DNA, 20 bp, Artificial Sequence
  chemically synthesized
gattatccatgtgatgttca

SEQ ID NO: 30854 - DNA, 20 bp, Artificial Sequence
  chemically synthesized
tatccatgtgatgttcacag

SEQ ID NO: 30855 - DNA, 20 bp, Artificial Sequence
  chemically synthesized
taaattgcacatctgccttg

SEQ ID NO: 30856 - DNA, 20 bp, Artificial Sequence
  chemically synthesized
accacaatcaccactacttc

SEQ ID NO: 30857 - DNA, 20 bp, Artificial Sequence
  chemically synthesized
ttttatatttccatttactg

SEQ ID NO: 30858 - DNA, 20 bp, Artificial Sequence
  chemically synthesized
aaattgccctccatctctgc

SEQ ID NO: 30859 - DNA, 20 bp, Artificial Sequence
  chemically synthesized
tctgccagcctctatatctt

SEQ ID NO: 30860 - DNA, 20 bp, Artificial Sequence
  chemically synthesized
agcctctatatctttggacc

SEQ ID NO: 30861 - DNA, 20 bp, Artificial Sequence
  chemically synthesized
ctctatatctttggacctag

SEQ ID NO: 30862 - DNA, 20 bp, Artificial Sequence
  chemically synthesized
tcctaccccaaacaaatgtc

SEQ ID NO: 30863 - DNA, 20 bp, Artificial Sequence
  chemically synthesized
cctaccccaaacaaatgtcc

SEQ ID NO: 30864 - DNA, 20 bp, Artificial Sequence
  chemically synthesized
ccccaaacaaatgtccaggt

SEQ ID NO: 30865 - DNA, 20 bp, Artificial Sequence
  chemically synthesized
aaatgtccaggtcagtgtct

SEQ ID NO: 30866 - DNA, 20 bp, Artificial Sequence
  chemically synthesized
aatgtccaggtcagtgtctc

SEQ ID NO: 30867 - DNA, 20 bp, Artificial Sequence
  chemically synthesized
cagtgtctcaggctttccca

SEQ ID NO: 30868 - DNA, 20 bp, Artificial Sequence
  chemically synthesized
tacttcatctttgaatgcac

SEQ ID NO: 30869 - DNA, 20 bp, Artificial Sequence
  chemically synthesized
gcactggactttccttcaat

SEQ ID NO: 30870 - DNA, 20 bp, Artificial Sequence
  chemically synthesized
ccttcaatgagccctacaac

SEQ ID NO: 30871 - DNA, 20 bp, Artificial Sequence
  chemically synthesized
tcaatgagccctacaacaag

SEQ ID NO: 30872 - DNA, 20 bp, Artificial Sequence
  chemically synthesized
aaacttttttccttcttttc

SEQ ID NO: 30873 - DNA, 20 bp, Artificial Sequence
  chemically synthesized
cttttttccttcttttctgg

SEQ ID NO: 30874 - DNA, 20 bp, Artificial Sequence
  chemically synthesized
tagcaaatgccatcaacatt

SEQ ID NO: 30875 - DNA, 20 bp, Artificial Sequence
  chemically synthesized
aacatttagaaaaaaaaaaa

SEQ ID NO: 30876 - DNA, 20 bp, Artificial Sequence
  chemically synthesized
atagtcttgtacttcttccc

SEQ ID NO: 30877 - DNA, 20 bp, Artificial Sequence
  chemically synthesized
ttcttccccagactatgcta

SEQ ID NO: 30878 - DNA, 20 bp, Artificial Sequence
  chemically synthesized
cagactatgctacagaacct

SEQ ID NO: 30879 - DNA, 20 bp, Artificial Sequence
  chemically synthesized
agaacctgagttaatgtgat

SEQ ID NO: 30880 - DNA, 20 bp, Artificial Sequence
  chemically synthesized
gaacctgagttaatgtgatc

SEQ ID NO: 30881 - DNA, 20 bp, Artificial Sequence
  chemically synthesized
cacaaacacacacacactct

SEQ ID NO: 30882 - DNA, 20 bp, Artificial Sequence
  chemically synthesized
caaacacacacacactcttg

SEQ ID NO: 30883 - DNA, 20 bp, Artificial Sequence
  chemically synthesized
acacacacactcttggagac

SEQ ID NO: 30884 - DNA, 20 bp, Artificial Sequence
  chemically synthesized
cactcttggagactggcatg

SEQ ID NO: 30885 - DNA, 20 bp, Artificial Sequence
  chemically synthesized
cttggagactggcatgaagc

SEQ ID NO: 30886 - DNA, 20 bp, Artificial Sequence
  chemically synthesized
ttggagactggcatgaagca

SEQ ID NO: 30887 - DNA, 20 bp, Artificial Sequence
  chemically synthesized
aaggtattacatcctttaaa

SEQ ID NO: 30888 - DNA, 20 bp, Artificial Sequence
  chemically synthesized
aggtattacatcctttaaat

SEQ ID NO: 30889 - DNA, 20 bp, Artificial Sequence
  chemically synthesized
ggtattacatcctttaaata

SEQ ID NO: 30890 - DNA, 20 bp, Artificial Sequence
  chemically synthesized
tacatcctttaaatagggca

SEQ ID NO: 30891 - DNA, 20 bp, Artificial Sequence
  chemically synthesized
ttaaatagggcatggttgat

SEQ ID NO: 30892 - DNA, 20 bp, Artificial Sequence
  chemically synthesized
aaatagggcatggttgatta

SEQ ID NO: 30893 - DNA, 20 bp, Artificial Sequence
  chemically synthesized
catggttgattagagttgtg

SEQ ID NO: 30894 - DNA, 20 bp, Artificial Sequence
  chemically synthesized
atggttgattagagttgtgt

SEQ ID NO: 30895 - DNA, 20 bp, Artificial Sequence
  chemically synthesized
tggttgattagagttgtgtg

SEQ ID NO: 30896 - DNA, 20 bp, Artificial Sequence
  chemically synthesized
gattagagttgtgtggggat

SEQ ID NO: 30897 - DNA, 20 bp, Artificial Sequence
  chemically synthesized
tgtggggatgagctccaaaa

SEQ ID NO: 30898 - DNA, 20 bp, Artificial Sequence
  chemically synthesized
gtggggatgagctccaaaac

SEQ ID NO: 30899 - DNA, 20 bp, Artificial Sequence
  chemically synthesized
tggggatgagctccaaaacg

SEQ ID NO: 30900 - DNA, 20 bp, Artificial Sequence
  chemically synthesized
gagctccaaaacggggcata

SEQ ID NO: 30901 - DNA, 20 bp, Artificial Sequence
  chemically synthesized
ggggcatacagatctaaaac

SEQ ID NO: 30902 - DNA, 20 bp, Artificial Sequence
  chemically synthesized
gggcatacagatctaaaacc

SEQ ID NO: 30903 - DNA, 20 bp, Artificial Sequence
  chemically synthesized
atacagatctaaaaccagga

SEQ ID NO: 30904 - DNA, 20 bp, Artificial Sequence
  chemically synthesized
acagatctaaaaccaggaca

SEQ ID NO: 30905 - DNA, 20 bp, Artificial Sequence
  chemically synthesized
aaccaggacagagacccatg

SEQ ID NO: 30906 - DNA, 20 bp, Artificial Sequence
  chemically synthesized
ttatgacatgccattgtgat

SEQ ID NO: 30907 - DNA, 20 bp, Artificial Sequence
  chemically synthesized
cattgtgatcagaccacacc

SEQ ID NO: 30908 - DNA, 20 bp, Artificial Sequence
  chemically synthesized
gtgatcagaccacacccaga

SEQ ID NO: 30909 - DNA, 20 bp, Artificial Sequence
  chemically synthesized
atcagaccacacccagacag

SEQ ID NO: 30910 - DNA, 20 bp, Artificial Sequence
  chemically synthesized
agaccacacccagacagaag

SEQ ID NO: 30911 - DNA, 20 bp, Artificial Sequence
  chemically synthesized
gaagtggcaccaccttacac

SEQ ID NO: 30912 - DNA, 20 bp, Artificial Sequence
  chemically synthesized
aagtggcaccaccttacacc

SEQ ID NO: 30913 - DNA, 20 bp, Artificial Sequence
  chemically synthesized
ggcaccaccttacaccgggt

SEQ ID NO: 30914 - DNA, 20 bp, Artificial Sequence
  chemically synthesized
ccttacaccgggtaagtaac

SEQ ID NO: 30915 - DNA, 20 bp, Artificial Sequence
  chemically synthesized
ccgggtaagtaactggttgt

SEQ ID NO: 30916 - DNA, 20 bp, Artificial Sequence
  chemically synthesized
cgggtaagtaactggttgtt

SEQ ID NO: 30917 - DNA, 20 bp, Artificial Sequence
  chemically synthesized
gggtaagtaactggttgtta

SEQ ID NO: 30918 - DNA, 20 bp, Artificial Sequence
  chemically synthesized
aagtaactggttgttagggc

SEQ ID NO: 30919 - DNA, 20 bp, Artificial Sequence
  chemically synthesized
gtaactggttgttagggcca

SEQ ID NO: 30920 - DNA, 20 bp, Artificial Sequence
  chemically synthesized
tggttgttagggccagagtg

SEQ ID NO: 30921 - DNA, 20 bp, Artificial Sequence
  chemically synthesized
ggttgttagggccagagtgt

SEQ ID NO: 30922 - DNA, 20 bp, Artificial Sequence
  chemically synthesized
ttgttagggccagagtgtag

SEQ ID NO: 30923 - DNA, 20 bp, Artificial Sequence
  chemically synthesized
gttagggccagagtgtagga

SEQ ID NO: 30924 - DNA, 20 bp, Artificial Sequence
  chemically synthesized
gggccagagtgtaggagagt

SEQ ID NO: 30925 - DNA, 20 bp, Artificial Sequence
  chemically synthesized
ggccagagtgtaggagagtc

SEQ ID NO: 30926 - DNA, 20 bp, Artificial Sequence
  chemically synthesized
gccagagtgtaggagagtca

SEQ ID NO: 30927 - DNA, 20 bp, Artificial Sequence
  chemically synthesized
gtgtaggagagtcagggtga

SEQ ID NO: 30928 - DNA, 20 bp, Artificial Sequence
  chemically synthesized
tgtaggagagtcagggtgat

SEQ ID NO: 30929 - DNA, 20 bp, Artificial Sequence
  chemically synthesized
gagagtcagggtgataggac

SEQ ID NO: 30930 - DNA, 20 bp, Artificial Sequence
  chemically synthesized
cagggtgataggacaagatg

SEQ ID NO: 30931 - DNA, 20 bp, Artificial Sequence
  chemically synthesized
gggtgataggacaagatgca

SEQ ID NO: 30932 - DNA, 20 bp, Artificial Sequence
  chemically synthesized
gtgataggacaagatgcaga

SEQ ID NO: 30933 - DNA, 20 bp, Artificial Sequence
  chemically synthesized
ataggacaagatgcagagag

SEQ ID NO: 30934 - DNA, 20 bp, Artificial Sequence
  chemically synthesized
taggacaagatgcagagagc

SEQ ID NO: 30935 - DNA, 20 bp, Artificial Sequence
  chemically synthesized
caggatgtcttattaaattg

SEQ ID NO: 30936 - DNA, 20 bp, Artificial Sequence
  chemically synthesized
tcttattaaattgtagttat

SEQ ID NO: 30937 - DNA, 20 bp, Artificial Sequence
  chemically synthesized
cttattaaattgtagttatg

SEQ ID NO: 30938 - DNA, 20 bp, Artificial Sequence
  chemically synthesized
attaaattgtagttatgagg

SEQ ID NO: 30939 - DNA, 20 bp, Artificial Sequence
  chemically synthesized
ttaaattgtagttatgagga

SEQ ID NO: 30940 - DNA, 20 bp, Artificial Sequence
  chemically synthesized
tgtagttatgaggaaggttc

SEQ ID NO: 30941 - DNA, 20 bp, Artificial Sequence
  chemically synthesized
tatgaggaaggttctggctt

SEQ ID NO: 30942 - DNA, 20 bp, Artificial Sequence
  chemically synthesized
aggttctggcttcggtacaa

SEQ ID NO: 30943 - DNA, 20 bp, Artificial Sequence
  chemically synthesized
ggttctggcttcggtacaat

SEQ ID NO: 30944 - DNA, 20 bp, Artificial Sequence
  chemically synthesized
tctggcttcggtacaatagg

SEQ ID NO: 30945 - DNA, 20 bp, Artificial Sequence
  chemically synthesized
ctggcttcggtacaatagga

SEQ ID NO: 30946 - DNA, 20 bp, Artificial Sequence
  chemically synthesized
ggcttcggtacaataggaag

SEQ ID NO: 30947 - DNA, 20 bp, Artificial Sequence
  chemically synthesized
cggtacaataggaaggagct

SEQ ID NO: 30948 - DNA, 20 bp, Artificial Sequence
  chemically synthesized
aggagctgagcatcttcatt

SEQ ID NO: 30949 - DNA, 20 bp, Artificial Sequence
  chemically synthesized
ggagctgagcatcttcattt

SEQ ID NO: 30950 - DNA, 20 bp, Artificial Sequence
  chemically synthesized
agcatcttcatttaggcttg

SEQ ID NO: 30951 - DNA, 20 bp, Artificial Sequence
  chemically synthesized
gcatcttcatttaggcttgt

SEQ ID NO: 30952 - DNA, 20 bp, Artificial Sequence
  chemically synthesized
atcttcatttaggcttgtag

SEQ ID NO: 30953 - DNA, 20 bp, Artificial Sequence
  chemically synthesized
cttcatttaggcttgtagga

SEQ ID NO: 30954 - DNA, 20 bp, Artificial Sequence
  chemically synthesized
ttcatttaggcttgtaggag

SEQ ID NO: 30955 - DNA, 20 bp, Artificial Sequence
  chemically synthesized
tcatttaggcttgtaggaga

SEQ ID NO: 30956 - DNA, 20 bp, Artificial Sequence
  chemically synthesized
gtaggagagggcaccactac

SEQ ID NO: 30957 - DNA, 20 bp, Artificial Sequence
  chemically synthesized
caccactaccagaaaaattt

SEQ ID NO: 30958 - DNA, 20 bp, Artificial Sequence
  chemically synthesized
cagaaaatcctgcatttatt

SEQ ID NO: 30959 - DNA, 20 bp, Artificial Sequence
  chemically synthesized
atttattaagaacatgattt

SEQ ID NO: 30960 - DNA, 20 bp, Artificial Sequence
  chemically synthesized
atgattttagcctatttcac

SEQ ID NO: 30961 - DNA, 20 bp, Artificial Sequence
  chemically synthesized
tgattttagcctatttcact

SEQ ID NO: 30962 - DNA, 20 bp, Artificial Sequence
  chemically synthesized
agcctatttcactgggatcc

SEQ ID NO: 30963 - DNA, 20 bp, Artificial Sequence
  chemically synthesized
atttcactgggatcctagcc

SEQ ID NO: 30964 - DNA, 20 bp, Artificial Sequence
  chemically synthesized
tttcactgggatcctagcca

SEQ ID NO: 30965 - DNA, 20 bp, Artificial Sequence
  chemically synthesized
actgggatcctagccaagga

SEQ ID NO: 30966 - DNA, 20 bp, Artificial Sequence
  chemically synthesized
cctagccaaggacagtataa

SEQ ID NO: 30967 - DNA, 20 bp, Artificial Sequence
  chemically synthesized
aacaatgctgctattattac

SEQ ID NO: 30968 - DNA, 20 bp, Artificial Sequence
  chemically synthesized
gctgctattattaccagcaa

SEQ ID NO: 30969 - DNA, 20 bp, Artificial Sequence
  chemically synthesized
cagcaaatattgctattatt

SEQ ID NO: 30970 - DNA, 20 bp, Artificial Sequence
  chemically synthesized
agcaaatattgctattattc

SEQ ID NO: 30971 - DNA, 20 bp, Artificial Sequence
  chemically synthesized
gcaaatattgctattattca

SEQ ID NO: 30972 - DNA, 20 bp, Artificial Sequence
  chemically synthesized
caaatattgctattattcag

SEQ ID NO: 30973 - DNA, 20 bp, Artificial Sequence
  chemically synthesized
caggggcatctatcacacat

SEQ ID NO: 30974 - DNA, 20 bp, Artificial Sequence
  chemically synthesized
ggcatctatcacacataaga

SEQ ID NO: 30975 - DNA, 20 bp, Artificial Sequence
  chemically synthesized
gcatctatcacacataagat

SEQ ID NO: 30976 - DNA, 20 bp, Artificial Sequence
  chemically synthesized
agataggaaaacaactatct

SEQ ID NO: 30977 - DNA, 20 bp, Artificial Sequence
  chemically synthesized
caactatcttagcgcaatgt

SEQ ID NO: 30978 - DNA, 20 bp, Artificial Sequence
  chemically synthesized
actatcttagcgcaatgtaa

SEQ ID NO: 30979 - DNA, 20 bp, Artificial Sequence
  chemically synthesized
tcttagcgcaatgtaagaga

SEQ ID NO: 30980 - DNA, 20 bp, Artificial Sequence
  chemically synthesized
cgcaatgtaagagatggaca

SEQ ID NO: 30981 - DNA, 20 bp, Artificial Sequence
  chemically synthesized
ggcaattatattaatatttg

SEQ ID NO: 30982 - DNA, 20 bp, Artificial Sequence
  chemically synthesized
gcaattatattaatatttgt

SEQ ID NO: 30983 - DNA, 20 bp, Artificial Sequence
  chemically synthesized
attatattaatatttgtggg

SEQ ID NO: 30984 - DNA, 20 bp, Artificial Sequence
  chemically synthesized
taatatttgtgggtagcacc

SEQ ID NO: 30985 - DNA, 20 bp, Artificial Sequence
  chemically synthesized
tgtgggtagcacctggccca

SEQ ID NO: 30986 - DNA, 20 bp, Artificial Sequence
  chemically synthesized
gtgggtagcacctggcccac

SEQ ID NO: 30987 - DNA, 20 bp, Artificial Sequence
  chemically synthesized
gtagcacctggcccacaggt

SEQ ID NO: 30988 - DNA, 20 bp, Artificial Sequence
  chemically synthesized
tagcacctggcccacaggtg

SEQ ID NO: 30989 - DNA, 20 bp, Artificial Sequence
  chemically synthesized
agcacctggcccacaggtga

SEQ ID NO: 30990 - DNA, 20 bp, Artificial Sequence
  chemically synthesized
cctggcccacaggtgagggc

SEQ ID NO: 30991 - DNA, 20 bp, Artificial Sequence
  chemically synthesized
ctggcccacaggtgagggcc

SEQ ID NO: 30992 - DNA, 20 bp, Artificial Sequence
  chemically synthesized
tggcccacaggtgagggcca

SEQ ID NO: 30993 - DNA, 20 bp, Artificial Sequence
  chemically synthesized
cccacaggtgagggccaggg

SEQ ID NO: 30994 - DNA, 20 bp, Artificial Sequence
  chemically synthesized
ccacaggtgagggccaggga

SEQ ID NO: 30995 - DNA, 20 bp, Artificial Sequence
  chemically synthesized
gccagggaaggccccaacct

SEQ ID NO: 30996 - DNA, 20 bp, Artificial Sequence
  chemically synthesized
aggccccaacctgagctatg

SEQ ID NO: 30997 - DNA, 20 bp, Artificial Sequence
  chemically synthesized
ctgagctatgaagactaatt

SEQ ID NO: 30998 - DNA, 20 bp, Artificial Sequence
  chemically synthesized
gactaattaagaatcaacca

SEQ ID NO: 30999 - DNA, 20 bp, Artificial Sequence
  chemically synthesized
aattaagaatcaaccacaga

SEQ ID NO: 31000 - DNA, 20 bp, Artificial Sequence
  chemically synthesized
attaagaatcaaccacagat

SEQ ID NO: 31001 - DNA, 20 bp, Artificial Sequence
  chemically synthesized
ttaagaatcaaccacagata

SEQ ID NO: 31002 - DNA, 20 bp, Artificial Sequence
  chemically synthesized
caaccacagatagggcttta

SEQ ID NO: 31003 - DNA, 20 bp, Artificial Sequence
  chemically synthesized
cacagatagggctttataga

SEQ ID NO: 31004 - DNA, 20 bp, Artificial Sequence
  chemically synthesized
acagatagggctttatagaa

SEQ ID NO: 31005 - DNA, 20 bp, Artificial Sequence
  chemically synthesized
tatagaaaggtatttccaaa

SEQ ID NO: 31006 - DNA, 20 bp, Artificial Sequence
  chemically synthesized
atagaaaggtatttccaaaa

SEQ ID NO: 31007 - DNA, 20 bp, Artificial Sequence
  chemically synthesized
agaaaggtatttccaaaaag

SEQ ID NO: 31008 - DNA, 20 bp, Artificial Sequence
  chemically synthesized
gaaaggtatttccaaaaagg

SEQ ID NO: 31009 - DNA, 20 bp, Artificial Sequence
  chemically synthesized
aaaggtatttccaaaaagga

SEQ ID NO: 31010 - DNA, 20 bp, Artificial Sequence
  chemically synthesized
aaggtatttccaaaaaggag

SEQ ID NO: 31011 - DNA, 20 bp, Artificial Sequence
  chemically synthesized
gtatttccaaaaaggagggg

SEQ ID NO: 31012 - DNA, 20 bp, Artificial Sequence
  chemically synthesized
ccaaaaaggaggggtagtgt

SEQ ID NO: 31013 - DNA, 20 bp, Artificial Sequence
  chemically synthesized
aaaggaggggtagtgtaagc

SEQ ID NO: 31014 - DNA, 20 bp, Artificial Sequence
  chemically synthesized
aaggaggggtagtgtaagca

SEQ ID NO: 31015 - DNA, 20 bp, Artificial Sequence
  chemically synthesized
aggaggggtagtgtaagcaa

SEQ ID NO: 31016 - DNA, 20 bp, Artificial Sequence
  chemically synthesized
gggtagtgtaagcaagggca

SEQ ID NO: 31017 - DNA, 20 bp, Artificial Sequence
  chemically synthesized
gtagtgtaagcaagggcatg

SEQ ID NO: 31018 - DNA, 20 bp, Artificial Sequence
  chemically synthesized
tagtgtaagcaagggcatgg

SEQ ID NO: 31019 - DNA, 20 bp, Artificial Sequence
  chemically synthesized
gtaagcaagggcatggaggt

SEQ ID NO: 31020 - DNA, 20 bp, Artificial Sequence
  chemically synthesized
taagcaagggcatggaggtg

SEQ ID NO: 31021 - DNA, 20 bp, Artificial Sequence
  chemically synthesized
aagggcatggaggtgaggaa

SEQ ID NO: 31022 - DNA, 20 bp, Artificial Sequence
  chemically synthesized
aaaagttgtttatgtgtttt

SEQ ID NO: 31023 - DNA, 20 bp, Artificial Sequence
  chemically synthesized
ttatgtgttttgagaactat

SEQ ID NO: 31024 - DNA, 20 bp, Artificial Sequence
  chemically synthesized
ttgagaactataagattttc

SEQ ID NO: 31025 - DNA, 20 bp, Artificial Sequence
  chemically synthesized
ggtgatcaaatataacattt

SEQ ID NO: 31026 - DNA, 20 bp, Artificial Sequence
  chemically synthesized
tgatcaaatataacatttaa

SEQ ID NO: 31027 - DNA, 20 bp, Artificial Sequence
  chemically synthesized
atcaaatataacatttaaga

SEQ ID NO: 31028 - DNA, 20 bp, Artificial Sequence
  chemically synthesized
atttaagagagttaatacct

SEQ ID NO: 31029 - DNA, 20 bp, Artificial Sequence
  chemically synthesized
gttaataccttggaataaaa

SEQ ID NO: 31030 - DNA, 20 bp, Artificial Sequence
  chemically synthesized
aataccttggaataaaacag

SEQ ID NO: 31031 - DNA, 20 bp, Artificial Sequence
  chemically synthesized
taccttggaataaaacagta

SEQ ID NO: 31032 - DNA, 20 bp, Artificial Sequence
  chemically synthesized
accttggaataaaacagtag

SEQ ID NO: 31033 - DNA, 20 bp, Artificial Sequence
  chemically synthesized
ttggaataaaacagtagagg

SEQ ID NO: 31034 - DNA, 20 bp, Artificial Sequence
  chemically synthesized
tggaataaaacagtagaggt

SEQ ID NO: 31035 - DNA, 20 bp, Artificial Sequence
  chemically synthesized
aataaaacagtagaggtagg

SEQ ID NO: 31036 - DNA, 20 bp, Artificial Sequence
  chemically synthesized
ataaaacagtagaggtaggc

SEQ ID NO: 31037 - DNA, 20 bp, Artificial Sequence
  chemically synthesized
taaaacagtagaggtaggca

SEQ ID NO: 31038 - DNA, 20 bp, Artificial Sequence
  chemically synthesized
aaaacagtagaggtaggcag

SEQ ID NO: 31039 - DNA, 20 bp, Artificial Sequence
  chemically synthesized
cagtagaggtaggcaggggc

SEQ ID NO: 31040 - DNA, 20 bp, Artificial Sequence
  chemically synthesized
gcaggggcaagaccctgaat

SEQ ID NO: 31041 - DNA, 20 bp, Artificial Sequence
  chemically synthesized
tttatatgacatgtcaaaca

SEQ ID NO: 31042 - DNA, 20 bp, Artificial Sequence
  chemically synthesized
aaacatggtacacattttga

SEQ ID NO: 31043 - DNA, 20 bp, Artificial Sequence
  chemically synthesized
atggtacacattttgatggt

SEQ ID NO: 31044 - DNA, 20 bp, Artificial Sequence
  chemically synthesized
tggtacacattttgatggtt

SEQ ID NO: 31045 - DNA, 20 bp, Artificial Sequence
  chemically synthesized
ttttgatggttgggtttaaa

SEQ ID NO: 31046 - DNA, 20 bp, Artificial Sequence
  chemically synthesized
tttgatggttgggtttaaaa

SEQ ID NO: 31047 - DNA, 20 bp, Artificial Sequence
  chemically synthesized
gatggttgggtttaaaaagg

SEQ ID NO: 31048 - DNA, 20 bp, Artificial Sequence
  chemically synthesized
atggttgggtttaaaaaggc

SEQ ID NO: 31049 - DNA, 20 bp, Artificial Sequence
  chemically synthesized
ggttgggtttaaaaaggcag

SEQ ID NO: 31050 - DNA, 20 bp, Artificial Sequence
  chemically synthesized
gagataacaatcatattttc

SEQ ID NO: 31051 - DNA, 20 bp, Artificial Sequence
  chemically synthesized
gataacaatcatattttcca

SEQ ID NO: 31052 - DNA, 20 bp, Artificial Sequence
  chemically synthesized
agtacattgttaacaatatg

SEQ ID NO: 31053 - DNA, 20 bp, Artificial Sequence
  chemically synthesized
gtacattgttaacaatatgc

SEQ ID NO: 31054 - DNA, 20 bp, Artificial Sequence
  chemically synthesized
cattgttaacaatatgcagg

SEQ ID NO: 31055 - DNA, 20 bp, Artificial Sequence
  chemically synthesized
attgttaacaatatgcagga

SEQ ID NO: 31056 - DNA, 20 bp, Artificial Sequence
  chemically synthesized
caatatgcaggaaggattta

SEQ ID NO: 31057 - DNA, 20 bp, Artificial Sequence
  chemically synthesized
gaaggatttaaagtctgcac

SEQ ID NO: 31058 - DNA, 20 bp, Artificial Sequence
  chemically synthesized
tttaaagtctgcactggaaa

SEQ ID NO: 31059 - DNA, 20 bp, Artificial Sequence
  chemically synthesized
actggaaacagatgttattt

SEQ ID NO: 31060 - DNA, 20 bp, Artificial Sequence
  chemically synthesized
acagatgttattttggtgta

SEQ ID NO: 31061 - DNA, 20 bp, Artificial Sequence
  chemically synthesized
agatgttattttggtgtatg

SEQ ID NO: 31062 - DNA, 20 bp, Artificial Sequence
  chemically synthesized
gttattttggtgtatggagc

SEQ ID NO: 31063 - DNA, 20 bp, Artificial Sequence
  chemically synthesized
ttggtgtatggagctggatg

SEQ ID NO: 31064 - DNA, 20 bp, Artificial Sequence
  chemically synthesized
ggatgcagatatgtaattga

SEQ ID NO: 31065 - DNA, 20 bp, Artificial Sequence
  chemically synthesized
gtaattgacagctttttacg

SEQ ID NO: 31066 - DNA, 20 bp, Artificial Sequence
  chemically synthesized
cgtagataaacaatactgtt

SEQ ID NO: 31067 - DNA, 20 bp, Artificial Sequence
  chemically synthesized
agataaacaatactgtttag

SEQ ID NO: 31068 - DNA, 20 bp, Artificial Sequence
  chemically synthesized
ttagtggataacctaccatt

SEQ ID NO: 31069 - DNA, 20 bp, Artificial Sequence
  chemically synthesized
agtggataacctaccattta

SEQ ID NO: 31070 - DNA, 20 bp, Artificial Sequence
  chemically synthesized
ttaaactaacatctgtataa

SEQ ID NO: 31071 - DNA, 20 bp, Artificial Sequence
  chemically synthesized
ttctctgaattatataattg

SEQ ID NO: 31072 - DNA, 20 bp, Artificial Sequence
  chemically synthesized
tctctgaattatataattga

SEQ ID NO: 31073 - DNA, 20 bp, Artificial Sequence
  chemically synthesized
gaattatataattgaaggac

SEQ ID NO: 31074 - DNA, 20 bp, Artificial Sequence
  chemically synthesized
taattgaaggaccagtttcc

SEQ ID NO: 31075 - DNA, 20 bp, Artificial Sequence
  chemically synthesized
aaggaccagtttccaagcaa

SEQ ID NO: 31076 - DNA, 20 bp, Artificial Sequence
  chemically synthesized
tttatttgaaaaccaaatga

SEQ ID NO: 31077 - DNA, 20 bp, Artificial Sequence
  chemically synthesized
gaaaaccaaatgaaagaact

SEQ ID NO: 31078 - DNA, 20 bp, Artificial Sequence
  chemically synthesized
ttattgctctaaatgacctt

SEQ ID NO: 31079 - DNA, 20 bp, Artificial Sequence
  chemically synthesized
tgttttatcatatcacaaaa

SEQ ID NO: 31080 - DNA, 20 bp, Artificial Sequence
  chemically synthesized
tcacaaaatagtcctctttg

SEQ ID NO: 31081 - DNA, 20 bp, Artificial Sequence
  chemically synthesized
aattttcattgacgtgcatt

SEQ ID NO: 31082 - DNA, 20 bp, Artificial Sequence
  chemically synthesized
gtgcattaagtgcgtcctgt

SEQ ID NO: 31083 - DNA, 20 bp, Artificial Sequence
  chemically synthesized
tcctgtgagaaactctgatc

SEQ ID NO: 31084 - DNA, 20 bp, Artificial Sequence
  chemically synthesized
aaactctgatcaagaacttg

SEQ ID NO: 31085 - DNA, 20 bp, Artificial Sequence
  chemically synthesized
tctgatcaagaacttgaaga

SEQ ID NO: 31086 - DNA, 20 bp, Artificial Sequence
  chemically synthesized
atcaagaacttgaagataga

SEQ ID NO: 31087 - DNA, 20 bp, Artificial Sequence
  chemically synthesized
atagacagattaacatgtca

SEQ ID NO: 31088 - DNA, 20 bp, Artificial Sequence
  chemically synthesized
gtcatggtcttgcctttatg

SEQ ID NO: 31089 - DNA, 20 bp, Artificial Sequence
  chemically synthesized
gcctttatgaagctcacatt

SEQ ID NO: 31090 - DNA, 20 bp, Artificial Sequence
  chemically synthesized
tatgaagctcacattgagta

SEQ ID NO: 31091 - DNA, 20 bp, Artificial Sequence
  chemically synthesized
ctcacattgagtaaagatgt

SEQ ID NO: 31092 - DNA, 20 bp, Artificial Sequence
  chemically synthesized
agatgttagattgttcaacg

SEQ ID NO: 31093 - DNA, 20 bp, Artificial Sequence
  chemically synthesized
gttcaacgaagtttccaaaa

SEQ ID NO: 31094 - DNA, 20 bp, Artificial Sequence
  chemically synthesized
ttcaacgaagtttccaaaat

SEQ ID NO: 31095 - DNA, 20 bp, Artificial Sequence
  chemically synthesized
tcaacgaagtttccaaaata

SEQ ID NO: 31096 - DNA, 20 bp, Artificial Sequence
  chemically synthesized
agtttccaaaatagggtcac

SEQ ID NO: 31097 - DNA, 20 bp, Artificial Sequence
  chemically synthesized
ccaaaatagggtcactagcc

SEQ ID NO: 31098 - DNA, 20 bp, Artificial Sequence
  chemically synthesized
caaaatagggtcactagccc

SEQ ID NO: 31099 - DNA, 20 bp, Artificial Sequence
  chemically synthesized
atagggtcactagcccaggc

SEQ ID NO: 31100 - DNA, 20 bp, Artificial Sequence
  chemically synthesized
tagggtcactagcccaggct

SEQ ID NO: 31101 - DNA, 20 bp, Artificial Sequence
  chemically synthesized
ggtcactagcccaggctagg

SEQ ID NO: 31102 - DNA, 20 bp, Artificial Sequence
  chemically synthesized
gtcactagcccaggctagga

SEQ ID NO: 31103 - DNA, 20 bp, Artificial Sequence
  chemically synthesized
actagcccaggctaggaagg

SEQ ID NO: 31104 - DNA, 20 bp, Artificial Sequence
  chemically synthesized
tagcccaggctaggaaggca

SEQ ID NO: 31105 - DNA, 20 bp, Artificial Sequence
  chemically synthesized
agcccaggctaggaaggcag

SEQ ID NO: 31106 - DNA, 20 bp, Artificial Sequence
  chemically synthesized
ccaggctaggaaggcagagg

SEQ ID NO: 31107 - DNA, 20 bp, Artificial Sequence
  chemically synthesized
gaaggcagaggtagtttctg

SEQ ID NO: 31108 - DNA, 20 bp, Artificial Sequence
  chemically synthesized
cagaggtagtttctgaagcc

SEQ ID NO: 31109 - DNA, 20 bp, Artificial Sequence
  chemically synthesized
gaggtagtttctgaagcctg

SEQ ID NO: 31110 - DNA, 20 bp, Artificial Sequence
  chemically synthesized
aggtagtttctgaagcctgg

SEQ ID NO: 31111 - DNA, 20 bp, Artificial Sequence
  chemically synthesized
gtttctgaagcctggaggcc

SEQ ID NO: 31112 - DNA, 20 bp, Artificial Sequence
  chemically synthesized
ttctgaagcctggaggccaa

SEQ ID NO: 31113 - DNA, 20 bp, Artificial Sequence
  chemically synthesized
tctgaagcctggaggccaag

SEQ ID NO: 31114 - DNA, 20 bp, Artificial Sequence
  chemically synthesized
tgaagcctggaggccaagag

SEQ ID NO: 31115 - DNA, 20 bp, Artificial Sequence
  chemically synthesized
gaagcctggaggccaagagg

SEQ ID NO: 31116 - DNA, 20 bp, Artificial Sequence
  chemically synthesized
ggaggccaagaggaggatga

SEQ ID NO: 31117 - DNA, 20 bp, Artificial Sequence
  chemically synthesized
gaggccaagaggaggatgat

SEQ ID NO: 31118 - DNA, 20 bp, Artificial Sequence
  chemically synthesized
aggccaagaggaggatgatg

SEQ ID NO: 31119 - DNA, 20 bp, Artificial Sequence
  chemically synthesized
ggaggatgatggggacaatg

SEQ ID NO: 31120 - DNA, 20 bp, Artificial Sequence
  chemically synthesized
gaggatgatggggacaatga

SEQ ID NO: 31121 - DNA, 20 bp, Artificial Sequence
  chemically synthesized
ggatgatggggacaatgaag

SEQ ID NO: 31122 - DNA, 20 bp, Artificial Sequence
  chemically synthesized
gatggggacaatgaaggagc

SEQ ID NO: 31123 - DNA, 20 bp, Artificial Sequence
  chemically synthesized
acaatgaaggagcaagtcct

SEQ ID NO: 31124 - DNA, 20 bp, Artificial Sequence
  chemically synthesized
cggacctatctctatcactg

SEQ ID NO: 31125 - DNA, 20 bp, Artificial Sequence
  chemically synthesized
ggacctatctctatcactgt

SEQ ID NO: 31126 - DNA, 20 bp, Artificial Sequence
  chemically synthesized
gtgggtaatcatgcgaatat

SEQ ID NO: 31127 - DNA, 20 bp, Artificial Sequence
  chemically synthesized
tgggtaatcatgcgaatatt

SEQ ID NO: 31128 - DNA, 20 bp, Artificial Sequence
  chemically synthesized
aatcatgcgaatattaggtg

SEQ ID NO: 31129 - DNA, 20 bp, Artificial Sequence
  chemically synthesized
aatattaggtgaagtgaatg

SEQ ID NO: 31130 - DNA, 20 bp, Artificial Sequence
  chemically synthesized
atattaggtgaagtgaatgt

SEQ ID NO: 31131 - DNA, 20 bp, Artificial Sequence
  chemically synthesized
aagtgaatgtgggtgcatga

SEQ ID NO: 31132 - DNA, 20 bp, Artificial Sequence
  chemically synthesized
gaatgtgggtgcatgatggt

SEQ ID NO: 31133 - DNA, 20 bp, Artificial Sequence
  chemically synthesized
aatgtgggtgcatgatggtt

SEQ ID NO: 31134 - DNA, 20 bp, Artificial Sequence
  chemically synthesized
atgtgggtgcatgatggttg

SEQ ID NO: 31135 - DNA, 20 bp, Artificial Sequence
  chemically synthesized
tgggtgcatgatggttgggg

SEQ ID NO: 31136 - DNA, 20 bp, Artificial Sequence
  chemically synthesized
gggtgcatgatggttgggga

SEQ ID NO: 31137 - DNA, 20 bp, Artificial Sequence
  chemically synthesized
catgatggttggggaaggtg

SEQ ID NO: 31138 - DNA, 20 bp, Artificial Sequence
  chemically synthesized
aaggtgaagtatcaacacat

SEQ ID NO: 31139 - DNA, 20 bp, Artificial Sequence
  chemically synthesized
aagtatcaacacattagtgt

SEQ ID NO: 31140 - DNA, 20 bp, Artificial Sequence
  chemically synthesized
agtatcaacacattagtgtg

SEQ ID NO: 31141 - DNA, 20 bp, Artificial Sequence
  chemically synthesized
acacattagtgtgaggcatt

SEQ ID NO: 31142 - DNA, 20 bp, Artificial Sequence
  chemically synthesized
cacattagtgtgaggcattc

SEQ ID NO: 31143 - DNA, 20 bp, Artificial Sequence
  chemically synthesized
gcattcaggccttaaccttt

SEQ ID NO: 31144 - DNA, 20 bp, Artificial Sequence
  chemically synthesized
cattcaggccttaaccttta

SEQ ID NO: 31145 - DNA, 20 bp, Artificial Sequence
  chemically synthesized
ggccttaacctttaaggtat

SEQ ID NO: 31146 - DNA, 20 bp, Artificial Sequence
  chemically synthesized
ggtattagaattcattatta

SEQ ID NO: 31147 - DNA, 20 bp, Artificial Sequence
  chemically synthesized
gaatctaaatccattactaa

SEQ ID NO: 31148 - DNA, 20 bp, Artificial Sequence
  chemically synthesized
aatccattactaaaagtgaa

SEQ ID NO: 31149 - DNA, 20 bp, Artificial Sequence
  chemically synthesized
agtgaaaagtgtcactgtaa

SEQ ID NO: 31150 - DNA, 20 bp, Artificial Sequence
  chemically synthesized
cctatttgttaatgtgcaaa

SEQ ID NO: 31151 - DNA, 20 bp, Artificial Sequence
  chemically synthesized
aatattgtttgtgtgtgtgt

SEQ ID NO: 31152 - DNA, 20 bp, Artificial Sequence
  chemically synthesized
tattgtttgtgtgtgtgtga

SEQ ID NO: 31153 - DNA, 20 bp, Artificial Sequence
  chemically synthesized
ttgtttgtgtgtgtgtgaga

SEQ ID NO: 31154 - DNA, 20 bp, Artificial Sequence
  chemically synthesized
gtttgtgtgtgtgtgagaga

SEQ ID NO: 31155 - DNA, 20 bp, Artificial Sequence
  chemically synthesized
ttgtgtgtgtgtgagagaga

SEQ ID NO: 31156 - DNA, 20 bp, Artificial Sequence
  chemically synthesized
gtgtgtgtgtgagagagaga

SEQ ID NO: 31157 - DNA, 20 bp, Artificial Sequence
  chemically synthesized
gtgtgtgtgagagagagaga

SEQ ID NO: 31158 - DNA, 20 bp, Artificial Sequence
  chemically synthesized
gtgagagagagagagagaaa

SEQ ID NO: 31159 - DNA, 20 bp, Artificial Sequence
  chemically synthesized
gagagagagagagaaacagc

SEQ ID NO: 31160 - DNA, 20 bp, Artificial Sequence
  chemically synthesized
gagagagagaaacagcgagc

SEQ ID NO: 31161 - DNA, 20 bp, Artificial Sequence
  chemically synthesized
gagaaacagcgagcgagcga

SEQ ID NO: 31162 - DNA, 20 bp, Artificial Sequence
  chemically synthesized
gaaacagcgagcgagcgaca

SEQ ID NO: 31163 - DNA, 20 bp, Artificial Sequence
  chemically synthesized
aacagcgagcgagcgacaga

SEQ ID NO: 31164 - DNA, 20 bp, Artificial Sequence
  chemically synthesized
cagcgagcgagcgacagaga

SEQ ID NO: 31165 - DNA, 20 bp, Artificial Sequence
  chemically synthesized
gcgagcgagcgacagagaga

SEQ ID NO: 31166 - DNA, 20 bp, Artificial Sequence
  chemically synthesized
gagcgagcgacagagagaga

SEQ ID NO: 31167 - DNA, 20 bp, Artificial Sequence
  chemically synthesized
agcgagcgacagagagagag

SEQ ID NO: 31168 - DNA, 20 bp, Artificial Sequence
  chemically synthesized
gagcgacagagagagagagg

SEQ ID NO: 31169 - DNA, 20 bp, Artificial Sequence
  chemically synthesized
agcgacagagagagagaggt

SEQ ID NO: 31170 - DNA, 20 bp, Artificial Sequence
  chemically synthesized
gcgacagagagagagaggtg

SEQ ID NO: 31171 - DNA, 20 bp, Artificial Sequence
  chemically synthesized
acagagagagagaggtgggg

SEQ ID NO: 31172 - DNA, 20 bp, Artificial Sequence
  chemically synthesized
cagagagagagaggtggggt

SEQ ID NO: 31173 - DNA, 20 bp, Artificial Sequence
  chemically synthesized
agagagagagaggtggggtg

SEQ ID NO: 31174 - DNA, 20 bp, Artificial Sequence
  chemically synthesized
gagagagagaggtggggtgg

SEQ ID NO: 31175 - DNA, 20 bp, Artificial Sequence
  chemically synthesized
agagaggtggggtgggggta

SEQ ID NO: 31176 - DNA, 20 bp, Artificial Sequence
  chemically synthesized
gaggtggggtgggggtatgg

SEQ ID NO: 31177 - DNA, 20 bp, Artificial Sequence
  chemically synthesized
aggtggggtgggggtatggt

SEQ ID NO: 31178 - DNA, 20 bp, Artificial Sequence
  chemically synthesized
ggtggggtgggggtatggtg

SEQ ID NO: 31179 - DNA, 20 bp, Artificial Sequence
  chemically synthesized
ggggtgggggtatggtgggg

SEQ ID NO: 31180 - DNA, 20 bp, Artificial Sequence
  chemically synthesized
tgggggtatggtggggtgga

SEQ ID NO: 31181 - DNA, 20 bp, Artificial Sequence
  chemically synthesized
gtatggtggggtggaaagcc

SEQ ID NO: 31182 - DNA, 20 bp, Artificial Sequence
  chemically synthesized
gggtggaaagcctggctttc

SEQ ID NO: 31183 - DNA, 20 bp, Artificial Sequence
  chemically synthesized
ggtggaaagcctggctttca

SEQ ID NO: 31184 - DNA, 20 bp, Artificial Sequence
  chemically synthesized
gtggaaagcctggctttcaa

SEQ ID NO: 31185 - DNA, 20 bp, Artificial Sequence
  chemically synthesized
tggaaagcctggctttcaag

SEQ ID NO: 31186 - DNA, 20 bp, Artificial Sequence
  chemically synthesized
aagcctggctttcaaggggc

SEQ ID NO: 31187 - DNA, 20 bp, Artificial Sequence
  chemically synthesized
ggctttcaaggggccagtat

SEQ ID NO: 31188 - DNA, 20 bp, Artificial Sequence
  chemically synthesized
ggccagtataagttttattt

SEQ ID NO: 31189 - DNA, 20 bp, Artificial Sequence
  chemically synthesized
gccagtataagttttattta

SEQ ID NO: 31190 - DNA, 20 bp, Artificial Sequence
  chemically synthesized
ttatttaaggaacctctatc

SEQ ID NO: 31191 - DNA, 20 bp, Artificial Sequence
  chemically synthesized
ctctatccagaattgatacc

SEQ ID NO: 31192 - DNA, 20 bp, Artificial Sequence
  chemically synthesized
atccagaattgatacctagc

SEQ ID NO: 31193 - DNA, 20 bp, Artificial Sequence
  chemically synthesized
tgatacctagccagcccact

SEQ ID NO: 31194 - DNA, 20 bp, Artificial Sequence
  chemically synthesized
acctagccagcccactgagc

SEQ ID NO: 31195 - DNA, 20 bp, Artificial Sequence
  chemically synthesized
cctagccagcccactgagcc

SEQ ID NO: 31196 - DNA, 20 bp, Artificial Sequence
  chemically synthesized
ccagcccactgagccaggct

SEQ ID NO: 31197 - DNA, 20 bp, Artificial Sequence
  chemically synthesized
ccactgagccaggcttggtg

SEQ ID NO: 31198 - DNA, 20 bp, Artificial Sequence
  chemically synthesized
ctgagccaggcttggtgaag

SEQ ID NO: 31199 - DNA, 20 bp, Artificial Sequence
  chemically synthesized
tgagccaggcttggtgaagt

SEQ ID NO: 31200 - DNA, 20 bp, Artificial Sequence
  chemically synthesized
agccaggcttggtgaagtag

SEQ ID NO: 31201 - DNA, 20 bp, Artificial Sequence
  chemically synthesized
ggtgaagtaggagattcctt

SEQ ID NO: 31202 - DNA, 20 bp, Artificial Sequence
  chemically synthesized
gtgaagtaggagattccttc

SEQ ID NO: 31203 - DNA, 20 bp, Artificial Sequence
  chemically synthesized
gaagtaggagattccttcag

SEQ ID NO: 31204 - DNA, 20 bp, Artificial Sequence
  chemically synthesized
ttcaggagaactgaatcccc

SEQ ID NO: 31205 - DNA, 20 bp, Artificial Sequence
  chemically synthesized
tcaggagaactgaatcccca

SEQ ID NO: 31206 - DNA, 20 bp, Artificial Sequence
  chemically synthesized
caaggtctgtacacatgctg

SEQ ID NO: 31207 - DNA, 20 bp, Artificial Sequence
  chemically synthesized
catgctgtggttttccaatg

SEQ ID NO: 31208 - DNA, 20 bp, Artificial Sequence
  chemically synthesized
tggttttccaatgtagccac

SEQ ID NO: 31209 - DNA, 20 bp, Artificial Sequence
  chemically synthesized
ggttttccaatgtagccacc

SEQ ID NO: 31210 - DNA, 20 bp, Artificial Sequence
  chemically synthesized
gttttccaatgtagccacca

SEQ ID NO: 31211 - DNA, 20 bp, Artificial Sequence
  chemically synthesized
ttttccaatgtagccaccag

SEQ ID NO: 31212 - DNA, 20 bp, Artificial Sequence
  chemically synthesized
tttccaatgtagccaccagg

SEQ ID NO: 31213 - DNA, 20 bp, Artificial Sequence
  chemically synthesized
tccaatgtagccaccagggg

SEQ ID NO: 31214 - DNA, 20 bp, Artificial Sequence
  chemically synthesized
tagccaccagggggagcatt

SEQ ID NO: 31215 - DNA, 20 bp, Artificial Sequence
  chemically synthesized
ccagggggagcattcagccc

SEQ ID NO: 31216 - DNA, 20 bp, Artificial Sequence
  chemically synthesized
cagggggagcattcagccca

SEQ ID NO: 31217 - DNA, 20 bp, Artificial Sequence
  chemically synthesized
gggagcattcagcccaagga

SEQ ID NO: 31218 - DNA, 20 bp, Artificial Sequence
  chemically synthesized
ggagcattcagcccaaggat

SEQ ID NO: 31219 - DNA, 20 bp, Artificial Sequence
  chemically synthesized
ggataggcttaaattctgac

SEQ ID NO: 31220 - DNA, 20 bp, Artificial Sequence
  chemically synthesized
cttaaattctgaccagcacc

SEQ ID NO: 31221 - DNA, 20 bp, Artificial Sequence
  chemically synthesized
ttaaattctgaccagcacca

SEQ ID NO: 31222 - DNA, 20 bp, Artificial Sequence
  chemically synthesized
caccaaggccctactatccc

SEQ ID NO: 31223 - DNA, 20 bp, Artificial Sequence
  chemically synthesized
accaaggccctactatcccc

SEQ ID NO: 31224 - DNA, 20 bp, Artificial Sequence
  chemically synthesized
ccaaggccctactatcccca

SEQ ID NO: 31225 - DNA, 20 bp, Artificial Sequence
  chemically synthesized
ccctactatccccagggcac

SEQ ID NO: 31226 - DNA, 20 bp, Artificial Sequence
  chemically synthesized
ccccagggcacaagaaaatg

SEQ ID NO: 31227 - DNA, 20 bp, Artificial Sequence
  chemically synthesized
agaaaatgtggcttttcttc

SEQ ID NO: 31228 - DNA, 20 bp, Artificial Sequence
  chemically synthesized
tgtcctcaatacccactaca

SEQ ID NO: 31229 - DNA, 20 bp, Artificial Sequence
  chemically synthesized
aatacccactacacagctga

SEQ ID NO: 31230 - DNA, 20 bp, Artificial Sequence
  chemically synthesized
cacagctgaaagctgccaac

SEQ ID NO: 31231 - DNA, 20 bp, Artificial Sequence
  chemically synthesized
aaccagttcattcttccttt

SEQ ID NO: 31232 - DNA, 20 bp, Artificial Sequence
  chemically synthesized
accagttcattcttcctttg

SEQ ID NO: 31233 - DNA, 20 bp, Artificial Sequence
  chemically synthesized
cctctctctcatgcacaaaa

SEQ ID NO: 31234 - DNA, 20 bp, Artificial Sequence
  chemically synthesized
cacataaaaactaaaattga

SEQ ID NO: 31235 - DNA, 20 bp, Artificial Sequence
  chemically synthesized
cataaaaactaaaattgatg

SEQ ID NO: 31236 - DNA, 20 bp, Artificial Sequence
  chemically synthesized
taaaaactaaaattgatgga

SEQ ID NO: 31237 - DNA, 20 bp, Artificial Sequence
  chemically synthesized
aaaactaaaattgatggaga

SEQ ID NO: 31238 - DNA, 20 bp, Artificial Sequence
  chemically synthesized
ctaaaattgatggagagaga

SEQ ID NO: 31239 - DNA, 20 bp, Artificial Sequence
  chemically synthesized
taaaattgatggagagagat

SEQ ID NO: 31240 - DNA, 20 bp, Artificial Sequence
  chemically synthesized
tggagagagataggttttct

SEQ ID NO: 31241 - DNA, 20 bp, Artificial Sequence
  chemically synthesized
ataggttttcttagcttttt

SEQ ID NO: 31242 - DNA, 20 bp, Artificial Sequence
  chemically synthesized
ttagctttttcagattttta

SEQ ID NO: 31243 - DNA, 20 bp, Artificial Sequence
  chemically synthesized
ctttttcagatttttacaga

SEQ ID NO: 31244 - DNA, 20 bp, Artificial Sequence
  chemically synthesized
ctcacacaaatctatgtgtg

SEQ ID NO: 31245 - DNA, 20 bp, Artificial Sequence
  chemically synthesized
aaatctatgtgtgtggcctt

SEQ ID NO: 31246 - DNA, 20 bp, Artificial Sequence
  chemically synthesized
tagtcttaatcatattgacc

SEQ ID NO: 31247 - DNA, 20 bp, Artificial Sequence
  chemically synthesized
ccttaaatccccactctgac

SEQ ID NO: 31248 - DNA, 20 bp, Artificial Sequence
  chemically synthesized
atccccactctgaccagaaa

SEQ ID NO: 31249 - DNA, 20 bp, Artificial Sequence
  chemically synthesized
ctaaataaaatccttactca

SEQ ID NO: 31250 - DNA, 20 bp, Artificial Sequence
  chemically synthesized
taaataaaatccttactcac

SEQ ID NO: 31251 - DNA, 20 bp, Artificial Sequence
  chemically synthesized
aaataaaatccttactcaca

SEQ ID NO: 31252 - DNA, 20 bp, Artificial Sequence
  chemically synthesized
cacagggttctcaatgtctc

SEQ ID NO: 31253 - DNA, 20 bp, Artificial Sequence
  chemically synthesized
caatgtctccagactcacaa

SEQ ID NO: 31254 - DNA, 20 bp, Artificial Sequence
  chemically synthesized
gactcacaacagactctttt

SEQ ID NO: 31255 - DNA, 20 bp, Artificial Sequence
  chemically synthesized
actcacaacagactcttttt

SEQ ID NO: 31256 - DNA, 20 bp, Artificial Sequence
  chemically synthesized
ctttttaggtgtctctgtca

SEQ ID NO: 31257 - DNA, 20 bp, Artificial Sequence
  chemically synthesized
ggtgtctctgtcacagaaaa

SEQ ID NO: 31258 - DNA, 20 bp, Artificial Sequence
  chemically synthesized
ctgtcacagaaaatggccac

SEQ ID NO: 31259 - DNA, 20 bp, Artificial Sequence
  chemically synthesized
tgtcacagaaaatggccaca

SEQ ID NO: 31260 - DNA, 20 bp, Artificial Sequence
  chemically synthesized
ccacaaggtcacctcactct

SEQ ID NO: 31261 - DNA, 20 bp, Artificial Sequence
  chemically synthesized
cacaaggtcacctcactctc

SEQ ID NO: 31262 - DNA, 20 bp, Artificial Sequence
  chemically synthesized
cacctcactctcaggcctgt

SEQ ID NO: 31263 - DNA, 20 bp, Artificial Sequence
  chemically synthesized
actctcaggcctgttagaac

SEQ ID NO: 31264 - DNA, 20 bp, Artificial Sequence
  chemically synthesized
ctgttagaacaagtccttcc

SEQ ID NO: 31265 - DNA, 20 bp, Artificial Sequence
  chemically synthesized
ttagaacaagtccttcccag

SEQ ID NO: 31266 - DNA, 20 bp, Artificial Sequence
  chemically synthesized
cccagaagaactccattttg

SEQ ID NO: 31267 - DNA, 20 bp, Artificial Sequence
  chemically synthesized
agaactccattttgtggtgt

SEQ ID NO: 31268 - DNA, 20 bp, Artificial Sequence
  chemically synthesized
tttgtggtgtgagatcgatg

SEQ ID NO: 31269 - DNA, 20 bp, Artificial Sequence
  chemically synthesized
ttgtggtgtgagatcgatgc

SEQ ID NO: 31270 - DNA, 20 bp, Artificial Sequence
  chemically synthesized
tgagatcgatgcgggtcttt

SEQ ID NO: 31271 - DNA, 20 bp, Artificial Sequence
  chemically synthesized
tcgatgcgggtctttcagac

SEQ ID NO: 31272 - DNA, 20 bp, Artificial Sequence
  chemically synthesized
gatgcgggtctttcagactg

SEQ ID NO: 31273 - DNA, 20 bp, Artificial Sequence
  chemically synthesized
tgcgggtctttcagactgga

SEQ ID NO: 31274 - DNA, 20 bp, Artificial Sequence
  chemically synthesized
tttcagactggagagaccca

SEQ ID NO: 31275 - DNA, 20 bp, Artificial Sequence
  chemically synthesized
cagactggagagacccacag

SEQ ID NO: 31276 - DNA, 20 bp, Artificial Sequence
  chemically synthesized
ctggagagacccacagaagt

SEQ ID NO: 31277 - DNA, 20 bp, Artificial Sequence
  chemically synthesized
tggagagacccacagaagtt

SEQ ID NO: 31278 - DNA, 20 bp, Artificial Sequence
  chemically synthesized
acagaagttaggattgccaa

SEQ ID NO: 31279 - DNA, 20 bp, Artificial Sequence
  chemically synthesized
cagaagttaggattgccaaa

SEQ ID NO: 31280 - DNA, 20 bp, Artificial Sequence
  chemically synthesized
agaagttaggattgccaaaa

SEQ ID NO: 31281 - DNA, 20 bp, Artificial Sequence
  chemically synthesized
ggattgccaaaagggtcttc

SEQ ID NO: 31282 - DNA, 20 bp, Artificial Sequence
  chemically synthesized
gccaaaagggtcttctggac

SEQ ID NO: 31283 - DNA, 20 bp, Artificial Sequence
  chemically synthesized
gggtcttctggactggtcca

SEQ ID NO: 31284 - DNA, 20 bp, Artificial Sequence
  chemically synthesized
tggactggtccacagcccct

SEQ ID NO: 31285 - DNA, 20 bp, Artificial Sequence
  chemically synthesized
tgtccatccccctgcctccc

SEQ ID NO: 31286 - DNA, 20 bp, Artificial Sequence
  chemically synthesized
cacctgcatctgtgtgtgca

SEQ ID NO: 31287 - DNA, 20 bp, Artificial Sequence
  chemically synthesized
cctgcatctgtgtgtgcaca

SEQ ID NO: 31288 - DNA, 20 bp, Artificial Sequence
  chemically synthesized
tgcatctgtgtgtgcacaga

SEQ ID NO: 31289 - DNA, 20 bp, Artificial Sequence
  chemically synthesized
ctgtgtgtgcacagagagtc

SEQ ID NO: 31290 - DNA, 20 bp, Artificial Sequence
  chemically synthesized
tgtgtgcacagagagtctgg

SEQ ID NO: 31291 - DNA, 20 bp, Artificial Sequence
  chemically synthesized
gtgtgcacagagagtctgga

SEQ ID NO: 31292 - DNA, 20 bp, Artificial Sequence
  chemically synthesized
cagagagtctggaaggttta

SEQ ID NO: 31293 - DNA, 20 bp, Artificial Sequence
  chemically synthesized
gagagtctggaaggtttaca

SEQ ID NO: 31294 - DNA, 20 bp, Artificial Sequence
  chemically synthesized
agtctggaaggtttacagag

SEQ ID NO: 31295 - DNA, 20 bp, Artificial Sequence
  chemically synthesized
gaagtctccacatcttccca

SEQ ID NO: 31296 - DNA, 20 bp, Artificial Sequence
  chemically synthesized
tcttcccacagcaactcttt

SEQ ID NO: 31297 - DNA, 20 bp, Artificial Sequence
  chemically synthesized
cgtaacatcctacctctctt

SEQ ID NO: 31298 - DNA, 20 bp, Artificial Sequence
  chemically synthesized
cctctcttcagtcattatga

SEQ ID NO: 31299 - DNA, 20 bp, Artificial Sequence
  chemically synthesized
ctctcttcagtcattatgaa

SEQ ID NO: 31300 - DNA, 20 bp, Artificial Sequence
  chemically synthesized
tctcttcagtcattatgaaa

SEQ ID NO: 31301 - DNA, 20 bp, Artificial Sequence
  chemically synthesized
ttttcattgtgaaaactttt

SEQ ID NO: 31302 - DNA, 20 bp, Artificial Sequence
  chemically synthesized
ttcattgtgaaaacttttca

SEQ ID NO: 31303 - DNA, 20 bp, Artificial Sequence
  chemically synthesized
cattgtgaaaacttttcaga

SEQ ID NO: 31304 - DNA, 20 bp, Artificial Sequence
  chemically synthesized
cttttcagagagaccccttt

SEQ ID NO: 31305 - DNA, 20 bp, Artificial Sequence
  chemically synthesized
ttttcagagagacccctttt

SEQ ID NO: 31306 - DNA, 20 bp, Artificial Sequence
  chemically synthesized
ccatctcttctccccactcc

SEQ ID NO: 31307 - DNA, 20 bp, Artificial Sequence
  chemically synthesized
ctcttctccccactccaagt

SEQ ID NO: 31308 - DNA, 20 bp, Artificial Sequence
  chemically synthesized
tcttctccccactccaagtt

SEQ ID NO: 31309 - DNA, 20 bp, Artificial Sequence
  chemically synthesized
ccccactccaagttgggcta

SEQ ID NO: 31310 - DNA, 20 bp, Artificial Sequence
  chemically synthesized
tccaagttgggctaaagttt

SEQ ID NO: 31311 - DNA, 20 bp, Artificial Sequence
  chemically synthesized
catattttgatttgctataa

SEQ ID NO: 31312 - DNA, 20 bp, Artificial Sequence
  chemically synthesized
tattttgatttgctataaca

SEQ ID NO: 31313 - DNA, 20 bp, Artificial Sequence
  chemically synthesized
tttgctataacagagtacct

SEQ ID NO: 31314 - DNA, 20 bp, Artificial Sequence
  chemically synthesized
tataacagagtacctgagtc

SEQ ID NO: 31315 - DNA, 20 bp, Artificial Sequence
  chemically synthesized
ataacagagtacctgagtct

SEQ ID NO: 31316 - DNA, 20 bp, Artificial Sequence
  chemically synthesized
acagagtacctgagtctggg

SEQ ID NO: 31317 - DNA, 20 bp, Artificial Sequence
  chemically synthesized
tagcttatttttttttttta

SEQ ID NO: 31318 - DNA, 20 bp, Artificial Sequence
  chemically synthesized
tttttttttaaagttttgtt

SEQ ID NO: 31319 - DNA, 20 bp, Artificial Sequence
  chemically synthesized
ttttgtttggttcatgattc

SEQ ID NO: 31320 - DNA, 20 bp, Artificial Sequence
  chemically synthesized
tcatgattctggtgacttaa

SEQ ID NO: 31321 - DNA, 20 bp, Artificial Sequence
  chemically synthesized
ttctggtgacttaaaagtcc

SEQ ID NO: 31322 - DNA, 20 bp, Artificial Sequence
  chemically synthesized
gtgacttaaaagtccaagat

SEQ ID NO: 31323 - DNA, 20 bp, Artificial Sequence
  chemically synthesized
tgacttaaaagtccaagatc

SEQ ID NO: 31324 - DNA, 20 bp, Artificial Sequence
  chemically synthesized
cttaaaagtccaagatcggg

SEQ ID NO: 31325 - DNA, 20 bp, Artificial Sequence
  chemically synthesized
tcgggcggttgcatctgata

SEQ ID NO: 31326 - DNA, 20 bp, Artificial Sequence
  chemically synthesized
cgggcggttgcatctgataa

SEQ ID NO: 31327 - DNA, 20 bp, Artificial Sequence
  chemically synthesized
atctgataaaggtctcatgc

SEQ ID NO: 31328 - DNA, 20 bp, Artificial Sequence
  chemically synthesized
tctcatgctggttccaaaca

SEQ ID NO: 31329 - DNA, 20 bp, Artificial Sequence
  chemically synthesized
catgctggttccaaacatgg

SEQ ID NO: 31330 - DNA, 20 bp, Artificial Sequence
  chemically synthesized
ctggttccaaacatggcaga

SEQ ID NO: 31331 - DNA, 20 bp, Artificial Sequence
  chemically synthesized
gttccaaacatggcagaaag

SEQ ID NO: 31332 - DNA, 20 bp, Artificial Sequence
  chemically synthesized
aacatggcagaaagcagaca

SEQ ID NO: 31333 - DNA, 20 bp, Artificial Sequence
  chemically synthesized
catggcagaaagcagacaaa

SEQ ID NO: 31334 - DNA, 20 bp, Artificial Sequence
  chemically synthesized
gcagaaagcagacaaagagc

SEQ ID NO: 31335 - DNA, 20 bp, Artificial Sequence
  chemically synthesized
gacaaagagcaagtgcatgc

SEQ ID NO: 31336 - DNA, 20 bp, Artificial Sequence
  chemically synthesized
acaaagagcaagtgcatgca

SEQ ID NO: 31337 - DNA, 20 bp, Artificial Sequence
  chemically synthesized
aaagagcaagtgcatgcaag

SEQ ID NO: 31338 - DNA, 20 bp, Artificial Sequence
  chemically synthesized
atgcaaggagatcacatgat

SEQ ID NO: 31339 - DNA, 20 bp, Artificial Sequence
  chemically synthesized
gcaaggagatcacatgatga

SEQ ID NO: 31340 - DNA, 20 bp, Artificial Sequence
  chemically synthesized
aaggagatcacatgatgaga

SEQ ID NO: 31341 - DNA, 20 bp, Artificial Sequence
  chemically synthesized
aggagatcacatgatgagag

SEQ ID NO: 31342 - DNA, 20 bp, Artificial Sequence
  chemically synthesized
cacatgatgagagaggacgc

SEQ ID NO: 31343 - DNA, 20 bp, Artificial Sequence
  chemically synthesized
acatgatgagagaggacgcc

SEQ ID NO: 31344 - DNA, 20 bp, Artificial Sequence
  chemically synthesized
catgatgagagaggacgcca

SEQ ID NO: 31345 - DNA, 20 bp, Artificial Sequence
  chemically synthesized
tgatgagagaggacgccagg

SEQ ID NO: 31346 - DNA, 20 bp, Artificial Sequence
  chemically synthesized
atgagagaggacgccaggga

SEQ ID NO: 31347 - DNA, 20 bp, Artificial Sequence
  chemically synthesized
ggacgccagggagagaaacc

SEQ ID NO: 31348 - DNA, 20 bp, Artificial Sequence
  chemically synthesized
gccagggagagaaacccaga

SEQ ID NO: 31349 - DNA, 20 bp, Artificial Sequence
  chemically synthesized
gggagagaaacccagaaagc

SEQ ID NO: 31350 - DNA, 20 bp, Artificial Sequence
  chemically synthesized
aacccagaaagccagactca

SEQ ID NO: 31351 - DNA, 20 bp, Artificial Sequence
  chemically synthesized
acccagaaagccagactcat

SEQ ID NO: 31352 - DNA, 20 bp, Artificial Sequence
  chemically synthesized
agaaagccagactcatggga

SEQ ID NO: 31353 - DNA, 20 bp, Artificial Sequence
  chemically synthesized
cagactcatgggaaagtatc

SEQ ID NO: 31354 - DNA, 20 bp, Artificial Sequence
  chemically synthesized
ctgtccaccatatgtgaaat

SEQ ID NO: 31355 - DNA, 20 bp, Artificial Sequence
  chemically synthesized
atgtgaaattagaattctaa

SEQ ID NO: 31356 - DNA, 20 bp, Artificial Sequence
  chemically synthesized
tgtgaaattagaattctaaa

SEQ ID NO: 31357 - DNA, 20 bp, Artificial Sequence
  chemically synthesized
ttctaaaaggaaacaaaaaa

SEQ ID NO: 31358 - DNA, 20 bp, Artificial Sequence
  chemically synthesized
aaatggattaaacgtttttt

SEQ ID NO: 31359 - DNA, 20 bp, Artificial Sequence
  chemically synthesized
aatggattaaacgttttttg

SEQ ID NO: 31360 - DNA, 20 bp, Artificial Sequence
  chemically synthesized
tgactgaatgtttcaacatc

SEQ ID NO: 31361 - DNA, 20 bp, Artificial Sequence
  chemically synthesized
aatctattaattcatatctt

SEQ ID NO: 31362 - DNA, 20 bp, Artificial Sequence
  chemically synthesized
tcatatctttagctaacctt

SEQ ID NO: 31363 - DNA, 20 bp, Artificial Sequence
  chemically synthesized
ctaaatgcatatcttacaaa

SEQ ID NO: 31364 - DNA, 20 bp, Artificial Sequence
  chemically synthesized
caaatgtatgccaatcttaa

SEQ ID NO: 31365 - DNA, 20 bp, Artificial Sequence
  chemically synthesized
atgtatgccaatcttaaaag

SEQ ID NO: 31366 - DNA, 20 bp, Artificial Sequence
  chemically synthesized
gccaatcttaaaagcagaca

SEQ ID NO: 31367 - DNA, 20 bp, Artificial Sequence
  chemically synthesized
cttaaaagcagacatagaaa

SEQ ID NO: 31368 - DNA, 20 bp, Artificial Sequence
  chemically synthesized
gaaaaagacacattgcatac

SEQ ID NO: 31369 - DNA, 20 bp, Artificial Sequence
  chemically synthesized
attgcatacaagaaaattat

SEQ ID NO: 31370 - DNA, 20 bp, Artificial Sequence
  chemically synthesized
tgcatacaagaaaattatta

SEQ ID NO: 31371 - DNA, 20 bp, Artificial Sequence
  chemically synthesized
gcatacaagaaaattattag

SEQ ID NO: 31372 - DNA, 20 bp, Artificial Sequence
  chemically synthesized
aaaattattagaggaaacaa

SEQ ID NO: 31373 - DNA, 20 bp, Artificial Sequence
  chemically synthesized
ggaaacctgaaaaaataaac

SEQ ID NO: 31374 - DNA, 20 bp, Artificial Sequence
  chemically synthesized
tattattattattatacttt

SEQ ID NO: 31375 - DNA, 20 bp, Artificial Sequence
  chemically synthesized
tattattatactttaagatt

SEQ ID NO: 31376 - DNA, 20 bp, Artificial Sequence
  chemically synthesized
attattatactttaagattt

SEQ ID NO: 31377 - DNA, 20 bp, Artificial Sequence
  chemically synthesized
ttattatactttaagattta

SEQ ID NO: 31378 - DNA, 20 bp, Artificial Sequence
  chemically synthesized
ggtacatgtgcataatgtgc

SEQ ID NO: 31379 - DNA, 20 bp, Artificial Sequence
  chemically synthesized
catgtgcataatgtgccggt

SEQ ID NO: 31380 - DNA, 20 bp, Artificial Sequence
  chemically synthesized
tatgtatacatgtgccatgt

SEQ ID NO: 31381 - DNA, 20 bp, Artificial Sequence
  chemically synthesized
gcacccattaactcgtaatt

SEQ ID NO: 31382 - DNA, 20 bp, Artificial Sequence
  chemically synthesized
attaactcgtaatttagcat

SEQ ID NO: 31383 - DNA, 20 bp, Artificial Sequence
  chemically synthesized
ttaactcgtaatttagcatt

SEQ ID NO: 31384 - DNA, 20 bp, Artificial Sequence
  chemically synthesized
cctgcacccccaccccacaa

SEQ ID NO: 31385 - DNA, 20 bp, Artificial Sequence
  chemically synthesized
ccccaccccacaacagtccc

SEQ ID NO: 31386 - DNA, 20 bp, Artificial Sequence
  chemically synthesized
ccaccccacaacagtcccca

SEQ ID NO: 31387 - DNA, 20 bp, Artificial Sequence
  chemically synthesized
gtccatgtgttctcattgtt

SEQ ID NO: 31388 - DNA, 20 bp, Artificial Sequence
  chemically synthesized
attgttcagttcccatctat

SEQ ID NO: 31389 - DNA, 20 bp, Artificial Sequence
  chemically synthesized
ttcagttcccatctatgagt

SEQ ID NO: 31390 - DNA, 20 bp, Artificial Sequence
  chemically synthesized
catctatgagtgagaatatg

SEQ ID NO: 31391 - DNA, 20 bp, Artificial Sequence
  chemically synthesized
gagtgagaatatgtggtgtt

SEQ ID NO: 31392 - DNA, 20 bp, Artificial Sequence
  chemically synthesized
ttggttttttgtccttgcga

SEQ ID NO: 31393 - DNA, 20 bp, Artificial Sequence
  chemically synthesized
tgtccttgcgatagtttact

SEQ ID NO: 31394 - DNA, 20 bp, Artificial Sequence
  chemically synthesized
atttcatccatgtccctaca

SEQ ID NO: 31395 - DNA, 20 bp, Artificial Sequence
  chemically synthesized
tttcatccatgtccctacaa

SEQ ID NO: 31396 - DNA, 20 bp, Artificial Sequence
  chemically synthesized
acatgaactcatcattttta

SEQ ID NO: 31397 - DNA, 20 bp, Artificial Sequence
  chemically synthesized
tcatcatttttatggctgca

SEQ ID NO: 31398 - DNA, 20 bp, Artificial Sequence
  chemically synthesized
tatggctgcatagtattcca

SEQ ID NO: 31399 - DNA, 20 bp, Artificial Sequence
  chemically synthesized
tgtgccacattttcttaatc

SEQ ID NO: 31400 - DNA, 20 bp, Artificial Sequence
  chemically synthesized
ttaatccagtctatcattgt

SEQ ID NO: 31401 - DNA, 20 bp, Artificial Sequence
  chemically synthesized
gtctatcattgttggacatt

SEQ ID NO: 31402 - DNA, 20 bp, Artificial Sequence
  chemically synthesized
tctatcattgttggacattt

SEQ ID NO: 31403 - DNA, 20 bp, Artificial Sequence
  chemically synthesized
tcattgttggacatttgggt

SEQ ID NO: 31404 - DNA, 20 bp, Artificial Sequence
  chemically synthesized
tggacatttgggttggttcc

SEQ ID NO: 31405 - DNA, 20 bp, Artificial Sequence
  chemically synthesized
caagtctttgctattgtgaa

SEQ ID NO: 31406 - DNA, 20 bp, Artificial Sequence
  chemically synthesized
tacgtgtgcatgtgtcttta

SEQ ID NO: 31407 - DNA, 20 bp, Artificial Sequence
  chemically synthesized
gtgtgcatgtgtctttatag

SEQ ID NO: 31408 - DNA, 20 bp, Artificial Sequence
  chemically synthesized
cagcatgatttatattcctt

SEQ ID NO: 31409 - DNA, 20 bp, Artificial Sequence
  chemically synthesized
agcatgatttatattccttt

SEQ ID NO: 31410 - DNA, 20 bp, Artificial Sequence
  chemically synthesized
tattcctttgggtatatacc

SEQ ID NO: 31411 - DNA, 20 bp, Artificial Sequence
  chemically synthesized
tttgggtatatacccagtaa

SEQ ID NO: 31412 - DNA, 20 bp, Artificial Sequence
  chemically synthesized
ttgggtatatacccagtaat

SEQ ID NO: 31413 - DNA, 20 bp, Artificial Sequence
  chemically synthesized
gtatatacccagtaatggga

SEQ ID NO: 31414 - DNA, 20 bp, Artificial Sequence
  chemically synthesized
atacccagtaatgggatggc

SEQ ID NO: 31415 - DNA, 20 bp, Artificial Sequence
  chemically synthesized
tacccagtaatgggatggct

SEQ ID NO: 31416 - DNA, 20 bp, Artificial Sequence
  chemically synthesized
aatgggatggctgggtcaaa

SEQ ID NO: 31417 - DNA, 20 bp, Artificial Sequence
  chemically synthesized
gctgggtcaaatggtatttc

SEQ ID NO: 31418 - DNA, 20 bp, Artificial Sequence
  chemically synthesized
tcaaatggtatttctagttc

SEQ ID NO: 31419 - DNA, 20 bp, Artificial Sequence
  chemically synthesized
atttctagttctagatccct

SEQ ID NO: 31420 - DNA, 20 bp, Artificial Sequence
  chemically synthesized
tttctagttctagatccctg

SEQ ID NO: 31421 - DNA, 20 bp, Artificial Sequence
  chemically synthesized
cgccacactgacttccacaa

SEQ ID NO: 31422 - DNA, 20 bp, Artificial Sequence
  chemically synthesized
gacttccacaatggttgaac

SEQ ID NO: 31423 - DNA, 20 bp, Artificial Sequence
  chemically synthesized
acaatggttgaactagttta

SEQ ID NO: 31424 - DNA, 20 bp, Artificial Sequence
  chemically synthesized
aactagtttacagtcccacc

SEQ ID NO: 31425 - DNA, 20 bp, Artificial Sequence
  chemically synthesized
ctagtttacagtcccaccaa

SEQ ID NO: 31426 - DNA, 20 bp, Artificial Sequence
  chemically synthesized
cagtcccaccaagagtgtaa

SEQ ID NO: 31427 - DNA, 20 bp, Artificial Sequence
  chemically synthesized
ctatttctccacatcctctc

SEQ ID NO: 31428 - DNA, 20 bp, Artificial Sequence
  chemically synthesized
ttaatgattgccattctaac

SEQ ID NO: 31429 - DNA, 20 bp, Artificial Sequence
  chemically synthesized
attgccattctaactggtat

SEQ ID NO: 31430 - DNA, 20 bp, Artificial Sequence
  chemically synthesized
ccattctaactggtatgaga

SEQ ID NO: 31431 - DNA, 20 bp, Artificial Sequence
  chemically synthesized
tatgagatggtatctcattg

SEQ ID NO: 31432 - DNA, 20 bp, Artificial Sequence
  chemically synthesized
tttgatttgcatttctctga

SEQ ID NO: 31433 - DNA, 20 bp, Artificial Sequence
  chemically synthesized
atttgcatttctctgatggc

SEQ ID NO: 31434 - DNA, 20 bp, Artificial Sequence
  chemically synthesized
ctctgatggccagtgatgat

SEQ ID NO: 31435 - DNA, 20 bp, Artificial Sequence
  chemically synthesized
gcattttttcatgtgtcttt

SEQ ID NO: 31436 - DNA, 20 bp, Artificial Sequence
  chemically synthesized
ttgcataaatgttttctttt

SEQ ID NO: 31437 - DNA, 20 bp, Artificial Sequence
  chemically synthesized
cataaatgttttcttttgag

SEQ ID NO: 31438 - DNA, 20 bp, Artificial Sequence
  chemically synthesized
atcctttgcccacttgttga

SEQ ID NO: 31439 - DNA, 20 bp, Artificial Sequence
  chemically synthesized
tcctttgcccacttgttgat

SEQ ID NO: 31440 - DNA, 20 bp, Artificial Sequence
  chemically synthesized
cctttgcccacttgttgatg

SEQ ID NO: 31441 - DNA, 20 bp, Artificial Sequence
  chemically synthesized
tttttcttgtaaatttgttt

SEQ ID NO: 31442 - DNA, 20 bp, Artificial Sequence
  chemically synthesized
aaatttgtttgagttcatta

SEQ ID NO: 31443 - DNA, 20 bp, Artificial Sequence
  chemically synthesized
tttgagttcattatagattc

SEQ ID NO: 31444 - DNA, 20 bp, Artificial Sequence
  chemically synthesized
tcattatagattctggatat

SEQ ID NO: 31445 - DNA, 20 bp, Artificial Sequence
  chemically synthesized
tctggatattagccctttgt

SEQ ID NO: 31446 - DNA, 20 bp, Artificial Sequence
  chemically synthesized
atattagccctttgtcagat

SEQ ID NO: 31447 - DNA, 20 bp, Artificial Sequence
  chemically synthesized
ttagccctttgtcagatgag

SEQ ID NO: 31448 - DNA, 20 bp, Artificial Sequence
  chemically synthesized
tagccctttgtcagatgagt

SEQ ID NO: 31449 - DNA, 20 bp, Artificial Sequence
  chemically synthesized
gaaaattttctcccattgtg

SEQ ID NO: 31450 - DNA, 20 bp, Artificial Sequence
  chemically synthesized
aaaattttctcccattgtgt

SEQ ID NO: 31451 - DNA, 20 bp, Artificial Sequence
  chemically synthesized
aggttgcctgttcactctga

SEQ ID NO: 31452 - DNA, 20 bp, Artificial Sequence
  chemically synthesized
ttgcctgttcactctgatgg

SEQ ID NO: 31453 - DNA, 20 bp, Artificial Sequence
  chemically synthesized
cactctgatggtagtttctt

SEQ ID NO: 31454 - DNA, 20 bp, Artificial Sequence
  chemically synthesized
tggtagtttctttagctgtg

SEQ ID NO: 31455 - DNA, 20 bp, Artificial Sequence
  chemically synthesized
tagtttctttagctgtgcag

SEQ ID NO: 31456 - DNA, 20 bp, Artificial Sequence
  chemically synthesized
ttagctgtgcagaagctctt

SEQ ID NO: 31457 - DNA, 20 bp, Artificial Sequence
  chemically synthesized
cagaagctctttagtttcat

SEQ ID NO: 31458 - DNA, 20 bp, Artificial Sequence
  chemically synthesized
ttagtttcattagatcccat

SEQ ID NO: 31459 - DNA, 20 bp, Artificial Sequence
  chemically synthesized
tagatcccattagtgaattt

SEQ ID NO: 31460 - DNA, 20 bp, Artificial Sequence
  chemically synthesized
gcttttgttgccatcgcttt

SEQ ID NO: 31461 - DNA, 20 bp, Artificial Sequence
  chemically synthesized
tgccatcgcttttggtgttt

SEQ ID NO: 31462 - DNA, 20 bp, Artificial Sequence
  chemically synthesized
cttttggtgttttagacatg

SEQ ID NO: 31463 - DNA, 20 bp, Artificial Sequence
  chemically synthesized
gcccatgcctatgtcctgaa

SEQ ID NO: 31464 - DNA, 20 bp, Artificial Sequence
  chemically synthesized
gtaatgcctgcgttttcttc

SEQ ID NO: 31465 - DNA, 20 bp, Artificial Sequence
  chemically synthesized
taatgcctgcgttttcttct

SEQ ID NO: 31466 - DNA, 20 bp, Artificial Sequence
  chemically synthesized
aatgcctgcgttttcttcta

SEQ ID NO: 31467 - DNA, 20 bp, Artificial Sequence
  chemically synthesized
gttttcttctagggttttta

SEQ ID NO: 31468 - DNA, 20 bp, Artificial Sequence
  chemically synthesized
ttctagggtttttatggttt

SEQ ID NO: 31469 - DNA, 20 bp, Artificial Sequence
  chemically synthesized
tctagggtttttatggtttt

SEQ ID NO: 31470 - DNA, 20 bp, Artificial Sequence
  chemically synthesized
tggttttaggtctaatgttt

SEQ ID NO: 31471 - DNA, 20 bp, Artificial Sequence
  chemically synthesized
tcttgaattaatttttgtat

SEQ ID NO: 31472 - DNA, 20 bp, Artificial Sequence
  chemically synthesized
cttgaattaatttttgtata

SEQ ID NO: 31473 - DNA, 20 bp, Artificial Sequence
  chemically synthesized
ttaatttttgtataaggtgt

SEQ ID NO: 31474 - DNA, 20 bp, Artificial Sequence
  chemically synthesized
taatttttgtataaggtgta

SEQ ID NO: 31475 - DNA, 20 bp, Artificial Sequence
  chemically synthesized
tttttgtataaggtgtaagg

SEQ ID NO: 31476 - DNA, 20 bp, Artificial Sequence
  chemically synthesized
ttttgtataaggtgtaagga

SEQ ID NO: 31477 - DNA, 20 bp, Artificial Sequence
  chemically synthesized
tttgtataaggtgtaaggaa

SEQ ID NO: 31478 - DNA, 20 bp, Artificial Sequence
  chemically synthesized
taaggtgtaaggaagggatc

SEQ ID NO: 31479 - DNA, 20 bp, Artificial Sequence
  chemically synthesized
gtaaggaagggatccagttt

SEQ ID NO: 31480 - DNA, 20 bp, Artificial Sequence
  chemically synthesized
cagtttcagcattctacata

SEQ ID NO: 31481 - DNA, 20 bp, Artificial Sequence
  chemically synthesized
ttcagcattctacatatggc

SEQ ID NO: 31482 - DNA, 20 bp, Artificial Sequence
  chemically synthesized
gcattctacatatggctagc

SEQ ID NO: 31483 - DNA, 20 bp, Artificial Sequence
  chemically synthesized
atatggctagccagttctcc

SEQ ID NO: 31484 - DNA, 20 bp, Artificial Sequence
  chemically synthesized
tcccagcaccatttattaaa

SEQ ID NO: 31485 - DNA, 20 bp, Artificial Sequence
  chemically synthesized
cccagcaccatttattaaat

SEQ ID NO: 31486 - DNA, 20 bp, Artificial Sequence
  chemically synthesized
ccagcaccatttattaaata

SEQ ID NO: 31487 - DNA, 20 bp, Artificial Sequence
  chemically synthesized
tccccatttcttgtttttct

SEQ ID NO: 31488 - DNA, 20 bp, Artificial Sequence
  chemically synthesized
ccccatttcttgtttttctc

SEQ ID NO: 31489 - DNA, 20 bp, Artificial Sequence
  chemically synthesized
tgtttttctcaggtttttca

SEQ ID NO: 31490 - DNA, 20 bp, Artificial Sequence
  chemically synthesized
ttctcaggtttttcaaagat

SEQ ID NO: 31491 - DNA, 20 bp, Artificial Sequence
  chemically synthesized
caggtttttcaaagatcaga

SEQ ID NO: 31492 - DNA, 20 bp, Artificial Sequence
  chemically synthesized
tttcaaagatcagatagttg

SEQ ID NO: 31493 - DNA, 20 bp, Artificial Sequence
  chemically synthesized
agatatgcgtcgttatttct

SEQ ID NO: 31494 - DNA, 20 bp, Artificial Sequence
  chemically synthesized
gatatgcgtcgttatttctg

SEQ ID NO: 31495 - DNA, 20 bp, Artificial Sequence
  chemically synthesized
atatgcgtcgttatttctga

SEQ ID NO: 31496 - DNA, 20 bp, Artificial Sequence
  chemically synthesized
attgatctatatctgtgttt

SEQ ID NO: 31497 - DNA, 20 bp, Artificial Sequence
  chemically synthesized
ctatatctgtgttttggtac

SEQ ID NO: 31498 - DNA, 20 bp, Artificial Sequence
  chemically synthesized
gtaccagtaacatgctgttt

SEQ ID NO: 31499 - DNA, 20 bp, Artificial Sequence
  chemically synthesized
acatgctgttttggttactg

SEQ ID NO: 31500 - DNA, 20 bp, Artificial Sequence
  chemically synthesized
ttttggttactgtagccttg

SEQ ID NO: 31501 - DNA, 20 bp, Artificial Sequence
  chemically synthesized
gttactgtagccttgtagta

SEQ ID NO: 31502 - DNA, 20 bp, Artificial Sequence
  chemically synthesized
tagccttgtagtatagtttg

SEQ ID NO: 31503 - DNA, 20 bp, Artificial Sequence
  chemically synthesized
cttgtagtatagtttgaagt

SEQ ID NO: 31504 - DNA, 20 bp, Artificial Sequence
  chemically synthesized
ttgtagtatagtttgaagtg

SEQ ID NO: 31505 - DNA, 20 bp, Artificial Sequence
  chemically synthesized
tagtatagtttgaagtgagg

SEQ ID NO: 31506 - DNA, 20 bp, Artificial Sequence
  chemically synthesized
gtgaggtagcctgatgcctc

SEQ ID NO: 31507 - DNA, 20 bp, Artificial Sequence
  chemically synthesized
tgcctccagctttgttcttt

SEQ ID NO: 31508 - DNA, 20 bp, Artificial Sequence
  chemically synthesized
ccagctttgttcttttggct

SEQ ID NO: 31509 - DNA, 20 bp, Artificial Sequence
  chemically synthesized
cagctttgttcttttggctt

SEQ ID NO: 31510 - DNA, 20 bp, Artificial Sequence
  chemically synthesized
cttttggcttaggattgact

SEQ ID NO: 31511 - DNA, 20 bp, Artificial Sequence
  chemically synthesized
ttaggattgacttggcaatg

SEQ ID NO: 31512 - DNA, 20 bp, Artificial Sequence
  chemically synthesized
taggattgacttggcaatgc

SEQ ID NO: 31513 - DNA, 20 bp, Artificial Sequence
  chemically synthesized
tggcaatgcaggctcttttt

SEQ ID NO: 31514 - DNA, 20 bp, Artificial Sequence
  chemically synthesized
ttggttccatatgaacttta

SEQ ID NO: 31515 - DNA, 20 bp, Artificial Sequence
  chemically synthesized
gtcgtttttccaattctgtg

SEQ ID NO: 31516 - DNA, 20 bp, Artificial Sequence
  chemically synthesized
aattctgtgaagaaaatcat

SEQ ID NO: 31517 - DNA, 20 bp, Artificial Sequence
  chemically synthesized
tctgtgaagaaaatcattgg

SEQ ID NO: 31518 - DNA, 20 bp, Artificial Sequence
  chemically synthesized
gaaaatcattggtagcttga

SEQ ID NO: 31519 - DNA, 20 bp, Artificial Sequence
  chemically synthesized
aaaatcattggtagcttgat

SEQ ID NO: 31520 - DNA, 20 bp, Artificial Sequence
  chemically synthesized
aaatcattggtagcttgatg

SEQ ID NO: 31521 - DNA, 20 bp, Artificial Sequence
  chemically synthesized
cattggtagcttgatgggga

SEQ ID NO: 31522 - DNA, 20 bp, Artificial Sequence
  chemically synthesized
attgaatctataaattacct

SEQ ID NO: 31523 - DNA, 20 bp, Artificial Sequence
  chemically synthesized
ttgaatctataaattacctt

SEQ ID NO: 31524 - DNA, 20 bp, Artificial Sequence
  chemically synthesized
ataaattaccttgggcatta

SEQ ID NO: 31525 - DNA, 20 bp, Artificial Sequence
  chemically synthesized
tattgattcttcctacccat

SEQ ID NO: 31526 - DNA, 20 bp, Artificial Sequence
  chemically synthesized
attcttcctacccataagca

SEQ ID NO: 31527 - DNA, 20 bp, Artificial Sequence
  chemically synthesized
gtatcttcttttatttcatt

SEQ ID NO: 31528 - DNA, 20 bp, Artificial Sequence
  chemically synthesized
tcttcttttatttcattgag

SEQ ID NO: 31529 - DNA, 20 bp, Artificial Sequence
  chemically synthesized
tcttttatttcattgagcag

SEQ ID NO: 31530 - DNA, 20 bp, Artificial Sequence
  chemically synthesized
tttcattgagcagtggtttg

SEQ ID NO: 31531 - DNA, 20 bp, Artificial Sequence
  chemically synthesized
gtggtttgtagttctccttg

SEQ ID NO: 31532 - DNA, 20 bp, Artificial Sequence
  chemically synthesized
ggtttgtagttctccttgaa

SEQ ID NO: 31533 - DNA, 20 bp, Artificial Sequence
  chemically synthesized
gtttgtagttctccttgaag

SEQ ID NO: 31534 - DNA, 20 bp, Artificial Sequence
  chemically synthesized
aggtccttcacatcccttgt

SEQ ID NO: 31535 - DNA, 20 bp, Artificial Sequence
  chemically synthesized
ccttcacatcccttgtaagt

SEQ ID NO: 31536 - DNA, 20 bp, Artificial Sequence
  chemically synthesized
tcccttgtaagttggattcc

SEQ ID NO: 31537 - DNA, 20 bp, Artificial Sequence
  chemically synthesized
cccttgtaagttggattcct

SEQ ID NO: 31538 - DNA, 20 bp, Artificial Sequence
  chemically synthesized
taggtattttattctctttg

SEQ ID NO: 31539 - DNA, 20 bp, Artificial Sequence
  chemically synthesized
ctctttgaagcaattgtgaa

SEQ ID NO: 31540 - DNA, 20 bp, Artificial Sequence
  chemically synthesized
tctttgaagcaattgtgaat

SEQ ID NO: 31541 - DNA, 20 bp, Artificial Sequence
  chemically synthesized
tttgaagcaattgtgaatgg

SEQ ID NO: 31542 - DNA, 20 bp, Artificial Sequence
  chemically synthesized
atgggagttccctcatgatt

SEQ ID NO: 31543 - DNA, 20 bp, Artificial Sequence
  chemically synthesized
gctctctgtttgtctgttat

SEQ ID NO: 31544 - DNA, 20 bp, Artificial Sequence
  chemically synthesized
tttgtctgttattggtgtat

SEQ ID NO: 31545 - DNA, 20 bp, Artificial Sequence
  chemically synthesized
tgcttgtgatttttgcacat

SEQ ID NO: 31546 - DNA, 20 bp, Artificial Sequence
  chemically synthesized
gcacattggttttgtatcct

SEQ ID NO: 31547 - DNA, 20 bp, Artificial Sequence
  chemically synthesized
cacattggttttgtatcctg

SEQ ID NO: 31548 - DNA, 20 bp, Artificial Sequence
  chemically synthesized
tgtatcctgaggctttgctg

SEQ ID NO: 31549 - DNA, 20 bp, Artificial Sequence
  chemically synthesized
gctttgctgaagttgcttat

SEQ ID NO: 31550 - DNA, 20 bp, Artificial Sequence
  chemically synthesized
ctgaagttgcttatcagctt

SEQ ID NO: 31551 - DNA, 20 bp, Artificial Sequence
  chemically synthesized
tgaagttgcttatcagctta

SEQ ID NO: 31552 - DNA, 20 bp, Artificial Sequence
  chemically synthesized
aagttgcttatcagcttaag

SEQ ID NO: 31553 - DNA, 20 bp, Artificial Sequence
  chemically synthesized
ttatcagcttaaggagattt

SEQ ID NO: 31554 - DNA, 20 bp, Artificial Sequence
  chemically synthesized
tatcagcttaaggagatttt

SEQ ID NO: 31555 - DNA, 20 bp, Artificial Sequence
  chemically synthesized
gcttaaggagattttgggct

SEQ ID NO: 31556 - DNA, 20 bp, Artificial Sequence
  chemically synthesized
aggagattttgggctgagac

SEQ ID NO: 31557 - DNA, 20 bp, Artificial Sequence
  chemically synthesized
ggagattttgggctgagaca

SEQ ID NO: 31558 - DNA, 20 bp, Artificial Sequence
  chemically synthesized
gagattttgggctgagacaa

SEQ ID NO: 31559 - DNA, 20 bp, Artificial Sequence
  chemically synthesized
agattttgggctgagacaag

SEQ ID NO: 31560 - DNA, 20 bp, Artificial Sequence
  chemically synthesized
gattttgggctgagacaagg

SEQ ID NO: 31561 - DNA, 20 bp, Artificial Sequence
  chemically synthesized
gctgagacaagggggttttc

SEQ ID NO: 31562 - DNA, 20 bp, Artificial Sequence
  chemically synthesized
acaatcatgtcgtctgcaaa

SEQ ID NO: 31563 - DNA, 20 bp, Artificial Sequence
  chemically synthesized
caatcatgtcgtctgcaaac

SEQ ID NO: 31564 - DNA, 20 bp, Artificial Sequence
  chemically synthesized
aatcatgtcgtctgcaaaca

SEQ ID NO: 31565 - DNA, 20 bp, Artificial Sequence
  chemically synthesized
tgtcttctgcctaattgccc

SEQ ID NO: 31566 - DNA, 20 bp, Artificial Sequence
  chemically synthesized
ttctgcctaattgccctggc

SEQ ID NO: 31567 - DNA, 20 bp, Artificial Sequence
  chemically synthesized
acttccaacactatgttgaa

SEQ ID NO: 31568 - DNA, 20 bp, Artificial Sequence
  chemically synthesized
cttccaacactatgttgaat

SEQ ID NO: 31569 - DNA, 20 bp, Artificial Sequence
  chemically synthesized
tccaacactatgttgaatag

SEQ ID NO: 31570 - DNA, 20 bp, Artificial Sequence
  chemically synthesized
aacactatgttgaataggag

SEQ ID NO: 31571 - DNA, 20 bp, Artificial Sequence
  chemically synthesized
ctatgttgaataggagtagt

SEQ ID NO: 31572 - DNA, 20 bp, Artificial Sequence
  chemically synthesized
atgttgaataggagtagtga

SEQ ID NO: 31573 - DNA, 20 bp, Artificial Sequence
  chemically synthesized
gttgaataggagtagtgaga

SEQ ID NO: 31574 - DNA, 20 bp, Artificial Sequence
  chemically synthesized
ttgaataggagtagtgagag

SEQ ID NO: 31575 - DNA, 20 bp, Artificial Sequence
  chemically synthesized
tgaataggagtagtgagaga

SEQ ID NO: 31576 - DNA, 20 bp, Artificial Sequence
  chemically synthesized
agggcatccctgtcttgtgc

SEQ ID NO: 31577 - DNA, 20 bp, Artificial Sequence
  chemically synthesized
ctgtcttgtgccagtttaca

SEQ ID NO: 31578 - DNA, 20 bp, Artificial Sequence
  chemically synthesized
tgtcttgtgccagtttacaa

SEQ ID NO: 31579 - DNA, 20 bp, Artificial Sequence
  chemically synthesized
gtcttgtgccagtttacaaa

SEQ ID NO: 31580 - DNA, 20 bp, Artificial Sequence
  chemically synthesized
gtttacaaagggaatgcttc

SEQ ID NO: 31581 - DNA, 20 bp, Artificial Sequence
  chemically synthesized
gcttccagtttttgcccatt

SEQ ID NO: 31582 - DNA, 20 bp, Artificial Sequence
  chemically synthesized
ttgcccattcagtatgatat

SEQ ID NO: 31583 - DNA, 20 bp, Artificial Sequence
  chemically synthesized
attcagtatgatattggctg

SEQ ID NO: 31584 - DNA, 20 bp, Artificial Sequence
  chemically synthesized
ttcagtatgatattggctgt

SEQ ID NO: 31585 - DNA, 20 bp, Artificial Sequence
  chemically synthesized
tattggctgtgggtttgtca

SEQ ID NO: 31586 - DNA, 20 bp, Artificial Sequence
  chemically synthesized
ggctgtgggtttgtcataga

SEQ ID NO: 31587 - DNA, 20 bp, Artificial Sequence
  chemically synthesized
tagatagctcttattatttt

SEQ ID NO: 31588 - DNA, 20 bp, Artificial Sequence
  chemically synthesized
atcaatacctaatttattga

SEQ ID NO: 31589 - DNA, 20 bp, Artificial Sequence
  chemically synthesized
cctaatttattgaaagtttt

SEQ ID NO: 31590 - DNA, 20 bp, Artificial Sequence
  chemically synthesized
tattgaaagtttttagcatg

SEQ ID NO: 31591 - DNA, 20 bp, Artificial Sequence
  chemically synthesized
attgaaagtttttagcatga

SEQ ID NO: 31592 - DNA, 20 bp, Artificial Sequence
  chemically synthesized
ttgaaagtttttagcatgaa

SEQ ID NO: 31593 - DNA, 20 bp, Artificial Sequence
  chemically synthesized
agggttgttgaattttgtca

SEQ ID NO: 31594 - DNA, 20 bp, Artificial Sequence
  chemically synthesized
gggttgttgaattttgtcaa

SEQ ID NO: 31595 - DNA, 20 bp, Artificial Sequence
  chemically synthesized
aggccttttctgcatctatt

SEQ ID NO: 31596 - DNA, 20 bp, Artificial Sequence
  chemically synthesized
catctattgagataatcatg

SEQ ID NO: 31597 - DNA, 20 bp, Artificial Sequence
  chemically synthesized
aatcatgtggtttttgtctt

SEQ ID NO: 31598 - DNA, 20 bp, Artificial Sequence
  chemically synthesized
ctttggttctgtttatatgc

SEQ ID NO: 31599 - DNA, 20 bp, Artificial Sequence
  chemically synthesized
ttgatttgcatatattgaac

SEQ ID NO: 31600 - DNA, 20 bp, Artificial Sequence
  chemically synthesized
attgaaccagccttgcatcc

SEQ ID NO: 31601 - DNA, 20 bp, Artificial Sequence
  chemically synthesized
ttgaaccagccttgcatccc

SEQ ID NO: 31602 - DNA, 20 bp, Artificial Sequence
  chemically synthesized
tgaaccagccttgcatccca

SEQ ID NO: 31603 - DNA, 20 bp, Artificial Sequence
  chemically synthesized
agccttgcatcccagggatg

SEQ ID NO: 31604 - DNA, 20 bp, Artificial Sequence
  chemically synthesized
tgaagtccacttgatcatcg

SEQ ID NO: 31605 - DNA, 20 bp, Artificial Sequence
  chemically synthesized
tccacttgatcatcgtggat

SEQ ID NO: 31606 - DNA, 20 bp, Artificial Sequence
  chemically synthesized
taagctttttgatgtgctgc

SEQ ID NO: 31607 - DNA, 20 bp, Artificial Sequence
  chemically synthesized
ttttgatgtgctgctggatt

SEQ ID NO: 31608 - DNA, 20 bp, Artificial Sequence
  chemically synthesized
tgctgctggattcggtttgc

SEQ ID NO: 31609 - DNA, 20 bp, Artificial Sequence
  chemically synthesized
cggtttgccagtattttatt

SEQ ID NO: 31610 - DNA, 20 bp, Artificial Sequence
  chemically synthesized
ggtttgccagtattttattg

SEQ ID NO: 31611 - DNA, 20 bp, Artificial Sequence
  chemically synthesized
atttttgcatcgatgttcat

SEQ ID NO: 31612 - DNA, 20 bp, Artificial Sequence
  chemically synthesized
tttttgcatcgatgttcatc

SEQ ID NO: 31613 - DNA, 20 bp, Artificial Sequence
  chemically synthesized
ttttgcatcgatgttcatca

SEQ ID NO: 31614 - DNA, 20 bp, Artificial Sequence
  chemically synthesized
tcatctaaaattctcttttt

SEQ ID NO: 31615 - DNA, 20 bp, Artificial Sequence
  chemically synthesized
tttttggttgtgtctctttc

SEQ ID NO: 31616 - DNA, 20 bp, Artificial Sequence
  chemically synthesized
gttgtgtctctttctggctt

SEQ ID NO: 31617 - DNA, 20 bp, Artificial Sequence
  chemically synthesized
tctctttctggctttggtat

SEQ ID NO: 31618 - DNA, 20 bp, Artificial Sequence
  chemically synthesized
ctctttctggctttggtatt

SEQ ID NO: 31619 - DNA, 20 bp, Artificial Sequence
  chemically synthesized
ctttggtattaggatgatgc

SEQ ID NO: 31620 - DNA, 20 bp, Artificial Sequence
  chemically synthesized
tgatgctggcctcataaaat

SEQ ID NO: 31621 - DNA, 20 bp, Artificial Sequence
  chemically synthesized
gctggcctcataaaatgagt

SEQ ID NO: 31622 - DNA, 20 bp, Artificial Sequence
  chemically synthesized
ctggcctcataaaatgagtt

SEQ ID NO: 31623 - DNA, 20 bp, Artificial Sequence
  chemically synthesized
tggcctcataaaatgagtta

SEQ ID NO: 31624 - DNA, 20 bp, Artificial Sequence
  chemically synthesized
gcctcataaaatgagttagg

SEQ ID NO: 31625 - DNA, 20 bp, Artificial Sequence
  chemically synthesized
cctcataaaatgagttaggg

SEQ ID NO: 31626 - DNA, 20 bp, Artificial Sequence
  chemically synthesized
ttccttctttttctgttgat

SEQ ID NO: 31627 - DNA, 20 bp, Artificial Sequence
  chemically synthesized
tctttttctgttgattggaa

SEQ ID NO: 31628 - DNA, 20 bp, Artificial Sequence
  chemically synthesized
tctgttgattggaatagttt

SEQ ID NO: 31629 - DNA, 20 bp, Artificial Sequence
  chemically synthesized
gttgattggaatagtttcag

SEQ ID NO: 31630 - DNA, 20 bp, Artificial Sequence
  chemically synthesized
ttgattggaatagtttcaga

SEQ ID NO: 31631 - DNA, 20 bp, Artificial Sequence
  chemically synthesized
tggaatagtttcagaaggaa

SEQ ID NO: 31632 - DNA, 20 bp, Artificial Sequence
  chemically synthesized
attcctccttgtacctctgt

SEQ ID NO: 31633 - DNA, 20 bp, Artificial Sequence
  chemically synthesized
cttgtacctctgttagaatt

SEQ ID NO: 31634 - DNA, 20 bp, Artificial Sequence
  chemically synthesized
aatttggctgtgaatccatc

SEQ ID NO: 31635 - DNA, 20 bp, Artificial Sequence
  chemically synthesized
gctgtgaatccatctggtcc

SEQ ID NO: 31636 - DNA, 20 bp, Artificial Sequence
  chemically synthesized
atctggtcctggactctttt

SEQ ID NO: 31637 - DNA, 20 bp, Artificial Sequence
  chemically synthesized
ggtcctggactctttttggt

SEQ ID NO: 31638 - DNA, 20 bp, Artificial Sequence
  chemically synthesized
ctggactctttttggttggt

SEQ ID NO: 31639 - DNA, 20 bp, Artificial Sequence
  chemically synthesized
attgattattgccacaattt

SEQ ID NO: 31640 - DNA, 20 bp, Artificial Sequence
  chemically synthesized
acaatttcagatcctgttat

SEQ ID NO: 31641 - DNA, 20 bp, Artificial Sequence
  chemically synthesized
gatcctgttattggtctatt

SEQ ID NO: 31642 - DNA, 20 bp, Artificial Sequence
  chemically synthesized
tcctgttattggtctattca

SEQ ID NO: 31643 - DNA, 20 bp, Artificial Sequence
  chemically synthesized
tcagagattcaacttcttcc

SEQ ID NO: 31644 - DNA, 20 bp, Artificial Sequence
  chemically synthesized
gattcaacttcttcctggtt

SEQ ID NO: 31645 - DNA, 20 bp, Artificial Sequence
  chemically synthesized
acttcttcctggtttagtct

SEQ ID NO: 31646 - DNA, 20 bp, Artificial Sequence
  chemically synthesized
cttcttcctggtttagtctt

SEQ ID NO: 31647 - DNA, 20 bp, Artificial Sequence
  chemically synthesized
ttcctggtttagtcttggga

SEQ ID NO: 31648 - DNA, 20 bp, Artificial Sequence
  chemically synthesized
cttgggatagtgtatgtgtc

SEQ ID NO: 31649 - DNA, 20 bp, Artificial Sequence
  chemically synthesized
ttgggatagtgtatgtgtcc

SEQ ID NO: 31650 - DNA, 20 bp, Artificial Sequence
  chemically synthesized
aggaatttatccatttcttc

SEQ ID NO: 31651 - DNA, 20 bp, Artificial Sequence
  chemically synthesized
tccatttcttctagattttc

SEQ ID NO: 31652 - DNA, 20 bp, Artificial Sequence
  chemically synthesized
gattttctagtttatttgcg

SEQ ID NO: 31653 - DNA, 20 bp, Artificial Sequence
  chemically synthesized
ttttctagtttatttgcgta

SEQ ID NO: 31654 - DNA, 20 bp, Artificial Sequence
  chemically synthesized
tttctagtttatttgcgtag

SEQ ID NO: 31655 - DNA, 20 bp, Artificial Sequence
  chemically synthesized
tatttgcgtagaggtgtttg

SEQ ID NO: 31656 - DNA, 20 bp, Artificial Sequence
  chemically synthesized
gtgtttgtagtattctctga

SEQ ID NO: 31657 - DNA, 20 bp, Artificial Sequence
  chemically synthesized
tttgtagtattctctgatgg

SEQ ID NO: 31658 - DNA, 20 bp, Artificial Sequence
  chemically synthesized
gatggcagtttgtatttctg

SEQ ID NO: 31659 - DNA, 20 bp, Artificial Sequence
  chemically synthesized
atggcagtttgtatttctgt

SEQ ID NO: 31660 - DNA, 20 bp, Artificial Sequence
  chemically synthesized
agtttgtatttctgtgggat

SEQ ID NO: 31661 - DNA, 20 bp, Artificial Sequence
  chemically synthesized
ttgtatttctgtgggatcgg

SEQ ID NO: 31662 - DNA, 20 bp, Artificial Sequence
  chemically synthesized
attcttctctcttttcttat

SEQ ID NO: 31663 - DNA, 20 bp, Artificial Sequence
  chemically synthesized
tcttttcttattagtcttgc

SEQ ID NO: 31664 - DNA, 20 bp, Artificial Sequence
  chemically synthesized
tttcttattagtcttgctag

SEQ ID NO: 31665 - DNA, 20 bp, Artificial Sequence
  chemically synthesized
tagtcttgctagcggtctat

SEQ ID NO: 31666 - DNA, 20 bp, Artificial Sequence
  chemically synthesized
tgttgatcctttcaaaaaac

SEQ ID NO: 31667 - DNA, 20 bp, Artificial Sequence
  chemically synthesized
cctttcaaaaaaccagctcc

SEQ ID NO: 31668 - DNA, 20 bp, Artificial Sequence
  chemically synthesized
ccagattcattaattttttg

SEQ ID NO: 31669 - DNA, 20 bp, Artificial Sequence
  chemically synthesized
cagattcattaattttttga

SEQ ID NO: 31670 - DNA, 20 bp, Artificial Sequence
  chemically synthesized
agattcattaattttttgaa

SEQ ID NO: 31671 - DNA, 20 bp, Artificial Sequence
  chemically synthesized
ttttgtgtctctgtttcctt

SEQ ID NO: 31672 - DNA, 20 bp, Artificial Sequence
  chemically synthesized
cttcagttctgctctgattt

SEQ ID NO: 31673 - DNA, 20 bp, Artificial Sequence
  chemically synthesized
agttatttcttgacttctgc

SEQ ID NO: 31674 - DNA, 20 bp, Artificial Sequence
  chemically synthesized
tgtgtttgctcttgcttatc

SEQ ID NO: 31675 - DNA, 20 bp, Artificial Sequence
  chemically synthesized
agttcttttaattgtgatgt

SEQ ID NO: 31676 - DNA, 20 bp, Artificial Sequence
  chemically synthesized
gttcttttaattgtgatgtt

SEQ ID NO: 31677 - DNA, 20 bp, Artificial Sequence
  chemically synthesized
ttcttttaattgtgatgtta

SEQ ID NO: 31678 - DNA, 20 bp, Artificial Sequence
  chemically synthesized
tgatgttagggtgtcaattt

SEQ ID NO: 31679 - DNA, 20 bp, Artificial Sequence
  chemically synthesized
atctttcttgctttctcttg

SEQ ID NO: 31680 - DNA, 20 bp, Artificial Sequence
  chemically synthesized
tctttcttgctttctcttgt

SEQ ID NO: 31681 - DNA, 20 bp, Artificial Sequence
  chemically synthesized
tgctttctcttgtgggcgtt

SEQ ID NO: 31682 - DNA, 20 bp, Artificial Sequence
  chemically synthesized
acactgattcgaatgtgtcc

SEQ ID NO: 31683 - DNA, 20 bp, Artificial Sequence
  chemically synthesized
actgattcgaatgtgtccca

SEQ ID NO: 31684 - DNA, 20 bp, Artificial Sequence
  chemically synthesized
cgaatgtgtcccagagattc

SEQ ID NO: 31685 - DNA, 20 bp, Artificial Sequence
  chemically synthesized
tgttgtgtctttgttctcat

SEQ ID NO: 31686 - DNA, 20 bp, Artificial Sequence
  chemically synthesized
ctttgttctcattggtttca

SEQ ID NO: 31687 - DNA, 20 bp, Artificial Sequence
  chemically synthesized
ccttcatttcgttatgtacc

SEQ ID NO: 31688 - DNA, 20 bp, Artificial Sequence
  chemically synthesized
tcatttcgttatgtacccag

SEQ ID NO: 31689 - DNA, 20 bp, Artificial Sequence
  chemically synthesized
ttatgtacccagtagtcatt

SEQ ID NO: 31690 - DNA, 20 bp, Artificial Sequence
  chemically synthesized
tatgtacccagtagtcattc

SEQ ID NO: 31691 - DNA, 20 bp, Artificial Sequence
  chemically synthesized
tgtacccagtagtcattcag

SEQ ID NO: 31692 - DNA, 20 bp, Artificial Sequence
  chemically synthesized
acccagtagtcattcaggag

SEQ ID NO: 31693 - DNA, 20 bp, Artificial Sequence
  chemically synthesized
cccagtagtcattcaggagc

SEQ ID NO: 31694 - DNA, 20 bp, Artificial Sequence
  chemically synthesized
tcattcaggagcaggttgtt

SEQ ID NO: 31695 - DNA, 20 bp, Artificial Sequence
  chemically synthesized
caggttgttcagtttccatg

SEQ ID NO: 31696 - DNA, 20 bp, Artificial Sequence
  chemically synthesized
tgttcagtttccatgtagtt

SEQ ID NO: 31697 - DNA, 20 bp, Artificial Sequence
  chemically synthesized
tcagtttccatgtagttgag

SEQ ID NO: 31698 - DNA, 20 bp, Artificial Sequence
  chemically synthesized
ccatgtagttgagtggtttt

SEQ ID NO: 31699 - DNA, 20 bp, Artificial Sequence
  chemically synthesized
gtagttgagtggttttgagt

SEQ ID NO: 31700 - DNA, 20 bp, Artificial Sequence
  chemically synthesized
tgagtgagtttcttaatcct

SEQ ID NO: 31701 - DNA, 20 bp, Artificial Sequence
  chemically synthesized
agtttcttaatcctgagttc

SEQ ID NO: 31702 - DNA, 20 bp, Artificial Sequence
  chemically synthesized
gttctagtttgattgcactg

SEQ ID NO: 31703 - DNA, 20 bp, Artificial Sequence
  chemically synthesized
gtttgattgcactgtggtct

SEQ ID NO: 31704 - DNA, 20 bp, Artificial Sequence
  chemically synthesized
ttgattgcactgtggtctga

SEQ ID NO: 31705 - DNA, 20 bp, Artificial Sequence
  chemically synthesized
ttgcactgtggtctgagaga

SEQ ID NO: 31706 - DNA, 20 bp, Artificial Sequence
  chemically synthesized
tctgttcttttatatttgct

SEQ ID NO: 31707 - DNA, 20 bp, Artificial Sequence
  chemically synthesized
ctgttcttttatatttgctg

SEQ ID NO: 31708 - DNA, 20 bp, Artificial Sequence
  chemically synthesized
gttcttttatatttgctgag

SEQ ID NO: 31709 - DNA, 20 bp, Artificial Sequence
  chemically synthesized
tcttttatatttgctgagga

SEQ ID NO: 31710 - DNA, 20 bp, Artificial Sequence
  chemically synthesized
ctgaggagagctttacttcc

SEQ ID NO: 31711 - DNA, 20 bp, Artificial Sequence
  chemically synthesized
gagctttacttccaagtatg

SEQ ID NO: 31712 - DNA, 20 bp, Artificial Sequence
  chemically synthesized
tccaagtatgtggtcaattt

SEQ ID NO: 31713 - DNA, 20 bp, Artificial Sequence
  chemically synthesized
gtatgtggtcaattttggaa

SEQ ID NO: 31714 - DNA, 20 bp, Artificial Sequence
  chemically synthesized
tatgtggtcaattttggaat

SEQ ID NO: 31715 - DNA, 20 bp, Artificial Sequence
  chemically synthesized
attttggaataggtgttgtg

SEQ ID NO: 31716 - DNA, 20 bp, Artificial Sequence
  chemically synthesized
aaatgtatattctgttgatt

SEQ ID NO: 31717 - DNA, 20 bp, Artificial Sequence
  chemically synthesized
aatgtatattctgttgattt

SEQ ID NO: 31718 - DNA, 20 bp, Artificial Sequence
  chemically synthesized
atgtatattctgttgatttg

SEQ ID NO: 31719 - DNA, 20 bp, Artificial Sequence
  chemically synthesized
tatattctgttgatttgggg

SEQ ID NO: 31720 - DNA, 20 bp, Artificial Sequence
  chemically synthesized
tattctgttgatttggggtg

SEQ ID NO: 31721 - DNA, 20 bp, Artificial Sequence
  chemically synthesized
ttctgttgatttggggtgga

SEQ ID NO: 31722 - DNA, 20 bp, Artificial Sequence
  chemically synthesized
atttggggtggagagttctg

SEQ ID NO: 31723 - DNA, 20 bp, Artificial Sequence
  chemically synthesized
agagttctgtagatgtctat

SEQ ID NO: 31724 - DNA, 20 bp, Artificial Sequence
  chemically synthesized
gagttctgtagatgtctatt

SEQ ID NO: 31725 - DNA, 20 bp, Artificial Sequence
  chemically synthesized
agatgtctattaggtctgct

SEQ ID NO: 31726 - DNA, 20 bp, Artificial Sequence
  chemically synthesized
tctattaggtctgcttggtg

SEQ ID NO: 31727 - DNA, 20 bp, Artificial Sequence
  chemically synthesized
tattaggtctgcttggtgca

SEQ ID NO: 31728 - DNA, 20 bp, Artificial Sequence
  chemically synthesized
gcagagctgtgttcaattcc

SEQ ID NO: 31729 - DNA, 20 bp, Artificial Sequence
  chemically synthesized
gttgatctgtctaatgttga

SEQ ID NO: 31730 - DNA, 20 bp, Artificial Sequence
  chemically synthesized
gatctgtctaatgttgacag

SEQ ID NO: 31731 - DNA, 20 bp, Artificial Sequence
  chemically synthesized
atctgtctaatgttgacagt

SEQ ID NO: 31732 - DNA, 20 bp, Artificial Sequence
  chemically synthesized
tctgtctaatgttgacagtg

SEQ ID NO: 31733 - DNA, 20 bp, Artificial Sequence
  chemically synthesized
atgttgacagtggggtatta

SEQ ID NO: 31734 - DNA, 20 bp, Artificial Sequence
  chemically synthesized
attaaagtctcccattatta

SEQ ID NO: 31735 - DNA, 20 bp, Artificial Sequence
  chemically synthesized
agtctcccattattaaagtg

SEQ ID NO: 31736 - DNA, 20 bp, Artificial Sequence
  chemically synthesized
gtctcccattattaaagtgt

SEQ ID NO: 31737 - DNA, 20 bp, Artificial Sequence
  chemically synthesized
ctcccattattaaagtgtgg

SEQ ID NO: 31738 - DNA, 20 bp, Artificial Sequence
  chemically synthesized
ttattaaagtgtgggagtct

SEQ ID NO: 31739 - DNA, 20 bp, Artificial Sequence
  chemically synthesized
tgggagtctaagtctctttg

SEQ ID NO: 31740 - DNA, 20 bp, Artificial Sequence
  chemically synthesized
gggagtctaagtctctttgt

SEQ ID NO: 31741 - DNA, 20 bp, Artificial Sequence
  chemically synthesized
aagtctctttgtaggtctct

SEQ ID NO: 31742 - DNA, 20 bp, Artificial Sequence
  chemically synthesized
agtctctttgtaggtctcta

SEQ ID NO: 31743 - DNA, 20 bp, Artificial Sequence
  chemically synthesized
aaggacttgctttatgaatc

SEQ ID NO: 31744 - DNA, 20 bp, Artificial Sequence
  chemically synthesized
aggacttgctttatgaatct

SEQ ID NO: 31745 - DNA, 20 bp, Artificial Sequence
  chemically synthesized
gaatctgggtgctcctgtat

SEQ ID NO: 31746 - DNA, 20 bp, Artificial Sequence
  chemically synthesized
aatctgggtgctcctgtatt

SEQ ID NO: 31747 - DNA, 20 bp, Artificial Sequence
  chemically synthesized
gtattgggtgcatatatatt

SEQ ID NO: 31748 - DNA, 20 bp, Artificial Sequence
  chemically synthesized
tattgggtgcatatatattt

SEQ ID NO: 31749 - DNA, 20 bp, Artificial Sequence
  chemically synthesized
gggtgcatatatatttagga

SEQ ID NO: 31750 - DNA, 20 bp, Artificial Sequence
  chemically synthesized
gcatatatatttaggatagt

SEQ ID NO: 31751 - DNA, 20 bp, Artificial Sequence
  chemically synthesized
atccctttaccattatgtaa

SEQ ID NO: 31752 - DNA, 20 bp, Artificial Sequence
  chemically synthesized
ttgtctcttttgatctttgt

SEQ ID NO: 31753 - DNA, 20 bp, Artificial Sequence
  chemically synthesized
ttttgatctttgttggttta

SEQ ID NO: 31754 - DNA, 20 bp, Artificial Sequence
  chemically synthesized
tggtttaaagcctgttttat

SEQ ID NO: 31755 - DNA, 20 bp, Artificial Sequence
  chemically synthesized
gtttaaagcctgttttatca

SEQ ID NO: 31756 - DNA, 20 bp, Artificial Sequence
  chemically synthesized
aagcctgttttatcagagac

SEQ ID NO: 31757 - DNA, 20 bp, Artificial Sequence
  chemically synthesized
agcctgttttatcagagact

SEQ ID NO: 31758 - DNA, 20 bp, Artificial Sequence
  chemically synthesized
ttttttgttttccatttgct

SEQ ID NO: 31759 - DNA, 20 bp, Artificial Sequence
  chemically synthesized
tttgttttccatttgcttgg

SEQ ID NO: 31760 - DNA, 20 bp, Artificial Sequence
  chemically synthesized
ttcctccatccttttatttt

SEQ ID NO: 31761 - DNA, 20 bp, Artificial Sequence
  chemically synthesized
ctatgtgtgtgtgtgcacat

SEQ ID NO: 31762 - DNA, 20 bp, Artificial Sequence
  chemically synthesized
gtgtgtgtgtgcacatgaga

SEQ ID NO: 31763 - DNA, 20 bp, Artificial Sequence
  chemically synthesized
tgtgtgtgtgcacatgagat

SEQ ID NO: 31764 - DNA, 20 bp, Artificial Sequence
  chemically synthesized
acactctttatccaatttgc

SEQ ID NO: 31765 - DNA, 20 bp, Artificial Sequence
  chemically synthesized
gccagtctgtgtctttcaat

SEQ ID NO: 31766 - DNA, 20 bp, Artificial Sequence
  chemically synthesized
cagtctgtgtctttcaattg

SEQ ID NO: 31767 - DNA, 20 bp, Artificial Sequence
  chemically synthesized
tgtctttcaattggagcact

SEQ ID NO: 31768 - DNA, 20 bp, Artificial Sequence
  chemically synthesized
acttagtccatttacattta

SEQ ID NO: 31769 - DNA, 20 bp, Artificial Sequence
  chemically synthesized
atttgatcctgtcattatga

SEQ ID NO: 31770 - DNA, 20 bp, Artificial Sequence
  chemically synthesized
gatcctgtcattatgatagc

SEQ ID NO: 31771 - DNA, 20 bp, Artificial Sequence
  chemically synthesized
tagctggttattttgctcgt

SEQ ID NO: 31772 - DNA, 20 bp, Artificial Sequence
  chemically synthesized
attttgctcgttagttgatg

SEQ ID NO: 31773 - DNA, 20 bp, Artificial Sequence
  chemically synthesized
tagttgatgcagtttcttcc

SEQ ID NO: 31774 - DNA, 20 bp, Artificial Sequence
  chemically synthesized
cagtttcttcctagtcttga

SEQ ID NO: 31775 - DNA, 20 bp, Artificial Sequence
  chemically synthesized
tcttgatggtcttcacattt

SEQ ID NO: 31776 - DNA, 20 bp, Artificial Sequence
  chemically synthesized
cacattttggcctgattttg

SEQ ID NO: 31777 - DNA, 20 bp, Artificial Sequence
  chemically synthesized
attttggcctgattttgcag

SEQ ID NO: 31778 - DNA, 20 bp, Artificial Sequence
  chemically synthesized
tggcctgattttgcagtggc

SEQ ID NO: 31779 - DNA, 20 bp, Artificial Sequence
  chemically synthesized
gattttgcagtggctggtac

SEQ ID NO: 31780 - DNA, 20 bp, Artificial Sequence
  chemically synthesized
cggttgtgcctttccatgtt

SEQ ID NO: 31781 - DNA, 20 bp, Artificial Sequence
  chemically synthesized
tccatgtttagtgcttcctt

SEQ ID NO: 31782 - DNA, 20 bp, Artificial Sequence
  chemically synthesized
ccatgtttagtgcttccttc

SEQ ID NO: 31783 - DNA, 20 bp, Artificial Sequence
  chemically synthesized
atgtttagtgcttccttcag

SEQ ID NO: 31784 - DNA, 20 bp, Artificial Sequence
  chemically synthesized
gcttccttcaggagctcttt

SEQ ID NO: 31785 - DNA, 20 bp, Artificial Sequence
  chemically synthesized
cttccttcaggagctctttt

SEQ ID NO: 31786 - DNA, 20 bp, Artificial Sequence
  chemically synthesized
cttcaggagctcttttaggt

SEQ ID NO: 31787 - DNA, 20 bp, Artificial Sequence
  chemically synthesized
ttcaggagctcttttaggtc

SEQ ID NO: 31788 - DNA, 20 bp, Artificial Sequence
  chemically synthesized
gagctcttttaggtcaggcc

SEQ ID NO: 31789 - DNA, 20 bp, Artificial Sequence
  chemically synthesized
ctggtgatgacaaaatctct

SEQ ID NO: 31790 - DNA, 20 bp, Artificial Sequence
  chemically synthesized
tcagcatttgcttgtctgta

SEQ ID NO: 31791 - DNA, 20 bp, Artificial Sequence
  chemically synthesized
ttatttctccttcacttatg

SEQ ID NO: 31792 - DNA, 20 bp, Artificial Sequence
  chemically synthesized
tctccttcacttatgaagct

SEQ ID NO: 31793 - DNA, 20 bp, Artificial Sequence
  chemically synthesized
ttcacttatgaagcttagtt

SEQ ID NO: 31794 - DNA, 20 bp, Artificial Sequence
  chemically synthesized
cttatgaagcttagtttggc

SEQ ID NO: 31795 - DNA, 20 bp, Artificial Sequence
  chemically synthesized
tgttgaaaattctttccttt

SEQ ID NO: 31796 - DNA, 20 bp, Artificial Sequence
  chemically synthesized
gttgaaaattctttccttta

SEQ ID NO: 31797 - DNA, 20 bp, Artificial Sequence
  chemically synthesized
cctttaaggatgttgaatat

SEQ ID NO: 31798 - DNA, 20 bp, Artificial Sequence
  chemically synthesized
tattggcccccactctcttc

SEQ ID NO: 31799 - DNA, 20 bp, Artificial Sequence
  chemically synthesized
ccccactctcttctggcttg

SEQ ID NO: 31800 - DNA, 20 bp, Artificial Sequence
  chemically synthesized
ccactctcttctggcttgta

SEQ ID NO: 31801 - DNA, 20 bp, Artificial Sequence
  chemically synthesized
tggcttgtagagtttctgcc

SEQ ID NO: 31802 - DNA, 20 bp, Artificial Sequence
  chemically synthesized
gcttgtagagtttctgccaa

SEQ ID NO: 31803 - DNA, 20 bp, Artificial Sequence
  chemically synthesized
ttgtagagtttctgccaaga

SEQ ID NO: 31804 - DNA, 20 bp, Artificial Sequence
  chemically synthesized
tctgccaagagagctgctgt

SEQ ID NO: 31805 - DNA, 20 bp, Artificial Sequence
  chemically synthesized
gagagctgctgttagtctga

SEQ ID NO: 31806 - DNA, 20 bp, Artificial Sequence
  chemically synthesized
agagctgctgttagtctgat

SEQ ID NO: 31807 - DNA, 20 bp, Artificial Sequence
  chemically synthesized
gtctgatgggcttccctttg

SEQ ID NO: 31808 - DNA, 20 bp, Artificial Sequence
  chemically synthesized
tctgatgggcttccctttgt

SEQ ID NO: 31809 - DNA, 20 bp, Artificial Sequence
  chemically synthesized
ggtaacccgacctttctctc

SEQ ID NO: 31810 - DNA, 20 bp, Artificial Sequence
  chemically synthesized
tttttccttcatttcaactt

SEQ ID NO: 31811 - DNA, 20 bp, Artificial Sequence
  chemically synthesized
aatctgacaattatgtgtct

SEQ ID NO: 31812 - DNA, 20 bp, Artificial Sequence
  chemically synthesized
tctgacaattatgtgtcttg

SEQ ID NO: 31813 - DNA, 20 bp, Artificial Sequence
  chemically synthesized
gtcttggagttgctcttctc

SEQ ID NO: 31814 - DNA, 20 bp, Artificial Sequence
  chemically synthesized
tcttggagttgctcttctcg

SEQ ID NO: 31815 - DNA, 20 bp, Artificial Sequence
  chemically synthesized
ttggagttgctcttctcgag

SEQ ID NO: 31816 - DNA, 20 bp, Artificial Sequence
  chemically synthesized
cttctcgaggagtatgtttg

SEQ ID NO: 31817 - DNA, 20 bp, Artificial Sequence
  chemically synthesized
tatttcctgaatctgaatgt

SEQ ID NO: 31818 - DNA, 20 bp, Artificial Sequence
  chemically synthesized
tgaatgttggcctgccttgc

SEQ ID NO: 31819 - DNA, 20 bp, Artificial Sequence
  chemically synthesized
gttggcctgccttgctagat

SEQ ID NO: 31820 - DNA, 20 bp, Artificial Sequence
  chemically synthesized
ttggcctgccttgctagatt

SEQ ID NO: 31821 - DNA, 20 bp, Artificial Sequence
  chemically synthesized
tggcctgccttgctagattg

SEQ ID NO: 31822 - DNA, 20 bp, Artificial Sequence
  chemically synthesized
cctgccttgctagattgggg

SEQ ID NO: 31823 - DNA, 20 bp, Artificial Sequence
  chemically synthesized
ctagattggggaagttctcc

SEQ ID NO: 31824 - DNA, 20 bp, Artificial Sequence
  chemically synthesized
ttctcctggataatatcctg

SEQ ID NO: 31825 - DNA, 20 bp, Artificial Sequence
  chemically synthesized
ctcctggataatatcctgca

SEQ ID NO: 31826 - DNA, 20 bp, Artificial Sequence
  chemically synthesized
ctgcagagtgttttccaact

SEQ ID NO: 31827 - DNA, 20 bp, Artificial Sequence
  chemically synthesized
tcgattctccccgtcacttt

SEQ ID NO: 31828 - DNA, 20 bp, Artificial Sequence
  chemically synthesized
cgattctccccgtcactttc

SEQ ID NO: 31829 - DNA, 20 bp, Artificial Sequence
  chemically synthesized
tcactttcaggtacaccaat

SEQ ID NO: 31830 - DNA, 20 bp, Artificial Sequence
  chemically synthesized
tcaggtacaccaatcagacc

SEQ ID NO: 31831 - DNA, 20 bp, Artificial Sequence
  chemically synthesized
ctagatttgatcttttcaca

SEQ ID NO: 31832 - DNA, 20 bp, Artificial Sequence
  chemically synthesized
tcacatagtcccatatttct

SEQ ID NO: 31833 - DNA, 20 bp, Artificial Sequence
  chemically synthesized
acatagtcccatatttcttg

SEQ ID NO: 31834 - DNA, 20 bp, Artificial Sequence
  chemically synthesized
catagtcccatatttcttgg

SEQ ID NO: 31835 - DNA, 20 bp, Artificial Sequence
  chemically synthesized
atcactgataccctttcttc

SEQ ID NO: 31836 - DNA, 20 bp, Artificial Sequence
  chemically synthesized
tttcttccagttgatcgcat

SEQ ID NO: 31837 - DNA, 20 bp, Artificial Sequence
  chemically synthesized
agttgatcgcatcagctcct

SEQ ID NO: 31838 - DNA, 20 bp, Artificial Sequence
  chemically synthesized
gttgatcgcatcagctcctg

SEQ ID NO: 31839 - DNA, 20 bp, Artificial Sequence
  chemically synthesized
ccattcttcacgtcattctc

SEQ ID NO: 31840 - DNA, 20 bp, Artificial Sequence
  chemically synthesized
ttcacgtcattctcgagcct

SEQ ID NO: 31841 - DNA, 20 bp, Artificial Sequence
  chemically synthesized
cattctcgagccttggcttt

SEQ ID NO: 31842 - DNA, 20 bp, Artificial Sequence
  chemically synthesized
gccttggctttcagctccat

SEQ ID NO: 31843 - DNA, 20 bp, Artificial Sequence
  chemically synthesized
tcagctccatcagctccttt

SEQ ID NO: 31844 - DNA, 20 bp, Artificial Sequence
  chemically synthesized
ctttaagcacttctctgtat

SEQ ID NO: 31845 - DNA, 20 bp, Artificial Sequence
  chemically synthesized
cttctctgtattggttattc

SEQ ID NO: 31846 - DNA, 20 bp, Artificial Sequence
  chemically synthesized
ttcatctaaattttttttca

SEQ ID NO: 31847 - DNA, 20 bp, Artificial Sequence
  chemically synthesized
gtttttatcttctttgcctt

SEQ ID NO: 31848 - DNA, 20 bp, Artificial Sequence
  chemically synthesized
ttggtttgaatttcctcctg

SEQ ID NO: 31849 - DNA, 20 bp, Artificial Sequence
  chemically synthesized
ttgaatttcctcctgtagct

SEQ ID NO: 31850 - DNA, 20 bp, Artificial Sequence
  chemically synthesized
gaatttcctcctgtagctcg

SEQ ID NO: 31851 - DNA, 20 bp, Artificial Sequence
  chemically synthesized
tttcctcctgtagctcggag

SEQ ID NO: 31852 - DNA, 20 bp, Artificial Sequence
  chemically synthesized
cggagtagtttcatcgtctg

SEQ ID NO: 31853 - DNA, 20 bp, Artificial Sequence
  chemically synthesized
cgtctgaagtcttcttctct

SEQ ID NO: 31854 - DNA, 20 bp, Artificial Sequence
  chemically synthesized
cttcttctctcagctcgtca

SEQ ID NO: 31855 - DNA, 20 bp, Artificial Sequence
  chemically synthesized
cgtcaaagtcattctccatc

SEQ ID NO: 31856 - DNA, 20 bp, Artificial Sequence
  chemically synthesized
atccagctttgttccgttgc

SEQ ID NO: 31857 - DNA, 20 bp, Artificial Sequence
  chemically synthesized
agctttgttccgttgctggt

SEQ ID NO: 31858 - DNA, 20 bp, Artificial Sequence
  chemically synthesized
gctttgttccgttgctggtg

SEQ ID NO: 31859 - DNA, 20 bp, Artificial Sequence
  chemically synthesized
ggtgaggaactgctttcctt

SEQ ID NO: 31860 - DNA, 20 bp, Artificial Sequence
  chemically synthesized
tgaggaactgctttcctttg

SEQ ID NO: 31861 - DNA, 20 bp, Artificial Sequence
  chemically synthesized
gaggaactgctttcctttgg

SEQ ID NO: 31862 - DNA, 20 bp, Artificial Sequence
  chemically synthesized
ggaactgctttcctttggag

SEQ ID NO: 31863 - DNA, 20 bp, Artificial Sequence
  chemically synthesized
gaactgctttcctttggagg

SEQ ID NO: 31864 - DNA, 20 bp, Artificial Sequence
  chemically synthesized
tgctttcctttggaggagga

SEQ ID NO: 31865 - DNA, 20 bp, Artificial Sequence
  chemically synthesized
gctttcctttggaggaggaa

SEQ ID NO: 31866 - DNA, 20 bp, Artificial Sequence
  chemically synthesized
aggaaaggtgctctgctttt

SEQ ID NO: 31867 - DNA, 20 bp, Artificial Sequence
  chemically synthesized
gaaaggtgctctgcttttta

SEQ ID NO: 31868 - DNA, 20 bp, Artificial Sequence
  chemically synthesized
gctctgctttttagagtttc

SEQ ID NO: 31869 - DNA, 20 bp, Artificial Sequence
  chemically synthesized
ctgttttttccccaactttg

SEQ ID NO: 31870 - DNA, 20 bp, Artificial Sequence
  chemically synthesized
tttgtggttgtatctacttt

SEQ ID NO: 31871 - DNA, 20 bp, Artificial Sequence
  chemically synthesized
ctacttttggtctttgatga

SEQ ID NO: 31872 - DNA, 20 bp, Artificial Sequence
  chemically synthesized
tgatgatagtgatgtaccga

SEQ ID NO: 31873 - DNA, 20 bp, Artificial Sequence
  chemically synthesized
gatgatagtgatgtaccgat

SEQ ID NO: 31874 - DNA, 20 bp, Artificial Sequence
  chemically synthesized
gtgatgtaccgatgggtttt

SEQ ID NO: 31875 - DNA, 20 bp, Artificial Sequence
  chemically synthesized
gtaccgatgggtttttggtg

SEQ ID NO: 31876 - DNA, 20 bp, Artificial Sequence
  chemically synthesized
tggatgtcctttctgtttgt

SEQ ID NO: 31877 - DNA, 20 bp, Artificial Sequence
  chemically synthesized
tttgttagttttccttctaa

SEQ ID NO: 31878 - DNA, 20 bp, Artificial Sequence
  chemically synthesized
ttagttttccttctaacaga

SEQ ID NO: 31879 - DNA, 20 bp, Artificial Sequence
  chemically synthesized
tagttttccttctaacagac

SEQ ID NO: 31880 - DNA, 20 bp, Artificial Sequence
  chemically synthesized
cttctaacagacaggaccct

SEQ ID NO: 31881 - DNA, 20 bp, Artificial Sequence
  chemically synthesized
acagacaggaccctcagctg

SEQ ID NO: 31882 - DNA, 20 bp, Artificial Sequence
  chemically synthesized
cagacaggaccctcagctgc

SEQ ID NO: 31883 - DNA, 20 bp, Artificial Sequence
  chemically synthesized
accctcagctgcaggtctgt

SEQ ID NO: 31884 - DNA, 20 bp, Artificial Sequence
  chemically synthesized
cctcagctgcaggtctgttg

SEQ ID NO: 31885 - DNA, 20 bp, Artificial Sequence
  chemically synthesized
gcaggtctgttggagtttgc

SEQ ID NO: 31886 - DNA, 20 bp, Artificial Sequence
  chemically synthesized
aggtctgttggagtttgcta

SEQ ID NO: 31887 - DNA, 20 bp, Artificial Sequence
  chemically synthesized
ggtctgttggagtttgctag

SEQ ID NO: 31888 - DNA, 20 bp, Artificial Sequence
  chemically synthesized
agtttgctagaggtccactc

SEQ ID NO: 31889 - DNA, 20 bp, Artificial Sequence
  chemically synthesized
cactccagaccctgtttgcc

SEQ ID NO: 31890 - DNA, 20 bp, Artificial Sequence
  chemically synthesized
actccagaccctgtttgcct

SEQ ID NO: 31891 - DNA, 20 bp, Artificial Sequence
  chemically synthesized
gaccctgtttgcctgggtat

SEQ ID NO: 31892 - DNA, 20 bp, Artificial Sequence
  chemically synthesized
cctgtttgcctgggtatcag

SEQ ID NO: 31893 - DNA, 20 bp, Artificial Sequence
  chemically synthesized
gtttgcctgggtatcagcag

SEQ ID NO: 31894 - DNA, 20 bp, Artificial Sequence
  chemically synthesized
ggtatcagcagcggtgtctg

SEQ ID NO: 31895 - DNA, 20 bp, Artificial Sequence
  chemically synthesized
cagcggtgtctgcagaaccg

SEQ ID NO: 31896 - DNA, 20 bp, Artificial Sequence
  chemically synthesized
ctgctgtctgatcgttcctc

SEQ ID NO: 31897 - DNA, 20 bp, Artificial Sequence
  chemically synthesized
ctgtctgatcgttcctctgg

SEQ ID NO: 31898 - DNA, 20 bp, Artificial Sequence
  chemically synthesized
ttcctctggaagttttgtct

SEQ ID NO: 31899 - DNA, 20 bp, Artificial Sequence
  chemically synthesized
cctctggaagttttgtctca

SEQ ID NO: 31900 - DNA, 20 bp, Artificial Sequence
  chemically synthesized
ctctggaagttttgtctcag

SEQ ID NO: 31901 - DNA, 20 bp, Artificial Sequence
  chemically synthesized
ctggaagttttgtctcagag

SEQ ID NO: 31902 - DNA, 20 bp, Artificial Sequence
  chemically synthesized
ttttgtctcagaggagtacc

SEQ ID NO: 31903 - DNA, 20 bp, Artificial Sequence
  chemically synthesized
agaggagtacctggccgtgt

SEQ ID NO: 31904 - DNA, 20 bp, Artificial Sequence
  chemically synthesized
gaggagtacctggccgtgtg

SEQ ID NO: 31905 - DNA, 20 bp, Artificial Sequence
  chemically synthesized
tacctggccgtgtgaggtgt

SEQ ID NO: 31906 - DNA, 20 bp, Artificial Sequence
  chemically synthesized
ggtgtcagtctgcccttact

SEQ ID NO: 31907 - DNA, 20 bp, Artificial Sequence
  chemically synthesized
gtgtcagtctgcccttactt

SEQ ID NO: 31908 - DNA, 20 bp, Artificial Sequence
  chemically synthesized
tgtcagtctgcccttacttg

SEQ ID NO: 31909 - DNA, 20 bp, Artificial Sequence
  chemically synthesized
gtcagtctgcccttacttgg

SEQ ID NO: 31910 - DNA, 20 bp, Artificial Sequence
  chemically synthesized
ccttacttgggggtgcctcc

SEQ ID NO: 31911 - DNA, 20 bp, Artificial Sequence
  chemically synthesized
acttgggggtgcctcccagt

SEQ ID NO: 31912 - DNA, 20 bp, Artificial Sequence
  chemically synthesized
cttgggggtgcctcccagtt

SEQ ID NO: 31913 - DNA, 20 bp, Artificial Sequence
  chemically synthesized
tgcctcccagttaggctgct

SEQ ID NO: 31914 - DNA, 20 bp, Artificial Sequence
  chemically synthesized
gcctcccagttaggctgctc

SEQ ID NO: 31915 - DNA, 20 bp, Artificial Sequence
  chemically synthesized
cctcccagttaggctgctcg

SEQ ID NO: 31916 - DNA, 20 bp, Artificial Sequence
  chemically synthesized
ctcccagttaggctgctcgg

SEQ ID NO: 31917 - DNA, 20 bp, Artificial Sequence
  chemically synthesized
cagttaggctgctcgggggt

SEQ ID NO: 31918 - DNA, 20 bp, Artificial Sequence
  chemically synthesized
agttaggctgctcgggggtc

SEQ ID NO: 31919 - DNA, 20 bp, Artificial Sequence
  chemically synthesized
gttaggctgctcgggggtca

SEQ ID NO: 31920 - DNA, 20 bp, Artificial Sequence
  chemically synthesized
ttaggctgctcgggggtcag

SEQ ID NO: 31921 - DNA, 20 bp, Artificial Sequence
  chemically synthesized
gctgctcgggggtcaggggt

SEQ ID NO: 31922 - DNA, 20 bp, Artificial Sequence
  chemically synthesized
ctgctcgggggtcaggggtc

SEQ ID NO: 31923 - DNA, 20 bp, Artificial Sequence
  chemically synthesized
tgctcgggggtcaggggtca

SEQ ID NO: 31924 - DNA, 20 bp, Artificial Sequence
  chemically synthesized
caggggtcagggacccactt

SEQ ID NO: 31925 - DNA, 20 bp, Artificial Sequence
  chemically synthesized
aggggtcagggacccacttg

SEQ ID NO: 31926 - DNA, 20 bp, Artificial Sequence
  chemically synthesized
gggtcagggacccacttgag

SEQ ID NO: 31927 - DNA, 20 bp, Artificial Sequence
  chemically synthesized
ggtcagggacccacttgagg

SEQ ID NO: 31928 - DNA, 20 bp, Artificial Sequence
  chemically synthesized
cagggacccacttgaggagg

SEQ ID NO: 31929 - DNA, 20 bp, Artificial Sequence
  chemically synthesized
ggaggcagtctgcccgttct

SEQ ID NO: 31930 - DNA, 20 bp, Artificial Sequence
  chemically synthesized
tctgcccgttctcagatctc

SEQ ID NO: 31931 - DNA, 20 bp, Artificial Sequence
  chemically synthesized
tcagatctccagctgtgtgc

SEQ ID NO: 31932 - DNA, 20 bp, Artificial Sequence
  chemically synthesized
cagatctccagctgtgtgct

SEQ ID NO: 31933 - DNA, 20 bp, Artificial Sequence
  chemically synthesized
gatctccagctgtgtgctgg

SEQ ID NO: 31934 - DNA, 20 bp, Artificial Sequence
  chemically synthesized
gagaaccactgctctcctca

SEQ ID NO: 31935 - DNA, 20 bp, Artificial Sequence
  chemically synthesized
actgctctcctcaaagctgt

SEQ ID NO: 31936 - DNA, 20 bp, Artificial Sequence
  chemically synthesized
ctctcctcaaagctgtcaga

SEQ ID NO: 31937 - DNA, 20 bp, Artificial Sequence
  chemically synthesized
tctcctcaaagctgtcagac

SEQ ID NO: 31938 - DNA, 20 bp, Artificial Sequence
  chemically synthesized
ctcctcaaagctgtcagaca

SEQ ID NO: 31939 - DNA, 20 bp, Artificial Sequence
  chemically synthesized
gctgtcagacagggacattt

SEQ ID NO: 31940 - DNA, 20 bp, Artificial Sequence
  chemically synthesized
gacagggacatttaagtctg

SEQ ID NO: 31941 - DNA, 20 bp, Artificial Sequence
  chemically synthesized
cagggacatttaagtctgca

SEQ ID NO: 31942 - DNA, 20 bp, Artificial Sequence
  chemically synthesized
agggacatttaagtctgcag

SEQ ID NO: 31943 - DNA, 20 bp, Artificial Sequence
  chemically synthesized
ttgtctgtgccctgccccca

SEQ ID NO: 31944 - DNA, 20 bp, Artificial Sequence
  chemically synthesized
tgtctgtgccctgcccccaa

SEQ ID NO: 31945 - DNA, 20 bp, Artificial Sequence
  chemically synthesized
ctgtgccctgcccccaaagg

SEQ ID NO: 31946 - DNA, 20 bp, Artificial Sequence
  chemically synthesized
gtgccctgcccccaaaggtg

SEQ ID NO: 31947 - DNA, 20 bp, Artificial Sequence
  chemically synthesized
gcccccaaaggtggagccta

SEQ ID NO: 31948 - DNA, 20 bp, Artificial Sequence
  chemically synthesized
ccccaaaggtggagcctaca

SEQ ID NO: 31949 - DNA, 20 bp, Artificial Sequence
  chemically synthesized
cccaaaggtggagcctacag

SEQ ID NO: 31950 - DNA, 20 bp, Artificial Sequence
  chemically synthesized
aaaggtggagcctacagagg

SEQ ID NO: 31951 - DNA, 20 bp, Artificial Sequence
  chemically synthesized
aaggtggagcctacagaggc

SEQ ID NO: 31952 - DNA, 20 bp, Artificial Sequence
  chemically synthesized
gtggagcctacagaggcagg

SEQ ID NO: 31953 - DNA, 20 bp, Artificial Sequence
  chemically synthesized
tggagcctacagaggcaggc

SEQ ID NO: 31954 - DNA, 20 bp, Artificial Sequence
  chemically synthesized
agaggcaggcaggcctcctt

SEQ ID NO: 31955 - DNA, 20 bp, Artificial Sequence
  chemically synthesized
aggcaggcctccttgagctg

SEQ ID NO: 31956 - DNA, 20 bp, Artificial Sequence
  chemically synthesized
caggcctccttgagctgtgg

SEQ ID NO: 31957 - DNA, 20 bp, Artificial Sequence
  chemically synthesized
aggcctccttgagctgtggt

SEQ ID NO: 31958 - DNA, 20 bp, Artificial Sequence
  chemically synthesized
ggcctccttgagctgtggtg

SEQ ID NO: 31959 - DNA, 20 bp, Artificial Sequence
  chemically synthesized
gagctgtggtggggtccacc

SEQ ID NO: 31960 - DNA, 20 bp, Artificial Sequence
  chemically synthesized
tggtggggtccacccagttt

SEQ ID NO: 31961 - DNA, 20 bp, Artificial Sequence
  chemically synthesized
tccacccagtttgagcttcc

SEQ ID NO: 31962 - DNA, 20 bp, Artificial Sequence
  chemically synthesized
cctggctgctttgtttacct

SEQ ID NO: 31963 - DNA, 20 bp, Artificial Sequence
  chemically synthesized
gctgctttgtttacctaagc

SEQ ID NO: 31964 - DNA, 20 bp, Artificial Sequence
  chemically synthesized
tttgtttacctaagcaagcc

SEQ ID NO: 31965 - DNA, 20 bp, Artificial Sequence
  chemically synthesized
ttgtttacctaagcaagcct

SEQ ID NO: 31966 - DNA, 20 bp, Artificial Sequence
  chemically synthesized
acctaagcaagcctgggcaa

SEQ ID NO: 31967 - DNA, 20 bp, Artificial Sequence
  chemically synthesized
taagcaagcctgggcaatgg

SEQ ID NO: 31968 - DNA, 20 bp, Artificial Sequence
  chemically synthesized
aatggcggctgcccctcccc

SEQ ID NO: 31969 - DNA, 20 bp, Artificial Sequence
  chemically synthesized
ccagcctcgctgccaccttg

SEQ ID NO: 31970 - DNA, 20 bp, Artificial Sequence
  chemically synthesized
gccaccttgcagtttgatct

SEQ ID NO: 31971 - DNA, 20 bp, Artificial Sequence
  chemically synthesized
ttgatctcagactgctgtgc

SEQ ID NO: 31972 - DNA, 20 bp, Artificial Sequence
  chemically synthesized
cagactgctgtgctagcaat

SEQ ID NO: 31973 - DNA, 20 bp, Artificial Sequence
  chemically synthesized
agactgctgtgctagcaatc

SEQ ID NO: 31974 - DNA, 20 bp, Artificial Sequence
  chemically synthesized
gactgctgtgctagcaatca

SEQ ID NO: 31975 - DNA, 20 bp, Artificial Sequence
  chemically synthesized
ctgctgtgctagcaatcagg

SEQ ID NO: 31976 - DNA, 20 bp, Artificial Sequence
  chemically synthesized
tagcaatcagggagactccg

SEQ ID NO: 31977 - DNA, 20 bp, Artificial Sequence
  chemically synthesized
agcaatcagggagactccgt

SEQ ID NO: 31978 - DNA, 20 bp, Artificial Sequence
  chemically synthesized
tcagggagactccgtgggcg

SEQ ID NO: 31979 - DNA, 20 bp, Artificial Sequence
  chemically synthesized
cagggagactccgtgggcgt

SEQ ID NO: 31980 - DNA, 20 bp, Artificial Sequence
  chemically synthesized
ctccgtgggcgtaggaccct

SEQ ID NO: 31981 - DNA, 20 bp, Artificial Sequence
  chemically synthesized
ccgtgggcgtaggaccctcg

SEQ ID NO: 31982 - DNA, 20 bp, Artificial Sequence
  chemically synthesized
aggaccctcggagccatgtg

SEQ ID NO: 31983 - DNA, 20 bp, Artificial Sequence
  chemically synthesized
ggaccctcggagccatgtgc

SEQ ID NO: 31984 - DNA, 20 bp, Artificial Sequence
  chemically synthesized
atgtgcaggatataatctcc

SEQ ID NO: 31985 - DNA, 20 bp, Artificial Sequence
  chemically synthesized
ctcctggtgcgccatttcct

SEQ ID NO: 31986 - DNA, 20 bp, Artificial Sequence
  chemically synthesized
gcgccatttcctaagcctgt

SEQ ID NO: 31987 - DNA, 20 bp, Artificial Sequence
  chemically synthesized
atttcctaagcctgtcagaa

SEQ ID NO: 31988 - DNA, 20 bp, Artificial Sequence
  chemically synthesized
ctaagcctgtcagaaaagca

SEQ ID NO: 31989 - DNA, 20 bp, Artificial Sequence
  chemically synthesized
tgtcagaaaagcacagtatt

SEQ ID NO: 31990 - DNA, 20 bp, Artificial Sequence
  chemically synthesized
gtcagaaaagcacagtattc

SEQ ID NO: 31991 - DNA, 20 bp, Artificial Sequence
  chemically synthesized
agaaaagcacagtattcggg

SEQ ID NO: 31992 - DNA, 20 bp, Artificial Sequence
  chemically synthesized
gaaaagcacagtattcgggt

SEQ ID NO: 31993 - DNA, 20 bp, Artificial Sequence
  chemically synthesized
aaagcacagtattcgggtgg

SEQ ID NO: 31994 - DNA, 20 bp, Artificial Sequence
  chemically synthesized
gcacagtattcgggtgggag

SEQ ID NO: 31995 - DNA, 20 bp, Artificial Sequence
  chemically synthesized
gtgggagtggcccaattttc

SEQ ID NO: 31996 - DNA, 20 bp, Artificial Sequence
  chemically synthesized
tgggagtggcccaattttcc

SEQ ID NO: 31997 - DNA, 20 bp, Artificial Sequence
  chemically synthesized
atgtcacccctttccttgac

SEQ ID NO: 31998 - DNA, 20 bp, Artificial Sequence
  chemically synthesized
tgtcacccctttccttgacc

SEQ ID NO: 31999 - DNA, 20 bp, Artificial Sequence
  chemically synthesized
acccctttccttgaccagga

SEQ ID NO: 32000 - DNA, 20 bp, Artificial Sequence
  chemically synthesized
cccctttccttgaccaggaa

SEQ ID NO: 32001 - DNA, 20 bp, Artificial Sequence
  chemically synthesized
ccctttccttgaccaggaaa

SEQ ID NO: 32002 - DNA, 20 bp, Artificial Sequence
  chemically synthesized
catgaccccttgtgcttccc

SEQ ID NO: 32003 - DNA, 20 bp, Artificial Sequence
  chemically synthesized
accccttgtgcttcccaagt

SEQ ID NO: 32004 - DNA, 20 bp, Artificial Sequence
  chemically synthesized
ccccttgtgcttcccaagtg

SEQ ID NO: 32005 - DNA, 20 bp, Artificial Sequence
  chemically synthesized
ggcaatgcctcaccctgctt

SEQ ID NO: 32006 - DNA, 20 bp, Artificial Sequence
  chemically synthesized
atgcctcaccctgcttcggc

SEQ ID NO: 32007 - DNA, 20 bp, Artificial Sequence
  chemically synthesized
accctgcttcggctggtgca

SEQ ID NO: 32008 - DNA, 20 bp, Artificial Sequence
  chemically synthesized
actgacctgtgcccactgtc

SEQ ID NO: 32009 - DNA, 20 bp, Artificial Sequence
  chemically synthesized
gcccactgtctggcactccc

SEQ ID NO: 32010 - DNA, 20 bp, Artificial Sequence
  chemically synthesized
actgtctggcactccctagc

SEQ ID NO: 32011 - DNA, 20 bp, Artificial Sequence
  chemically synthesized
gcgagatgaaccccatacct

SEQ ID NO: 32012 - DNA, 20 bp, Artificial Sequence
  chemically synthesized
gatgaaccccatacctcaga

SEQ ID NO: 32013 - DNA, 20 bp, Artificial Sequence
  chemically synthesized
ccatacctcagatggaaatg

SEQ ID NO: 32014 - DNA, 20 bp, Artificial Sequence
  chemically synthesized
gtcttctgtgttgttcacgc

SEQ ID NO: 32015 - DNA, 20 bp, Artificial Sequence
  chemically synthesized
tcttctgtgttgttcacgct

SEQ ID NO: 32016 - DNA, 20 bp, Artificial Sequence
  chemically synthesized
ttctgtgttgttcacgctgg

SEQ ID NO: 32017 - DNA, 20 bp, Artificial Sequence
  chemically synthesized
gttgttcacgctgggagctg

SEQ ID NO: 32018 - DNA, 20 bp, Artificial Sequence
  chemically synthesized
tcacgctgggagctgtagac

SEQ ID NO: 32019 - DNA, 20 bp, Artificial Sequence
  chemically synthesized
acgctgggagctgtagacca

SEQ ID NO: 32020 - DNA, 20 bp, Artificial Sequence
  chemically synthesized
agaccagagctgttcctatt

SEQ ID NO: 32021 - DNA, 20 bp, Artificial Sequence
  chemically synthesized
ctgttcctatttggccatct

SEQ ID NO: 32022 - DNA, 20 bp, Artificial Sequence
  chemically synthesized
ggccatcttggctcaaaaac

SEQ ID NO: 32023 - DNA, 20 bp, Artificial Sequence
  chemically synthesized
aactggaactttatttgtga

SEQ ID NO: 32024 - DNA, 20 bp, Artificial Sequence
  chemically synthesized
aaagaaaaaatcgatcaata

SEQ ID NO: 32025 - DNA, 20 bp, Artificial Sequence
  chemically synthesized
aatcgatcaatatagacttc

SEQ ID NO: 32026 - DNA, 20 bp, Artificial Sequence
  chemically synthesized
gtgaaaattttcttcaaatc

SEQ ID NO: 32027 - DNA, 20 bp, Artificial Sequence
  chemically synthesized
acaatatctaaaaaattgcc

SEQ ID NO: 32028 - DNA, 20 bp, Artificial Sequence
  chemically synthesized
aaattgccgagactgatatc

SEQ ID NO: 32029 - DNA, 20 bp, Artificial Sequence
  chemically synthesized
ttgccgagactgatatcaag

SEQ ID NO: 32030 - DNA, 20 bp, Artificial Sequence
  chemically synthesized
tatctctatacatgttcttc

SEQ ID NO: 32031 - DNA, 20 bp, Artificial Sequence
  chemically synthesized
atctctatacatgttcttcc

SEQ ID NO: 32032 - DNA, 20 bp, Artificial Sequence
  chemically synthesized
ctctatacatgttcttccag

SEQ ID NO: 32033 - DNA, 20 bp, Artificial Sequence
  chemically synthesized
ttccaggagttttgtgattt

SEQ ID NO: 32034 - DNA, 20 bp, Artificial Sequence
  chemically synthesized
tccaggagttttgtgatttc

SEQ ID NO: 32035 - DNA, 20 bp, Artificial Sequence
  chemically synthesized
ttatgtctttaatctatttt

SEQ ID NO: 32036 - DNA, 20 bp, Artificial Sequence
  chemically synthesized
atctattttgagttgactta

SEQ ID NO: 32037 - DNA, 20 bp, Artificial Sequence
  chemically synthesized
tttgagttgacttatggctt

SEQ ID NO: 32038 - DNA, 20 bp, Artificial Sequence
  chemically synthesized
ttgagttgacttatggctta

SEQ ID NO: 32039 - DNA, 20 bp, Artificial Sequence
  chemically synthesized
ttgacttatggcttaaggta

SEQ ID NO: 32040 - DNA, 20 bp, Artificial Sequence
  chemically synthesized
tgacttatggcttaaggtaa

SEQ ID NO: 32041 - DNA, 20 bp, Artificial Sequence
  chemically synthesized
caattttattcttttgcatt

SEQ ID NO: 32042 - DNA, 20 bp, Artificial Sequence
  chemically synthesized
ttcttttgcatttggatatc

SEQ ID NO: 32043 - DNA, 20 bp, Artificial Sequence
  chemically synthesized
ttttcccaacactatttgtt

SEQ ID NO: 32044 - DNA, 20 bp, Artificial Sequence
  chemically synthesized
tttcccaacactatttgttg

SEQ ID NO: 32045 - DNA, 20 bp, Artificial Sequence
  chemically synthesized
tcccaacactatttgttgag

SEQ ID NO: 32046 - DNA, 20 bp, Artificial Sequence
  chemically synthesized
ctatccttcccctattgtgt

SEQ ID NO: 32047 - DNA, 20 bp, Artificial Sequence
  chemically synthesized
tccttcccctattgtgttgg

SEQ ID NO: 32048 - DNA, 20 bp, Artificial Sequence
  chemically synthesized
attgtgttggtggccttgtt

SEQ ID NO: 32049 - DNA, 20 bp, Artificial Sequence
  chemically synthesized
gtggccttgttgagaattac

SEQ ID NO: 32050 - DNA, 20 bp, Artificial Sequence
  chemically synthesized
tatatacgtaaatttatttc

SEQ ID NO: 32051 - DNA, 20 bp, Artificial Sequence
  chemically synthesized
atatacgtaaatttatttct

SEQ ID NO: 32052 - DNA, 20 bp, Artificial Sequence
  chemically synthesized
gctctttattctgttcaatt

SEQ ID NO: 32053 - DNA, 20 bp, Artificial Sequence
  chemically synthesized
ctatgtgtctatttatgtga

SEQ ID NO: 32054 - DNA, 20 bp, Artificial Sequence
  chemically synthesized
gtgatagtaccatacttttt

SEQ ID NO: 32055 - DNA, 20 bp, Artificial Sequence
  chemically synthesized
ccatacttttttggttacta

SEQ ID NO: 32056 - DNA, 20 bp, Artificial Sequence
  chemically synthesized
tttgtaatataatttgaaat

SEQ ID NO: 32057 - DNA, 20 bp, Artificial Sequence
  chemically synthesized
tcagaacgtgtgctgccatc

SEQ ID NO: 32058 - DNA, 20 bp, Artificial Sequence
  chemically synthesized
aacgtgtgctgccatcaagt

SEQ ID NO: 32059 - DNA, 20 bp, Artificial Sequence
  chemically synthesized
caagttggtttttctttctc

SEQ ID NO: 32060 - DNA, 20 bp, Artificial Sequence
  chemically synthesized
tttctttctcaagattgttt

SEQ ID NO: 32061 - DNA, 20 bp, Artificial Sequence
  chemically synthesized
tcaagattgttttggccatt

SEQ ID NO: 32062 - DNA, 20 bp, Artificial Sequence
  chemically synthesized
caagattgttttggccattt

SEQ ID NO: 32063 - DNA, 20 bp, Artificial Sequence
  chemically synthesized
aagattgttttggccatttg

SEQ ID NO: 32064 - DNA, 20 bp, Artificial Sequence
  chemically synthesized
agattgttttggccatttgg

SEQ ID NO: 32065 - DNA, 20 bp, Artificial Sequence
  chemically synthesized
ggccatttgggggtgttctg

SEQ ID NO: 32066 - DNA, 20 bp, Artificial Sequence
  chemically synthesized
ttgttttctgtaaaatgtgc

SEQ ID NO: 32067 - DNA, 20 bp, Artificial Sequence
  chemically synthesized
gttttctgtaaaatgtgcca

SEQ ID NO: 32068 - DNA, 20 bp, Artificial Sequence
  chemically synthesized
ctgtaaaatgtgccagagct

SEQ ID NO: 32069 - DNA, 20 bp, Artificial Sequence
  chemically synthesized
tgtaaaatgtgccagagctc

SEQ ID NO: 32070 - DNA, 20 bp, Artificial Sequence
  chemically synthesized
tgccagagctcaggtaacaa

SEQ ID NO: 32071 - DNA, 20 bp, Artificial Sequence
  chemically synthesized
taacaaaagcaaaaataaac

SEQ ID NO: 32072 - DNA, 20 bp, Artificial Sequence
  chemically synthesized
caaaagcaaaaataaacaag

SEQ ID NO: 32073 - DNA, 20 bp, Artificial Sequence
  chemically synthesized
aaagcaaaaataaacaagtg

SEQ ID NO: 32074 - DNA, 20 bp, Artificial Sequence
  chemically synthesized
caaactaaatattttctgca

SEQ ID NO: 32075 - DNA, 20 bp, Artificial Sequence
  chemically synthesized
taaatattttctgcacagca

SEQ ID NO: 32076 - DNA, 20 bp, Artificial Sequence
  chemically synthesized
gcaaagaaaacaatcatcaa

SEQ ID NO: 32077 - DNA, 20 bp, Artificial Sequence
  chemically synthesized
caaagaaaacaatcatcaaa

SEQ ID NO: 32078 - DNA, 20 bp, Artificial Sequence
  chemically synthesized
aaaacaatcatcaaaaggaa

SEQ ID NO: 32079 - DNA, 20 bp, Artificial Sequence
  chemically synthesized
aatcatcaaaaggaacagtt

SEQ ID NO: 32080 - DNA, 20 bp, Artificial Sequence
  chemically synthesized
atcatcaaaaggaacagttt

SEQ ID NO: 32081 - DNA, 20 bp, Artificial Sequence
  chemically synthesized
catcaaaaggaacagtttgg

SEQ ID NO: 32082 - DNA, 20 bp, Artificial Sequence
  chemically synthesized
agtttgggagaaaatattta

SEQ ID NO: 32083 - DNA, 20 bp, Artificial Sequence
  chemically synthesized
acagatcatatatctgatac

SEQ ID NO: 32084 - DNA, 20 bp, Artificial Sequence
  chemically synthesized
gtctaatacccaaaatatat

SEQ ID NO: 32085 - DNA, 20 bp, Artificial Sequence
  chemically synthesized
tctaatacccaaaatatata

SEQ ID NO: 32086 - DNA, 20 bp, Artificial Sequence
  chemically synthesized
ctaaatatgaaaaaatataa

SEQ ID NO: 32087 - DNA, 20 bp, Artificial Sequence
  chemically synthesized
aaaaaatataatagtaacct

SEQ ID NO: 32088 - DNA, 20 bp, Artificial Sequence
  chemically synthesized
aatagtaacctaagtaaaaa

SEQ ID NO: 32089 - DNA, 20 bp, Artificial Sequence
  chemically synthesized
atagtaacctaagtaaaaat

SEQ ID NO: 32090 - DNA, 20 bp, Artificial Sequence
  chemically synthesized
aacctaagtaaaaatgggca

SEQ ID NO: 32091 - DNA, 20 bp, Artificial Sequence
  chemically synthesized
acctaagtaaaaatgggcaa

SEQ ID NO: 32092 - DNA, 20 bp, Artificial Sequence
  chemically synthesized
tctgaatatacatttctctg

SEQ ID NO: 32093 - DNA, 20 bp, Artificial Sequence
  chemically synthesized
tttctctgaagacatgcaaa

SEQ ID NO: 32094 - DNA, 20 bp, Artificial Sequence
  chemically synthesized
tctgaagacatgcaaatggt

SEQ ID NO: 32095 - DNA, 20 bp, Artificial Sequence
  chemically synthesized
gaagacatgcaaatggtcag

SEQ ID NO: 32096 - DNA, 20 bp, Artificial Sequence
  chemically synthesized
aagacatgcaaatggtcagc

SEQ ID NO: 32097 - DNA, 20 bp, Artificial Sequence
  chemically synthesized
atggtcagcaggcatatgaa

SEQ ID NO: 32098 - DNA, 20 bp, Artificial Sequence
  chemically synthesized
tggtcagcaggcatatgaaa

SEQ ID NO: 32099 - DNA, 20 bp, Artificial Sequence
  chemically synthesized
tgcactacatcaccaatcat

SEQ ID NO: 32100 - DNA, 20 bp, Artificial Sequence
  chemically synthesized
gcactacatcaccaatcatc

SEQ ID NO: 32101 - DNA, 20 bp, Artificial Sequence
  chemically synthesized
aaaatgcaaatcaaaaccac

SEQ ID NO: 32102 - DNA, 20 bp, Artificial Sequence
  chemically synthesized
aagtatcactcacacctgtt

SEQ ID NO: 32103 - DNA, 20 bp, Artificial Sequence
  chemically synthesized
atcactcacacctgttgaga

SEQ ID NO: 32104 - DNA, 20 bp, Artificial Sequence
  chemically synthesized
tgagatggctattatcaaaa

SEQ ID NO: 32105 - DNA, 20 bp, Artificial Sequence
  chemically synthesized
tggctattatcaaaaaagac

SEQ ID NO: 32106 - DNA, 20 bp, Artificial Sequence
  chemically synthesized
gctattatcaaaaaagacaa

SEQ ID NO: 32107 - DNA, 20 bp, Artificial Sequence
  chemically synthesized
ttatcaaaaaagacaagaga

SEQ ID NO: 32108 - DNA, 20 bp, Artificial Sequence
  chemically synthesized
tatcaaaaaagacaagagat

SEQ ID NO: 32109 - DNA, 20 bp, Artificial Sequence
  chemically synthesized
atcaaaaaagacaagagata

SEQ ID NO: 32110 - DNA, 20 bp, Artificial Sequence
  chemically synthesized
tcaaaaaagacaagagatag

SEQ ID NO: 32111 - DNA, 20 bp, Artificial Sequence
  chemically synthesized
aaaagacaagagataggggt

SEQ ID NO: 32112 - DNA, 20 bp, Artificial Sequence
  chemically synthesized
aagacaagagataggggttg

SEQ ID NO: 32113 - DNA, 20 bp, Artificial Sequence
  chemically synthesized
gacaagagataggggttgga

SEQ ID NO: 32114 - DNA, 20 bp, Artificial Sequence
  chemically synthesized
acaagagataggggttggag

SEQ ID NO: 32115 - DNA, 20 bp, Artificial Sequence
  chemically synthesized
gataggggttggagaggctg

SEQ ID NO: 32116 - DNA, 20 bp, Artificial Sequence
  chemically synthesized
taggggttggagaggctgtg

SEQ ID NO: 32117 - DNA, 20 bp, Artificial Sequence
  chemically synthesized
ggttggagaggctgtggaga

SEQ ID NO: 32118 - DNA, 20 bp, Artificial Sequence
  chemically synthesized
gttggagaggctgtggagaa

SEQ ID NO: 32119 - DNA, 20 bp, Artificial Sequence
  chemically synthesized
tggagaggctgtggagaaag

SEQ ID NO: 32120 - DNA, 20 bp, Artificial Sequence
  chemically synthesized
gaaaggagaactcttgtgca

SEQ ID NO: 32121 - DNA, 20 bp, Artificial Sequence
  chemically synthesized
ggagaactcttgtgcatagc

SEQ ID NO: 32122 - DNA, 20 bp, Artificial Sequence
  chemically synthesized
gaactcttgtgcatagctgg

SEQ ID NO: 32123 - DNA, 20 bp, Artificial Sequence
  chemically synthesized
aactcttgtgcatagctggt

SEQ ID NO: 32124 - DNA, 20 bp, Artificial Sequence
  chemically synthesized
tgcatagctggtgggaatgt

SEQ ID NO: 32125 - DNA, 20 bp, Artificial Sequence
  chemically synthesized
ggtgggaatgtaagttaaca

SEQ ID NO: 32126 - DNA, 20 bp, Artificial Sequence
  chemically synthesized
gtaagttaacatagccatta

SEQ ID NO: 32127 - DNA, 20 bp, Artificial Sequence
  chemically synthesized
tagccattatagaaaacgta

SEQ ID NO: 32128 - DNA, 20 bp, Artificial Sequence
  chemically synthesized
ccattatagaaaacgtatgg

SEQ ID NO: 32129 - DNA, 20 bp, Artificial Sequence
  chemically synthesized
gtttctcaaacaactaaaaa

SEQ ID NO: 32130 - DNA, 20 bp, Artificial Sequence
  chemically synthesized
ttctcaaacaactaaaaata

SEQ ID NO: 32131 - DNA, 20 bp, Artificial Sequence
  chemically synthesized
aatagagttattgtatgatg

SEQ ID NO: 32132 - DNA, 20 bp, Artificial Sequence
  chemically synthesized
taaataaaatccgcattttc

SEQ ID NO: 32133 - DNA, 20 bp, Artificial Sequence
  chemically synthesized
aataaaatccgcattttcta

SEQ ID NO: 32134 - DNA, 20 bp, Artificial Sequence
  chemically synthesized
ctgcactctcatgttaattg

SEQ ID NO: 32135 - DNA, 20 bp, Artificial Sequence
  chemically synthesized
aattgcagcattattcacaa

SEQ ID NO: 32136 - DNA, 20 bp, Artificial Sequence
  chemically synthesized
cagcattattcacaatagcc

SEQ ID NO: 32137 - DNA, 20 bp, Artificial Sequence
  chemically synthesized
tattcacaatagccaagaca

SEQ ID NO: 32138 - DNA, 20 bp, Artificial Sequence
  chemically synthesized
ccaagacatggaaacaatct

SEQ ID NO: 32139 - DNA, 20 bp, Artificial Sequence
  chemically synthesized
agacatggaaacaatctaag

SEQ ID NO: 32140 - DNA, 20 bp, Artificial Sequence
  chemically synthesized
atctaagtggtatctatata

SEQ ID NO: 32141 - DNA, 20 bp, Artificial Sequence
  chemically synthesized
ggtatctatatatagatgaa

SEQ ID NO: 32142 - DNA, 20 bp, Artificial Sequence
  chemically synthesized
tatatatagatgaacagata

SEQ ID NO: 32143 - DNA, 20 bp, Artificial Sequence
  chemically synthesized
aacagataaagacattgtga

SEQ ID NO: 32144 - DNA, 20 bp, Artificial Sequence
  chemically synthesized
acagataaagacattgtgac

SEQ ID NO: 32145 - DNA, 20 bp, Artificial Sequence
  chemically synthesized
tatgatatcacaatattatt

SEQ ID NO: 32146 - DNA, 20 bp, Artificial Sequence
  chemically synthesized
aatattattcagccttaaaa

SEQ ID NO: 32147 - DNA, 20 bp, Artificial Sequence
  chemically synthesized
atattattcagccttaaaaa

SEQ ID NO: 32148 - DNA, 20 bp, Artificial Sequence
  chemically synthesized
attattcagccttaaaaaag

SEQ ID NO: 32149 - DNA, 20 bp, Artificial Sequence
  chemically synthesized
ttcagccttaaaaaaggaga

SEQ ID NO: 32150 - DNA, 20 bp, Artificial Sequence
  chemically synthesized
tcagccttaaaaaaggagat

SEQ ID NO: 32151 - DNA, 20 bp, Artificial Sequence
  chemically synthesized
cagccttaaaaaaggagatg

SEQ ID NO: 32152 - DNA, 20 bp, Artificial Sequence
  chemically synthesized
agccttaaaaaaggagatgg

SEQ ID NO: 32153 - DNA, 20 bp, Artificial Sequence
  chemically synthesized
gccttaaaaaaggagatggg

SEQ ID NO: 32154 - DNA, 20 bp, Artificial Sequence
  chemically synthesized
atggggggaatgtataaacc

SEQ ID NO: 32155 - DNA, 20 bp, Artificial Sequence
  chemically synthesized
ggggggaatgtataaaccta

SEQ ID NO: 32156 - DNA, 20 bp, Artificial Sequence
  chemically synthesized
aacctagagtacattttgct

SEQ ID NO: 32157 - DNA, 20 bp, Artificial Sequence
  chemically synthesized
ttttgctaagtgaaataaac

SEQ ID NO: 32158 - DNA, 20 bp, Artificial Sequence
  chemically synthesized
taagtgaaataaaccagaca

SEQ ID NO: 32159 - DNA, 20 bp, Artificial Sequence
  chemically synthesized
accagacacagaaacaaata

SEQ ID NO: 32160 - DNA, 20 bp, Artificial Sequence
  chemically synthesized
ccagacacagaaacaaataa

SEQ ID NO: 32161 - DNA, 20 bp, Artificial Sequence
  chemically synthesized
ggcatgatattacttatatg

SEQ ID NO: 32162 - DNA, 20 bp, Artificial Sequence
  chemically synthesized
acttatatgtggaatctcaa

SEQ ID NO: 32163 - DNA, 20 bp, Artificial Sequence
  chemically synthesized
tggaatctcaaaagaaaaat

SEQ ID NO: 32164 - DNA, 20 bp, Artificial Sequence
  chemically synthesized
ggaatctcaaaagaaaaata

SEQ ID NO: 32165 - DNA, 20 bp, Artificial Sequence
  chemically synthesized
gaaaaataaggtcaaatgca

SEQ ID NO: 32166 - DNA, 20 bp, Artificial Sequence
  chemically synthesized
taaggtcaaatgcatagaaa

SEQ ID NO: 32167 - DNA, 20 bp, Artificial Sequence
  chemically synthesized
atgcatagaaacagtgtaaa

SEQ ID NO: 32168 - DNA, 20 bp, Artificial Sequence
  chemically synthesized
tgcatagaaacagtgtaaaa

SEQ ID NO: 32169 - DNA, 20 bp, Artificial Sequence
  chemically synthesized
gcatagaaacagtgtaaaaa

SEQ ID NO: 32170 - DNA, 20 bp, Artificial Sequence
  chemically synthesized
catagaaacagtgtaaaaag

SEQ ID NO: 32171 - DNA, 20 bp, Artificial Sequence
  chemically synthesized
agaaacagtgtaaaaagggg

SEQ ID NO: 32172 - DNA, 20 bp, Artificial Sequence
  chemically synthesized
acagtgtaaaaaggggaaga

SEQ ID NO: 32173 - DNA, 20 bp, Artificial Sequence
  chemically synthesized
tgtaaaaaggggaagaaaga

SEQ ID NO: 32174 - DNA, 20 bp, Artificial Sequence
  chemically synthesized
taaaaaggggaagaaagaaa

SEQ ID NO: 32175 - DNA, 20 bp, Artificial Sequence
  chemically synthesized
gggaagaaagaaagagaaaa

SEQ ID NO: 32176 - DNA, 20 bp, Artificial Sequence
  chemically synthesized
ggaagaaagaaagagaaaat

SEQ ID NO: 32177 - DNA, 20 bp, Artificial Sequence
  chemically synthesized
gaagaaagaaagagaaaata

SEQ ID NO: 32178 - DNA, 20 bp, Artificial Sequence
  chemically synthesized
agaaagaaagagaaaatagg

SEQ ID NO: 32179 - DNA, 20 bp, Artificial Sequence
  chemically synthesized
aagaaagagaaaatagggag

SEQ ID NO: 32180 - DNA, 20 bp, Artificial Sequence
  chemically synthesized
aaagagaaaatagggagaag

SEQ ID NO: 32181 - DNA, 20 bp, Artificial Sequence
  chemically synthesized
aagagaaaatagggagaagt

SEQ ID NO: 32182 - DNA, 20 bp, Artificial Sequence
  chemically synthesized
aaatagggagaagtaggtca

SEQ ID NO: 32183 - DNA, 20 bp, Artificial Sequence
  chemically synthesized
aatagggagaagtaggtcaa

SEQ ID NO: 32184 - DNA, 20 bp, Artificial Sequence
  chemically synthesized
ggtcaaaggttataaacttg

SEQ ID NO: 32185 - DNA, 20 bp, Artificial Sequence
  chemically synthesized
gttataaacttgcagctgta

SEQ ID NO: 32186 - DNA, 20 bp, Artificial Sequence
  chemically synthesized
ttataaacttgcagctgtat

SEQ ID NO: 32187 - DNA, 20 bp, Artificial Sequence
  chemically synthesized
tgcagctgtataggataaat

SEQ ID NO: 32188 - DNA, 20 bp, Artificial Sequence
  chemically synthesized
ctgtataggataaataagtt

SEQ ID NO: 32189 - DNA, 20 bp, Artificial Sequence
  chemically synthesized
gtataggataaataagttta

SEQ ID NO: 32190 - DNA, 20 bp, Artificial Sequence
  chemically synthesized
gataaataagtttagagatc

SEQ ID NO: 32191 - DNA, 20 bp, Artificial Sequence
  chemically synthesized
aagtttagagatctagtgta

SEQ ID NO: 32192 - DNA, 20 bp, Artificial Sequence
  chemically synthesized
gagatctagtgtatggcatg

SEQ ID NO: 32193 - DNA, 20 bp, Artificial Sequence
  chemically synthesized
aaactaaacatttgttatga

SEQ ID NO: 32194 - DNA, 20 bp, Artificial Sequence
  chemically synthesized
ctaaacatttgttatgacag

SEQ ID NO: 32195 - DNA, 20 bp, Artificial Sequence
  chemically synthesized
tttgttatgacagtagatgt

SEQ ID NO: 32196 - DNA, 20 bp, Artificial Sequence
  chemically synthesized
atgttagatgcccttacaca

SEQ ID NO: 32197 - DNA, 20 bp, Artificial Sequence
  chemically synthesized
gatgcccttacacaaagaaa

SEQ ID NO: 32198 - DNA, 20 bp, Artificial Sequence
  chemically synthesized
cttacacaaagaaaaagcaa

SEQ ID NO: 32199 - DNA, 20 bp, Artificial Sequence
  chemically synthesized
ttacacaaagaaaaagcaaa

SEQ ID NO: 32200 - DNA, 20 bp, Artificial Sequence
  chemically synthesized
gaaaaagcaaaaggtatcta

SEQ ID NO: 32201 - DNA, 20 bp, Artificial Sequence
  chemically synthesized
aaagcaaaaggtatctatgg

SEQ ID NO: 32202 - DNA, 20 bp, Artificial Sequence
  chemically synthesized
aagcaaaaggtatctatgga

SEQ ID NO: 32203 - DNA, 20 bp, Artificial Sequence
  chemically synthesized
tatggaaggtgttgtattga

SEQ ID NO: 32204 - DNA, 20 bp, Artificial Sequence
  chemically synthesized
gaaggtgttgtattgatgga

SEQ ID NO: 32205 - DNA, 20 bp, Artificial Sequence
  chemically synthesized
aaggtgttgtattgatggat

SEQ ID NO: 32206 - DNA, 20 bp, Artificial Sequence
  chemically synthesized
taggttaatttgcttgattg

SEQ ID NO: 32207 - DNA, 20 bp, Artificial Sequence
  chemically synthesized
atatcctatattttttgaac

SEQ ID NO: 32208 - DNA, 20 bp, Artificial Sequence
  chemically synthesized
ttgaacaagcttacttgttt

SEQ ID NO: 32209 - DNA, 20 bp, Artificial Sequence
  chemically synthesized
tttcagataaaatattttaa

SEQ ID NO: 32210 - DNA, 20 bp, Artificial Sequence
  chemically synthesized
attttaaaagcttttatctg

SEQ ID NO: 32211 - DNA, 20 bp, Artificial Sequence
  chemically synthesized
taaaagcttttatctgaagc

SEQ ID NO: 32212 - DNA, 20 bp, Artificial Sequence
  chemically synthesized
atttctgtttcctaattgtt

SEQ ID NO: 32213 - DNA, 20 bp, Artificial Sequence
  chemically synthesized
tttctgtttcctaattgttt

SEQ ID NO: 32214 - DNA, 20 bp, Artificial Sequence
  chemically synthesized
ttctgtttcctaattgttta

SEQ ID NO: 32215 - DNA, 20 bp, Artificial Sequence
  chemically synthesized
ttaaaacttatgtaaccctt

SEQ ID NO: 32216 - DNA, 20 bp, Artificial Sequence
  chemically synthesized
tgtaaccctttggatataat

SEQ ID NO: 32217 - DNA, 20 bp, Artificial Sequence
  chemically synthesized
tttttctctatttttaatat

SEQ ID NO: 32218 - DNA, 20 bp, Artificial Sequence
  chemically synthesized
tttttaatatcagtactctt

SEQ ID NO: 32219 - DNA, 20 bp, Artificial Sequence
  chemically synthesized
atatcagtactctttagata

SEQ ID NO: 32220 - DNA, 20 bp, Artificial Sequence
  chemically synthesized
atacagctatcactgtctct

SEQ ID NO: 32221 - DNA, 20 bp, Artificial Sequence
  chemically synthesized
tacagctatcactgtctctc

SEQ ID NO: 32222 - DNA, 20 bp, Artificial Sequence
  chemically synthesized
acagctatcactgtctctca

SEQ ID NO: 32223 - DNA, 20 bp, Artificial Sequence
  chemically synthesized
tctcagggtacctctgcctc

SEQ ID NO: 32224 - DNA, 20 bp, Artificial Sequence
  chemically synthesized
atgttgaaattttatatctc

SEQ ID NO: 32225 - DNA, 20 bp, Artificial Sequence
  chemically synthesized
tatatctccggcctacaact

SEQ ID NO: 32226 - DNA, 20 bp, Artificial Sequence
  chemically synthesized
atatctccggcctacaactc

SEQ ID NO: 32227 - DNA, 20 bp, Artificial Sequence
  chemically synthesized
tatctccggcctacaactca

SEQ ID NO: 32228 - DNA, 20 bp, Artificial Sequence
  chemically synthesized
gcctacaactcagggtttta

SEQ ID NO: 32229 - DNA, 20 bp, Artificial Sequence
  chemically synthesized
tgtctctattaaatgtttat

SEQ ID NO: 32230 - DNA, 20 bp, Artificial Sequence
  chemically synthesized
tattaaatgtttatgagcca

SEQ ID NO: 32231 - DNA, 20 bp, Artificial Sequence
  chemically synthesized
ttaaatgtttatgagccaca

SEQ ID NO: 32232 - DNA, 20 bp, Artificial Sequence
  chemically synthesized
gtttatgagccacagagaat

SEQ ID NO: 32233 - DNA, 20 bp, Artificial Sequence
  chemically synthesized
ttttttgaacttctgtgttt

SEQ ID NO: 32234 - DNA, 20 bp, Artificial Sequence
  chemically synthesized
aaaaaattaacctaatgtga

SEQ ID NO: 32235 - DNA, 20 bp, Artificial Sequence
  chemically synthesized
taacctaatgtgaaagaccc

SEQ ID NO: 32236 - DNA, 20 bp, Artificial Sequence
  chemically synthesized
aatgtgaaagaccctagatc

SEQ ID NO: 32237 - DNA, 20 bp, Artificial Sequence
  chemically synthesized
atgtgaaagaccctagatcc

SEQ ID NO: 32238 - DNA, 20 bp, Artificial Sequence
  chemically synthesized
tgtgaaagaccctagatccg

SEQ ID NO: 32239 - DNA, 20 bp, Artificial Sequence
  chemically synthesized
aaagaccctagatccgggga

SEQ ID NO: 32240 - DNA, 20 bp, Artificial Sequence
  chemically synthesized
aagaccctagatccggggaa

SEQ ID NO: 32241 - DNA, 20 bp, Artificial Sequence
  chemically synthesized
atccggggaaaggtgctgtg

SEQ ID NO: 32242 - DNA, 20 bp, Artificial Sequence
  chemically synthesized
gggaaaggtgctgtgtggct

SEQ ID NO: 32243 - DNA, 20 bp, Artificial Sequence
  chemically synthesized
gaaaggtgctgtgtggctta

SEQ ID NO: 32244 - DNA, 20 bp, Artificial Sequence
  chemically synthesized
gtggcttagagtataaacat

SEQ ID NO: 32245 - DNA, 20 bp, Artificial Sequence
  chemically synthesized
ataaacatcagaatgtgcta

SEQ ID NO: 32246 - DNA, 20 bp, Artificial Sequence
  chemically synthesized
agaatgtgctatggactttc

SEQ ID NO: 32247 - DNA, 20 bp, Artificial Sequence
  chemically synthesized
atggactttctagaatattt

SEQ ID NO: 32248 - DNA, 20 bp, Artificial Sequence
  chemically synthesized
tcagtgcccttgtatatcct

SEQ ID NO: 32249 - DNA, 20 bp, Artificial Sequence
  chemically synthesized
ttgtatatcctcagaatgtg

SEQ ID NO: 32250 - DNA, 20 bp, Artificial Sequence
  chemically synthesized
gtatatcctcagaatgtgtg

SEQ ID NO: 32251 - DNA, 20 bp, Artificial Sequence
  chemically synthesized
atatcctcagaatgtgtgga

SEQ ID NO: 32252 - DNA, 20 bp, Artificial Sequence
  chemically synthesized
tggagagtaattccaaaaca

SEQ ID NO: 32253 - DNA, 20 bp, Artificial Sequence
  chemically synthesized
agcccttacttcaatatcca

SEQ ID NO: 32254 - DNA, 20 bp, Artificial Sequence
  chemically synthesized
ccttacttcaatatccatgg

SEQ ID NO: 32255 - DNA, 20 bp, Artificial Sequence
  chemically synthesized
tcaatatccatggtggtcca

SEQ ID NO: 32256 - DNA, 20 bp, Artificial Sequence
  chemically synthesized
tatccatggtggtccatagc

SEQ ID NO: 32257 - DNA, 20 bp, Artificial Sequence
  chemically synthesized
atccatggtggtccatagct

SEQ ID NO: 32258 - DNA, 20 bp, Artificial Sequence
  chemically synthesized
tccatggtggtccatagcta

SEQ ID NO: 32259 - DNA, 20 bp, Artificial Sequence
  chemically synthesized
tggtggtccatagctagggc

SEQ ID NO: 32260 - DNA, 20 bp, Artificial Sequence
  chemically synthesized
tggtccatagctagggctag

SEQ ID NO: 32261 - DNA, 20 bp, Artificial Sequence
  chemically synthesized
tccatagctagggctagcag

SEQ ID NO: 32262 - DNA, 20 bp, Artificial Sequence
  chemically synthesized
ccatagctagggctagcaga

SEQ ID NO: 32263 - DNA, 20 bp, Artificial Sequence
  chemically synthesized
tagctagggctagcagaagg

SEQ ID NO: 32264 - DNA, 20 bp, Artificial Sequence
  chemically synthesized
agctagggctagcagaagga

SEQ ID NO: 32265 - DNA, 20 bp, Artificial Sequence
  chemically synthesized
gctagggctagcagaaggaa

SEQ ID NO: 32266 - DNA, 20 bp, Artificial Sequence
  chemically synthesized
tcactcaaattatctgctct

SEQ ID NO: 32267 - DNA, 20 bp, Artificial Sequence
  chemically synthesized
ttatctgctcttggaaaaac

SEQ ID NO: 32268 - DNA, 20 bp, Artificial Sequence
  chemically synthesized
cttggaaaaaccagtccctt

SEQ ID NO: 32269 - DNA, 20 bp, Artificial Sequence
  chemically synthesized
ttggaaaaaccagtcccttt

SEQ ID NO: 32270 - DNA, 20 bp, Artificial Sequence
  chemically synthesized
gaaaaaccagtccctttggg

SEQ ID NO: 32271 - DNA, 20 bp, Artificial Sequence
  chemically synthesized
gggtagccccaatcatgtgt

SEQ ID NO: 32272 - DNA, 20 bp, Artificial Sequence
  chemically synthesized
atgtgtaagtctttttcctg

(The sequence listing continues in the following parts.)

We claim:

1. A genetically modified human cell comprising:
(i) a deletion or insertion at one or more chromosomal sequences that are complementary to a nucleic acid sequence of any one of SEQ ID NOs: 161,203; 161,204; 161,205; 161,206; 161,207; 161,213; 161,215; 161,216; 161,217; 161,218; 161,220; 161,221; 161,222; 161,224; 161,230; 161,231; 161,309; 161,233; 161,235; 161,236; 161,237; 161,240; 161,241; 161,243; 161,245; 161,250; 161,252; 161,254; 161,255; 161,256; 161,257; 161,258; 161,259; 161,262; 161,265; 161,267; 161,269; 161,271; 161,272; 161,273; 161,274; 161,275; 161,278; 161,279; 161,280; 161,281; 161,283; 161,287; 161,297; 161,298; 161,299; 161,300; 161,303; 161,310; 161,311; and 161,312;
(ii) a Cas9 endonuclease and/or one or more guide RNAs (gRNAs);
wherein the cell is produced by a method comprising introducing the Cas9 endonuclease and the one or more gRNAs to the human cell to effect one or more double-strand breaks (DSBs) at one or more loci within the δβ-globin region of human chromosome 11, causing deletions or insertions of chromosomal DNA at the one or more loci, wherein one of the one or more gRNAs comprise a spacer sequence selected from the group consisting of a corresponding RNA sequence of any one of SEQ ID NOs: 161,203; 161,204; 161,205; 161,206; 161,207; 161,213; 161,215; 161,216; 161,217; 161,218; 161,220; 161,221; 161,222; 161,224; 161,230; 161,231; 161,309; 161,233; 161,235; 161,236; 161,237; 161,240; 161,241; 161,243; 161,245; 161,250; 161,252; 161,254; 161,255; 161,256; 161,257; 161,258; 161,259; 161,262; 161,265; 161,267; 161,269; 161,271; 161,272; 161,273; 161,274; 161,275; 161,278; 161,279; 161,280; 161,281; 161,283; 161,287; 161,297; 161,298; 161,299; 161,300; 161,303; 161,310; 161,311; and 161,312.

2. The modified human cell of claim 1, wherein one of the one or more gRNAs comprise a spacer sequence selected from the group consisting of a corresponding RNA sequence of any one of SEQ ID NOs: 161,205; 161,206; 161,207; 161,217; 161,230; 161,231; 161,241; 161,254; 161,255; 161,259; 161,269; 161,275; 161,310; and 161,311.

3. The modified human cell of claim 1, comprising the Cas9 endonuclease and the one or more gRNAs.

4. The modified human cell of claim 1, wherein the modified human cell has increased expression of γ-globin and/or fetal hemoglobin (HbF) relative to an unmodified human cell.

5. The modified human cell of claim 1, wherein the human cell is an isolated progenitor cell.

6. The modified human cell of claim 5, wherein the isolated progenitor cell is a hematopoietic progenitor cell or an induced pluripotent stem cell.

7. The modified human cell of claim 1, wherein the one or more loci are proximal to a boundary of the Corfu long deletion or the Corfu small deletion.

8. The modified human cell of claim 1, wherein one of the loci consists of a sequence that is complementary to a nucleic acid sequence of any one of SEQ ID NOs: 161,203; 161,204; 161,205; 161,206; 161,207; 161,213; 161,215; 161,216; 161,217; 161,218; 161,220; 161,221; 161,222; 161,224; 161,230; 161,231; 161,309; 161,233; 161,235; 161,236; 161,237; 161,240; 161,241; 161,243; 161,245; 161,250; 161,252; 161,254; 161,255; 161,256; 161,257; 161,258; 161,259; 161,262; 161,265; 161,267; 161,269; 161,271; 161,272; 161,273; 161,274; 161,275; 161,278; 161,279; 161,280; 161,281; 161,283; 161,287; 161,297; 161,298; 161,299; 161,300; 161,303; 161,310; 161,311; and 161,312.

9. The modified human cell of claim 1, wherein one of the loci comprises a sequence that is complementary to a nucleic acid sequence of any one of SEQ ID NOs: 161,205; 161,206; 161,207; 161,217; 161,230; 161,231; 161,241; 161,254; 161,255; 161,259; 161,269; 161,275; 161,310; and 161,311.

10. The modified human cell of claim 1, wherein the cell is derived from a human patient having a β-hemoglobinopathy.

11. The modified human cell of claim 1, wherein the cell is derived from a human patient having sickle cell disease, sickle cell trait, hemoglobin C disease, hemoglobin C trait, hemoglobin S/C disease, hemoglobin D disease, hemoglobin E disease, or a thalassemia.

12. A composition comprising a plurality of the modified human cell of claim 1 and a pharmaceutically acceptable carrier and/or a pharmaceutically acceptable salt.

* * * * *